United States Patent 7,833,706 (GENETIC POLYMORPHISMS ASSOCIATED WITH RHEUMATOID ARTHRITIS, METHODS OF DETECTION AND USES THEREOF) - sequence listing, part 9

SEQ ID NO: 10805 - DNA, 1790242 bp, Homo sapiens
  misc_feature (1)...(1790242): n = A,T,C or G, or insertion/deletion polymorphism (see Tables 1-2)
tattgtatgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttattagagactaagattgcaacccctgcctttttttgttttccatttgcttggtagatcttcctccatccttttattttgagcctatgtgtgtctctgctcgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagcctcgatggtctttacagtttggcatgaatttgcagcagctggtaccggtttttcctttccatgtttagtgcttccttcaggagctgttttagggcaggcctgttggtgacaaaatctctcagcatttgcttgtctgtaaagtattttatttctccttcacttatgaagcttagtttggctggatatgaaattctgggttgaaaattcttttctttaagagtgttgaatattggcctccactctcttctggcttgtagagtttctgccaagacatccactgttagtctgatggacttccctttgtgagtaacctgacctttgtctctggctgcccttaccattttttccttcatttcaactttggtgaatctgacaattatgtgtcttggtgttgctcttctcgaggagtatctttgtgacattctctgtatttcctgagtctgaatgttggcctgccttgctagattggggaaggtctcctggataatatcctgcagagtgttttccaacttggttccattctgcccatcactttcaggtacaccaatcagacgtagatttggtcttttcacatagtcccatatttcttggaggctttttcgtttctttttatgctttcttctctaaacttcccttctcccttcatttcattcatttcatcttccatcactgatacactttcttccagttgatcgcattggctcctgaggcttctgcgttcttcacgtagttctcgagccttggctttcagctccatcagctcctttaagcacttctctgtattggttattctagttatatattcgtctaaatttttttcaaagttttcaacttctttgcctttggtttgaatttcctcctgtagttcgcagtagtttgatcgtctgaagccttcttctctcaactcgtcaaagtcattctccgtccagctttgttccgttgctggtgaggagctgcgttcctttggaggaggagaggcgctctgctttttagagtttccagtttttctgctctgttttttccccatctttgtggttttatctacttttggtgtttgatgatggtgatgtacagatgggtttttggtgtggatgtcctttctgtttgttagttttccttctaacattcaggaccctcagctgcaggtctgttggagtttgctagaggtccactccagaccctgtttgctggatatcagcagcggagattgcaaaacagcggattttcgtgaaccgtgaatgctgctgtctgatcgttcctctgcaagttttgtctcagaggagtacctggccgtgtgaggtgtcagtctgcccctactggggggtgcctcccagttaggctgctcgggggtcaaggggtcagggacccacttgaggaggcagtctgcccattctcagatctgcagctgcgtgctgggagaaccactgctctcttcaaagctgtcagacaggtacacttaagtctgcagaggttactgctgtctttttgtttgtctgtgccctgcccccagaggtggagcctacagaggcaggcaggcctccttgagctgtggtgggctccacccatttcgagcttcctggctgctttgtttacctaagcaagcctgggcaatggcgggcgcccctcccccagcctcgctgctgccttgcagtttgatctcagactgctgtgctagcaatcagtgagactctgtgggcataggaccctccaaagcatgtgcgggatataatctcctggtgcgctgtcttttaagcccatcggaaaagcgcagtattagggtgggagtgacccgattttccaggtgccgtctgtcacccctttctttgactaggaaagggaactccccgacctgttgttctttccgagtgaggcagtggcttgcccgacttcggctcgcgaacggtgcactgcacccactgtcctgcgcccactgtctggcactccctagtgagatgaacctggtacctcagatggaaatgcagaaatcacccgtcttctgcgtcgctcatgctgggagctgtagaccggagctgttcctattcagccatcttggctccaccttctcttttcttaactgcttcttagtaatccctgagtgaaatgtctatcctcaaatactggaaattccttagcgtgtacctgggtggcttcattgtctttcattttgagccatagtcaccaattattggcaacaggagaagtcccactcaatatcctatgtcatttaaagatctcatttgaagccataggttaggatgtgttatcccctcaggtgacagaatggtttggccacctggaggttgttgatagacttaaaaatgacccttttgggagtgaaggggaaataaatcatcttagtgggttgtgaagtgagaggtaaaaacataggggtggtggacaactcatttgggaagtattatgatgaaggcacagagaactaagtagcaaccacagggagttgtagggtaaaagtatgttttgtttgtttgaaaattttcaggtagaagtcctgtggcatatttttgcactgatcattggagaaagggtgataatgcagtgtgtgaggtgatcgtgaaggagcagagtccttgaaaaggtgagggaagaagggatccagcacacaagagagattagcctttggtaagagcaagaggacttcttgcattttaataggagggagggtagagaagatgaggctcggtgttagtgggtttatagatttgatgatggaaagatgtgaaacatcttccagatggcttctgttcttcttagtgaggcaggagagttggttagctgctaataataaggatggttgggaagggagagtgagaaacattttttttttttgtattaatagtacataagaccttcaaatcaggggcagattcatttagattcacctaaaatacctgacaaggtgccagaagtatttatcacatatttttgaaaaaaatggttttaattatcacaaacagggattattcctagctttaaatctcattttagaaaggtattatggctgttcagaaaattacatatttttaaagcccgaacctgaaattgccagtattttgagatattatggacagatgaaatggactcatggttcatgcaaaagtgattttcattctataagggattttattgacaagaagaaactactccattctgactaaagaacatattgcaccctggaggatttattttccaagagaggctactgacagggatagaattatcttctttttggaggcctcccttctctcctgtaatcttctagctggcgcctaacacagggctctgcatcaaggggcttctcaatacatccaattgaatgactttgtttggggccggtcctgatgcccagaacgaaaaaacttacttttgattacctcgggagaattgctagtaatggccctgatttattctctctcttttttctctcttttttttttccccagctcttctaccctcaatgtttgattgcttgcaagaggcatgtgagccaaaattttaaagtttgcaaagtataaagaaaggaaacaagtaaatagggaaggagaataaatactgaacaagactgggcaaggtgacaagaaagaactactgtgaaaatctggaagagggccaggatgcaaaatgcaggggctgtgtagtttacaggaactatttagcctccagcatgcctcagcgatcacacagagaaaggcagatttctctgcttttgtctcctaccctatagttagctatggaaatttgacataggtgatatatgttttctgtcagcaaactgatacaaatacagaggaccatggggcctgtgatcaacaaatccaacgtgatttgaattgctaggaggggacctcttgtggctatagtgggaaatacttcagctaaatactaccttggaggctgcagatatttttatgaaggaattaaaaaaaaacccactataaaagctctttaaaattacatttcagatatttataatatttaattgttttgataacaccaaattctgtaagaaggttttatctgtattgcatctctgaagagttcagtgtaatttaaagctcttcagcttttatccatttaattcacatatcctctgaaaagcaaatgaaaagaataagagttctcatctacattttgtaggtggaaaggagaggtacagggcaggtaagtaacttattgtggtttcacagcaggacaagctaggcttatgatagaatttggatatctcatcttgggctcaattcaacagtcctggtttggaaaacattcattattaaagctctaaaacaaaacctgctattttgcaagtgtcaagtgatttctttattcaagaaaagatggattgagagacataaaacttactctttgtttcactgtgaaaagatgctattcctagattctccagggggaaaaagctgctttaaaaaaatctggggaggatagcatgttagcaactaagaatctttagataaatatattgtcaattatgcccattttaaaggtagctacataaaaatacagttgttttgaaggctatcctgaaaatcatataaaatgaactcctttcatagttgattctctgacagttcccagaccctgcctttcctcttggctccctgaaatttgtgctaagagtatctggagagccaataaataaatgctttctttttattttgaattcagccttttaagaacaggactgccaaaactcaaacaagtagttcatattttagttagcacctcttgttttagaagctattagaagaaagtcggaaaaatggtaatgtccaaggaaatgccacagaagttcgagtgggatgtcaaggaattgatgaaatgataaagattgtttcagtggatgtgaagatattgagggagaagatatcaaaaaaaagggaaaaggaaatgtgaaaaagaatagtcatagagagaaaaaataaattttggtggagaagacttttttttttggtggcttaaatttaataatgggttaacctattgagtttttggtaaatcttcagtttagattctttactgataatgatgtggttcctcataaatactggaaggagagagtgtgatgcttggtacaagggatgagacaggtaatatttcagaagaagaaaaatacgatctcagatgtgacacatggccttgatgccatcatctctagggttctgaagacattgaattttacataattgatcttttgatgtgaggatttcctggactcttgttttccctgctttatcatttttcactttcaataattccagcctttggctttaattagatagaagaggttcttcttttggaaaggaactagagaaatgcaaatctaaacttattcagagctatgtttgtaggtctctaggcaaagtatgtgtctggcctttttcaacgaagtattttcagtaacaagttgtcagtgaggtcagtgactagcggttcaggattagataccacccaccctggcttgtaacctcccctttctttcttatcctgggtgaacaacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggtaagaatcaagtttgtaaagagaagagctgaacttcagcgaattctcatttctgcattgaattcctgtgtcttagttataatcataggtttaaaatttggggttttcttctgaactgaggaagatcacattattgtatgaaataggaatgttttgactagttatgagaaacgtaggctttcacgctaattttaaagttataaataactttcgaactattgccaggggaagctggtagccaaggtcgtgctttgcattcagagagtttctggctataaaaagccgattggatactgtgcaggaaaagataagatatggcctggatgcttgtgctttggcatgggagtggggaaaaggaagcaaagatggaatatgtttgaagggattttactttcaaccaaaagctaattcatagtaaatggaagatgtttcaagtgagataatggcaaaaagcattaatttctgaatttaatgtctatttgttttataattggaaggaatattaagaggttgaggaatgctctcagaactgtttgatgaccagttatagtcaaatgaaaatcactgtatggaatgatcatgagatgtaatgatcaatcatgtaaagaaaaggtcactatctaatgggatctgaatgattgtgagcagctgctgtcagttacacggaagacaaataaaagaaatgagttcaaatggaaacaagaagaaattggggttagacatcagaaagttcatttactgtagaggttttgagtcactgatatgtgcctactaagatctctggagataacgtgagaatgcaatgatttgcttaaaacaaagtggaaaaagcaggatttcaagtttgcattggttctgggtttgtggctagctttttagacagattgaaagctcaacatattgagaatagttgtgatttgaagattcagattatccatggtcagatttgaatggcatatttgagtgtgctattaaaatttcattgtccattataaaaaattatctcagtagaaccataggacaagtttgttaaatggagaaacctaaaatacagacagtatagacaaagttattcccatttgttacctcctacacatagtctaaatcttcctatttgagtaaagattggtaaaactttttttcattataaaagcattaaatgttcatcgtaggaattttgaaagcacagaaaaatatttcctgtaatttcattgatgtgtttccttctagtctttttttttctagatggctttaaaaataattgcaataatagtatagataaaatttggaaccttgctttttcrtttaaccatataccaaaacattttccacagaatattacctattctacagtggtgttattttaaatttgtgtaacatttgttcaagtgaatgaatataattttattaatcattgctgaacatctagatgctatggtaaacatctttgtgtatttatttacttatgtgtatatgtatgttgtagatatgtttaagataatttccttaatctctgtttctaactgtagaagtgttggattagagaacactatgtttgaaggtaaaagttgtgatatttaagatgtgtttttactgttattcttttaaagcattgtaaaattcctagtctaccaaatgatatatttattgtctatgatgtgcaaaacattgttatcaggcacatagataccaaaatacttagtgtttagaaggatggaatctctcctacctacaaaatttccactcaataaacttttacagatatcaacaaagctacatgtcagagttgaaaatacttcagctctgcctgaaaccgatagatagtattgttgatcacttacgttactttgcacatgaaaataacagaatgtataagtaactttattagaagaccatgtagacatagtgatttatatgacttttatgatacaactgtgacaaagaaataggaataggaagaataaattctttacttattgtgaatctttggagaaattagaagtatttggagaaaatctgtaggcaacagactagaaagaaaagggatagagggcacatgctagaggagcaattcagtattgggtttttctatagggaaaacatgagaatggaattaggcgtggctatggtaggagtcagagaagataagttttaattctgtcattgttgagtttgagaaccatgttgtgtaaatagagtagaaggaagaaagctaaggaattagtgataaatacaactaattattggaagtggttactggtcccaagtaatcaaagtggagagattagagatatcaatattatgtggtgtgaagtgagaggtagagttatgaattatcaaataatatattcttcctgtattaaaaaactttttaaattgtgaagtttttattattcagtaataatatttagagaaaaaccatagctacagaaggatgggagtttcattctctattccccatgaacttctgtttgcatgtttctattttttttggaatagaagggattaagatttaagaagagaagttggcaacccaaactggcctgaagagaaattatgcgctttgtaaygaaaacttgaaaatagtgtttatttatggatcattggctcatgggaatgctagtctagagatttaaaaagtgtgattttctgattcttgtttggatactggattttaagtgasatggtacwgcggggtggaactccggagtttagcaaagttgcaaatctaatggaaagtgacagataattgaggctgcagaatttttgaaggtgaacaggactgttagccgatacatctgatttttcacatgcttaaatactgtttttaaccacattatttttgcctgggattcagcgagtaatctgtaaccaatttaatcactagcttctagcatatgataggtgactttgagttcctgtgtgcaaaatggaagattaggtcaagtttatttggcaccctccccacctcttttctttgcctttcattatcctaaccaggatgattttctgcttcagatgcctcctggcaatggggaaattgatttgaaggagaaggcaatgtttagtgcaaagaaagtctctcaaatactggaacttgaacaatggaggcccctactttaaattagcactgttcaaaatgtaattagaagttcccaatttttaactaatctatgaaacgagataagaggcttgtgcctgaaagtaaatcagctacaccctaagcactttgtagcaagacttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatctttcccccacctttcccccctttctattccacaaaaccgccattgtcatcatggcccgttctcaatgagctgttgggtacacctcccagacggggtggtggccgggcagaggggctcctcacttcccagtaggggcggccgggcagaggcacccctcacctcccagagggggcggctggccgggcagggggctgaccccccacctccctcccggagggggcagctggccgggcggggggctgacccccccacctccctcccggacggggcggctggccgggcagaggggctcctcacttcccagtaggggcggccgggcagaggcgcccctcacttcccggatggggcggctggccgggtggggggctgacccccctacctccctccctcccggacggggtggctggccgggcggggggctgacccccccacctccctcccggacggggcagctggccaggcagaggggctcctcacttcccagtaggggcggccgggcagaggcgcccctcacctcctggacggggcggctggccaggcggggggctgacccccccacctccctcccggacgaggtggctgccgggcggagacactcctcacttcccagacggggtggctgctgggtggaggggctcctcacttctcagatggggcggctgccgggcggaggggctcctcacttctcagacggggcggttgccaggcagagggtctcctcacttctcagacggggcgaccgggcagagacgctcctcacatcccggacggggcggcagggcagaggtgctccccacatctcagacgatgggcggccgggcagagacgctcctcacttcccagatgtgatggtggccgggaagaggcgctcctcacttcctagatgggatggcggccaggcagagacgctcctcactttccagactgggcagccaggcagaggggctcctcacatcccagatgatgggcggccaggcggagatgctcctcacttcccagacggggtggtggccaggcagaggctgcaatctcggcactttgggaggccaaggcaggctgctgggaggtggaggttgtagtgagccgagatcatgccactgcactccagcctgggcaccattgagcactgagtgaacgagactccatctgcaatcccagcaccttgggaggccgaggctggtggatcactcgtggttgggagctggagaccagcccggccgacacagtgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcagagggagaccgtggaaagagagggagagggagaccgtggggagagggagacagagacggagagggagagggagaggctgtagcaagactttctagatgaaggaagcactcattaacttacattctggtacaagctccttttctcatcgcagacctgcagtttgagtagcgttgcttaagttacactgtataaacatttatctcctcttgagaggtgaagctggctaggcttcagggtcaggtggggacttggagaacttttctgaatagctaarggattgtaaatgcaccaatcagtgctctgtgtctagtctagctaaaggtttgtaaacgcaccaatcagcactctgcaaaaatgcaccaatcagcgctctgtgtctagctaaaggtttgtaaatgcaccaatcaggactctgtaaaaacagaaccagtcactctgtaaaatggaccaatcagcactctgtaaaatggaccaatcagcaggacatggtgggggccaaataagagaataaaagctggctacctgagccagcagtggcaacctgctcgggtccccttccacactgtggaagctttgttctttcactcttcataataaatcttgctgctgctcactctttgggtccgcactacctttatgagctgtaacactcaccgtgagggtctgtggcttcattcctgaagtcagccagatcatgaacccactgggaggaacaaacaactccagacgtgctgcctttaagagccgtaacactcactgtgaaggtctgtggcttcactcctgaagtcagcaagaccacgaacccaccggaagggagtaactccggacacatatgaacatctgaaggaataaactccagacacaccatctttaagagtggtaacagtcaccgtggggtctgcggcttcattcttgaagtcagcgagaccaagaacccaccagaagcaaccaattctggacacattttggcaacccagatgggactctcgcctattgccaagtgatgagtaccatcagaccccttttgcttgctattctgtcctgtttttccttagaattctgggggtaaatactgggcacctgtcggtcagctaaaagcaactagcgcggccgctggactaaagacacaggtgccaggctttctgggatagggctctctaacaatccctgactctatggagttgggaatgttggtttgcctggagccagcttccactttaatggtacttccaggctgagccgagggttgacagagaggaaagccattcagctccggggtcccaacaacaagttggttgaccctgcggccatgagtggaactctcaaaatcatgtcacccaagygagacttgcccatctatcctatctcctgacccttgcctcctgggtcctaatgcctgtcagacaaacttcctctcgcctctcttctctgaggctagtccacttctaaaaascactccctgtctctggtgcttttctagtttctcctataagaatgatttctagtataaacttcaggactcttttaccttctttaggcacccgggctcaccaatcagaaagacataatttttgcccaaagtcccatctgggcaagggactatctggaattttaggatccctcttcagacaagcaggcctaacaaaagctattcctgaagctaggatatggggagcttcggaaatggtatctttcctattcatataagtgaggacaaaaagcatcactcttccaactctggagatcctttccctctctcagggtatgtccgtccagttcatttttggggcataacatctttataggacagtggtaaggtcccaatactaacaggataatgcttaggactctaacagctttttgagaatgcatcggtaagggccactaaatccaatttttcttggtcctctttgtggtctaagaggacaggcaagaatgcaggtttttgagaatgcatcagtaagggccactaaatctgaccttcctcggtcctctttttggtctaagaggaaaactagtgtttctgatgctgcgtcggtgagcacaactattctgatcagcagggtccagggaccgttgcgggttcttgggcaagaggtgtttctgttgctgcatcagtaagtgcaactattccaatcagcagggtccagggactattgtgggttcttggggaggggtagaaacaaaccaagaccaagggtggttttgtctttcagatgggaaacactcaggcatcaacaggctcacccttgaaatgcatcctaagccattgggaccaatttgacctgcaaaccctgaaaaagaggcagctaacttttttctgcactatggcctggccccaatattctctctctgatgggaaagatggccacctgaaggaagtataaagtacaatcctatcctgcagcttgactttttctgtaagaaggaaggcaaatggagtgaaataccttatgtccaagctttcttttcattgaaggagaatacacaactatgcaaaacttgcaatttacatcccacaggaggacctctcagcttacctccatatcctagcctccctatagctccccttcctattaatgataagcctcctctaatctcccccacccagaaggaaacaaacaaagaaatctccaaaggaccacaaaaacccctgagctatcatttatgtccccttcaagctgtagggggaggggaatttggcccaacccgggtacatgtccccttctccctctctgatttaaagcagatcaaggcagatctggggaagttttcagatgatcctgttaggtatatagatgtcttacagggtctagggcaaacctttgacctcacttggagagatatcatgctattaggtcaaactctggcctttaatgaaaagaatgtggctttagttgcagcccgagagtttggagatacctggtatcttagtcaagtaaatgatagaatgacagtcgaagaaaggggcaaattccctactggtcagcaagccatccccagtatggatccccactgggacctcgactcagatcatggggactggagttgcaaacatctgttgacctgtgttttagaaggactaaggagaattaggaaaaagcctgtgaattattcaatgatgtccaccgtaactcagggaaaggaagaaaatccttctgccttcctcgaacagctatgggaggccttaagaaaatatactctcctgtcacccgacccactcgagggtcaattgattctaaaagataagtttattacctaatcagccacagatatcaggagaaagctccaaaagcgagccttgcgccctgaacaaaatctggaggcattattaaacctggcaacctcggtgttctataatagggaccaagagaaacaggcccaaaaagaaaagcaagatcagagaaaggccacagccttagtcatggccctcagacaaacaaaccttggtggttcagagaggacagaaaatagagcaggtcaatcacctggtagggcttgtattcagtatggtttgcaaggacactttaaaaaagattgtcctactagaaataagctgctccctcacccatgtccactatgcggaggcaatcactggaaggctcactgccccagagtacaatggttctctgggccagaagcccccaaccagatgatccaacaacaggactgaggatgcccggggcaagtgccagctcatgtcatcaccctcactgagccccgggtatgtttaaccattgagggccaggaaattgatttcctcctggacactggcatggccttctcagtgttaatctcctgtcctggacagctgtcctcaaggtccgttaccatctgaggaatcctgggatggcctgtaaccaggtatttctcccacctcctcagttgtaactgggagactttgctcttttcacatgcctttcttgttgtgtctgaaagtcccacacccttattagggagggacatattagccaaagctggagctattatctatgaatatggggaacaagttacccatttgttgtcccctgcttgaggagggaatcaaccctgaagtctgggcattggaaggaacaaactcaaggtccatccttaagccttcccacaggacaaaacttttctttatacatcacaaagagagcaggaatagctcttggggtccttactcagactcatgggacaaccccacaatcagtgacatacctaagtaaggaaattgatatagtagcaaaagtctggcctcactgtttacaggtagttgtggcggtggctgtcttagtgtcagaggctatcaaaataatacaaggaaaggatctcactgtctggactactcacaatgtaaatggcatactaggtgccaaaggaagtttatggttatcagacaaccgcctgcttagataccaggcgctactccttgagggaccagtgcttcaagtgcatacatgtgtggccctcagccctgccacttttctaccagaggatgaggagctggtcaagcatggctaccaacaggttatagtccagacttatgccacccaagatgatctcttagaagtccccttagctaatcctgaccttaacctatataccgatgaaagttcatttgtggagaatgggatacraagggcaggttatgccatagtaacagtacttgaaactaagcctcttcccccagggaccagcacccagttagcagaactagtggcacttacccaagccttagaactgggaaagggaagaagaataaatgtgtatacagatagcaagtatgcttatctaatcctacatgcccatgctgcaatatggaaagaaagggagttcctaacctctgggggaacccccattaaatatcacaaggaaaccctggagttattgcatacaatgcaaaaacccaaggagtataagactgccaaaaccaccagagagaaaagatggagagaaagaaagagagagacaaagtcaaagacagaaggaaagagagagaggaagaaacagatagacaaagagaaggagacagaggaagagacagagacaaagaaggagtcaaagagagagacagagagaggaagatacagagagacagaaagtcaaacaaggaaagaggaagagacaaagagggagtcagagagaaagagacagacagatgaagaaatcaaagagggagaaagagagagatagaagtagtaaagaaaaaacagtgtaccctattcctttaaaagccagggtaaattaaaaacctataattgataattgaaggtcttctctgtaaccctataacactcaaataccaccttgttgtcagtgtaaacaagggtgtagcccgaaagcactgaggccactgacaacccatagccttcctatctaaaatccttaacacagcaagtttcctaacaggggatctaaatcataattaattaccatacaaaggtccaaccagacctaggaggaactcccttcaggacaggacgatagatggttcctcctgggcgattaagggaaaaagacaatgggtgttcagtaagtgataaggaaactcttgtagaagcagagttaggaaaattgcctaataattggtctgcttaaatgtgcaagctgtttgcactcagctaaaccttaaagtacttacagaatcaggaaggagccatctataccaattctaagttaatatggactgaacgagggtttattaatagcaaagaataattaaaatcccaaacttacaaggttttcaacaaaagtaaagtttgctaaaagttaacggagtaacatgtattatcctactaccacacactctcaaaggatttctcagacagtttgcaagaaataacaaaatctatccttactctacaatcccaaatagactcttcggcagcagtgactctccaaaactgccgaggcttagacctcctcactgctgagaaaggaggactttgcaccttcttagyggaagagtgttgcttttacactaaccagtcagggatagtacaagatgcygcccagcgtttacaggaaaaggcttctgaaatcagacaacacctttcaaactcttataccaacctctggagttgggcaacatggcttctcccttttctaggtcccatgacagcaatcttgctattactcaccttcgggccctgtatttttaacctcttcgtcaaatttgtttcctctagaatcaaggccatcaagttacagatggtcttacaaatggaaccccaaatgagctcaactaacaacttctactgaggacccctggagtgacccgctggccctttcactggcctaaagagatcccctctggaggaaactagaactgcagggcaggccccttctttgcccctatccagcaggaagtagctagagcggtcatcgcccaattcccaaaagcagttggggtgtcctgtttagaggggggattgagagatgaagccggctgggcttctgggttgggtggggacttggagaattttctgtctagctaaaggttgtaaacgcatcartcagcactctgtgtctagctaaaggtttgtaaacgcaccagtcagcactctgtaaaaacgcacaaatcagtgctctgtgtctggctaaagatgtgtaaatgcaccaatcagcactctgcaaaaatgcaccaatcagcactctgtgtctagctaaaggtttgtaaatgcaccaatcagcagtctgtaaaaacgcaccagtcagtgctctgtgtctagctaaaggtttgtaaacgtgccaatcagcactctgtaaaaacggaccaatcagcactctgtaaaacggaccaatcagcgctctgtaaaatggaccaatcagcaggatgtgggtggggccaaataagggaataaaagctggccacctgagccagcagcggcaacccgctcaggtccccttccatgctgtggaagctttgttcttttgctcttcacaataaattttgctgttgctcactctttgggttcgcattacctttatgagctgtaatactcaccacgagggtctgcggcttcattcctgacgtgagcgagaccgtgaacccatcgggaggaacaaaccactccggatatgccgcctttaagagctgtaacactcactgagaaggtctgtggcttcactcctgaagtcagcaagaccgtgaacccaccggaaggaagaaactctggacacatctaaaggaacaaactctggacacaacatctttaagagtggtaacactcaccacgagkgtcygtggcttcgttcttgaagtcagtgagatcaagaacccaccagaaggaaccaattctggacacactcttacctatatgcatgaaggcagagaattgggatgaaggtatacaattaactgggtaataaatgaattaccaattctcagttgatgaggcctctaggggtggcatcagttcaaagaggcccagagttagctcattgaggagcccacagaataactgagaggcaggattgctgaagggctacactgggtctactctaatgttggtttggaattcattcattcattctatatgacttgtgtgccagacatagttcttagtctggagataaataccagtgaaccaaaaatagaccctgtcctcatgatgtttcctttctaatgtgtgtgtttttgtggatgggggtgaagacagagtaatacataaaccaacttctctgagattcaccagaagagatcctgggttcttagtccagggctgaagctcatgggtcatgttttcatgggaatttgcaggattaacttgcttttctgttagactctgcaatttctattttcccaatgtgggattacaaaggaatcttaagaatcaaatagtctgtgatagacactgttggttgcctatgcaatatccatgtattctcctctgcttgctaattgacagaaccctaatttgggtcaagaaaaaaaaggcataatgttatgcaggttgatcttgtatcttcttcccgcttaagacagttatatttggttaagacagatgcatagcagttctaatagacctgcctcattctttccagcagctttgtcgtgttttactctgtgtatgtagcagaatttatttagcccattctgaattgatggacatgtttgtagttttcagtatttgttgtttgtttgtcctgttgctgtgtgcaatgaatatgcttgttcatatatcctggtgtactttttgagtgtatccttagaatacgttcatggaagtggaattgctgtatcaatgggaatgtttattttaaaatttcataagtattacatttaattggaaatattcaagagtacacataatttataatttgagatgtattgtcatatttctcttcaagaagttcatatcagtttataccccttcaacagtgtatactaagagcttatgttcctaacacttaaacagcactgatgataccatatcaaaaattttcaattttggctgcttggtgaaaataatatcttgttttatttgatttgcatttaattaattataagtatagttgaacaatttctaagtacttattaacccattgcccttctttttacataaattgcctttacaaatacttgcccaattttttctattgagtctttttttttttttgagatagagtctcgctctgtcacccaggctagagtgcagtggtgccatctcagctcactgcaagctccgcctcgtgtgttcacaccattctcctgcctcagcctcccaagtagctgggactataggcgcccaccaccacgctgggctaaattttttttttttttttttgagacggggttttgctcttgtcacccaggttggagtgcaatggcgcaatctcggctcactgcaacctctgcctcctgggttcaagcaattctcctgcctcagcctcccgagtagctgcgattacgggtgcccaccaccacgcctggctaatttttttgtgtttttagtagagatggggttttactgtgttagccagcatggtcttgatcttgtgaccttgtgatccatctccctcaacctcccaaagtgctgggattacaggcatgagccaccacgcctggctgagttcttctttttatcccaccatagtaaattaagcaaattagctttttgcctgtttaatatgttccaggtatttccccataatttgttgtttattttatgacttttgttttatttttgaattatatagaaaacaaaatatttttgtagtcaaaattttaaacctcttcctttatagcttctgggttttgagttttgcttagaaagggctttctgcttaattattataaatttattatacatactttaaaaatgtattatacataaaaatttccacttagttattatacatttattatacataaacttatatattcatactttcagaactttaaaattcttgctacatctggaattgaatttgggcaaaagagtgagcagggagtaagctttatttttaatttttctcctaaatgtttattcagttgatcattataatttatttaagaatcaccttttttcctgataatttgaaaagccgtatttatcataagctaagtttatattggagtccatttctcagctgtctttcctgttctattaatatttgttcctattttttccaatccctacttttaaaataacttcatttcataatatgttttaataactggaaggaataatccttctccatattcttttctgtcctttcaggattttcctagatgtaatcacataatatttatttctagatgaattttaacattttatcaagttctcaagtggtctgtggacatttaacagggagaattaacacttctgtaatgttcaatttgcctatacatcactttttaatatacttaattcttcttttacaaccctcagtagagttttaaagttgttttcatatcagtatttaaaaaatttttattggtatcataaacggtctctttccttccatcatattttaaaattagttattatgtgtaagaaagtgagccattgatttgggtccacatttgtatttttaagaagtgcctccggtggttgatacacagctaatattcatatgggcttttgggatctagatctctatactgctcttttggatttatttcttcaaccaggtgtttcctcagatctgtaactaatcagtccacatatcttttttaaaaagtcatttataaaaattaactttcttaaagtaaaaagttatatatgcatatttattttagtaaagggtaccttagccagggtttttgattataactaaagtctactttagctggtttaagcaacaagagtttcataaatgacattaggtagttcatagattctccatgagagccagagaaacaaagacaatgcagctgggaagattggacagtgatacagaagtactggtttctaccgtttggtgcttttgggctggacactggaagccccatcgcagctttcctagaaggatctgattcctgtgacgttctaaaatctcacccaagccatgattgattggtgaaatctgggttctatttcagtcaatttattgctccatgttattctgagttattttaatgttttatctgttagtgaggactgatagtccctagtgaggcatacaaattgttaaaatatgaaatgcttttgtacttctcccttacccttaccagtgattttccttcacttggcctctgcttgagaccccctggacctttcctagacccagcaactgaaaggtaaacacttggcacaggatgaagcttccaagacagctccagcctaagctctgattgcttggggcctgagccatgctggttgttaaatatttttaatatctctcctactgttactcaattgacatccaattagattctatatattttttaaggcttttctgacccactaataataattaaaagtcagaccaatgaaagaatatatgacaatttatttaaccagtcccttattaatgcacatttaggttgtttctaccttttgttgctacaaacaattctgcagtttgtgatatacatctttgttcgtatgttcagatccctagaagtggcattactttgttcaataattcgtgcatataaaattttgtggatactgccagaatgcttttcaaagagattttaccaatattcactttgaccaacagtgtatgagatagctcacatttctttatcttggcaaagaaaatttcacaaaagatttaaaaaatgtttgagtgaaaccaattttatcttttagcaatgakttttttaaaaaaaggaagagaagaaaattaagttagtttactatgagtggctcctaatgaacctataccaatgtagcaaaaaatcattgttctcttttctaattaataatattttgatacttttctagagaccaagatagaatttggttttactttttaaattctacctttctgatatatgggaaaacatttgtgaattcccaatattctgttaccactctcattttccattagtatgccaaatgccagcaagaattctgtgataatatgtgcatgtttttcagtgctctgtaaaatagtggttctcaactcagggtgcttttgcttctcagaggacatttggcaatgtctggagacatttttggctgtcataactagggggcaggttcttttggcatctagtgggtagaagccagggatgctgctaaacattttacaacacacaggaaagcccccaaccataaagagttatccagcctcaaatgtcaatagcactgaagatgagaaaccctgctttaatggaatatacccagaaatggtcatttatctaaattgttaagcattctcttactatcttttctcctttctcgtttatcaatttcatytcaagattgttggtacaatctttttattttaaagaccattctccttgggagacaagatgaaagcaaagtaaaaatattgttattttgctttctctctattacttgttaatatgaaatctgtctgggggaggaggagacttgtaccttttttatctacttccatcatcaaacacaaccttaaaagtttttgtgttgtttaagtctttgctcatcctaggtttacactacttttctaatagactgatactacagtgatgtgttcatcctaacctttaccttcttccttcttttgtgtgttctttaaacatctcagctctttagaaggctccttgtataccatctgtgtgatgtagtaatggcttaagttttttgacctatttttcatttaaagtctgtggctctgggacattcttatattttctctcaactgctaagcaatctaagatacttgtcttactttgctttgtgttttctttctttactgtaatgaactctaaggtgatatgttcaattttccccaaggttcctgtcactttcacttccctaacgtatcattctttgttggtaataattaaatccagggtagcagttccattctttgcttcttttgccctctgaatgatgaagctgctggtagagaggcaggagataaaggagaggaatgattcagattttaattacttcattgtctttttcttttgccaaattcttggatgtttaaatctttgccaggtctctttttatcttgacctgtcacttcagtcaactttcttttctttttagcctttccatcacttctttcctagaatttacatttttgggtatttcactgagaacacagaagagatatattctaaattttcttttgtcttggtgataattttcccttacatctttaagaaagtgtcttcctcttttatgttacacgatttttaaattttgtttttttctgttatttttgaaatacataagatttatatttagtcctggtgtttgtcagaaatgaggtatgtgtagcctttgagctcaatcagtattagttttgattctacagaattattctctcaaatcttaaagtgaaggacaagtatcttgttaagtttctgggctacaggaggtacatttgcatcggggcaactcttctcctactcctattatttgttcctctacttggaggtgaatttaaccctagataatctgaagcaattcgattcacctttctaaaagagacacataaaacctaatctccagagcacccttctgtctgtgtttttcttatgtctgccttctcttttggggctttctcataccagagtacaatatgtcattctttccttgtcccctctcatcctgtgctgcatttctgcgactcaaaatcttctggctgagtgtagttagaaatgtattgctaggaggtgtctaggaaacacccctggctacctgaaaagcagcttctttgaagtaagggggtgcaagctgactttttgattggttgtgccagccccaagtctttgataggatgtgaggatacatgggtgggatgtgaggttgttgcaaatttagacacaagtgagtttcagctccctttttccttgtttataattcatgaagtagataaggtaaagtggccagatttagtaaataaaaatacaggacacactcttgatttaaattccaaggaaacagcacatatgtgtgtgtgcatgcgtgcgtgtgtaagtatgtcccaaatattgcatagggcatacttatgccaaaaaattattctttgtttatctgaaagtcaaagtgggcattttgtattttatctgtgaaccttaaggtaagggaaaattttcctccagtgtttggaaatcattaatgagatccttatcattttgtgtctcagatactagcgtaaaagggtctttttctaacttgasaaagcttgccctttctagtcttgtttcagctgcagggctggtcaacactggggagactggaggaaatttgtagaatctgggagccttcaaacaggagaagactgaaaacctggactctttccttttacaatgtatctgttgttaggaagagttcttctgacccctgcatcaaattagtactgactaaaatttgctagtgagaaagaacaccaaagacccttaaactagaaccccccttgtggcctatgttaccctagaagtgtttgtttctggcacatgtgtaactgactggaaggccctcctgactcagccactaggcttggtaaattaaaacgttgaaggcatgggttctgtgccatacatttgccggaatggtatgcttgtcttaaatcattgtggcctctcactggatccacagcaacagctagagtgcagcaggagaaagggtctcactgaactatggggagtcagcttccatcagtaaactgtgtaccaggaacagagcaccagcatccttcaacaaagcccacttgtattctaatccacttctctgcctttctttctctgtggcatgtgaatgaagatgcccccagagtttttgaacaatttgagagacaagagagatactggattccctgccagtctggcaattgggaagtggttttagcttgaaaaattaatagtaatgacctcatttttacccaaaactattgaagtggaccctgctattaccacatatacacatatattttacaaatatgacatcataacatatatcattttataattgttcagttctgtgaaagtttcttttttccttttccagtggcatgacctcagaagattgtatatatttttctgtgttcttgtgctttgcatttttgaatatacctatactgcttagattaataaagatctgtttataaaagacaatcaagttttgtgatttcttataattcctgggtctttctcttctttgccagcctgtatcattaatatattttaaagaccaagctaaaaaattaacctgaaataagtagccatccttgggtaaatatttttaattttgattacttaacttgggtgcctcggcctttagtttatatgatataatcttacatttaggcatatgctaatttaaaatatattggttattgatccctatgattgcattctagaggaaaatatagaatatatttatgatcttaggataggacataatttcttaaataagactcccaaaacatagccataaagtaaaaaactgaaattattacattaatgcaaaaattaattaattaaaagactgaaaaaacaataaaaakaaacaaaaactaccagttgacagggtatgtttacattcatccatataaagtggattgcattgttgtttcccaatcctcttgctccctatatccatcccctttgccatgtgtctttgcaattcctcctgctagaggcagagtgtatttccctgctccattaatgttagacttggccatatgacttgttttgcctgtcggaatgtgggcagaaaagttagacttggccatataacttgctttgcccattagaatgtgggcagaaaaggcagagtgccaactttgagccttcaccttaagaggtactcaatgtttccatttgcccatcttgtgtttctgttcatgagaagaatatgctccaagtggcctacttgtccaaggaggatgagaaaaatgtggagcagatctggatcccaaaactatagcctggggcaagctaagccaggtccattctgaattagccaatctttagccaacctgaaaatccacaagaaataataaatgttttcttaggccactgagttctaaacctcagtggtagttttttttatatggtgttattgtcaaaatagttgactcatacatcatttaacaaaagtcatttatcataagattttattaaaaactccaaaaaattaataaggaaaagataatcaaaaaacgaacaatccaatagggtcaatgatatgtgaaaaggtaattcacagaaaagaaaactagaatgacccataaataagtcaaaagaaacttagttttcttcactagttactgggtaaagacacattaaaacaacaatgggatactttatctactcattaaattggtagatattaatgtatggcaataacctagaatgtgtaaggatatgaagaaaatggaactttcatatacagatgttacaatgttcaagggaaggtatcctagacaaagagggacatatgaagcagggagaggatattttcaaggaatattactgacaaaagattatatttacaatatatagggaattctttgaagtcagtaaggaaatgaacaggcaacctaggagaaaaacaggtgaagaatacaagtaagcaattcatagaaaggatatttgaatggctgactaatcaactaaaaagagattagcatttacactggtaatcagaagtgcaaatcaaaacaatagtgatgtgatatctcctttgcatgtcccatgttgatgggagttaaaatgtcatgtaatatcttgttttggtgaggaggtggggacatgtgaacctacattctctgctggtggtgttttttggagaccaatttgacaatacttattgaaactgaacacacattctgacccagaaattctacttctgaattgtattagtttgctaggactgccagagtaaaataccacagactgggatctttaagcaagagaaatttattttttcacagttctggaggctataagtccaagatcaaggtgttggcaggtttggtttcttctgaggcctctttccttggcttgcagatgaccacctttctcacatggttgcccctctatgtgcacattcctgatgtcttttcttctctatgtcctaatttcctcttcttagaaggacaccagtatgactgaattagggcccatcctaacagcctcattttaacctaatcacctctttaacggacctatctccaaatacagtcatatcgtgagtgaggtactagggtttaggactttaacacaggaattttgaggagatacaatttagcccataacagaatgtatacaccagagggactcttgcataggcacacaaagagacatgtatgagaatgtttattacagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcaatgtacaaaaatcacaagcattcttatacaccaataacagacaaacagagagccaaatcatgagtgaactaccattcacaattgcttcaaagagaataaaatacctgggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagattcaatgccatccccatcaagctaccaatgactttcttcacagaattgggaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatgatactggtaccaaaacagagatatcgaccaatggaacagaacagagccctcagaaataatgcctcatatctacaaccatctgatctttgacaaacctgagagaaacaagcaatggggaaaggataccctttttaataaatggtgctgggaaaactggctagccctacgtagaaagctgaaactggatcccttccttacaccttatacaaaaattaattcaagatggattaaagacttacatgttagacctaaaaccataaaaaccctagaagaaaacctaggcgataccattcaggacataggcatgggcaaggacttcatgtctaaaacaccaaaagcaatggcaacaaaagccaaaattgacaaatgggatctaattaaactcaagagcttctgcacagcagaagaaactaccatcagagtgaacaggcaacccacaaaatgggagaaaattttcgcaacctactcatctgacaaagggctaatacccagaatctacaatgaactcaaacaaatttacaagaaaaaaacaaacaaccccaccaaaaagtgggcgaaggatatgaacagacacttctcaaaagaagacatttatgcagccaaagacacatgaaaaaatgctcatcatcactggccatcagagaaatgcaaatcaaaaccacaatgagataccatctcacaccagttagaatggcgatcatcaaaaagtcaggaaacaacaggtgctggagaggatgtggagaaataggaacaattttacactgttggtgggactgtaaactagttcaaccattgtggaagtcagtgtggcgattcctcaggggtctagaactacaaataccatttgacccagccatcccattactgggtatatacccaaaggattataaatcatgctgctataaagacacatgcacacgtatgtttattgtggcactattaacaatagcaaagacttggaaccaacccaaatgtccaacaacgatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccgcatgttctcactcataggtgggaattgaacaatgagaacacttggacacaggaaggggaatatcacacttcagggactgttgtggggtggggggagcggggagggatagcattaggagatatacctaatgctaaatgacgagttaatgggtgcagcacaccaacatggcacatgtatagacatgtaacaaacctgcacattgtgcacatgtaccctaaaacttaaagtataataataataaaattaagaaaaaagaagttaataacggatgtcatcaagggcccaagttctttctatagttctgctctgtcatccttcctcttcagctttgcagtaagattgttttatttccaggcaccttaccacagtcaggttaaggaagacatggcaaggatgctgatgtccttttgatagggraagcaaaagctttaccgtctcattggccagaattctttcacatgccattctgagttgcaaagaaggctgggaaatcaaatgtcctgcctccatagcagagaaagataagggagaataaggttgggactatgtgctgagtgagcaaacatgcaatgtttaccacatctttatagtccaacatagatagaccaaaaaacaaacaaacaaacaaaaaaacaaaaccacacaatgaaacagacacagagagatagaagtagaaagagatgggaaatacaatattatttgtgtaaatttaaacatccatacacataaagttatatattcttgtagacgtatatagcatatgtaaaaaaagttacggaagtttaattggaaatgtacccattaactaccataagaagcagagaggggaatggaactgagaacagggaatatagactatgaaaacaaaaaataaaacaggcttttcatagactagtccaccagttaggaccatgattgattgtgtcagtctaattctgtgcacccaagacccagggggataaaagtggattggcttgggatgtgtgtgtgtgggttactcagactgtttgatttggcagggttatcatttgaagtaaaagaagtgtgattcattggctctatgactgaatttaattattttacctttctctgtgataagcttcattcttttgaatacaattgatgacctaataggaatgatgttatagttttaatttagtgactatagcagttatattttggaaaatttagggatattacaagttttgcaaaattgattttgtttttgtacatatatttcttttgttctattatgcaaaatcagtagaactagacttagagagtcaatgaaagacatgagtaaaatagacatggctgcttagtagtgaaatccatcactctctagttttctgttattatctttggaaacagagagtgtgggagaaaaggatttccttcctctctttctaatatagcctcagtgactgagtggctctctgctctggaatgaagcaggttggcacaactccacaagtcttatgtgggaacaagacacagaggtttctattttttcttagtgtcatttgtttgtgtttagttcggtattctatctttaaccattctatacccactcttccaaaaaatactcagtttattaatatgtgttagtgtccctttaatttattaagcatgttgcaactttggaagaagctctaaacatatttccatttcagtaccaggttttcttgctatccaattataaattattaacgtggatggagtagaagacttccattgatggcatggattcaatttgctaaataaagctgtgtggacataatcattctctatccatttaaaaatcaaaggggcaatctgtttgatgtgtttcacagcagccctctaaaattcaatggcattttggttttgaaaagcagaatttcacaaagagaaaagtatctttccacaaaataacaataattgataaatgaattatttggcatggtaattagcattccattatattctatgtgtaattttataagtaattactcttcatagaagttttataggtctcatttcacatcaggaaaacagggtaaattggggtcattgtggatgaggccaaagagggtaaagtgagtttgaatttgaacccagtttgttttgcatttcttactattcttattatgacatttcttctcatcatattcttcactgtacttgttttgtaatgtggctgcctcattccttctatagttaatcttgggagagctcatctactcttatggattagagtgtaacatggatggacaggttactatatctgtatctctaggcataatttttctccaaagttcatggattctgcatttccagttgctcatgggacataactatttgcatatgccactgcacctcaaacttagcatacctaacctatgtcagagtccgagcttgcactatacctgtcaattggtgtgaatattacctgctaagagcccactgctgtaatttaggggaataataagttgttttgaagataaatgaaatacaataggccctttgggaggccgaggcgggcagatcacaaggtcaggagttcgagactagcctggccaacatagtgaaaccccatctctactaaaaatacaaaaaattagccgggcatggtggcgagtgcctgtaatcccagctgctcgggaggctgaggtaggagattcacttgaaccggggaggcggaggttgcagtaagccgagatcacgccattgcactccagcccgggtgacagtgtgagactccgtctcaaaaaaaaaaaaaaaaaaaaaaaagaaacacagtaggccccttatctgtggttgcattttctgtggttttagatactcaaggtcaaccctggtctgaaaatatgaaatggaaattccagaaataaccaatccacaagttttaagtgtgtgccattctgagtagcacaatgagatcttgtgttatcctgttatgtctcaatcaggacacgaatcatctttttgtccagcatgtcctgctgtatatgctgcctgcccattagtcactcctagaggccatctagattttcaaatggactgtcgtggcctagccccaaagcgcaagagttctgatgcaagcatattgttataattgctctattttataattattattgttaatttcttgcctaacttataaattaaactttatcatagtttgcaggtataggaaaaacatatatagggttcagaactatctgtggtttcaggaattcactatgggtcttggaacacataccttgtctataaggggggactattgcctatataaaatatattgaaaattcagatacagcatatagtgtatggaggcrtttttgctaaaagtaaaaaggagtattttaagtaagtagtatctattcactgcttattcaatctctccctacccctaagcrttatccttaattttttttaatctacaaatagaattgaggctaataaggcctttagatgtaggttcttaaggcacctgcgaaaaccaaaaaccattgagtgagacatagttcaggagagcctgtgtcaggtaccaaactcagagctgaaaagtaaagtagaattaagtgggtaactagaaacaacaacaataacaaaattatttatatacatattccaaaatgtgtggatgattggcaaaaaggataagcaaattactggcaaaactgacttttcagttttattctgaatagtgggttatcctataagttaatttgagaaaaaagcccaggtatctattttatattacagcgaatgtatctgtttagaaaattgaagatataaaatttcataaaagaatataattaagaggtatcctattttatttccaaatgtaaaatatgatatttacctggctattgttagttattacatgaggaaagaaactgccacatttgagtatgagagacgatcttatagagcagtttctttcaatgaagaacccaatgcttgtttttattattagaaatagaattcccctttaaaggaaaataacctataattttttattttgaatgacaattgaggaagagaattaacatttattttctctttggaaaatttagtactttagcatagaggatgtgccattagtggcaaatctgagagcaggaaaaagagattgctctttgaaattgctttttcacttttgccatagttaacttagttaacttgatgtttgtgatataattgcatcaaagaaacagaaaattttttatcttcagccaagataaatttgtggaagttaatgattttagctaattagatagtaaaatttttatttttagaataaatcaggcaaattgctgtccatgtctttccacactaagtgagtgttaagttgtgaaataaagaacctataaattgtaagggaactttgttagtcataataccgcatgtttatgagaaatatattaatgctgtaataacaggaagtatatctttaaaattagtctgtggcttctaatatataatgaaaatttagcaaatattaaacagggagttaaagaggttacaaatgtcatataattttgaagagagattttatcctgtaatttagttctgttttcttcaggatttgttttcgattttctaatggagcttagaatctttatgtaagattgttgttcatttgtttgtcccagaaaaatttaggattgtgggaagtctttctgatgattgaacccaattctgcttcttcttggtaattctgccacttcttggtcttctagtgctttttttcagaggatgcagctgttggagcagatagaggaggaaataatggtagtgtgatacagatgagaagcattaatctgggctctaaaagtcaaatttatatgggcaaaataaaatgggatatttctaagcacatttactaaggaaagttgagatgatgtgtcccagttcctagctgaagtataaaaatacatgtcattgggtgcaatatgtgggctttcagaatctaataataccctctgctggctaaatgaggaattgtgtttaaaaatgagtgacttggcttttttgtttgtttgtttttaaaatatggatgattgctctattataaaaggattgagcagtgcagagtattgtgaaataatataggaaaaaattgtaaatgtgaagaatgaagccaatatgttactaaaatgttttctaaagtgaaattaatgtagaaatatctataagtagaatttctgaatcttttggtctatattttaatcatgaagtaggtcatagggaaggaatgcagtagggggaaaatacgtgaatctctggcccctatcctcaataacaattcagattaattcaagatatttaaattaccttcattagttattcctaaattactgttgtaagagctattgacaaatatatgaaggtgagataagaactgcttttctcaccccaccactggacactacctgggtaacgggatcaattataccctaaatgtcagcatcatgtagtatacccatataacaaacctgtacaagtacttcctgaatctaaaataaaagttgatattataaggaaaagaaagaatggcttttctgtggatagcctgatttaatttctgttaaaaataacaggcatattcttaagtaacctgaaagcttgatcgcttcagggaagtatcatataacatgcctgttttatattttttctttctacttttacaaattctcaaaaattctactttgggatttacagtgttttgggtacataatgaccatgcaagttgtatttagaagttgatagtgggtaatgtattattatttcattgtaaatctgaaaaatagaatttcaggtctgattctgctgtttgatgttacccttcactggcatgttgctttaagagcacccatccccccttcttgcttgggccactgtgtcctgtcagtcatcctgaaatacactagggtgcttgtcaggctgtttgcttacagatgcatcataagccaaattgtgagccatgatagtggcactgaatttctaaatacaagaaattgcttagacaattggtttagtatctgtatatgggcaatactctgtcctgcagtaggtgagtggagtgtcaaacttttaaaaatcaaactttgctataaggcaaatcctagtaattatagattatctgttgctcggttagataactttgggggaaatgaaaggacattatttctataaaatgggatgaatagaaactattatgttgtgcaatttttacttttataactaattttcgttttagtaacactaaactctagactattttatgaaagctccaattttaaatgtctacttttccgagtatattagcaggcatttcagatttagataaaaatgtggttctcttacacatttttttctttcacaactcaggcagattcaattgagcagaggctcgagtctgctgtttattagtggttttaaaaatagcactaaaacagattctcatgtgccaatacccaagctatagtagtcttacatcagctcatttaaaaactcctactctgtaactgagctattactataatgattgagtaactgtatgcaaggcactagaaactttacatactttagacacaaaaattgtacagcgagtaggttatttgtgcaaataatttaattgcttttaattaaaagttatgggcttttaaacttaaattgtgcatggatttttccctgtagtttttgtgcgcagacttaaatatttttaaacagagaattggtaaagcaaaaaaggagaaactcatgatttttgatacttgtgtattcaatacggtagagcatagctaagaggcagcaagaagttaaagttgtaaggctttatctaaggtaaatgagaaaagattgctttttcagatacctagaatgactctttatttattccttgtcttgttctagaaaggatttaaggtgacttataaggctacatgaaattcaagataggataaattaaatgtggagtgaaagaagaaagaaaacaagtgtgggatataaaacagagccaggagtaagaaaaaaaacaataaaataaatgcagcaattctcaatgataactctggtgtattatggatagatgagagagaaaatatagggtttcagaaatcttatggtggagtttcatacaaaccagttgcctyctcttaccttggtggcagtctggaatgaggagagtatattagattataaatattaaatatgctttaaatgtcactcgtgttttggtgaaaaatagtgaagaaatgctgcccttttaacccacacactaacttatgtgaaagtaaatgtggccccaaatgttcagaaaaaaatttggttagttcagaagagagattaaagaagcttagttttttggaaacaccagagtgatctaaataagataaaatatctacataatagaacagacatgatcaagacaatgtttaaaataaaatatatttagcaattttgtataaatgtatgaatactmgtcctacaattttaaaaaataaattgttgtaaatgggattagctactttccttcttttcacacttttaatctagcagtaaatttaacttgaatttcaacttcagtaaggtcaaaattaactggattgatctaacttgtaaaaaaagttgttgggtagaaagaaggaaaccagagacaggactttataatgtactttcatcttcacatactcgcaggacacctactatgttgaagattctggactctgggccttgtactcactaaactgggcttgtctaagtgaactagcttagaaactcgctgctgtcagagagcagaattgaaaaaagacaagagggtagtagttaaaatttgcgaaggattttcagtgttgtcttctgatattaacatgatgagccagggacagtcatttggctcttttttattcrttgttaaaagtaaggtcaataagaaatgattcaccagggctgtggttgtgaagaagaccgagacccgcgatgggaagctggtgtccgagtcctctgacgtcctgcccaagtcaacagctgcggcagcccctcccagcctgcccctcctgcggctgccccagatcctgggagggaggccgttgtgcagaggagcacagggaagaggagacccacctgaggctcagccctagcccctcagcccacccacgggagagtttactgactggggaccgcacttgcccatgcctccagctacaaaacaattcaattgcttttttttttggtccaaaataaaacctcagctagctttaacacacacacacacacacaaagaaaaataaaaagaaatttttttttaaagcagtacaaaaacaaatactgaaagctcttgtttttgtagttttgtaaacacatagataggttgacttagagttcttgccagaaaaattataaatcaaatatataacacataactgatcagatgcacaggatgatattgagaataacctgaacacacaggtgtgaagcctgggaatgaatactattaagaagttaggtagggtttaggcaccaaatactgtaaattgacagatgtacaagaagggccaagacacttcgaaaaagtgaatcaacttttgaaagtattaattcagagaacttaaggaagagctcctggagccaaaggatatcagtggaaacttgtaattatatagtgaatgaaataatgtagaaatatttctgtgccactgggataagagatgaacacaaaagatgtttttaaaagtcaaatttaccgagaaataacttatatataccatattaaattcactcctttaaagtttacagtttgatgagttctgacaaccatatacagttatagaaccatcaccgccacaatcaaatagaatatccccaacatgctaaaaagtttctttgtgcccttctgcagtcaactgattacatcaactgttggcatctggcaactaccaatctgttttttgtccctgtatttttgtcctttcaaaaatgttatataaatggaatcatatagtgtgtacttatttatgtctgattctcactcagcaaaacgcttttgatattcgttcatgtcattgcatgtatacttggttcattctttcttcttgcataacatgtgatggtattcttgtgccacagattgtttatccattcacttgtagatgaaaatttgagttgtttctagtttctgactacagtagtcccctcttatccatggtttcacttttagcagtttcagctacccatggttcaaaaatatgacacaaaataagatattttgcgagagagaatgagtgagcacattcacataacttttattgcaatatattgctaaaatcattctattttattatgttattgttgttaatctcttactgtgcctaatttataaactttattatatgtgtgttgaataggaaaaagcatagtatatatagggtttggtactatcccaggtttcaagtatccactgggggtcttggaacatatcccccaaggattggggggatgactgtcttatgagtaaggccaccatgaatgtttgcatacaggtatctatatggacataagtgtttatttctcttggctaaatacctaaggagtggaattgctgagctatagagtgggtatatgtttaactttataagacacttccaagcttttctctaaagtggctgtaccagtttacgtttttgctagcaatgtgtgagatttccagttgtttctcatctttgctagctccagtatttataatctttcaaattttagccattctagcatgtgtggaggagtacatattttggctttaatttgcatttctctagtgactaatgatgttgaacatttttcatgtgcttatttgccatgtatatattttctttggtaagatgtcttttcaattttttttttgcccatttaaagagttgagttgtttttcatttaattattgagttctaagggttctttttatttcctggatacaagacctttgtcatatgtagattttcaaaatactttgtccccgtctatggtttgtattttcacgaagtttgaattttcatgaagtccagtttatcaactttttcgtttatggatcatgcttttggtgttgcatctaagaagactttgccaaggttacaatgatttttttcctatgttttcttctagaagtttaatagctttaggtcctacctttagctctgtgatccatttcaagtaagtttttgtatgtgatgtgaagaaagggccaacattccctccctgcctcccttcctccctgcctaacttcctgactttcttcccttccttccttccttctttcttccctccctccctccctcctttttctctttcttccttccttttctctctctctcttttttttttgttttagtaaaattgctgcaattaattgccttgggaatacatcactttttatttttatatttgtggtagagtcctaaaaactgaattgctgggtcaaagtttaaatacatacatatacatatacatgtattgcatatttgccctccatagggataatgttttaaatatccacaagcaaggtataagagtatttgtttctctgcagccttactaacagtttgttataaaaattttggtatttgccaatctgaaaggtgagaaagaatatctcaatgtattttaatttgcatttctctttttttttttttttgagacggagtcttgctctgtcgcccaggctggagtgcagtggcgcgatcttggctcactgcaagctctgcctcccgggttcaagccattctcctgtctcagcctctcgaatagctgggactacaggcacccaccaccatgcctggctaatattttgtatttttagtagagatggggtttcactgtgttagccaggatggtctcgatctcctgacctcatgatccaccgcctcggcctcccaaagtgttgggattacagtcatgagccactgcgcccggacttaattcgcatttctcttattatgaatgaggttgggaggctttttacatggttaagtttacatatttttccatgaatgagaaattgcattcaacctcaaatagtatctattaatctcttgctatgaaagatgagtgaagatgagtgtttgtggcttttccatcttttctttttttgctgtgtaattccacagcaaattgctagtctgcccaccatgtccccaaatgtgttctcagtccatgtgtatgggatacttctaatgttactaatgttttgttgcttgcttccatttgtttcttgaattctaaattgttggggagaagcaggagggtggtgttttgaagccaggggagaaaagtcatctatttcctatagagaggatatttaacatgtgtaataagaaacagttaagtagggttaataggtatttagctagtgttcctggagaaactttaagaaaatattgataaataatgaacttggatggttagatttaaagattctagcagagactttttaaaattctcttcaaggattatgacagaatggaaaactaggagacacagaagaagctgaaattccccagttacatactatttgttttcctaagtgtatttattgatttacagaaaaatgaatatagtgtttttcaaggactttggtttcattttatttattctgataagcaggcttttatttatttctagctgaacagagaacaaagaagaaatgggaattttttggcttcacattgaggttgatgagaattctactacctttgccattctctttttgttctctgctttttaaaaatatcagaccttacgagaattcatatacagttgagctgttttacaatawtatggaatgggatggacccataggctcactggacttgcagcaacagaagcctctgtcactttcaaagtgtatgtgaagggcacattacttctgccgtggttgcttaaagttgatgccttgtagctgaaggttattcttgttctggtgattcagtgaaagcttttctgttgtctcatatattagattagcttcttctttgacttcaatttgactaatttagttctatggcttttaaaaaatatgtaggtaaccttcatgctgggcttatataagatgggtctccattttggcatactttttatatggtacaaaatgtccttaagtagaaggcattgctacatagagtaactgaccatggggcatttctgttctttctctgtagctgcaattttgaaaatgtgtgccattgtggtgagcttttagtatgaactgacatgttataaaataactaaatggtatgttgtcagggtcataaagtcatcttgtggaattctcatgtacaatattacttttcaggtaagtcagaaattgaattatgactttttgctttttttaagagggagattagatttgaccagctattcatgatcagaaggacattgtaagacctaaatataagtagaatctgttgttttcctttgttttcatatttcatattggttaaagtaatttttttttttaccttttttgctgctttcattttggttgtatgtgtgaggaaacatgtttaattttggttgctctggctagagtaaacacattttttaatttaattaattttgtttgaatcttttcataaagaattcataaaactcatcatttttgggggaggctcaatttgatcatttttcaaaaacatcaataagatggctatctaaaggtttaataaagagaacttcaaatactcaagcttataaagtttgaattacaacatgctaatgatatttaccttttgttctaaaatgtaatattgttttgttctgttgaaattcagagattttggatgctaaggaaataaaaagtacagactcttggagttccccacacttagtgcatctaacagttgtagccctaaccctggggcataccttttatgtaccactctggaattgatttcaaagggctcaagatcctttaggaggctgttgtgcattaggaatgtgtttgtttgttttttttaagacagtactttaggcatgttgcatttctaattagtgcacatgtaggaaatatgccttattgattttgaagtcaagaaatccaataaaatgaggccaccggagggaagctttgttttaaagtcttttgttatgaaaacaatcaatgaaagcactcttgaataataattatgaggtctatagatgagggagaggtttaatctgaatgtagacaagtagattctgttctttcacttaaaaggggataatgatatcaactaatgtttgttgagcccctgccaggtgtcagagatattggctaagttaatggattttatatagattttcttaggtaatctttaagatccttttgaggtaggtactcttattattctcattttatggattaggaaactgatgttcaggaaagatcagtaatttatctaaagtcaccagcgagcagggaacagagcctggattctcacccaggcagtccaactttaaagctgatgctgataatcactgaggcccaatagtggtgagaggtaagagaatttaagaactctttagcagacggtgggggttgcagggtgaagcgaaaggatgtctcacatgggctgctgcatattaccctgctaagggtctgagtggagatgaaatctagccctccctctgctgggcaaactgtgggcctttctgctaacacttgcagggctgtgtctactcagagagtggcacagttttcttttttttcttgtcttgwcttttttttttttttttttttttgagatggaatttcactgttgttgcccaggctggagtgcaatggcgtgatctcagctcactgcaacctccgcctcccaggttcaagtgattctcctgcctcagcctcccgagtagctgggattacaggcgcccaccacaattcccggctaatattttaaatttttattagagacaggatttcactatgttggccaggctggtctcgaactcctgacctcaggtgatccacctgccttggcctctcaaagtgctggaattacaggtgtgagccaccgtgcctggtcagttttctaatccatctgtccagaaggggcatatttttttaattcacctgaaggcaaatctcaattctacagtcatactctgaatatcactgcctgtatttccattcacttgcaatagtggacttcaacctacctctttctagtctacatgcttccttggtagtctcattgtatctacctttatgctgacaactccaaaagttatattttcatttcagatttctctttcaaaccctgctcttgtatatctaactgcctactttacatcttcactttgatgttaatatgcacctcaaatttatcatgtccccagctggactcttcttcttcctgctcctcttgcagccattcccacctcagttaatggcaactctatccttccagttgctccagatcgaaaaacttaaagatatcttgagttctctctagcctatgtttaatctttcatgaattcctgttgtctcaattgtcaaactatatctacaatctgaaccctgtgtccacttctgctaccaccaaccagttctaagccattattttatctcatctaggttactatgggaactcccaatggctgtccctattttttcttttgcccttcgtacttcgttctattcaccagagtgattcctctaaataaaacagttgatgttttagtgctcaaacatctgcaatagttcttatgatctgcagcctccatacmtttctgactttctctcttactatgctctttgtagctcactctgccctgcttacactggcctccttgctgttctgccactgcttttctgccttaggcttctgttgtgatgttacttctgcctgcagtgctcttcccccggctgtctgcttggctaattttcttgcctcttcgagtcttgctcagatgtccccttctcaatgaggctagtcttgaccttatttaatactgaaatctgctctgaacttccctatcacccagccctgcctactctattctgctttttcttttttaaaatggcatatgttattttctaatatacgaaatcatttactatttattatctttattgtttatggtcacactctcctcgtgattggcacagagtagatagtcagtaaatataagttgaaagaatgaataaatgaatgatgccctatagtctagggatacgtctgatctcacatcattttgctcttatagcctaccaaaaagctaggtgggagagtttatatagattattgccctctatgtaaacacatcaaaaatatttgtaaagtccaggaagagcatttgaaaagaatgagacccaactattccttcatcacttacgatatcaggcagtttcttgattttattgatctgacaaacctcagatccttttgtttaccaagagagtagaaggtgtatgtatttctttcttggtaggccaaacataccagcaaattattgcactggaaacatggaggtggggcttggaaaaccagtgtgtatagaaattgtagtggaagttttatattacagttgtcttctttccattttatttcactctagccaagactcaattgtataaaatcagctatgataatattgtatggcaaacttcccttgcctcsttttcctttacttaaatcttcttgtgatgatttagattttttttttcagttaacatctggtttcaatccttcacattattcctgactatattatactaatttttctgaggcatggtgatgggggagagcgaggcttataaagttcagttatgcattcaagataaatttttttttttttttttttgagacggagtctcgctctgtttcacgatcttctaatcttggctcactgcagcctctgcctcctaggttccagcaattctcctgtctcagcctcctgagtagctgggattacaggcacatgccaccatgcctgtctaatttttgtatttttagtagagatggggtttcaccatgttggccaggctggtcctgaactcctgacctcaggagattgtagtggaaggctggcctctgcctcccaaagtgctgggattacaggcatgagccaccgcacgcgacctcaagataaattcttaatgaaaatttttaaaatactcttttataacattatttcagtacttgacagtctttcactagttgctgatcctttcttctgatattttgggagacaggtattaggcaaaggttaacatttgtgatgatggtggggattggcacctactattaatacaaatatttctcttttatatttaactaaatagagtttcactaaatgagatccactgtgaatccatgaagcccaaagatacttttggtggaagacttgttgacatgatcagaatagtttaaacttgaggaagagacacttatttccagataaaaccatcaaacatatatgaatgtgcacacctgtgtgtatgtgttagtgttatgacaataatcagggcatagaaagaaccatgttaatagagatgatgtatagtacttatcaggagaaaacatgggagaaggtcgataataaataagaatagttacctgggagaacacaaattaaatataatcacagatatactaataaatcatgaatgttttttatttctgtgttttcgactatttaacctttaattatttactcatgaatggaattttgaatgttcacaaaataattttaataaaagaggtagagaaatacacatatagtgaatgcacactcttgcatggaaatcagaagcttaaggaaagaataataacagagagcatttggatggaggaaagagaagtaagagaagagatattgtcacacagcttaatacttcagtaactttactggtccagatttaaaaaactattacagtaacagatgacacattctaaaaattttaagaaaccttctcttagaagtggaataacagccaggtgtggtggtgcgygcctgtggtcccagctacttgagaggctgagtgggaggattgcttgggcctgggaggtggaggttgcagtggtgagctgtgatcacgccactggcactccagcttgggcaacagagtgaccckgcctccaaaaaaaaaaaaaagtggaataacatgacttttcaccttaactctttggcaattatatatcttggcatattgaggaaacaatgaaagaagcaaatctgaccacttggtgatatggagtgctagaaagtctgggcaggcctatctttaacgtttgtattgggaagtgtgagggtacagacggaggcctgcacaccatatgcctatgtgtataagttacaattctatgtaataggctgctaaagtaggctctactcgccaatctttctactttgagaaatataccttcaaataacccagaaggcaagattggttttagaatccttgggttccttttagaaggaggtggtggaggtggagctcacctctgtgtccctgacacatggcctgttctcttctcttcccacttctggctgtcttgcacttgaggggccttgagtgcctgcaagttgacagcccagcctgtacacccaaactcaatctgcactcattggcaaacagctgccttttggctacctctcaggtatagggttgggcacattgaatggttcagtcttggaaggatggattccacgaagaggccaacataggcactggaagtgggtttgcactcgttgagcagggagttgagacactggctaccctgggtaggataggatagaatagatgtgggctctgggtgggtgcatcatcttggccccatggacacttccaaagcatgaggatagggggtggggaagcttttgcccagggttatagagaaagtggccatttatttgggtgataatcccaaataagataatgttagacatgcctcctagactttaagagaagtaaatttcaacaatttcagattaacacgaaatatgattccaagggactatatatgacataaaaggaatgtgataaattaaacatgaagaaagaagatgcatagttggtagggcctgggctttactacattttctttcactggaacctaagattgtggctgatgtgtttaagtcctccataaatagttgttgaacaacaacataaacaaccccaaactccaatgtatctgtgtaggggtacaaatttgaaagaatatgaattaaagatgagaagagggacatatgtagtttggatatttgtccccacccaagtttcatgtagaattgtgattcccagtgttggaggtggggtctggtgtggagtgattggactttgggggcggatttctcatgatggcttagcaccagcctcttggtgttgtcctcatgatagtgagtgagttcttgagagatctggctgtttaaaagtgtgtggcacctctctctctttctctcttgctcctgttctcaccatgtgagatgcttgctccccaccttgccttctgccatgagtaaaagctccctgaggcctccctagaagctgagcagatgccagcaccatgctttctgtatagcctgcagaaccatgagccaattaaatatcttttctttataaattacccaatctcaggtatttcttatagcaatacaagaatagcttaatacagggacacctgactgaaggcaaataaaagagaatggcagaaactaggaaaagtaaagttgggaaggctaaagcacttctcatttgctaggtctggcaggacatgctgaaggtaagaaaaacaaaaacaggaaggaatagatcctctacattagtcacatgataagggattaatagatgacttatgatacatctaaactatgatgtcaaattggcaagggtggaacaaagattaagggaattgaattgagtagaaaaacaaaaatgttataattcgtattaaatatataaatccatatgttctggtattatgtatgatatctctggaactataagagtaagtgcccaaagtagttgcctctgggagggaaattaggtggtaggaagacagggatgagagagagagagacttggtttcactatatacattattaaaccttgtattacctaataaaatgtttaattaattaaacaataattgaaactctagatgatgaaagtaaagaagatagcctagtctctttaaattagttgaagtacatacatccaaaaggagtatatccctgaaccctaaaatgatctttagatgtgataacagaaactttcttgggaatccctgagaaatggtagacctgccagaaagcagagtgctctggagtgaatgtttgtatcttccccacctgccactgcaaatccatgtgttgaaatcctaactcccagggtgatgatattagaatggtggagcctttgggagctaattaggccatgagtgtatagtcctcatcaataggattagtgtccttataagaagagacatgatgtgttctgctatctgccatgcgaagatacagagagaaggcagccatctgcagaccagaaagctggccctcaccagacaccagatgggccagtaccttgaactaggacttcccagcctccagaactgtgagaagtaaatgtttgtcgtttaagccacccagtctatgatatatttgttatagcaccatgaactaatacatagagaagagcaaatattcttattttcaacataggtaaaaagatgatctctttaattagactggacatctaggtgccaatctgtaggaaaactaaaaacctaatttgtaaataaagggcagtaattactagcagtcagcatgaattcttcacgaacaagtcatgccaaactataaatatatattttttgagctcttaaacaggaaggtgtagaaagggtgtttctatttcattaaaacattgggaaaagcctcttcatgatatatctatatttttgacgaaatgaaaaaggtagattatttcacacaacagtgtttaataatattgaaaatcatgtctaaagtgtttattaattgatcattacatatctggaaagagatttgtaacagtatcaaaattaggttttatgtctggccttcacctgtttaatgacttaatagggaattctagaattcatactggacaaattaatggataaacagggaaatgggagggggtgttaatgtgttgggttctcccaaaccaatttttgactagcaggaataaaagtccatattctacaggataaggtgttaggaagacaaaataaaattctgcatttaggagtaaataaaaatcatttgtttaaagatgtgatgagagacttgagtttgcaataatctttgaaataaaaaagacttaaacattttagttgaaaagtgagtataaagttagactaattaggtaagtatgatgactgtgtcatggartttaataagcttaaaggagaatcagccatcaccttacaaactaattgtgttacaaaagttaatctttttttttttaaattaaatatttgatattagggaattttctataggaaccacattacagatggttaggtttccaagccatcccacaagaacatgacaacttatstaaaagaattgtagttttactaagaggagcctgagctctagagtgggtggtgaagagtggggaggcagtgggggagkgggtggtggttatgtgttactgtagggaggagaagtaggtgccaaatgttttctgtttaatatttgtgagggaatggcaacccttaggcaaattttggaaatgaatagttttccactggcctctctgtgcatctctctgatcttccatcatccctctcctttgctgccagggcacgatgaaaacacaacgtggttcgtgctgtaatagagacgtgcacagggtgtcaaatggcaagcaatgagctagttcatactaatgtgtgactgaatgtgtgcaccccatgacctctcagaattaactgcatttagaaatgaaatgtgtgttaaaccaaatgaacttaaaattgatataaaatgataaaagttcagtttccagcagggaataaagtggaatgaagaaaattgagtcattgcagacaaagatagtttggggagaagggaaggatccatatggttgggtttgccctgccttggtgtctttctctggagacatctatcaccactgtcaagagatttgttctccttcctttrattctgaaaactggaattttgttatagtctctctccaaatctgtacttttcttactttatttataaagcgtactttttcccctttattaagccatctcttttggataaaagtttaaaagtggcaggtttcaactcaacgagcatctaatggtatagtaagcttctcatcatttctattcatccaagcccagtgtgttggtgaaatgaaggttgtgtagaaggtattcttgaatcgtttgggaggtactgcctaactcctaagattttatagattacaaaatgcaaatgccggccagggtggtggctcacgcctgtaatcctagcactttgggagggtgaggcgggcggatcacctgaggtcaggagttcaagaccagcgtgaccaacatggagaaaccctgtctctactaaacatacaaaattagccaggcgtggaggtgcatgcctgtaatcccagctacttgggaggctgaggcaggagaatcacttgaacttgggaggcggaggttgtggtgagccgagatcaggccattgtactccagcctgggcaacaagagcaaaactcagtctcaaaaataaaacaaaataaaatgcaaatgcctcagaatgtaatacttacaacctagtaggatttttgttttggatttgcgttgtggtattgctatatctacaaatttgtcagattttgactttgcttcaatttcatttgcaaaattatgcagttttctgcctatgatagccctaatttccaatcagtcaggaatactgaccaggacatacaaaagagcaggaagactttttaaaaataagaaatagcatttatttaaagattaataattatatgaagccaagttctttaaggatttattttttttaagtaatttttaccatggaaaaatgaacttttgaaaaacttttacttaatttgtgttaaagacatgaacacagacttaaaagatactttggctaaattaggttgtcttttatctcttggctaaaaagcactccttttagaaagctccttctaggttgaaaaattcttctagaaggatttacatatgatatggataatttttgctctccttaattttttrtcttccttactttcaatttctggtggccatgtagctttggaaaccagtcgtgaatttcacggtgaaaatgacatgtttttaaaggctgcgaaggttcaccaaattttattttagttcacaacagtctcctctacttttgtccttcagatgaaagaacaaagcaatggcagaaatcttgacttgatttttatgtaggatagtacctgtcgtagaggagtaacaaataaattcttttgtgagcacttatttgatagaaccctaaggctatacactgaaggacatatcctrttgcacagattggctctgggctatgcagaaaggtcaccacaggaataggctatctgtcaatttagatttccctgtgttagaaggaatcaaagtggtaggtgaaatgattgaaaaagcaaaatcaaaaccaaaccaaactaaaacatttcagttctagaaatgcatttgagagaaaccatttggcaatagtgtttggagcctttcttgaagcgtgtctcttacattgcagctgaatcgctgagaaaagagaccatgtttctacttttagaaggagaatgaaatcaacgcaaaggagagagaaacaaggtaaaacagggctaaattgtagggctttgactttatatgttgatgtatcatatgccaataacagtaatttgaaactttgatttgagaagaaactcaagtaatatcttttcacttaatagaatttgaataattattttttcaaggcaaaatctttcaaaaagtaaaggaattgtagccaccctgtaartggcttgtgatagagttaagcacagactaggaacaaggacacacttggcaggtttgaaggggcaaatggggccctgggcaggccatttgggttattttcaataagagaaagagaactatctagaaatgtgctacatttcaggaagtgtgctctctctttgcaatcaacgatgccagtgggtttcatctaaaattcttaacacttactgtagtttttagtagattaataaataatatattatagctatttgaaaatatggctagagtttttgaacgttaatccgactatgacatgccacatatggtcatttggtataaatgtatattgttaggcaaaaatctcactgaattgatttttaaggataacgttaatgccttagagaatggcttgcaattcttttttttcttcttattttgtcttgaccaaatatcaatgccttctcaggggcttctctctttttacaacaactgtgcaatttgtattagtttcttttcctgtccaagaaggtaaattgcctttaaccttctccaatcaaaaccctcaaataaacaatctctaaatcaagtaaggacatatctttacttgttcccatgtctttcaaaggtttacttgttccttgtctaagtcatcattaacaagaagaagcaaaatatgggcataggctgcctcagtgctgtgatttcacagaagccaaaggacttgaatgctgtaagatgtgtcttacctttctgatcacttaagactactgatcaaatacaaacccaccccggatgagttgttaatttaatcatgaacatacttgtgtagattaatttgttacaggacctaagcccaggcagcatgacctcagggaacagttggggaatatcttctttctctgaaggtagaytttgtagcctggtcctctgagggctatggttgatatcaggaagaggtgctgaatacaagttttacctattccatgatttcataagtgttcttctttagaaaacagttttctttattaataagcatccttttgtgtttgtgcacaggcagcatgtcagctgaaacaccaatcacattgaatatygatcctcaggatctgcaggtccaaacattcaccgtggagaagctactggagcctctcataatccaggtattaataccatggaaattatgatatatagtaactgcagaagaatgaaaaatatgtgggaaaaatgaataatgaagaataaaagatttgatttttatatataaatatgtcatctaaaattgtcctttaaagagttgttaagatgtgaaaagtaggtatgtgtgttgttaagatgtgaaaaagtatgtattctgaaagtttcccccacattctcttttagcaagaatagcagtaataatatatatatatatatatatatatatataattttcagagtacctttatataaattatcttctttgataatcgtgaaaactgaatgaggcaggtaacatggttaaaaccatctttattacatagatgaggaaactgaggcctagagaatttcactaacttgcctcaggcacatggcatctcatttgccaaatgggaaactacctttaaaatactaaaatgtatgagaaaagcagctatttaaaggaattctgtgatgaagtctttcataaggtgaataatcctttgatgatatgcataatgattctctgactttttttattatgtaagtcgagatttcatgtattggattttcttagagcagggcttgaagaaacttatgcagtggtatagatttaaatttttgtcattaacccacaatttgtgagggaactcccctttaggcctgccttacatcttgcctcctaatacaagattcaagtcccttttcctagggactcaaagaacccaagggttacttgggtgaaaaactatgccgacctttcctcagataatttaaatatgttctgcttatcttttttgtgagatggatgtggggaggggagtagctctgagaatagactttgtatatatttttacaagtttacatatttttatcaatttgtacatgttgtacaagttgatatctgctactcgaaagacaattcaaaacatgtgcatccctgatgataccttaatagttaactttggcagtcttaacggcactaatatctggtgtgaaatttatactagatgactgtggagacttcattaaagtccgtcttagccactcactaaacagtttcatgttaaaaagaaaaaaggctgggtgcagtggctcatgtgtataatcccagcactttgggaggccaaggcaggaggatcgcttaagtccaggagttaaagaccagcctgggcaacatagtgagaccctgtttaaaaaaaaaaaaaaagaaagaaaaaccctcatttgtttttctaatgaagttcacaaaaaaattggaatgtcaaaaaaagttaaaaaaaagaataaaaacactcataattttaccaagagataaacattaatgttttggtgcgtttacttccagtacaataaagttgtgggagatttttatcatctttgtactttgtaatattaaagaatatatcttctttatatatatccttacaygtatatatattatatatatatatatgaagaatatatatatattaacaagtggagctagtactatatatgcagggtttaatcccacttttccattttaaatgatattttaataatttccctatttatttgtaagcatggtttaataaagctgctatttacttatatatgatatggctgcactacagtttttttaaagtagcctcacatttttggacatttagggtgtttctatttttttcctattataaatattgctctgctgaacatctttgtatatacatttttgtcatcaatttgtattatttcactagaattagttacaaatgtaaaagttaatggccaagatatgaatatttttatactttttcatacatatcaccaagttttttggggacagttttaaatgagttctcacaagtcatttaaggttttgttcctatccaattataaggagtaggaatagggaaatgaccttcatttcggagatggctggtgaaaacaaatacattaatgctagtttataacccttatttgctctataacaatggaacattacagttggtcacttaaaacttgctaatcacaaaggttgctgacatattgcttataaacagagagagtatcatggggaaactactttttatattctaactgaaactaatagatattttgctttagtcaagtacattgctaaagaagttaatagaaagtattctaagtaaattcacattaaagggtaatgctagtcacagtgtgtgtgtgtgtgtgtgtgcgcgcacgtgcacattttatggcatgttctaaatagataataaccatctataaacatttattgagttcacctataaaattagaaggatgaaaatgacctgagtaatcttgtttgattggaaagaaatgtatctcttttaaaaagtgtgattatactagttttagagggcttttgatgttcttggattcaaacttttcatgatccacaagtagatgagtcacagaaatggaactcattaccttttacataccagacagttctgttacatgtaaatataattgctaattttgtcttccttaagattgatgtcaatgttttcaaaatagtcactgatttcttaaaagtactttggtataaaacatcaacgtctcaggtataaaaatgattttatggtcttagcaatactcaagtgatattaaattaaaatattaataatttatataatatcaacttatgcaataactatcttataaagcagaattctatttaactaaattatttgtatacactcttgtttttttaataatgggattctccttatcaaaaaccagtacatttcaaagtcaaagagttatattttaaaataactgatctttctggatttgatgttcagccttcttgtatctgtcactttgatcatgtataacccaccaacacaaataaaatatctcattaaattatattaaaggtttttttttctaggataacatcatgttaagtgtctcattacattcttttttgtttttcaaaaagtgtttatttttatttttttagataagaatagctgtttaaaatttacaagaaaaaacaaacaactccatcaaaaagcggacgaaggataggaacagacacttctcaaaagaagacatttatgtggccaacaaacatatgaaaaaaagctcatcatcactggtcattagagaaatgcaaatcaaaaccacaatgagataccatctcacgccagttagaatggtgatcattaaaaagtcaggaaacaacagatgctggagaggacatggagaaataggaatgcttttacactgttggtgggagtgtaaattagttcaaccattgtggaaggcaatgtggcaattcctcaaggatctagaaccagaaataccatttgacccagccatcttgttactgggtatatatccaaaggattataaatcattctactataaatacacatgcacacgtatgtttatgggagcactattcacaatagcaaagacttggaaccaacccagatgcccatcaatgatagactggataaagaaaatgtggcacatatacaccattgaatactatgcagccataaaaaaggatgagttcatgtcctttgcagggacatggatgaagctggaaaccatcattttcagcaaactaacacaagaagagaaaaccaagcgccacatattctcactcataagtggaagttgaacaatgagaacacatggacacagggaggggaacatcacatactggggcctgttgggaggtgggggctaggggagggatagcattaggagaaatacctaatgtagatgatgggttgatggatgcagcaaaccaccatggcatgtgtatacctatgtaacaaacctgcacgttctgcatatgtatcccagaacttaaggtataataaaagaaaaaaaaagagtaacctgtttatttgaaaagactaagtagacctcagtatttatttttcatcaacttttattttaagttcaggagtacatgtgcaggatgtgcaggtttgttacataggtaaacacgtgccatggtggttggctgcacagatcatcccatcacctaggtattaagcccagcgtccattagctattcttcctgatgctctccctcctcccacccctgctgacagaccccagtgtgttccccccatgagtccatgtgttctcatccttcagctcccacttataagtgagaacatgtggtgtttggttttctgttcctgcattagtttgctgaggataatgacttccaactccatccatgtccctacaaaggacgtgaacttgttcttttttatgactgcatagtattccatggtatatatgtaccacattttctttatccagtctatcactgatgggcgtttaggttgattccatgtctttgctattgtgaatagtgctgcagtgaacatgcatgtgcatgtatctttataatggaatgatatatattcctttgggtatatacccagtaatgggattgctgagtcaaatggtatttctgcatctaggtctttgagaaatcgccacgctgtcttccacaatgtttgaactaatttacatacccaccaacaatgtaaaagcattcctttttctctgcaaccttgtcagcatctgttgttttttgactttttaataagcattctgacaatgagatggtagctcattgtcattttgatttgcatttctccgatgatcagtgatgttgaactttttttttttgagacagagtcttgctctgtcacccaggctggagtgcagtggcatgatctcagctcactgcaacctctacctgctgggtttcagtgattctcctgcatcagcttcctggtagctggatttacaggcacatgccaccatacccggttaatttttgtattcttagtagacacggggtttcaccatgttggctaggctggtctcgaactcctgacctcaggtgatccacctgcctcagtctcccaaagtgctgggattgcaggcatgagccaccgcacccagctgataaactttttttcatgtttattggccgcatgtatgtcttcttttgagaagtgtctgttcatgtcttttgcccactttttaatgttttttttttcttgtaaatttgtttaagttccttgtagactctggatattagacctttgccagatgaatagattgcaaaaattttctcccattctgtaggttgtctgttcactctgatgataatttcttttgctgtgaggaaactctttagtttaattagaacccatttgtctgtttttgcttttgctgcaattgcttttggcattttcatcatgaaatctttgcctttgcctatgtcctgaatgctattgcctcaattttcttctagggtttttatagttttgggttttacatttaaatatttaatccatcttgggttttttaattattattattgtttttttatttgctttaagttttagagtacatgtgcacaatgtgcaggtttgttacatatgtatacatgtgccatgttggtgtgctgcacccattaacttgtcatttacattaggtatacctcctaatgctatcactccccgctcccggctaccccacgacaggcccaggtgtgtgatgttccccttcctgtgtccaagtgttctcattgttcaattcccacctatgagtgagaacacgtggtgtttggttttttgtccttgcgatagtttgctgagaatgatggtttccagcttcatccatgtccctacaaaggacatgaactcatcattttttatggctgcatactattccatggtgtatatgtgccacattttcttaatccagtctatcattgttggacatttgggttggttccaagtctttgctattgtgaatagtgctgcagtaaacatacgtgtgcatgtgtctttatagtagcatgatttataatcctttgggtatatacccagtaatgggatggctgggtcaaatggtatttctagttctagacccctgaggaatcaccacactgacctccacaatggttgaagtagtttacagtcccaccaatagtgtaaaagtgttcctatttctccacatcctctctagcacctgttttttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgttttttttcttgtaaatttgttggagttctttgcagattctggatattagccctttgtcagatgactagattgcaaaaattttctcccattctgtaggttgcctattcactctgatggtagtttcttttgctgtgcggaagctctttagtttaattagatcccatttgtcaattttggcttttgttgccattgcttttggtgttttagacatgaagtccttgcccatgcctatgtcctgaatggtattgcctaggttttcttctagggtttttatggttttgggtctaacatttaagtctttaatccttcttgaattaatttttgtataaggtgtaaggaagggatccagtttcagctttctatatatggctagccagttttcccagcaccatttattaaatagggaatcgtttccccatttcttgtttttgtcaggtttgtcaaagatcagatggttgtacttgtgtggcattatttctgagggctctgttctgttccattggtcgatatctctgttttggtaccagtaccatgctgttttggttactgtagtcttgtagtatagtttgaagtcaggtagtgtgatgcctccagctttgttcttttggcttaggattgacttggcaatgcaggctcttttttggttccatatgaactttaaagtagtttttcccaattctgtgaagaaagtcattggtagcttgatggggatggcattgaatatataaattaccttgggcagtatggccattttcatgatattgattcttcctatccatgagcatggaatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtttgttattggtgtataagaatgcttgtgatttttgcacattgattttgtatcctgagactttgctgtagttgcttatgagcttaaggatattttgggctgagacaatggggttttctagatatacaatcatgccatctgcaaacagggacagtttgacttcctgttttcctaattgaataccctttatttccttctgcctgattgccctggccagaacttccaacactatgttgaataggagtggtgagagagggcatccctgacttgtgccagttttcaaatggaattcttccagtttttgcccattcagtatgatattggctgtcggttggtcataaatagctcttattatgttgagatatgtcccatcaatacgtaatttattgagagtttttagcatgaagggctgttgaattttgtgaaaggccttttctgcatctattgagataatcatgtggtttttgtcgttggttctgtttatatgctgaattacatttattgatttgtgtatgttgaaccagccttgcatcccagggatgaagcccactagatcatggtggataaggtttttgatgtgttgctggattcggtttgccagtattttattgaggatttttgcatcgatgttcatgagagatattggtctaaaattctctttgtttgttatgtctctgccaggctttggtatcaggatgatgctggcctcataaaatgagttagggaggattccctctttttctgttgattggaatagtttcagaaggaatggtaccagctcctcctcatacctctggtagaattcggctgtgaatctgtctggtcctggactttttttggttggtaagctattaattattgcctcaatttcagggccttttattggtctattcagagattcaacttcttcctggtttagtcttgggagggtgtatgtgtcgaggaatttatccatttctttgagattttctagtttatttgcatacaggtgtttatagtattctctgatggtagtttgtatttctgtgggattggcggtgatatcccctttatcattttttattgggtctatttgattcttctttttcttctttattagtcttgctagcagtctattaattttgttgaccttttcaaaaaaccagctcctggattcattaattttttgaagggttttttatgtgtctatttccttcagttctgctctgatcttacttatttcttgctttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcgcagagattctggtatgttgtatcttgttctcattggtttcaaagaacatctttatttctgccttcattttgttatgtacccagtagtcattcaggagcaggttgttcagtttccatgtagttgagtggttttgagtgagtttcttaatcctgagttctagtttgattgcactgtggtctgagagacagtttgttatgatttctgttcttttacatttgctgaggagtgctttacttccaactatgtggtcaattttgtaataagtgcagtgcggtgctgagaagaatgtatattctgttgatttggggtggagagctctgtagatgtctattaggtcctcttggtgcagagctgagttcaattcctggatatccttgttaactttctgtctcactgatctgtctaatgttgacagtggggtgttaaagtctcccattattattgtgtgggagtctaagtctctttataggtctctaaggacttgctttatgaatctgggtgctcctgtattgggtgcatatatatttagaaagctcttcttgttgaattgatccctttaccattatgtaatggccttctttgtctgttttgatctttgttggtttaaagtctgtcttatcagagactaggattgcaacccctgcctttttttgttttccatttgcttggtagatcttcctccatccctttattttgagcctatgtgtgtctctgcacgtgagatgggtttcctgaatgcagcacactgatgggtcttgactctttatccaatttgccagtctgtgtcttttaattggagtgtttagcccatttacatttaaggttaatattgttatgtgtgaatttgatcctgtcattatgatgttagctggttattttgctcattagttgatgcagttacttcctagccttgatggtctttacaatttggcatgtttttgcagtggctggtaccagttgttccttcccatgtttagtgcttccttcaggagctcttttaggcaggcctgttggtgacaaaatctctcagcatttgcttgtctgtaaagtgttttatttctccttcacttatgaagtttagtttggctggatatgaaattctgggttaaaaattcttttctttaagaatgttgaatattggcccccactctcttctggcttgtagagtttctgccgagagatcagctattagtctgatgggcttccctttgtgggtaacccgacctttctctctggctgcccttaccattttttccttcatttcaactttggtgaatctgacaattatgtgtcttggagttgctcttcctgaggaatatctttgtggtattctctgtatttcctgaatttgaatgttggcctgccttgctagattggggaagttcttctggataatatcctgcagagtgttttccaacttggttccattctgcccgtcactttcaggtacacgaatcagacatagatatggtcttttcacatagtctgatatttcttggaggctttgttcatttctttttattcttttttctctaaacttctcttcttgcttcatttcattcatttgatgttccatcactgataccctttcttccagttgatcgaatcagctgccgaagcttgtgcattcgtcacgtagttctagtgtcatggttttcagctccatcaggtcctttaagaacttctctgcgttgggtattctagttagccattcgtttaatcttttttcaaggtttttaacttctttgccatgggttcgaacttcctcctttagctcggagaagtttgatcatctgaagtcttcttctctcaactcatcaaagtcattctccatgcagctttgttacgttgctagtgaggagctgcattcctttggagtaggagaggtgctctgatttttagaattttcagtttttctgctctgttttttccccatctttgtggttttatctacctttggtctttgawgatggtgacgtacagatggggttttsgtgtggatgtcctttccgtttattagttttccttctaacattcaggaccctcagctgcaggtctgttggagtttgctggaggtccactccagaccttgttttcctgggtatcagcagtggagtctgcagaacagcgaatattggtgaacagcaaatgttgctgcctgatctttcctctgggttactttttrtatatggtgtaaggtaggggtccagtttcaattttctgcatgtggctagccagttctcccagcactatttattaaataggaaatcttttccccattgcttgttwttgycaggtttgtcgaagatcagatggttgtaggtttgtggtcttatttctgagttccctattctgttccattggtctacgtgtctgtttttataccagtaccatgctgttttggttactgtagccctgtagtatagtttgaatttgggtagtgtgaagcctccagctttgttctttttgcttaggattgtcttggctatttgagctgttttttggttccaaatacattttaaaatagttttttttctaattctgtgaagaatgtcagtggtagtttaataggaatagcagtgaatctataaattgctttgggcagtatggccattctaacgacattgattcttcctatccatgaggatggaatgattttccgtttgtttgtgtcctctctgatttctttgagcagtgatttgtagttctccttgaagaaggctttcacttcccttgttagctgtgttcttagatcttttattatttttgtagcaatcataattgggagttcattcatgatttggctctctgattgcctattgttcatgtataggaatgctagcaatttttgcacggtgattttatatcctgagactttgctgaagttgcttatcagcttaaggagcttttgggctgatacaatgggctttttctagatataggatcatgtcatctgcaaataaagataatttgactttctctcttcctgcttggatactctttatttctttttcttggccttattgtcctggccagaacttttgatactatgttgaataggagtggtaagagagggcatccttgtcttgtgcgttttcaaggggaatgcttccagcttttgcccatttagtatgatattggctgtgggtttgtcatagatggttatttttttgaggtatattccttcaatacctagtttattgagagtttttaacatgaagggatgttgaattttattgatgtccttttctacgtctattgagataatcatgtggtttttgtctttagttctgtttatgtgatgagtcacatttgttgatttgcatatgttgaaccaaccttgcatcccagggatgaagacaactcgatcatggtggataatttttttgatgttctcttcgattcagtttgccagtatattattgaagatttttgtatcgatgttcatcaaagattttggcctgaagttttatttgtttggttgtatctctgccagattttatcaggatgatgctggcctcatagaatgagttagagaggagtcccttcttttcaattttttgaatagttttagtagaaatgataccagtcctttttgtacctctggtagaattcakctataaatccttctggtcatgggccttttttttggttggtaggctatttattgctgcctcaatttcagaactcattattggtctattcaggcattcagttttttcctggttcagtcttgggagggtgtatgtgtccaggagtttatccatttcttctagattttctagtttatgtgcatagaggtgattatagtattctctgtggtgaatgagaagaatatatattctgttgtttttgggtggagagttctgtagatatctattaggtctacttgatccagagctgagttcaggtcctgaatatctttgttaattttctgtcttgatgatctgtctaatattgtcagtggggtatttaaatttcccaatctaagtatctttataggtttctaaggacttgctttgtgcatctgggtgctcccatattgtgtgtatgtatataggatagttagcttttcttgtcagtttgaaccctttatcattatgtaatgcccttctttgtcttttttgatctttgttgttctaaagtctattttgtcagaaactaggattgcaacctctgctttttttctgttttccatttgcttggtaaattttcctccatccctttattttgagctgatgtgtgtctttgcatgtgagatgggtcacttgaagacagcactgtgatgggtcttggctctttatccaacttgtcattctgtgtcttttaattggaacatttagcccatttacatttaaggttaatcttgttgtgtgaatctgatcttatcatcatgatgctagctggttattttgcagacttgtttatgtagttgcttaatagtgtcactggtctgtgtacttcagtgtgttttttagtggctgataatgctttttcttttccatatttagtgcttcctttaggagctcttgcaaggcagactgaatggtgacaaattccctcagcatttgcctgtctgaaaaggatcttatttcttcttcatttatgaagcttagtatggccagatatgaaattctgggttggaatttttttctttaagaatgttaaatattggcccccaatctcttctgccttgtagggtttccactgagtggtctgctgttagtctgatgggcttccctttgtaggtgacctggcctttctttctggctacacttgacattttttctttcattttaaccttgaagaatctgacgattatttgtcttggggttgatcttctcatggagcatcttactggggttctctgcattccctgaatttatatgttggcctgttttgctaggttggggaagttctcctggatgatatcctgaactgtgttttccaacttggttccatcctccctgtctctttcaggtactccaatcagtcataggtttggtctttttatgtattcctgtagttctcagaggttttgttttttccttttcactcttttttctctaatcttgtcttcctgctctatttcagcaagatagtcttcaagctcacttttaatggggtttttatggggtcttttttgttggtgttgtgttgttttctgtttgtttttcttttaacagtcaggtcactcttctgttgggctgctgtggtttgctgggggtccactccagaccctagttgcctcagttttccttacctggaagtatcaccagtgaaggctgtgaaacaacaaagacagcagcctgctccttcttctggaagctctgtcccagtgggggtactgacatgttgctgttcctaatgtgcctgtaggaagtgtctgtagactcctgttgggagggctcacttggtcaggaggaatgggatcagaagcagtctggatgctttctggtggagcagatatgctgcgttggggcggggagtgrgggatccttcttcatctggaccgtttgtattctccaaagctggcaggctagaatggctgagtccactgaaccacagagatggtgtggcaacccctcctcctgagagctccatcccagggagagatcagggctttgtctgtagagcccttgctggggtggctgaaacccccacagggaggtcccaccctgtgaggaggaatggattggggtcctacttaaagaatcagtctggctataatctggcaaggcagctgtgctattgtcggggacccttctttgtctggaccatttgtattctccaaagccatcaggctggaatggctgagtcgactgaaccatggagatggtggccgcccctcccgcaaggaacttggtctcatctcagcctgttgccattggctggctggaattccaatcagtgggtcttaacttgtggggtgctgtgggagcaggcctgcagaatgacgctgtttggctccctggttttagcccccttcctagggatatatacggacagatctctcgtcttgccagggatcctggggctggagtgtggaaaactcctgggtctctgtgtgtgcctggacggctgctttgccaacattctacacagttctgtgtatcagacccaacgccctggtggtgtgggctcacgagaggatctcctgatccacggattacaaagatccgtgggaaaagcgtggttttccaggtggggtctcacaatcacttactgctttacttggctcagggtgggggttcatttggctccgtgctgctcccaggtggaccatcgccccaccctgcttttctttgttcttcgtgggtcaaattgtttgcctagtcagccctaatgcaagaacctggatacttcagttgaaggtgctgaattcacttgctcctttccttcctctctgagtgcgcagacsgcagctgcttctaattgtccatcttggtgccggcagcgaggttggggctccaaatctagccgccgccatctaccccaggggaggaggagaaggagtgttttttttttttaatatatttaatggacaggtaatgaggcaaataaaaattctgtacattcagggtgtacgatgtgatgatttgatgtatgtatgcaatgtgtaatgattaccacagtcaaatgaattaacacatccatctctacccatagttaccactgtgtgtgtgtgtgtgtgtgtgtgtgtgtgtgtgtgtgtggctaasacacttaaaatctactttcttatcaaatttcaagtaaagaatacaatatgttaactatagtcaccatgctacacagtagagtcccaaaacttattcatcttaaaactgaaattttatatcctttgatcaacaatcttccccatttccccaattcgctagcacctggaaaccacccttttaccctctgcttctttgaatttaacttttttagatttcacatataagtgagatcatacagtatttgcctttctgtgtctggcttattccatttagcataatgtcctccaggttcatccatgttagaaaatggcaggatttacttttttttatgactgaatagtattcgattgcataaacaccacattttctttattcattcatctgtagatggttgttcccatattttggctactgttacaaagagtgtttaatttgaaatagttacatggtttaagtacatgatatagtctctgatttcactggaaaacattccaaaagaagttcatgtctttaagttcacattgccaccagctaaagttattaattcagtagtcccattaaaaatttcttcactttcctcatgatttatcttcatgttatattcctttgcttccagggttccacagaaattacttatcacctctgtatataactcaaagtcaaaattacattttaatttttggagtaattggtcatagatactattatgtcactctaacttctgaattcatttcttcataaatctttattctgctcttttatggttaccaaattcttccctaccaaacctgatttatctttaatgtattttttttttctcttgggcacagagatttttttctcttgggtcattttgcagggatatttagcctgggatatatttcaatcattcactttcagtttcttgtgtgataacttacacagttgcatccctctgtaataaattcttccaatggatcagaaataatttctcagcaattacatttttatgactgcaactgtaggcatctgcactttatcactttcaagatccaagtttggcaatgcaatgcagaaagtctatttatgcagaattgtgcttcaaagaatttacatctctatgttgtatactctctgaaggggatataaactgctagatcatgctacagtcattatataatgaaactgtctataatcttatttgctgcaaaatacagtttggtaggtgtcagatttatgttgaatgtgagttaaaagaattgacttactcaaaatcccttaaaataatagtaataacaaactctttataatgtgttatcttttgtaaagtttttttttgaagggcaaaggtcaaatgtattttctgactgtaaatatatcccatgttttcaagaagtaaatctagagttagaagaacagtaataaacattatttctttgtcgttcacctctaagtattgtaggacctcttggcctttttttcatttctacctccatagtgtctcccacctgtccccttggggatagcttttaatactcactggggcaagtttacctaccagcccctgtattagtcagcataagcaaggttgtgctgtgataagaagacaacccccaaatctcagaggcttaataaaatttatttcctgctcaagctacatgttcaatgtgagctggggtttctgcttgagacaggcactcagagacccaggctaatatagacttatctcaacatgtgcttccactgtcattgcaactggggaaatggaacatgataaatcatgcgagaactcctaaaatgttcacctggacatgacatatgtcaatcctctatttacattgcttttgtcaaagcaagttatgtggtcaaagtggatgttgggtatgtgatcctgccctgtgcccagaggacaatgggaatatttgtgaacagccttaataactattacattccctttgccttctttttagggkttccttttgttaagtctccataatgctctcaagacactttggcacccttgttacagctaactttatcagggtgggcaactgacttagtgacactcagttataggttggcaagaaccctgtgacgtgctctgccatgagagctctgcctctgggggatgattatgaattggtcccgttagcatcctctttttgaggagttgactatattctgagatttaagcagttagtacctagggttaaacagttctattaggtgcaaagctgaaagatacacagaaagtagaaacaaggggaagagttgagtcatagtgaatgtggcattttcaggtttggattcacaaactcctgctgttcaggaacaataagattacctagttgccagggttttaacagatttttttcagtttccaaactacattctattctcagaattatacttcagcctctgtgggactcattgttttcagttcccagaccactgggccatgtaggccagatgcttatccttatgtaatctgattccctggcctcctactctacccttgcaagttcaaaggaagtcccattagcagcagcaatccagagttcctgtaattgacctcacttgcttgtgctagagtggggattttcctataaaacctcttttctcttctgttcattcctgcatttccaaattttgaagtctctgaattatgactcacttgtgctyccaaaccagcgtatctgccgtgtattccagttttgtctggcttcagcttattgctggtggatggtgactgctgctggtggtactctgggaaactggaaatgaacatgccaaggtagccatgtcctagtggcttcaaagcagtgtaggggtgaaggccaaatttctcctttgccctctggaagttcgggtgaaaaatcaattgagaaaaggcagattaataggagaaaggacrtataaaatttatttcagtgtgcataacacaggggaattgtagcctttaaaaagttgttgttttttttttaactctggagaacaaaacataaaaataattagcctaaataaaaaatcataaataatcatttcagtcttttatcagttcagtcccatgtaattaattattgttctgcttgatggtagtttagcaattttatgagtccagtktttttttttattagagttctggaatttttacacagttcattgattcacttatacagtttcagagttgtcagaaacctttatttgtcagtgttattcccatgaacttctttgaagacccatacttcaggatttgggaagagctttcaagaaaaaaaaagcatcagaataaaacaattaactgtggacaatgggacttaaaatggccatggttaaataaacaattgacaaagatatttggtcttttttttgtggcctacaacaattcaacataacactcataattatgaatgacaacatataccaagatatatcatattttaagaaatctcatacagttttggaacacatactaacaagatagccatataaatataactcagaaaaaaggttaaacattatttgttatttgacagttcttcccatataatttaatatataaactaaacctgtttattatttctcttttggatacttcaggggtctttgggaaaatcccaaagttagtttgaagtcaaaaagacttactttagaatttgaaggttgattttgggaagcttgtcaagtatgtcaaacatttaaaatatttgatcaaaaattactgtgaaataaagtcattcatttagctggtgtaataaaggatttccaaaagccaaaacctttactctttgacagtttgacagagatgagacttagtttttcaaatactcaaaagacctattaagatagcatgaggcacacaaaagctgtttctcccctttttttttttttgcagtttactcaaaatgtgaaccaaagtcgtttactatttcttattgatactatatgaaaatcttgttcaaaggagaaaataaaattctagttttgtagactatttttgattttaaggctcagtttaaaaacaaatagtaaattttaaataaatttaatattaaatattaaatatttcattcaccttaattattttgaaattctctctttctcaactttctatacccatttagttttatttatatcatttttctcattttgaaacaacctttacataatctctgaactatatgaaattgctttttctcaacaaaagcacatcctcataccttataacattttacttcccttacatactccatacatagttgtttatcatatacagtagttttaattatatactaattataatagtaactcttagtaaccctagtttctactgaaaacctaggaagtaagtaattttgaactgttttatatcagtgtttgtaaatgaaaacaattttataatttttagaaagatgtttcatcagttttttgctcattaacagatacagatatatttagcttttctatgccatataagaacaagatgtcaaaattatctaaactatgcttaataattaatgttttagtattttaacttacttagaaatgactcaaacatttcatgattctctactacttaacataacatgtccttaagattttaaattattgaaaaatattttttaacagttatatttgaattattcatggaaaataaagctatttatttaggttattatgtattttttttgaaaaagcaaaaccagcatcagctaattttatcttaactaaggcctttgagatactggacacaggtccctccccattgtccctactctagttgtcctgggttctgagtacccatgtggcacccaggatgactacgaagggtaggacctgtctgaatcctggatttgcacacctaatatagggcccagggcagaggacggacttgtgaagacaatgttgggaggatctgacccctctcagcatgaccaggaggcagagctggaccagggaggatggggccatattgggcttggctcaacaagccacagtaggatgtgtgtaagacttttgggagcccagcagccagcacttacagttttagtttatatacaaatcaagaaaatatcaagaatatcatagaaacaacagttttatgaccttaaaacatctaacagaggtagcataaacctgtgtgaccagtagacctaggcaaaaatgtctaaattaaattttgaagacatttttattttactagcaattttaaaactagctttatttaccaaagatttattaaagtcaagggaacttgaaaagttttgggctagttatataatttatgagtactcatttatttttaagtcaatttgatatcatgtagataatatgcaaacacatgtatagacacatacatgtagacacaacatacaacacacacgtatacatgtatgtatacaaaagtcaaatagatgagggagtttaatgcaaaaaagagtagagatttcagacctgagaggaacccattcacgacttttgagtctccatgaggaaaacagagaaccccaaaacagggagtcagtggtacctttttgttgtggttctcaagaggcttcagggtcactcaaagtcccatctagatcccttcatgtgtatcagacgtagagaaaggaaggagaagtaaactttatttttttaaaactttatttatctgaacttcagttttttttcttttaaaccaaaggtaactaccaagtgattcagaaccaaaaaagccatttatgatttaaccaagggagcacaagacatctccaaagaggtacaaagaagcagtcttcacaaaatccagagccaccccacaaagacctctggaagaaaatagagacttagtgatgaacaggaacataactgtccatggaagggaaaaagatcaatgacaaatgggtaccccaaaaagtcaagggtcacacaaatataaattcaaaataagtaattcaaacttcttttttttttttttttgagacagggttttgctctgttgcccaggctaaagtgaagtggtgtaatcatggctcatagcagccttgatctctgggctcaagccatcctcctgtctcagtctcctgagtatttgagactacagatgcatgccaccacacctggctaattttttaaattaattttttgtagagaagggatctgtttcaggctagtctcaaactcctgggctccagcgatcctcctgcctcagcctctcaaagtgctgggattacaggcataagccaccgtgcctgaccctcaaactaatttttataaatgtttcctttttcccctgagttaaaggatttacatctccaaggggctggttccctgactagaaatcaaacctgagttgaggcaatgaaacagtggaatcctagccattagaccataggccagagtgctttttgcagatcctagatggatccaaagcaggcaattgagtgtacaggattttaagtttcctttgaatattatttctgctttaaaaatcttactaagagaatttctaaggctatattcctttaatatttttaaaaataggtacgaataagatagctgtttaagacaagcactctctaaaaagttttcttttaagtatagccaatttatttattccataaatgactcaagttaatgagccattttcatggagtctcagaggtagctttccaggtttagactatcatggacagtataagtggcagtataaaaatgggaagatgatgtagttctcatgatcccctcaaaattcactttcagaaaaagtctaatatagcaaaggacacttgtgacagatggttgaggaggtgtttgttcatatggtgcctccagtattgaggagggaggggcaccagtcatagatctgttaatctgtgacactgagtaggtcctcctgggattggactttccaggactatccaggcaacaagagttaggacaacaaaagccccttatggatgggatttcttatttaagaaaaactttgctgagagcttggcacatttggaacagagtgtgctgcttaatatcttaggtacctccgggttcctagtccttttaggctggccaccagacgtggcccaaaaatcatgcccactggatggcagagaccaagagatagggctcctacgtggtcaaaagtcaagctctcaaggacataaaacaagagggactcttcacagaaagacagagacaaaggaaaaaataaagactacttctgtgaggaaaaggatggacaatatgaatattcatagcaaaaatataccagagtcattacatctaagactagtcatacaaatgcttttctcccattaatcttaaatttggaaagaaaaaagagacaaactgatttttctcgtctgcttgaccagattatgcagagagagagactgggagtctgactggtaagaatttcttatcattctgttcacctatcaggtcctgtgttcctttgactgcagcttctagaggagcagagcagttttggttatcccaccaacaatgccaaatctgtaaggtcaaagggattgcttcctctttgccctctgaagttttgctgaaaaatcaactgacaagaggcagattaacaggagaaaagacacacaaaatttatttcaatgtgcataacacaggggaatagtaggagaatgattacctcataacccaacgggtacagaagcttatataccctttttcatagaggaggggagataggggaaatgtgtcaacttggggtgtagtaaatgatttttaggggaaattcagtggacttggagaacatacagtggcctgggacaaagtttgttgggcccgcagagcatgatttttgacaaacgtctgtccaggtgtgttgacagacttcagtctacctgcctgtgattagagttattattaaattgatgaaaactcagggaagggaccagaagtaattatttttttctttggcgagtctggacattaggcagattagggagtatcaaagtaaagctccttccagtgtctgctggtccccaggggtgtttaatttaaaataatcggctgggcgcagtggctcatgcctgtaatcccagtactttgggaggctgaggcaggcagatcacctgaggtcaggagttcgagaccagcctgaccaacatggagaaacctgtctctactaaaaatacaaaaaattagccaggcgtggtggtgcatgcctgtaatctaatcccacctactcaggaggctaaggtaggagaatcgcttgaacctgggagacggaggttgcagtgagccgagatcgcaccattgcccttcagcctgggcaacaagagcgaaactccgtctcaaaataataataataataaacataccagggtaccatattttggggtgaaattctctggtctccttcagctgccaatcctcaatgtggtagaatggcgctaggctcctacaaaagaggggagaatgcctctcttcccaattctgtgctgcactctctcatatgggccccagtgaggcaatgattgcacctagagtcacacacaattcctatgaaaatgatccctttcagcttcttctctactctctccccgctccttactagagtcaaggccagtcctagtgactgcatggggagtagttagtcctagcttttccaagcaccatgtttttctttcctgcctggctcctatgaagaacctctctgctacaccccactctcgtcaaaattcctttctactctccttgaccacaaccccctctaaaggcagcaagcaatcatatatatcaatttatgcaaagagatgcctagatgcccaaagagttaattttccactgctctacagacagatttgattggctttcaggtagcagggagagaacatgtctgccccctttggcttcttagccttctagaagataatttcctttgtttctttcagaaaacagttcaagttttgtttgtggttgctttctgtcatttctataggtcattttgaataagcatgatgccatttacttatgctttcttggttttacctccaagcttcttttttgtactcttgctgattattctatcaatagaatttgtatcagaattaatcttgaagcttccaaggaaatctcaaaaggaagtctgcacacatagagtgttcttgtagggcacgttgtaagcaaatattggagttttgactataacctcaacgagtaaccttaaaagttagtaaattaagtgtcttttaaatactaataggcttaaggcttaataagtataaagatgttatttttatggtaggatgaagaaataaacttaattctgcctcagtaatgttttaaagtttaagatgattcagtatagctgagttgattctaataaagtgaattctccaatttctgcatgattttactgccagaaaactgctcccatgggaaaatggctaggctatagtatttcttaagacacaaatagtggagaaaaaggaagtcactcattacattaaaataaggataggaaaacccatagctaattgattaaaatagtacaagtccagtgggagcgtgcatggcaaggatacaaggaggcccccaccagcagaaactggtagctttgagatgatctgtgggtagctgccattcattgtatgtgcttcacctcttctcagcttgcttcctaaaccttttgtcctattagactgtgattttcttcactttaatgttgctcccctctttttcagggttctccaaccaaccccagttcactctgtttctgttaatactttatctttcaatcacagctcatcttttcctcaatgaattcagactgattccatwgatacccacttctaacttagctttaggatataattgttctcttataaactgattgtgtgggcagccaggtgatgcagactgataagccaagatacacctgccctcttagtggaaaatgatattaatagattgatagaagcaattgtgcttcagctggctgaaaggatagaagagtccatatctccccagatgtcgtcattttcactgctcaaggtctgactctacccttcatagactccccggggctatttcaggacatctaacttgtcttatgagatactgttgcagcttgaaaactctgactctagaccagtggttggcaaacttttactgtatgggtccagatagtaaatagtttcagttttggggaccatagcgtctctattgcaactactctgctattgttgtaatgtgaaagcaaacttagataatatgtaaacacatgggtgtggctgtgttccagtaaaattttgttatttaccaaaatagacaagaggccagatttggctcctacgatgtaaaatggtgccccttctatgtcttggaaggccctggttctagactgaccgttttcttttcttttcttttttttttttttgagatgatgtctagctgtgttgcctaggctggagtgcagtggctcgatcttggctcactgcaatctctgcctcccagtttcaagcaattcttctgcctcagcctcctgagtagctgggactacaggcgtgcaccatcatgcccagctaattttttgtatttttagtagagacagggtttcaccatgttgatcaggcaggttttgaactcctgacctcgtgatccgtctgcctcagcctcccaaagtgctgggattacaggcgtgagccactgcgcctggcctagactgaccattttctcatggagctactctgcactccctggttaaggaagggtaagaaatgggcattatctcacacacaattgagagcccccagtgagataaagtatgatggagtggtttgtggccaagccctatgggagatacagaaggcttacttggaggaagagtactaagtaggcaattcagaaaatccctgttattgttgagattctgttagcccagtggttttcaaccctggctgcacaataaaattgcctggggagctcttaaaagtcctgatgcccaggccttacacaaaaccagttaaatcagaatctctggaagtaggactagacaataatttttaaagctcccaggtgattaccatgtcagaactgttatgctggccatgatatcagccagtagtgagcatggttctgcctcttggtccaaagcttgccataaaatggtgccccttctatgcctttttaacctcattgtagctgaatttgaatacatagatatccacatttctgtatatatatatatatatatatatatatacacacacacacacacacacatatacatatatatacacatatatatgtacagtagtgaaagctctacaaattaaataaattaaggcttaataaatgtggtttttcagatgagttttttcttttaggaaacagtttgcattckcaatcttgatttgcaagataccatatttcgttaatttaaacacattttcccacattgtccacctcacattttttaccatttctgaaattaggatgcatcgtataatggaaataaacatttaatgtagctttcctttttgtacttgtaggggattacaagttttcccacagcacactttagtttatctttcgtaagtgatctgaccttcctcataaactcctacctactgggaattggaataaatgccttctgtttaagccaataagatggtaaactgatgtgattcaacaatataaacagtcccttttggtaaatgctcagtctttttagataaaatgctctaaaacaggagattgggttgagggtgttgcttatatgatttcacggtgggagatgcggcctttggacccatgtggtgacctttggacacttagtgcctgccgagtggctggtctggaatgctctctggactgtgacctttgagggagtgatgggtcccatgcatggtcatcttgtgggcacctctgtgcatttcttgatgtccttatatgctttgtggggcgttcttttgtagcttggctagggtctgtggtttctccaggatgctttaaccccactttggcccttgatggtgcttcagattcgaagtcccagctacatcctccatccagtatctggcattatctgtgtaccctcagactctgctagatcacttggctcttcaccatggtgaactcagggcaggcccactgcttttcaacatagcctcattttgattgtttttcatggtatctaggatgttctgggtttcatctaagcctcatgggaatcaagactgatttaagaaagctaagctgaccttctctctacccatttacattgttatgtattattgagcttcaagattgtgatggcaagattacactgtagctacccctgaagttttgtgcaggggagctcataaaacaattttctttcaaagtcttgaagataaatggaataaaaattcctcggctttctgtgtttcccaactaactgtgttagttgagagccattacagcttttaatctgggtgaagcccagagaagagaaataaaatgtgtctaacctgtttctgagacctttcttccaatagtccacacttctttttcctgtctgaccagatcttctttatcataaaactgtgatctagtctatcagatctagcttttgctaaatgagagccaaaaggatttagaaaatgattttctctttctgtgttttcttctactagtttcataatttttggtcttacatttaaatctttagtccatttgagttgatttttgaatatggtgagagataggggtctcatttcactcttctgtgtatggatatccagttttcctagcaccatttattgaagaaattgtcctttctccagtgagtgttcttggtgcctttgtcaaaaatcagttggctgtaaatgtatggatttggtattgggttctctattctattccattgctttacatgtctgtttttatgccagtgccatgctgttttggttaatatagctttatagtaaattttgaagtcatgtagtatgatgcctccagcttcacaattattttctttcttgagagcttaagaaagtcagctttgaaactcaaagatgatcaatggtatctttgttctgtctgctgtctttattcctagacaataagtctcttggcttcaccttggttatggaaggttcaatattgacaaaatatccatatttacacttttaagagaagtgattacattggtggtttgtgttgtagttgatagtattttagaattgagagactatggtaatatcaaagaagggactttgggacattaaagatcaagtgctggccaatgagattcaagatgggtgactggtatttaatttttaccccaaacaatgagacaaaatgactattgacttagagagagttctgacaaatgaggtggatacagcctaatcaatcttaractgaatataagtatttaatttgctgatgagctatatttaaatcatattttggttgctataaaatcttcagccctgcaaatctaatcactatctttgatgatcttttttgcttaatgtttattatctctcatattcatcatgatgagcaagtagctatgtatattttctcctggatatcgtcaataaaatggagttttgtgttagaagagaacaagaaagagtaaatctgaccatctaaggtagatgtgaaaaagggaatccggcagcagatagtgggagggaaatgcagataaaactttctaagtttatgttggtaaagcaaacacaaatgacaaaatattggcatagtttattcaatttatggttgatagggttgtaaatgattatcaaacaattctggaatacgtaagtaggagtcataaccatattctaccatcagtcactgctggaagtggaatgcggggctggacggaccaagggattatgtgaacatatctaagctattacatgtgcagtcaacttatttattttagagtcttctttggtatgattggattttttactttttgttttgcttcctttaagcagtcaaaggttattgatggaaaaaggttgactttttgctttttcttattcaacatttctttgaatcagtactgtcctataaactatggattattgatttactggaattactagttgtttgatttaggaataaattacagcatgaatataatttctctttagtttgcttaatttaatatctttatagtttttcttctcattttttgaaatatttatttgtagaaaaggagactatatgattaacattacatttttaaaactgaatttgtctgaatttttgttctgtataaaacaggcatttttccaacaagcatatgagaaaaagctcaacatcactgatcattagagaaatgcaaatcaaaaccacaatgagataacatttcaaaccagttagaatagctattattaaaaagtaaaaaaaaaaaaaaagcagatgctggagaggtcgcagagaaaaaggaatgcttatacgctgttggtgggaatgtaagttagttcaaccattgtggaaaacagtgcggcagttcctcaaagacctaaaaacaactaccatttgacccagtaatcccattactggatatatacccagagtaatataaatcattctaccataaagacatatgcacgtgcctgttcattgcagcacaattcacaatagcaaagtcatggaatcaacctaaatatacatcagtggtagacaggataaagaaaatgtggcatatatacaccatggaaaactatgctgtcattaaaaaaaaatgagatcatgtcctttgcaggaacatggaaggagctggaggccattatctttagcaaactaatgcaggaacagaaaaccaaataccacttgtgtgctcacttataagtagaagctaaatgatgagaacacatggacacatagaggggaacaacagacactgggtcctataagagggtggagggagagaatcatgaaaaataactattgagtgctaggcttcatacctgggtgatgaaataatctgtacaacaacttttcatgacgtgagtttacctatttagcaaacctacacatgtacttctgaacttaaaataaaagttaaaaaacaactattaaatttagtttcaaaaaccaggcatttcctctaaataatagtaatgttcgaaatgacaaaatctacatatcctagaattaatatgttaacggttgggtttcctgagaaatactacacctaattgttggggtttctcaaagctcagtcctgtgacttcttctccagttatacatcgtttttaagagatctcattcaatctctgattaaaaaaaaatttttccccaaacgtctttgcaattttggtaagatcagcaaaactactgacaagtgaacaattaaattgaaaaagtaacctatacgaaacatatctccaacttttacctctttcaattccagaattgtatactagtctccactttaaaaactctaaaaggcaaatttaacatggctaatgccatggtaatccatcaactcttgatttcccttcctactcatgtccctttactttcctcaactagtaaatattacctccatttactcagctgctcaggccagatgccagagtcatccttgatgccatattgctttcataacccatattcaatctgtcagcaaaccttgttgacactttagaatataccaaaattttgtcatttcttaactccgccactgcttcctcaaagaagccagtgtggtcttcacttgggctacagcaacggactcctaactgctttcccttcttctattcctcatcccatccttgcctagtctgttttgcatagagctgtctctagtctgttttgcctagagcatttagaatgatgctttaaaatttggggtcagatcatgttactttcctgtttcaagcacttcagtaacttccagtcataagaatagaattgagagcattagtggtgatctacaagtcctgcacaatttggtgcctccataccagccttcctattgctcctggaatacaacagtcaagctcttgttttggaacctttgcgcctgtttcttctgtttgggatgttttcctccagatatttaaatgtcttattcttctgtttccttggatccttcttacttaatcagagatgctttccctaatatgcagtctaaactagctcttctctttcactctttattttcttaccctttttcactttcctcatagcatctgtcaatacctactattggccaggtgcagtggctcacgcctgtaatctgagcattttgagaggccgaggcaggtggatcacttgaggtcaggagtttgagaccagcctggccaacatgggtgaaaccccatctctactaaaaacacaaaaattagctgggcgtggtgacaggcacctgtaatgccagctacttgggaggctgaggcacgagaatcgcttgaacccaggaggcagaggttgcagtgagccaagatagcaccactgcactctagcctgggtgatggagtgaggctctgtctcaaaaaaaaaaaaaaaaaaaaaaagaatacctgccgttgtgttacacatttacttatgtatttgtttattctctgttcccccaccttcttagaatgaggctcattgccatgttctggcacagtgtaggtgcaccatcaatatttgttgaataaatgaatggtaaagtccaaactcgtttgtttttggatggtaagtggttaagtgaaaactagaagaaactaatttggtattattctcagcatgtggtcttttcctagttgtgtttagctttatatttatccaggagtaagtgcacttcttggattaggatatttagctacaactgcttatgtgtttgacacgtaaatctctttgctttgttatgccatctgtgtggcacagagggctggtggaattggagagggatctacatgtgctttgttactgyccctcaatagttcggagtaatggcttatgttagcagtggttgtttatctaacaaacaaacaaaaccctaaattatatttttaaaaaggttatggttattttacactttttgtatcacttgtggtaaagattgttatggattgaattgtgccatttccaaccccaacattcacatattgaagccctaaccccagtttctcagaatgtgaccgtagttggagacagggcctttggatatagaagtaattaaattaaaatggggtcatttgggtgggccctaatccaatatgactggygtccttatcagaagagattaggatgtacagggaaagacatcattgttgtgtgcatacatgtgaggacacagagagaggacagccatctgatagccaaggagcaaggcctcaggagaaaccaaacctgttgacaccttggtcttggacttctgacctccagaactgtaagaaaataaatttctgttgtttaacccaggggtccccaacccctaggcctccagtgccagtaccagttgagtaccccaactggtgcatgtccatggcctgttaggaactgggccacacagcaggagatgagcagtgggtgggtgagcaaaagaaacttcatctgtatttacagccaacccccatcgcttgcattactgcctgagctctgcctcctgtcagatcagcagtggcattagattctcatgggaaagtgaaccttattgtgacgtaggttgcctactccttatgagaatctaatgcctgatgatctgccactgtctcccatcacccccagatgggaccgtctagttgtgggaaaacaagctcaaggctcccactgattctacattatggtgagttgtatagttatttcatatatattacaatgtaataataatataaagtacacaataaatgtaatccacttgaatcatcctgaaactgagaggtgaagccagctggacttcctgggtcaagtaggggacttggagaacttttttgtcttacgaagggattgtaaaatgcaccaatcagtgctctgcagctagctagaggtttgtaaaatgcaccaatcagcgctctgtaaaatggaccaatcagcactctgtaaaatggaccaatcagcaggacatgggcggggacaaataagggaataaaagctggccactccagccagcagtggcaacctggtagggtccgyttccttgctgtggaagtgttgttctttcacgcttcaaaataaatcttgctactgctcactctttgggtccatgccatctttaagagctgcaacactcactgcaaaggtctgtggctccattcttgaagtcagcgagaccacgaacccaccagaaggaaccaactccgggcacaaaaacgtctacccccactccacccctgggtctgtggaaaagttgtcttccataaaatgggtctctggtaccaaaaaggttggggaaccgtggcttaagccacccagtctgtggtattttgttatggcagccctagaaaactaacacaaggattgaaaaaaatgaaaaaatcagtaataaaaaggatgtgccagctctttttatttgtagtttgaaaatgaattatgtaacgtgtctttgttggggggggcaaaaaaagactggatataatatacttgatcctagattacattgaactgatcagaccccaactaaactagacaggagatatggcagaaaatcccacattaaggacttccttttaatgaaagctgctatgtgttatcactaaactttaattttgctgtagcaacccattcttttggtaacctcgtatgaatcactgaacattgtgactcttgatttaaaggcttctaaaatgtagggttttattcttttttttttttcatccagtaaaccactgtttgtttatttttcacagtacgctggctctgtgttttcaggatgagtcaagcacggcccctgtccttattgagttcgtggtagagcagaggaggcaatatgtgaacagctaattacaagacagtataatgagtgatacaagagctacgaacaaggagctgtgaggggagggagtcaccccaggttgaggttgctgaacatttcctgttctgagcctaacaagtagtttgtggtcagattccacagatagaagatgagaatgaaaatttagtgagcagtgagatcaaaattgcctcaaaagctacgctaaagagtttggactttgcttgtaggcagcaggtagcctacaggtagtgcaaatatgagagatttacattttcaagagacggctctagtgggaatgtagggctggtgcagaggcagtgagacctctcagaagacgcttcatgaaagattcaacgagggcagaatcattgcacacacttttcataatgatagattggtgaatggggcagagaatgatgccccgtttctgtgtcttggatgacaaggacttggagaggaagatgagagagagactagcccagatgacctctgggtttctgcttcaggttagaggtgttagccactgaggtaaaaaatacagatggtggagaggcaggttgatgggcaaaggcttctctactttgggcatgctgtgttttcattttctatcacctattacattaaatattaactctttctttgacttttataactttttatttaagatgaaacctatttcttggccttctcaccctattgcctgtgtttaccccacagtttgctaagtttggctatctgctattttcagacaaaataaatttttttctctgcccctttgcacacaattttctttccctggcttacatacctcccttttatctcttctggtagaaaattatctgttcttaaaggctcttcttggaagtcctacttaatccttgtgaatgtttgcaattttggcagcactttctttgtacttatataagtgtaaacagttatcattctgcctttaatgttgcaactagttgtgtatttctcttattgccatattggagcttattcatatttatttcctgaatgcctagggtattattttgaacaaaatataagtgtttattggcttgaaaggaactaaaagaagattgaagttggtttgggggggtgttgaatgttatctagaggcattttttgggttctcaaccctttaatcttcctctgtacttttgttaatccagtaagggttgttttggtagaagtaaaagaatagttgaaattatcaatgacttgaagaagggacaccccctctcctccccgagactggtttgtaccttttactttgaaagatcacagtttttacttatctataggcagttttatttttctacccttctaatttctttcagaaccctgttgaagttttagctaattaacatagcttaaatgtcttatattttatttcatacattaaaattaactcaagggagcaaaagtagccctgaaggctcctgtgagctattggaggaaggttgaaattcaaagtgttttagctaataaacaagaaaagagatggctgttaacagggcctttttatactacaatgagggtagaattaaaaaaaatcagaactatattgggaaggaacaaggttatagaatataattgtgttacccaagttggcattaaaaaagacatttcacggccaggcgcagtggctcacgcctgtaatcccagcactttgggaggctgaggcgggcggatcatgaggtcaggagatcgagaccatcctggctaacatggtgaaaccctgtctctactaaaaaatacaaaaaaaattagccaggcgtggtggcaggtgcctgtagtcccagctacttgggaggctgaggcaggcgaatggtgtgaacctgggaggcggagcttgcagtgaacggagatcgtgccacggcactccagcctgggcgacagagtgagactccgtctcaaaaaaaaaaaaaagtcaacatattctacagtgttcatattgtgtgccagtgtggctctatataatgacagttgatggcttggttcattaagcttatcaatttaattttcagcatctttagagcatttagagaagcacacctaaatttggaaaatctataaaaaccttttttatactcttaattttaatatataaatatttttacacaccattgaaaatatgtccggttttgtggaatgttaaacttgcagaattaatagagtgggaatttcttctttataaattacttgaaacttttaatttagcaccattcccatggaagttccttcctgtatctacgatgaaggtgtgtctttatagcctagcacagatttacagactaaagaaagtaagcaaacccaagctctctaatgctgcaagcttggagattttctatatgagagggacccctgaagtctgagaaagaggggaatgggagggttttgtatctatggcaaaaggtaaagttagcaagacatgggcttaaaccctacattagaatcatctttgttgcaagttgttccaactaaacttccttacagaaatataactgatttagtactgaaaaagaaaatgaggacacaggatttattttacaggataacttgaaagctaattttactggttgctggtattccttcaagaggtgggagaccttttcaaatagcgccctcctatcctccgccttggtgagaatcatctgctatggtgagtcacagtcactgataggagtaagttaaatctcttaggtgagttagggttaaaaaaaatagtttcagctttctttttttccacaggattgccaagccatatttactttctgaaataaaaggaatcattgaaaacctcacttgactttagtttaatcaatatcaaataactgtattggagtattttaaaagaagacgtaggtacaaacaacttataaaagtgaataacttgcaagttgcaattgccttttttgatggaagcatgatgttcttatacaaagttcttttcacatttcttacttctctggcatttattataaggaacaaagcatttctggaacgctcattttaatttcaaagcccaggctattctatggaaaacatttggcgcatggaggatctgaacaatagaggaggaatgtgcagtgggaagcatcatgaattgcagcacttaaaatacattccgagggaacacttcagacaatgatacttattctttgttttaaacaaagattttaaactggtagttataatttgtcttaatctggacaaatacctttcaactctcaatatataaattagactgacaagagtgagatatttgccttttggaatttgtgaaaacccatgtaataaatcaggcttattattattcttatataatccatgatgaagacacatgatcttatttagctgcttgtaaagcatatagaatgagctttgctaactgccacatttagcatggggggccccaagagcaagataaacttagatccagagagaatacctttgttaaagattcctataaccaattttctgcacctacatggggaacaaactagaaaatayacatgaaatgccaacaaatatttgtgtcatattatgcattttccaaaatactttaccttatttgaccttccccagtcttgtaggataacaatgattgtttttattttctaagagaggaaacaaaggcctgccacaagacattccactctgggtgatgaacatggaaataaagcaaattagaatgaaacagaggatctattgggtaaggggaggagggtaggagggcagatgaaaatgattttcatccgcatatttcccccataacttcttaagttttttttttagttcatggataaaaactgggtccagatatccaagtaaacaaacatcgaatgctccataaacaaacaacaacgaaaatctctagggactactgagcaggaagcattatgtagtttgctgtcaaagatgtgatgcatgattatcatgagcctccactgtttcatgacatgcagcagattagctttcaagaggagtttcaggtcttctattttaaatattagatacaagttgtttttttcctttctctcattcctctacgatggtgattttaaagctttgtttataaaaatttaatccaaaacttgtaattgtgatccaagatttaattaagaaatgggttgttttttttttttttttttttgagatagagttttgcccttgttgcccaggctggagtgcaatggcgtgatttcggctcaccgcaacctctgcctgccgggttcaagcgattctcctgcctcagcctcctgagtagctgggattataggcatgcgccaccatgcccggctaattttgtatttttagtagagagggggtttgtccatgttggtcaggttggtcttgaactcccgacctcaggtgatccacccgcctcggcctcccagagtgctaggattatgggtatgagccactgcccctggccagaaatgggtgttttttaataatgtaattcagtatgatgtttttgtttccaaatacagaagcttaatttttatcttcaaataatgttcttattatgagtttgttcttgtatttgttaagattcatttctttctttttttccccaagctttattaaattaaaattggcgaataaaatttatatatatttatggtgtaccctgtgatgttttgatatatgtatacattgtaaaatgattaaatcaagctaattaacacatttctcacttcatatacttgtggtgaggagtttgttcaagttttgctactcgaagaatgctctagaaggctgtgtatgtgtgtattgttttaattacagaaacttcatataaaaaatacagaactttgataaaacagtcaaaaatgagagtagaaaattatgtatctccaaaatatcaaataattataaaataaaatttataccacttttaagccagcaatctacattaagagggagccaaaaataattataattaagtcagtattagtctatttaggctgagaatagagataactaatattaggagagggagaaacattctgaatcatatagaacagtggttgcttcaggggacaaagtccaaatccttactatgacctactttcttgccctttgtaacctttcagatctgtcttctaccctttcccctaactcatttggcctctcaaacaggtctcactcaaagtcccctgtcaagaggcctttcctgaccaccccgatccccactctctctcactgtattccctccgccaactttatttttcctcaaaacatttactgaaccttacatttttaaatttgtttatatgtttattgtatgctgccgatattaagaatgtaaactccatgaaagcatgaaatgcatttcttttccatcatccagaacaatgtaaaaaataggtgttcagtaaatatttaacatagaaatgatttgatgactggggtagttgaagagaggacattttaatgtctatattttgaaattcaatcactaagactcccacttccttcctatttttagttgggaactccacggtggctgctgttgctgttcttggtgccatgacttgacttttgtaggtgtaccaacagcactggaaatgagtcatgttactatgaaatacagttgacctttgaacaacactggtttgaactatgcaggttcacttttaatcagattttttttcaataaaagttacatcaagtgtgcctgcctctcctgccttcccttccacctcctccatctcttctgcctcttacacccccaaggcagcaagaccaaccctcctcttcttcttcatcttcctcaggaatatgaatatgatgaggatgaagacctttatgatgatccatttctacttgttgatttatttaattatgttttctctgccttatgattttcttaataacaaataacactatcgtctctctagctcatcttattgtaggaatatagttatatagtacatacagatacaaaatctgtgttaattgactatttatgttatcaggcttctggtcaacagtaggctattcgtagttatgtttttgaggagttgaaagttatactcagattttcaactgcacggtgggttggcgcccctagcccttgagttgctcaagtgtcaactgtactgtcttttgttctggtctgtaatatcccaggactgtgttctccttacaatttgtcaatttagtactttgtatttttccaattttaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgagtactccaatcctggtcaggagcaaactgcatatctttagggtgttagtcacccaaattagatttgtgagtgttttgtttttgttggctccagttttttagtcttttgcagagctgtgaggagctagctgtgggaggcagagtggctcattagacagctccaaggctcagtcccactccaggctcttctttttagttgctcggtccccccaggcaattcctcttcctcccctgccttgccatagcttttccataataaacaaagagaagagtacccttttttggtcttagaatatagtgagaaatgactaatgaagctgaagatttatttgtctatacataaataaattatgaagttccttgaaaacagctgggaaatagaagtttcagacctgaccatctcagaagtacatttttaaccttgcaaatttctggaggtttagacttcctaaacttttcaaaaaatgctttgcataaactgtgaatgagccaagttgctgctttgttaatattacataataaaagcatatatttcatctttttgagatctttacttatgataatacagcaattttctaatgaatataggtctcaactgtaggacagtttaaaataattgctgaatattctttggttagtggaatgatttcgtatatatcagctttctgcaagtatctattttgggaggaaaaggaaagttaaattttcttgttcagctttgtaaaagagacttgggatttttaaatatttttctccctcaatcccccaacgtaactttaagaaaatcaggaagcctttgctaattaaataattaaaatgaatatactagtaacaataagctttatgtcacatgtatgatacaggggatttaaaaaaaatttttggccgagtgcggtggcccatgcctgtaatcccagcastttgggaggccaaggcaggtggattgcctgaggtcaggagttcaagaccagcctggccaacatggtgaaaccccatctctactaaaaacacaaaaattagctgggtgtggtggcaggcgcctgtaaacttgggaggctgaagcaggagaatcgcttgaacctgggaggcagaggttgcagtgagccgagatcacaccattgtactccagcctgggggacaagagcgagacttcgtctcaaaaaaaaaaatttttgtatttatgtgaatttatttttaaaataaattttactgtgtatatttaaggtatacaacatgatgttatgaaatacatataaatagtaaaatggttgctgtaataaagtaaattgacatattcataatctcacagttacccatttttttgtgtgtgtagcaagagcatctaaatctactcmtttagtaaaaatcctgaatacagcattattaactatagtcttcatgttgtgtactagatttctagagctcattcttcataactgcaactttgtatcctttgatttgcactgacccatttcctcactcctgcccccagcccctggtagatactgttttattctctgtctctgtatgactttcttaaacaaagattctacatataagtgagatcctgcaatagttttctttctatgtctagcttattccacttagcatgatgttcttcactttcatccatgttgtggcaaatgacaggttctccttttttcctttgtatatatagaccaatttctttatcgattcatctgttgatggatgcttaggttgttttcatatcttgactattgtgaataatgatacagtgaatatgggagtgcaggcatctttatgaagtggtgatttcctttacttcagtgttatacccagaagagggattgctggctcttaatggtagttctatttctaatttctttaggaacctccatactgttttccaaaatggctacactttgttatgtatgttatatacaatttatattttataggtattcttcagacaataaatagaaaacataatgtgcaaaataatttgaaatatatttgttgtttttccctgctccctaccaactgagaccctctctttgtccttgttcttgatcatcatcttagtcaccaagccagtttagactcttcctttcattccaccctctcttccaattaatgtctaagttcaatgaacttttaaaaacttttctaaaacttttattttaggttcagggtacatatgcaggtttgtcatattggcgtcatgggggtttggtgtacagattcttttatcagtcaggttcaatgaattttttctccttgttgtctctcagatctgttccttctactctattcctaacattgcttcatgaattcaggattattgcattagccttcctccatagtaaaatcaaatagatcttttaaaaatgaaaatatgctcattttacttctctgcttaaaatcatttttagtagctgttggaggatcagggggactatctttttcaataaagttcaaacttttaaacctacctcccaaagcatttcatgatttggcttctaccattatcttgcacctctttcctgtgatgcacctccctcatatgttcctccaaacaggaactcrcagtttcttgaatgttccgwgttgctttatgcctctgtgcatgtgttatcagctacagtcataccttacttaacaatggggacatgttctgagaagtgcatccatatgccattttgtcattgtgtgaacatcatagagtgtacttacacaaacttagatggcatagtctacaacacacctaggcatcctaggctacaaactcgtacagcatgttactatactgaatgctgccagcaattattaatataacatagcggtaagtatttgtatatctaaacatagaaaagacacagtaaaaatatggtataaaaaattaaaaaatggtacacctatgtagggcacataccatgaatggaacttgcaggactggaagttgctctcagtgagtcagggaatcatgaatgcctaggacattactgtatatcactgtagactttataaatactgtacacttaggctaccctaaatttatttaaaaatatttttccttcttcaataataagttaaccgtagcttactgcaactttttaactttataaacttaaaaaatttttaactttttgactcttttgtagtaatacttagattaaaacacattgtacagctgcacaatattttcttttttatgtccttattctataagtttttttcttttttacatttttaattatttttttttttacggtttaaagttttttttactaaaatctaagacacaaatacacacattagcctaggcctacacagaatcagggctatcaatatcactgccttccactttcatatcttgtcccactgaaaggtcttcaggggcaataacacgcatgggaattttcatctcctgtgataacaatgccttcttctggaagtgttaccaaaacccacaggcgttgcactacaatgttactatggctatgaggtcactaggcaataggagtttttcgactctactatattcctatgggaccaccgtcatgtacgcatctgttgttgaccaaaatgttgttatgcaaaacatgaccttattcccgtcacttggattgcttttctaattcagccagtttttgctcatgtagcaaagctgagcccaggtcatcttttccaggaagtgtttactgaccccgtatgctgatttagatgactgtcttctgtgtccttacagactgagcacctctcgttcatgacactaaccaccccatacagtaaacattgatgtacttgtttagtaaatcatgactgttagttaatttattgagcgtggcaggtaccaagtgttatttgattaccaatgcctgacacatcacagacacctgttaaacgtttgttaaataaattaaaaagttgaagcatccttttgtcactttatattataaaattttgtaatagtcttatctttgcttttacggaaaattaactctcataattatagtttctctgttgattctttggtaagggatatgagccctatcctgacattgtttctgtaggaaaatgtgatctatttgacaacatagtttccataaactgtctggtaataagtatgtacgtcatcagtcattctcagaagggaacaataattgccatgagatggtatttccctttgtttttaagtaagttaatctttttagttcaaaaaaaagatgttattttaaagagaagttctcaaagagaagtcttgattctaggattatgctgtacagggtatatccttcactgtgttctattataatgtgtgaaatacctctacatgtcatatgctgtatacacaacagattcatttggttaaagatcaccaaatgctttactgtgtgatttatttgacaaactgccaaaatgagctaccgccagcaacttcagtgtgggaggaaagcaatgcaatggcacatcgttctggaatttggggaacagccaatgattatcctatggatagtagggatagtgacagtgaaagcactgttcccaaaagcttggaaggaattttaagctcagtggtggggttgaagtataagaagaatggattctgatccaataaactctacaaaatacttgaaacatattttaagtagtttcctgctttgagttttttttttttttaaaggtatttgtccagtggcataaggtgaaggactaatgaagaacaactaataaggttaaagtatttggaaaagtgaaaatatattgagagtacagatagctttattatatatttattgacttatttttaagaattttgagaccaatttagaaaacttttccttccaataaagacatactataatttatgtagccttactacaagattctgttttattgctatccgtggctttatttacagacttgaagtgataaataatgtgggtattttggttacctaaagaacctgcccatgaaaggtgaaacaggggtagtataaaggagagacggtgaaaggaaaggtagtatgtgtagtatgtgggtagaagtgtagagattcagcagaggtggttcacattgtaagtaatacttatagttactcatgatcttatggcttactcctacactaccaatacaatgrcaaagtattaaatttgacattttctttaaatagttttagaatattcgtatagcagttacccaggaattaggtaagagttgtttataatgtctagattacatgttttgcctgtagcatatatactacctttatatagtttctattaccctaaaatctctagacattgcttctaagccaggggtccccaaccctgggtcgtggaccggtactggtccatggcctattgggaaccaggccgtacagcaggaggtgagtggcaggcaagtgagcattactgcctaagctccacctcctgacagatcagctgcggcattagattctcataggagtgtgagccctattgtgaacagcgcatgtgaaggacctagtttgtgtgctctttatgagactctaacgcctgatgatttgaagtggaatggtttcatcctgaaaccatycccattccccccatccaccatctgtggaaaaattatattccatgaaaccggtttctggtgccaaaatggttggggacaactgttctaagccacacaagtggttatttttaatgttttaaatggtttattgaagaataacatatatacagaaaagtgcacacattatctctaacaacaatacatatccacatagtgaacacactcatgtaacctccacccacgtcaagaaatagaatattattagaaccctaagagggccccttgtccccgctaccagctactactctstcactatcctgacttctaacaccataggtgagttttgcctctttttgaacttcaaatactgagactatacagtatgttgtattttgtgtctgatttcttttgcttaatgttgtatgtctgtgagagctcaccatgtagtagttcattcattcattgataataaaccataatttatctatctgttctattgctgatgaacattygaattatttctggttttttctttaatgagcattgctattatatacacatttgtgtattactttcagtgcattaatgtagactttcttttggactaatacctaggaatgaaatttctgggtcataaggtatacatatgcccagctttagtagatattaccaaacagctttccaaagtgaattttctaatacgagctccaactgctccacattcttgtgaacttggtgaacttggtgttggcaagtgtcagtgtttttaattcaaatgtatgtagtggtattatattgtagttttaatttgtatttctgtgataactttttatatgttctagatatgagtccttttgttagttgtaggtattacaaatatcttctccctttcataatattaaccattttttaatattcagaagttcttaatttaaataaattccaaattattattttgttcctttatgggtagagacttttatgttctgttaaaaaaaaactttgttaacataactacttcaaagtcaagaagatattttcttacgttactatctggaagctttattgttttataatctacctgggaataaatttttatgaattgtgtgaattagaggtcatattttttttgaaatacagaaatttaattgctccagtaccatttataagcatttagatgtttagtttttccagtaccacttattgaataaactgtttttttcttttgaattactctttcacctttgttgaaaaccagttgaccatatatgtatgggtctacttaggtgctcttacatgaatatgaatctttgatttatatatctattcttacaccaatgccacaatagtcctaattactgtacctcatagtaattgaaatacaaattatttttattaggttattctaggtgccttgaacctcatagaaattttagaattagcttgttaatttttacaaaaaagtccactgagattttggttaggastagattagatctatggatcaatttgtgctgaactgacattttaacagtgatgagtcttctgattaaaaacatggtatatatctctacatttattgtggatacaaatcttgcacatattttattaaatttgtccccaagtatttcatatcttctgatattttaaatggtactttataacatttaatttaaatatatcacaataattctttctgccctctccagtctattttaaaatccatccagtgaactttttttttactttagttcctgaattttcatttgttttttgaaaatagtttccattcctgaaatgtcctatctattcatccattaggactagcctcttttaaaatctatttatgatagttgcattacaccctttatttgctgactacaactgggttttgtttctgttgactgatttttcttttactatgggtgacattttcctgtttcttcatatgatagtaagttttggttatatacttgacagcatagaaaatagactataagtattttggattcttgtttgggtgaaatggtagagatggaaaaagaaagagatgtttcggattcttttattttccttggaagagtgttgagttttacttcagcaggtggttaaattactgatgaataaccaggagtttgtgtagcctttttaacaggttgattcggtttttattcttacagagaattcttagtcctgggacatagtcttttattctatagtgtggccttggtggagtttcagtggacagtttgatgtgtttacaaaacccatctaacttgcaggattcaaactttaaactctgttgttcctgaaatgaaatgggcagcaattgaaatcacagcacagatttttatttttattttttttccttatgagtattggtttctattgggttcttcagcatctccccaattttagaaaaattcatgtgtacctttagggctccccagtctgtagttttctcttttatgagatttttttaccttcagtttttgctcattctgtcctttcccagactctgtcctgtgacatcttaaatcagtaagatggtagctttctacttgagttctaactgccctatgctgtcccagtggagagtgtacttacaggaaatgccatataaatgtaactctcaaccactacggtttctagtatttcaagagtcaaattctctccagtttcttttttctttctgtccttgtcaggtgccttgaaatagttgttttgggaggagccaagatagctgactacagggttcaggaagagcttctcccaccaagagaccacaccgtcaaaatcagcacattctgaacagtacttcggaaggaaggcattgaaagtggttggaaggagaatgcagatcctgggctgaagkggggaggaagttgggaaccctgcatggggttgccaagcaccaggactcattcctggccctgagaggctcccagggaagggatgagttaaataggcatagagtggcctgctctcaccagggacctcaagaatcctaggtgcaggagaccccatgatccccatagacatttgaactgacaaggagagctgtttggagagctggcaaagacaggaatccagcctgcatggaacccagaaggtttggaacaagaatgatcacagtggcacatggccagggatgcccagcccccaaggcttgccatactcctctaggtggttttggcctttcttaactgtcagatctagacagaacagggctatctaactgtagggtggagccagtctgatgagtgctcctctgtctgcccagcctctcccaaggtctctgtctggctgcatccacttgcagtacagcctcagacgcccagctgatatactttcctgtagccaccaccataactctttggctggtagatccaatataactgtcagataacttttgcagatgggccctcaccagtgtgcaccctctcacagcttccacccaccactttgctggtgtgcattcacctgcagcctcttcctataaaccttgccactgccaccctggtgccactggagcacatgtgcatgcacagcccccaccgccctaccactgccctgttgctgcaggtgcacacatgtgagcatgaaccccactgacaccaccctgatgaagggcttttgtcagcaccctccatcagagtattgttgccagtggaccaggaaaatcttggtctctccagtgtagcagggccagagaacaaagctgtgggcttggtcccagcccccacagggttagagcatgcagcacagaagtgatgagctgagycttgaccttctgaaatcatccagaaatgaagccagttgaccaaatccaacttataccacagtcaaaccaccaagggcatcaaagaatataaaagcaaaaagctcgatccaaaggagaacaagctcaaagatttaagggaacatcaacccacacagatgagaaagaaccagtgtaagaactctggccactctaaaagtcaatgtattcttacttccaaatgactgcactagctcaccagcagtggtttttaacccaactgaaatggctgaaagacagcatagaattcagaatttggatggcaagaaagattatcaagatttgggagaaagttgaaacccaatccaaggaatctaaggaatccagtcaaatgattcaagagctgaaagataaaatagccattttaagaaagaaccaaactgatctgatagagctgaaagactcaccaaaagaattttgtaatataactggaagtattaaaagcagaatagatcaagctgaggaaggaatctcagagcttgaaggatggttctttgaaacaactcagtcagataaaaataaaggaaaaagacaaaaaaggagaaaacctctgaraaatatgggattatgtaaagagaccaaatctatgactcattggcatccctgaaagagagggaaagagagaatgccttggaaaacatatttgaggatattgtccacaaaaatttccccaatctctgtaaagaggttgacattcagatacaggaaattcagagacccctgtgacatactatacaagatgactatccccaagacacataattatcattctccaaggcaaatgccaaagaaatagtactataggcatctagagagaaggggcaggtcatctacaaagggaatcccatcaggctaatagtggacctttcagcagaaaccctagaatctggaagagactacaggcctatattcagcatgcttaatccttgaagaaaagaaattccaaccaggaagttcatattcagtcaaactaagcttcataagcaaaggagaaataaaamcctttttagaaaagcaaatgctaagggaatttgttaccactagacctgtctttcaagaggtccttaaaacccatttacacctagtgttccatcattggaacaataagcatatgggaattatttatatcctaytactcaaggtcatcaccaaggtctgattgtaaaaattaaaaaaattgcaacctcaggtataaatgggttaagggagtgctaaacatggaaacaaaagactattaccagccaccacaaaacacttaagtacatagatccaatgcactataaagcaactacataatcaagtctacataaacaccagctaacaacatagatggcaggatcaaatctgcacatatcaatgttaaccataaatgtaaatgggttaaatgccccacttaaaaggcatagagaagtaagttggataaagaagcaagatccaactgcatgctgtcttcaagagacccatctcacctacagtgacacccatatgttcaaaataaagggatggagaaagatttaccaagcaaatggaaaacaaaaaagagctgaggttgatattttttatttcagacaagtcagacttcaaaccagcaatgatgacaaaagacaaagaagggcatttcataatgttaaagggttcaattcaacaagaagacttaactattctaaaaatgtatgtactcaacactagagcatccagattgataaaacaagttcttacagacctataaagatagataaccacactataatagtgggagacttcaacaccctactgacagaattagacagaccatggaggcagaaaactaacaaagatattcaaaacctaaactcaacacttgactgaatagacctaacacatctacagaagactccacccaaccacagaatatacattcttctcatctgcacatggcacatactctaaaatcaaccaaatgctcagctataaagcaattctcaacaaattcaaagaaactgaaatcataccaaccacattccaggtcctcagtgcaataaaaatagaaataaataccaagatggtctctcaaaaccatacaatgacatgaaaattaaacaatgtgctcctgaatgacttttgggtaaacaataaaattaagggagaaatcaagaaatactttggaataaatgaaaacaaagatacaatgtaccagawtctctgggacacagctaaagcagtgttaagaggaaagtttatagcaccaaatgcccacatcaaaaaggcagaaggctctcaaattgacagtctaaattttagctagaggaactagaaaagcaagagaaaaacaacctcaaagttaatggaagaaaagaaataaccaaaatcagagctgaactgaataaaattgagacgtaaaacacattttggtgtgtatatgcatgataaaattctactcagacataaaaggaacaaattaatgacattcacagcaacttggatggagctggagactattattctaagggaagtaactcaggaatggaaaaccaagcattgtgtgttctcactcacaagtgggagctgagctatgatgatgcaaaggcataagaatgatacaatagattatggggactcattggaaagggtgggaggtggggtgagggataaaaaactacaaactgggtacagtgtatactgctcgagtgatgggtgcaccaaaatatcacagatcaccactaaagaacttactcatgtaaccaaatgccacctgttcctccaaaactcatggaaataatttttttaaaaaataaaaaatcaatgaaacctaaagtttgttttttgaaagaacaaataagattgatagactactacctagattatgaaaaaaaaatagagatgatccaaataaacacaatcagaaataaaaatggggacattaccatcaacctcacagaaacataaaaaaccctcagagactattatgaacacctctatgcacataaactagaaaacctagaagaaactgataaatttccagaaacatacaagctcccaagaatgaaccaggaataaattgaaaccctgaacagatcagtaatgagttctgaaattgaatcagtaataaaaaaatccctgctaatcagaaaaagccctggaacagatgaattcacaactaaattctaccagacatataaagaagagctggtacccatcattctgaaactgttcaaaaaatcgaggaggagggattcctccctgattctacgaggtcagcaacactctgacaccaaaacctggcagagacacaatgataaaagaaaacttcaggccaatatacctcatgaacatagatgcaaaaagcctcaataaagtacaagcaaactgaatccagcagcacatcaaaaagctaattcatgacaatcaaataggccttatccctgggatgcaagttccgttcaacatatacaagtcaataaatgtgattaatcacaaaaacagaactaaaagacaacacacgatcatctcaatagatacagaaaaggctttcaataaaattcaacatcctttcagtttaaaaaccctcaacaaactaggcatcaaaggtacatacctcaaaataataaaagccatctatgacaaagtcacagtcaacagcatatgaataggcaaaagctggaagcattctccttgagaactggtgcaagacaaggatgcccaccctcatcactcctattcaacatagtactggaagtcctagccagaacaatcagtcaagagaaagaaaaaaaaatgtatccaagtaggaagagaggaattcaacctatctttctttgcagacgatttaagcctatrcttagaaaacctcatcgtctctgcccagaggctcctagacctgataaacaactttagcaaactttcaggatacaaaatcaacatacaaaaatcascagcatttctatacagcaataacatccaagcaaagagccaaatcaagaatacaatccattcacaatagccacaaaaagtacaaaatacctaggaatacagctaatcagggaggtgaaaggtctttacaaggagaactagaaaatgctgctgaaagaaatcagacatgacacaaataaatggaaaaacattccatgctcatggatcagaagaatcaatattgttaaaatggccatactgcctaaagcaatttacatatatatccaaaagaaaataaatcattctaccaaaaagacacatacactcatgtgttcactgcagcactatttacaatagcaatgacatggagtcaacccaggtgcccatcaatggtggattggataaagaaaatgtaccatgtatacaccatagactactatgcagccataaaaaagaatgaagtcatgtcctttgcagcaacatggatgcaactggaggccattatcctgagtgaatgaacacaggaacagagaaccaaatatcacatcttctcacttatacttgggagctaaacattgggtacatatggacacaaagaagggaataatagacattggggcctacttaaaggtggagggtaggagaagggttaggattgaataactacttaccaggtactgtgcttactacctgggtgatgaaataatttgtaccccaaacccagtgacatgcagtttactgatgtaacaaatctgcacatgtacccccgaacctaaaataaatgttggaaggagaaagttaaaaaaagtagttggtttatatattttgtctgttatttgtgagaggattagtcatatgtattctatcttattattgctagcagtggaaactgccactttctgttttgagtttattttttcctctgagtaaataattttaagttggaaatcagttctttttttcttttttaaagcaagttggagaggttattcttttgcctctggattccattgttgctactgacaaattaactataagtcattttgcaacttccttgaaggtactgtgccttttttctctgacttgtttaaaccatttttaaaatcttttgtttttagaaatattgtggcttttttgctcccatagttcggcgagtggaagagagtggtgtccagcagcttcttctctccctttgtttggtgagtgggagggaatgttacagcaattttactcctgctgcccccagcttggtgaggaggaatgttacagctattttgctccagcagttcagcaaattcttgtcctgagaccaagaggaataaggtacatggacattggagattgagtaagacaaagtaaaattttattgagtgacagaaagaaaactctcagcaatgagaggggtcctgaaagtgggtaaggctgtgaggctgagtctggggtttttatgggcttagaatgggggactgcatgctgataggtccttgagtggtcttggaaaaagcaccattcaattggttaaaagacatcattcagaaggaaccagttgagagagagggggtaagatagggatgaaagttctcactccagtcgtggactctaatgctgaactggcagttcgattttcaggttttagactttcctttgcttgaaggttgggtttcactggggacccatccctgtctgcagaggaatttgtctcctgttgctgtcagtaatattattataatatgccttcatgtggttttcttggtatttatcctgctaggggtttatagcacttggaagtctatggtttgatgtctttcatttattttggagaattcttgatcattttctcttcagatatcccttttcttcttctcttacatgtcttttcaaattatgattatgcatttaatattttttcatcatgtctcataggtctcttatgctcttttctgtattttgtacatttgtttttctcttcatgcttctatctggacattttctattaacatattatggttaataatcctgtgtttagctatgtctatgtgacattgaatccaactgtttcaatctttattatattacttggttcaagaatttccacttaatatgtttttacaaattataatttcctgctgaaattttcatcatgatataatttttcttgatcatctcatttatacttaatatccatatctaatttgtgtaatatggctctcttgtaggtttgttcctattgtctatttttccttttggtttcttaagtatccaatattgtctttggtatgttggataattttttattggatgctggatattgtgtattaaaattatagaattaatttttaaagtttggtaaagtaccatttaaaatgtggaatgttggctagacatttcttcctaggtaggcccagaactccaattttaccttcctaacttgctgagaaaaggcttaaaattatttgcccagttcctctaatcagctgcaacattcttttgacttctttgttgttcagtctctctaccacttggcttctcataactatagacaaaaagtcaactccaggtagacttaggatctaaatgtcaaaaacaattttaaatactctttaaaaaataagagtttttttttacgctttgggagtagagcaagatttgttaaacatgaaacaaaaagctatgaaaagacatacattttactagctcaaagttaactagtttaaattttactaattcaaatcttactasttcaaaattaagaactttgttctgtcaaaaaatttttaaaagaaaatggaaagatacactgagaraagatattggtataaatccaacaagggatttgtaacaagaacatatagcgaaccttcacaaatcaaaaagaaaagcaaaatgaacaaaaggaaaatggcccgaaaagaatttcacagaagagtatacacatgacatcaataagaatataaagagatgtctgtcctcattagtgagatagatatgcaaatgaggtatcattttatgcaattaaactggcaaaaattaaaaagtctgacaataccatatgttagaaagactttgaagcaataggatcttttaaacattgcttgtgggaatgtaaattggtacaactactttgaaaaacagttttggtatgtcacgtttgtcaaatgccaaagttccatatatgcatggctatgtttcttgactcagatcaattccatttctggtggtggtggtgtatagaaatgcaatagacttttttaagataggtacttgatgagatgttttctctgaaatgaaacatttgaatggtaattttaaaaagcagaaaacatttgaattatgcaaacacacatggcctgtccctttgggatcccctaggatagtaaagccttagtactttgtttggcttatgtgagtaaccagttttgcaaaagtgatgtaatgtagtatatgatacttgctgcttatacatgatattgcaaagaacagagtattgtaacagataattaatatattttgtattcataaacatttaggaatattttttctaagatagagaaaaatgtatacagtgtagtcagcatagtgatacatgatctattattatggtagctgggataacttgactttgagatttttttagcatcatgagttgtctttcagaataaattctagagacaaatagtaagcaaaaatattatttagttttgttgttggggaaaaagataactaatgatctgtgtgtaacaagtcttaaagatttgtcagtcaaatttagagttgtagagcaaacttggttgaaatttacttgaaaggtggcttagtagtactatgagatccccacagagggtaaggttctcagttatccaggttttagcttttgctttcaactactaaaaacttttcacatggaattatagattttaattgcaatagaaaaggcattctcttgttttttcattaatgctttgatgaatataaaaagaacaggaaaaaatagtggaatataaaataagcctggctcagcatttgttctaatcagaaataagagtttataatgagagagaaagattatggaaaggaagtgattagtcagtataacagtgggtgttgttaggagagaaagaagaggatcacaaaagaaactatttatactattttcctatgcctttttcctattaatttgcaaacatttattgaatgtctactgtttacctattttggttaaatatttagtgcctatatttggtactattttgggccctgggtatataaaaataaataagatatgtcctgggcacccagagtatattgggaaaaatagatatgcaaatagctgtaataatgtctgataaatgacactgtaatggtatgaacaaaggctgtggaggsacataggaaaaagcaatcaaatagcgtttccaaatagtgtttccaaagttctttcattttccattattaagtaggggaaagtgaatctccctcatatgaatacagataagtattatctgtatactatctgtctttccccagagccttacatttctttctctcttttaaaaataattatttattgaaacctttttgtgggccaggctctgttatatatgctgggctcgcaaaagtcaactagatagataaggcttgccctcactgagctgactaacattttagtgggagacagacaggaaaaaaagtaaagagatttgcttttaattcttaaagtgtatagattctttcttcttgaaacgtttaaaaatgatattagtataaaatagttttctcattagatttagatatctaaaaatgtgttagatttctaaaaatctaacacatttttagattcctagtaaaataaaatgaatataatggttccttaacttataagtggataattaacttaaaatttcaagagtgttcagggaaagattaaggctcaactttttgtatactactcagagaagccaggatgcctacaaaggtggagcacagcactaatcaaacccatgcatactttaatgcttagcccaccactactaccactaaagcctgacgacaggtccatctgccaatccagtcccccccccataaattcaatacagtctccactaataactttacctaatgtatcaaggaaaccgcagataccactaaggtttatagccaaagaagtcatacttcactactgcacacacacacaagcaaagccaaagggccccacccaagcaataccagagacacagcttcaggaagaagcaccctccatgaaaaaaagtaaattcaaaaatagaaacaacggttacaccagatgtggagatatcaatgtaaagattcaggaaacctaaacctaaaggaacacaataattcttaattattaataattaataataagatagatcttaacaaaaaagaaattatcagaatcccagatgaagaattcaaaatactgattttaaggaagctcggtgagatgcaagagacatctgaaaccaatgtaaagaaatcaggaaaacaattcagaatatgaatgagaaatcaaggagacagatattaaataagaaacagaaattctggaactgaagaatttattgatggaaatagaaaatgtattcaaaagcttccacaatagactagactacgtagaaaaaagaatttgagaactggaagacaaatctttaaaaataatccagtcagacaaaaatatataaaaaatatgaaaaggaatgaacaaagcctttgagaagtttggcacaacataaagtaactgaatttacaaattattggtgttcataagggcaaaaagggatcaaaaggtttagaaagcccatttaatgaaataatagatgaaaacttctcaagtataacaggagatttagatatccagatacaggaagctcagtgatccccaaataaatacaatgcaaaaaggactttgctatggcacattataatcagactgtctaaagccaaagtgaaaggcacattctaaaacagcaagagaaaagcccctagtcacaacagaaactccatcaaactatcagtggacttctcagcagaaactttacaagccagaaaagaattgcatgatatattcaaagtgctgaaagaaatcaactatcagccaataattctatatccagcaagattaaccctcataaatgaaggagaaataaacactttccagacaagcagatgctaagagaattcatcaccaccagaccagacctacaagaaattcccaagggaatcctgaacttargctgagcatggtggctccaatctatgatcccagcactttgggaagcctaagcagtagcatcacttgagtccaggatttcaagaccagcctgggcaacatagtgagactctggctctacacacacacacacacacacacacacacacacacacacacacacacaagttagctgggtgtcatggtgcatgcctctggtcctagctacttgggaggctgaggtgggaggatcacttgagcctgggaggtagaggctgtagtgagttgtgatcaggccactgcactccagtctggacaacagagccacagcctgtctcacacaaaaaagagagtactaaacttgaaaggaaaaggacatttaccatcatgaaaaacattaaaagtgtaagtcattggtagagcaagctcacaaaggaggaagagaaagaaatcaaatggaaccactacagaattacaccaaaccacaatgataaacaataagagaaaaagaagggtacaaagaatttttttaaaaactagaaaacaattaacaatatgacagaaaaaatcccttacatatcaataataactttgaacataaatggactacctgctccacttaaatatgtagactggctgaattaatttaaaaaagatctaagcatatgctgcttataagaaacttacctgaaaagacacatatagactaaaaatagggatggggtggggagatattccacaaaacagaagccaaagcaagcaggagtacttgcatcagataaaacagaatttaagtcaaaaaccataaaaaagacaagatcattatataatgrtagagggatcaattcaggaagagaatagaacaattctaaatacatgcatccaatcctggagcacccgtattcataaaacaaatatgactagatctaaagagagagagacagcaatatggtaatattaggggacttcaacaccctactcctggcattacacagattattgagatagagaatcaataaagaaaagttgaactttaggccaaatggacctgacagacatttacagaacactctacccaacaactggagaatacacactctttacattagcaatggaatgttctccaagatagaccatatattaggctgcaaaacagtcacaacaaattaaaaaaaattgaaatcatatcaagtatcttctcagaccatagtggaatagaactagaaatcaataccaagaggaactttggaaagtatacagacacatggaaattaaacattatgctcctgaatgaccactgggtcaatgaagaaattattattgaaataaaaatttttttgaaacaaatgaaaattaaaacacaacataccaaaatctgtgagatacagaaaaagcagtgctgagagggaagtttatggcattaaatacctacatcataaaagtagaagtattacaaatttataatctaataacacttcaaggaactagaaaagtaaaaacaaacaaaaccccaaattagcaggaaaaaagaaataacaaaaatcagagtagaattaaatgaattagagactaaaaaaaatacaaaagatcaacaaaacaaaaggttggttttttgaaaagataaacaaaattgataaactgctagctagaccaaccaagaagatggaagactcatgtaaaatcagaaattagaatgaagagattacaactgataactacagaaatacaaatgatcatcagagacgattataaatattgatatactcacacactagaaaacctagaagaaatggagaaattcctggaaacataccacctgccaagattgaascaggaaagaatagaaaacctaaacagaccaataattagtagcaatattgaattagtaataaaaaaactcccccaaaagaaaagcccaggaccagatggattcacagctgcattgtaccaaatatacaaagcactaattctaatcctcctgaaacttttacaaaaaattgaggaggaaggaattctccctaactcattctttgaggccagtattattctgatacctaaaccagaggtgacacatataaaagaaaacagatcattatccctgatgaacagagatgcaaaaatcctgaacaaaattctagcaaactgaacccaacagcacatcaaaaatatattacactggattaagggttccaagatggccaaataggaacagctccagtctacagctcccagcatgagtgacgcagaagatgggtgatttctgcatttccaactgaggtaccaggttcgtctcactggggcttgttggacagtgggtgcagcccatggagtgtgagctgaagcagggcggggcatcgcctaacccaggaagtgcaagggcttggggaattcactttcttagccaaggaaagccgtgacagacggtacctggaaaatcaggacacgcccacccaaatactgtgcttttccaatggtcttagcaaacggcacaccaggagattatatcccgcacatggctcacagggtcccatgcccatggagcctcgctcattgctagcacacagtttgagatggaactgcaaggtgacagtgaggctcagggagggacatctgccattgctgaggcttgaataggtaaacaaagtggctaggaaacttgaactgggtgaagcccacygcagctcaaggaggcctgcctgcctctgtagactccacctctgggggcagggcatagctgaacaaaaggcagcagaaacttctgcagacttaaatgtccctgtctgacagctttgaagagagtagtggttctcccagcacagagtttgagatctgagaatggacagactgcctcctcaagtgggtccatgacccgcgagtagcctaactgggagacacctcccaggagggtctgactgaaacctcatacagctgggtgaccctctgagatgaagcttccagaagaaggatcaggcagcaacatttgccgttctgccatatttgctgctctgtagcctccactrttgatactcaggcaaacagggtctggagtggacctccagcaaagtccaacagacctgcacctgagggtcctgactgttagaaggaaaactaacaaacagaaaggacatccacaccaaaaccccatctgtacgtcaccatcatcaaagaccaaaggtagataaaaccacaaagatgggaagaaaccagagcagaaaagctgaaaattctaaaaatcagagcacctcttttcctccaaaggaatgcagctccttgccagcaacggaacaaagctggatggagaatgactttgatgaattgagagaaaaaggcttcagatgatcaggaataacaaacttctccaagctaaaggaggatgttcaaacccatcacaaagtagctaaaaaccttgaaaaaagattagacaaatggccaactagaataagcagcatagagaagaccttaaatgacctgatagagctgaaaaccatggcacgagaactacgtgacgaatgcacaagcttcagtagccgattcaatcaagtggaagaaagggtatcagcgattgaagatcaaatgaattaaacgaagcgagaagagaagtttagagaaaaaagagtgaaaagaaatgaacaaagcctccaagaaataggggactatgtgaaaagaccacatctacgtctgattggtgtacctgaaagtgacggggagaatggaaccaagttggaaaacactcctcaggatattatccaggagaacttccacaacctagcaaggcaggccaacattcaaattcaggaaatacagagaacaccacaaagatactactcaacaagagcaactacaagacatataattgtcagattcaccaaaattgaaatgaaggaaaaaatgttaagggcagccagagagaaagatcaggttacccacaaagggaagcccatcagacaaacagtggatctctcagcagaaactctacaagccagaagagagtggggaccaatattcaacattcttaaagaaaagaattttcaatccagaatttcatatccagccaaactaagcttcataagtgaaggagaaataaaatattttacagacaagcaaatgctgagagattttgtcaccagcaggcctgccctaaaagagctcctgaaggaagcactaaacatggaaaggaacaaccggtaccagccactgcaaaaccatgccaattgtaaagaccatcgatgctaggaagaaactgcatcaactaatgagcaaaataactagctaacatcataatggcaggatcaaattcacacataacaatattaaccttaaatgtaaatggtctgaatactccaattacaagacacagactggcaaattgggtaaagagtcaagacccatcagtgtgctgtattcaggaaacccatctcttgtgcagagacacacataggctcaaaataaagggatggaggaagatctaccaagcaaatggaaaacaaaaaaaggcaggggttgcaatcctagtctctaataaaacagactttaaatgaaaaaagatcaaaagagacaaagaaggccattgtataatggtaaagggatcaattcaacaagaagagctaactatcctaaatatacatgcaccaaatacaggaggccacagattaataaagcaagtccttagagacctacaaagagacttagactcccacacaataataatgggagacttaaacaccccactgtcaacattagacagatcaacgagacagaaagttaacaaggatatccaggaattgaactcagctctgcatcaagtggacctaatagacatctacagagctcttcaccccaaaccaacagaatatacattcttctcagcannnnnnnnnnnnnnnnnnnnataacaaactgtctctcagaccacagtgcaatcaaactgggaactcaggatcaagacactcactcaaaactgctcagctacatggaaaactgaacaacctgctcctgaatgactactgggtacatgacaaaatgaaggcagaaataaagatgtcctgtgaaaccaatgagaacaaagacacaacatactagaatctctgggacacattcaaagcagtgtgtaagggaaatttacagcaataaaagcccacgagagaaagcaggaaagacctaaaattgacaccctaacatcacaattaaaagaactagagaagcaagagcaaacacattcaaacgctagcagaaagcaagaaataactaagatcagagcagaactgaaggaaatagagacacaaaaaaccctgcaaaacaatcaatgaatccaggagctggttttttgaaaggatcaacaaaattgatagaccgctatcaagacaaataaagaagaaaagagagaagaatcaaatagatgcataaaaaatgataaaggggatatcatcattgataccacagaaatacaaactaccatcagagaatactataaacacttctacacaaaaaaactagaaaatctcaaagaaatggataaattcctggacacatacaccttcccaagactaaaccaggaagaagttgaatccctgaatagaccaataacaggctctgaaattgaggcaataattaagagcctaccaaacaaaaaaagtccaggaccaggcagattcacagccgaattctaccagaggtatgaggaggagctggtaccattccttctgaaactattccaatcaatagaaaaagagggaatcctccctaactcattttatgaggccagcatcatcctgataccaaagcctggmagagacacaacaaacaaagagaattttaggccaatatccctgatgaacatcaatgcaaagatcctcaataaaataagggtgaaacaaatccagcagcacatcaaaaagcttatccaccgtgatgaagttggcttcatccctgggattcaaggctggttcaacatacacaaatcaataaatgtaatccatcatataaacagaaccaaagacaaaaaccacattattatctcaatagatgcagaaaaggcctttcacaaaattcaacagcccttcatgctaaaaactctcaataaactaggtgttgatgggacatatctcaaaataataatagctatttatgagaaacctacagccaatatcatactgaatgggcgaaaaccggaagcattccctttgaaaacgagcacaagacagggataccctctctcaccactcctattcaacrtagtgttggaagttctggccagggcaatcaggcaagagaaggaaataaagggtattcaattaggaaaagaggaagtcaaattgtctctgtttgcagatgacatgattgtatatctagaaaaccccattgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggacacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagacaatcctaagccaaaagaacaaagctggaggcatcatgctacctgacttcaaactatattacaaggctacagtaaccaaaacagcatggtactggtaccaaaacagagatatcaaccaatgaaacagaacagagccctcagaaataataccacacacatctacaaccatctgatctttgacaaacctgacaaaaacaagaaaggaggaaaggattccttatttaataaatggtgctgggaaaacttgctagccatatgtagaaagttaaaactgaatcccttccttacaccttatacaaaaattaattcaagaatggattaaagatttaaatgtcagacctaaaaccataagagccctagaagaaaacctaggcagtaccattcaggacataggcacaggcaaggacttcatgagttaaaaaccaaaagcaatggcaacaaaagcctaaattgacaaatgggatctaattaaactaaagagcttccgcacagcagaagaaactaccatcagagtgaacaggcaacctacagaatgggagaaaattttttcaatctacccatctgacaaagggctaatatccagaatcgataaagaacttaaacaaatttacaagaaaaaatcaaacaaccccatcaaaaaatgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtcgaagacagtgtggcgattcctcaaggatctagaactagaaataccatttgacccagtgaccccattactgggtatatacccaaaggatcataaatcatgcttctataaagacacatgcacacgtatgtttattgtggcactattcacaatagcaaagacttgaaaccaacccaaatgtccaacaatgatagactggattaagaaaatgtggcacatataccccatggaatagtatgcagccataaaaaaggatgggttgatgtcctttgtagggacatggatgaagctggtaaccatcattctgagcaaactatcgcaaggacagaaaaccaaagaccgcatgttctcactcataggtgggaattgaacaacgagaacacttggacacagggtggggaacatcacacactggggcctgttatggggtggggggaggggggatggatagcactgggagatatacctaatgtgaatgatgagttaatcggtgcagcacaccaacatggcacatgcatacatatgtaacaaacctgcacgttgtgcacatgtaccctagaacttaaagtataacaactgtatatatatgcatatatgtgtgtgtgtgtgtatatatatatatatatatatatatatatatatatatcactatgatcaggtgggttttatatcgtgatgcaaggatagttcaacatggccaatcaataaaacctgatacattacataagcagaatcaagggaaagaaacatatgttcatctccatagatgcagaaaaagtatttgagaaaatacagtatcccatcatgatacaaactctcaacaaagtgggcatagaaggaatctccctgaaaataagaaagaccatatacgagaaacctacagttaacatcatactgaatgggaaaaagttgaaagcattttctctaagaactggaacaagacaaggatgcccactttcgccattcctattcagcatagtaccagaagtcctagccagagcagtcaggcaagacgaagaaatgtaaggcatccaaattggaaaagagaaagtcaaattatccctgtttgctgatgatatgatcttatatttagaaaaccctaaagactccatacaaaaactcttagatttgataaatgaattcagtaaaatttcaggatacagagtcagtgtacaaaaatcagtggtgttcttatacaccaataatgatctatctaggaaagaaatcaagaagtaaatcttatttacaatagctacaaaaagatatgtagaaataaatttaaacaaggaggtaaaagatctctacaaggaacactagaattcacagataagaaattgtagatgacacaaacaaatggaaaaacatcccatgctcatggatcaaaataattagtattgttaaaatgaacatactgcccaaagcaatctacaaattcaatgcaatccttatcaaaatactaatatcatttttacaggattagaaaaaacaatcctaaaattcatacagaaccaaaaaacagcccaaatagtcaaagcaatcctgagcaaaaagaacagaatagctattattttttttcccacacagttcactgatgtatagaatggctattattaaaaggacaaaaaataacagatgttggcgaggatgtggagaaaagaaaacccttatattctgttggtagaaatataaattagtacagcctctatggaaaactgtatggagatttcccaaaggactaaaaatagaactaccattgcatccagccatccactactgaatatctacccaaatgaagccaatatataaaaaagataccttcacttgtatgtttattgcagcactatttacaatagcaaagatatgcaatcaacctcagtgtccatcaatagatgaatggataaagaaaatgtagtatatatayacacacacacacacacacmtatgtgtgtatatatatacacatacacacacacacatatgtgtgtatatatatacacatacatatatatacaaaacctaggcattaccattcaggacataggcatgggtgtttcacgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaaaggctaatatccagaatctacaaggaactcaaatttacaagaaaaaaacaaacaaccccatcaaaaagtgggcaaaggacatgaacagacacttctcaaaagaagacatttatgcagccaaaacactggccatcagagaaatgcaaatcaaaaccacaatgagataccatctcacaccagttagaatggcgatcattaaaaagtcaggaaacaacaggtgctggagaggatgtggagaaataggaacaattttacactgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacacgtatgtttattgtggcactcttcacaagagcaaagacttggaaccaacccaaatgtccaacaatgatagactggattaagaaaatgtggcacatatacaccatggaatactatgacaccataagaaagatgagttcatgtcctttgcagggacatcgatgatgctggaaactatcattctcagcaaactattgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacaagttaatgggtgcagcacaccagcatggcacatgtatacatatgtaactaacytgcacattgtgcacatgtaccctaaaatttaaagtataataataataaaataaaataaaataaagaaactatctgaatgcaagagaacactcttataattactaatttttgaaagcttaccgtgtaccactcatggaactaaaaactttagattttatacaacaattatagtagagggggtaaggaaaactattaacaactatacaataatgcctcctctcattatatttgtatgtggccatttaaagtagttaaataaattcccagatacttyagataattcatctatttacttaggtcaaatgactctcaaggtcaaggcttaaaattaaacctgaaatgtaaaagtaaacaactgtttactttttacagaaacctgcccaggaaatggccttcagaagcttcatgcttttaaataactaagcccagcctgctaaagtctatgtataataacacttggctgcttaagaacttaaggttgctccctgattcctcacatatcaatgcaatcttttctgtctaagggtgggttcaactttgaatcagcaagtcctaaagtgtttactttcacttgattcattctctgtttcaggtgaactatttaccataatccttttaactctactaatctatctttgctcagaccattcccttgactaggaggtccactgggtgtatcagtccttttcaaaatggcaccccgagctcttttaatcaagtctttctccagacttcacagagacagaaatagagaaactacagcaaaggaatacaaccataacaagattgttaaggggagccaacagtagctgagagccttctgaagaaggaaagctaacagaagggtgttgacagatgaaaacaagaagagaaagctacagtttagaatatgatatgaggagtctgcagaggatgtcagagtcactctgcccactagaatccaaagaatctctggcttggagtaggcaagtatgatacaaggcagaaatgagcagtgggtctgaaaactgaggtgatcacttgaattcctatatgtgaaatgctgtgctccctgtcactttctctattactgtttgccaacagctcaacgcttaaccccaagtcataaaatgagggctttttttcacaacataatttgaggaaattatctggggagtatggccccagagaaaagctgttttatggcaagaaagagggaaaatgccagaaacagaaagacataggataaataaaatggtgtgcctaatccagagatgtctcaaaacacacaattgaaaggacgacatacggtttcagaagaaatatctctatgggggaaaaaaagaagaagacttcacaaaatagttattatgattgaaagagagaccaaatttaggctatgatcaagattcagaacctccagagaaaacaaaaaatatatataggaaacgcataacccaaacataaactagatcagtgtagcacaactttaagcaatagaaaagagaatctatttgaccttcatcataaatcattcccctctgagtggcccaggggttgtgacattgggtccttggagaagaagatatgatttcagtatcctacatcaccctgtactaaataaaatgtatagagtcacagtaacattaatggtgcactgtgattttcaacttttactattagctaacgaacaaatgcagatgacttcattatggttgcatatcagaattaaaatgttaacaaccttggtcaggcttggtggctcatgcctgtaatcccaacactttgggaggccgaggcaggtggatcacctgaggtcaggagttcgagaccagcctggccaacatggtgaaaccccatctctactaaaaatacaaaaattggccgggcatggcggtgggtgcctgtagtcccagcttgtcagaaggctgaggcacgagaatagcttgaacccaggaggcagaggttgtggtgagcagagatcgcaccactgcactccagcctgggcgacagtgggagactccgtctcaaaaaaaaaaaaaaaaaaaaagttaacaaccttgtcaatgtaagaatacaatttgaagtgacagaaaacagaagggaaaggtggaatgcagaagtaaagggggaggaagtggaatggatgctgttagtcttactatacacaaagagtggtcaggacactaattaaaaatgatagaatacaaaacagagggataataataaaacaaaaaataattcaaattatcaaacattggaaggaagaaagggtaaggacacagaggtaggggaacaaaactttcatatttcattgtagggagtaaatagataattccttaaataaatcaatcaaagaaaagagatataagcatacgacttaaagttatgaagtaagcaccagaagatctaaaatcaaacctgcttcctccagattgtgggactggaagcaaaggaggtttttcctagggtgttggattgaaagtagcaaggagcagggcaaaagattattgcttttcatcataagctcttctgctctgtttaatgttttatgatatgcatattttgatctaaaatttttatagatctgaactgaacttcaactcctggaaaattatcaattagccttcttcattcttaccattccacatgtactctcttaacacttttatatttaaaggtactataacatcttgaacattttcatctgctataattattctcatttactttcctaaaactaagttatactgaagttccttgaagtcagtaatcagaacttatttttaatgagattatcagcatttgatacatagtacaatatatttttaattgtgataatgtattaagtgttgagggaagggaaggatagagggagggaaggagagagggaaggagggaggaagggagggagggagagaggaagggaagggaaggaaagggaaggacttgactttcaactttcttatctaatataatacttgattttctgtagtctatctaaccttctgtcttcatctcatatgccagtgttttattcttcttttcagcttttacaaatgtttctgaaattattttttaggagtgctgagatattcccgggaatatgtgttcaatcctgtcagttcacataagatagggagatggcacctgttctctgtctcatagtctgatttcaagggggtgaaaaaagaaaacataagctatggaatgttgtctcttccatgtacctcaagacttatcagtcacccttctccaagcaagttttgcacttgcttccttttctgtccaggctgcatgcttgcaaactgaaagaggaarcaaattttatctctggttttgaggaaattttttttgggggttggtcgtagggacactgggcttttcccatttctttgaatgccaatgaattgactgtatcctaatcccatcattgtctatacaccaattcrtaatgatgtcatgataatcacatcgatctaaaaggcgtaggagagcagcatagcttttattctatttatttttttacttttatttttgacacagggtctcactctgtcacccagactggagcacagtggtacaatcacggctcactgcagcctcaacctctcaggctcaagtgatcctcccacctcagcctcctgagtagctgggactgtaggtgtgcaccaccatgccaagctaactttttatactttttgtagaaacaaggttttgccatgttgcccaagctggtcttgaactcctggactcaagtgattcatctaccttggcctcccaaagtactggcattacaggcatgagctactggggcccaacatagctttcgatcataaaattctccttggggcacctaatctagaagtctttctcaagagaaatcaaaattattgatagttgtttagcacttaggtaactcagaaacaagcatcagaacagatatgctaaatgttgctatttctgtgtagtgagtttcatgcttaactgcctgagaaaggcagacatcttaggaaataaaatattacatagaaaatcaatggagtttggtgatttccatcctttgagacttactgattgtatggtggtctcatcaaatccaatatagcacacaacaggctggtggtaaagtttatgaaagaatctctcgaaaattccaaactgcattaggcctggaagttatgcttcgaggggataaaggatcaaccaatgactggctgaccctgggacacaaaagactgacctgttgccttaaggggagatcattctggtgcgattcactctccagacctcctatgggatcagttagagctatactttagctcagcactttccagtagaaaagctaatgtgagcctcatatgtgattttaaatattttggtagtcatattttaaaaattattagcatttacaaaaaaaatttaagtaaatagaaaaaaatcaaatatttaaaatgtaaaaaaaggtaaaattggttttaaaactgtattttgattaatccaacatatctaaaatatatcatttcaacatgcaatcaatataaaaagattattgacagtttacattttcccatacaaagtatttgaaatccattatgtattttacccttataaaacatctgaattcagatactaaattttcatcagaaatacttgatctgtatttagatgtcataaaaacttatagttgaaaaagatgattcacatactcataatttaaagtttttcaatagctgaatgaagtattggtttttaaaatttaagttacaattagataaaattagaaattcagatcctcagtcacactctgcacatttcaagtgctcagcggccacatgcagtcaatgtttgccatcccgtacagtccaagctttagttcaacttctctcagcttcttctctgccctctcctgcttccctcaccccctcgtagatttcacttgacgggactccagtaaatcagttgcacaagaacctccatcttaggttctgctacttgggcacccagcctgtataaactatagtctattataatctactcgcagagatttgcaatacaattcagcattttaagaatgttgactgagaagttatctagtaatgaacccatgcttagaatttttaattgagttttatgaatttacttaatgtttttcttacagaagagttcttaacatttctagaaacacttgttttccaaggatcacagtttgaggctgtactagagaattattctcaagcaatttcaaagatacttagagtgaccagagtaacatatattaaatgacagaaaaaataaagggaaatggagatacacaattatcaaacagtcaacaaatatttctttagtataaacttgaaaggcaatcccaactctgtgaataactaaccaggtagctctaggcaaatcattttttctttctagatttgagtctccttatttgccttatgtgcattatctcatcaagacacataaatacaaatcagtattattgtagttattattatcatcattaatattagagaggcactgtggagatgtaacctatcttccacatattaatgccagataaatcttcctaaaacatagacttagtcctgttactgtttgactaaaaaattttgtaaggatgccccagcatccttatcttgccattgaaggatctccaaggtttattccaaatttatcattccaagtttatttccaacttcactttccatctatcccacataatgaaccagctttgaggagttccagcactggatggccagtatgaaaatgatgaaccaaaaaggagattgaaaagaaattaccaaagatgtgaaaaagaaaccaggactggcagtgctccattagtcaaggaaacagtatttcaaaaagagaaaataatcaactatgtcaaatatgctgagagttcaagtcagatgacactagagatagcaaagtttgtaaagaccttgtgaagaagatgctgagttcagtttatacatggtgagtatgtaataccaaaacagccaggtggaaccacctagtaaaaggttacagcagtaatgttgtccacagtatgtgtcactactcactggggaagaaatgaacagtttcaactagtatgttgaacatcaaacattcccaagagtggccattatttgtgggagtgagatgagtatgattatctatgtattaatgtagaaaaattattgagaagcactcagaatttggcagtggaactttacatgagaactaaaagttgtcaatatagcaactgtaattcaaatcatgagaatgaagaagctctcccaggaaaggaaacaagaagtgacagagaggaccaagactaacactaaaaaaagagacaagaggaagaagtcaatgaggaaagagaaagacgatgtggggaagtaatagaagaatttcatatataatattctaaaagaaaggcggaaagtttcaggatgagtaaataaatgtcgaatgcagcacaggagttgaagagaattaaaattgttcaaaagtaattggattaaacaacaaatacaccaagcagaacaggtcaggtaaaacaggattaggagtttaagaaaagagtagactaaaagaaagtggaattgttattgaatatttgccagttgtaaagcaggggcaagctaatatgtgtgaagaaagaactaatgaaaaggaaggtaaatgaacatgctacagaaaaaaaggtaattgtagaataaaagtctctcgagaagagaagagaagggatgagctaagatccagataatgattggaaagattagttttaaagagcaaaaaggaacaccacttcttttgaaacttaagaaagggatgagaagaaacagtcaaggacagaaattcttaagatttttattcctccccctgagcaactgcaatagcttaatgcactctttaatgctagaatgtgcaacacaacaataattttcagacccatcttctgtgaacataaactttaggtcactctgttacctttgcacacatttatgaaatggctacgctgtggtgccatcgctatagctgtgaaggagagcagagccatggctaatataagaatcacacctctgatttcagactctttaccagctgagatttcaggccacattttagtttctaggactcattacttacaaatcaacctgttaacatgcattaaatctttgctcccacctttgaattatacttcaaagtaaatggtacacagcttacagaatttctcrtactttcaaaactggaattactgttatttcttaaatcagcttgtctatatgtccagcatatcaagtaactcaaattggaatggctatgcacacatattaagtacttcccaatcatccgcacacctcataatggttgacactgaggagtttgctgaaaatatcaaatgcactaaaagaaaagtctgctgaagatttttcaagagaacattatggaataccatgttgaacgtttttttagcaattagtagtttacaagcaatgtagctaattatctcatcagtcttcaatggaaatgtttccataaactttctgccagctacaggacacaatgcatgcatgttaaaatgtgttagaacaagagttcatcattctctttcaaatgaagaacgaactgcgtctcctgaagcatgctataccaagttgaaaagaatattgcatttgtgtcttaatgcttatctaaggacattgttaagttataataacagttaaatgcacacaacaccaacatagtaagagatggaagtaatgagggcagcagctgttgcctttgaaaccatatataggctgtgagcaattggtggtaaataccaaacatttcacctaagtcctaactgcaacattgttgaacaagtagatggagctgacccgttacttaggaatcgttaacaaaaattgaactgctattttcttttataaataaatattcaatatagctgagtttcaaaagctctttcaatacaggtaacccaaaatggacaccagtaaaaatttttctaatctctagttccctaggacaaaatttatttccttgcatatatatatatgtgtgtgtgtctgtgtgcatataaatatgcatatatatatgtgtgtgtgtgcgtgcaaggaaatatgtactgtactatacacacacacacacacacatatatatatactggaacaatcagggagaagataggtaacattttaaatgttcaatattgaaaattctataatgccatttgttgtttaagtacctaagtatactgataggaagattaagtacacttccaggatgccactttccaagaataatcatttctggaagtaatggttttctctgactaatatggatggtggtaagccttgactcctaattcctactgcaaaaaaaaaaacagtctgtagcctggagtcttgcaaacattgagatgaagaactatgaaaatgtagaaagagagataaatagaaaaaatacacaagtacatatgttatgcacatgaggtatgtgaacattttttaacccaaagtttactactcacaagggagagagaaagtcccctagtttctggctacatccactaccctgccagacatattcatgagccatgcaaagtggggcaagttgtcaactactgtaggcctaagctctacaaacatgcagctgggaggctcctgcattaatatactaaataccatagcatttcttttaatacaaaataccataaccccatatttaggaaggagagctatagttagcttctgatagattcgaaagctccacattaatcttcctagccctccaactgactcttgatgaccttggtggaggcctacaattaaaaatagatgggaggcagtttagcagtggcaagcttccattaatttgcaagacctctcccagtaaacatacatgaacatgaagcccgtggtatctgtttggaattgctacctctggtaggcataactaccgaggctatagacattagactgcacattcaagctccagataattcacatgaaaggatacagatttttctttgtacaaatatatggggtacacctgtaattttattacttgcatagattacatagtggttaagtcagggctttcaaggtattcatcacccaagtaacgtacattgtacgcattaaccaatttctcactatcctctccgctctaaccctctcacccttccaagtctccattatcaatcattccactttctacattcatttatacacaatttttagcatccacttatgaaagcatgcaatatttgtctttttgtccctggcttgtttcacttatgataatgatacccagttctatccaatttgctgcaaaagacatatttcattcttttttttttttgccattttctcatttcttatttttattgtcttgttttattggaaatatagttgttgcatctgtttctttttttattttattattattatgctttaagttttagggtacatgtgcacaacatgcaggttagttacatatatatacatgtgccatgctggtgtgctgcacccattaactcgtcatttagcattaggtatatctcctaatgctatccctcccccctccccccaccccaaaacagtccccagagtgtgatgttcccctttctgtgtccatgtgttctcattgttcagttcccacctatgagtgagaacatgyggtgtttggttttttgtccttgcgatagtttactgagaatgacgatttccaatttcatccatgtccctacaaagggcatgaactcatcattttttatggctgcatagtattccatggtgtatatgtgccacattttcttaatccagtctatcattgttggacatttgggttggttccaagtctttgctcttgtgaagagtgccgcaataaacatacatgtgcatgtgtctttatagcagcatgatttatagtcctttgggtatatacccagtaatgggatggctgggtcaaatggtatttgtagttctagatccctgaggaatcrccacactgacttccacaatggttgaactagtttacagtcccaccaacagtgtaaaattgttcctatttctccacatcctctccagcacctgttgtttcctgactttttaatgatcgccattctaactggtgtgagatggtacctcattgtggttttgatttgcatttctctgatggccagtgatgatgagcattttttcatgtgtttttggctgcataaatgtcttcttttgagaagtgtctgttcatgtcctttgcccactttttgatggggttgtttgtttttttcttgtaaatttgtttgagttcattgtagattctggatatcagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcctatgcctatgtcctgaatggtaatgcctaggttttgtatatatatatatatatatatatatatatacacacacacatatgtgtgtgtgtgtgtttgtgtgtgtatatatatataatatatatatactgcattttctttatccattcatctattgatggacactgagtttgattgcatatctttgctattgtaaatagtgctgcaataaacatacaagtgaaggtatcttttttatatattggcttcatttgggtagatattcagtagtggatggctggatgcaatggtagttctatttttagtcctttgggaaatctccatacagttttccatagaggctgtactaatttatatttctaccaacagaatataagggttttcttttctccacatcctcgccaacatctgttattttttgtccttttaataatagccattctatacatcagtgaactgtgtgggaaaaaaaataatagctattctgttctttttgctcaggattgctttgactatttgggctgttttttggttctgtatgaattttaggattgttttttctaatcctgtaaaaatgatattagtattttgataaggattgcattgaatttgtagattgctttgggcagtatgttcattttaacaatactaattattttgatccatgagcatgggatgtttttccatttgtttgtgtcatctacaatttcttatctgtgaattctagtgttccttgtagagatcttttacctccttgtttaaatttatttctacatatctttttgtagctattgtaaataagatttacttcttgatttctttcctagatagatcattattggtgtataagaacaccactgatttttgtacactgactctgtatcctgaaattttactgaattcatttatcaaatctaagagtttttgtatggagtctttagggttttctaaatataagatcatatcatcagcaaacagggataatttgactttctcttttccaatttggatgccttacatttcttcgtcttgcctgactgctctggctaggacttctggtactatgctgaataggaatggcgaaagtgggcatccttgtcttgttccagttcttagagaaaatgctttcaactttttcccattcagtatgatgttaactgtaggtttctcgtatatggtctttcttattttcagggagattccttctatgcccactttgttgagagtttgtatcatgatgggatactgtattttctcaaatactttttctgcatctatggagatgaacatatgtttctttcccttgattctgcttatgtaatgtatcaggttttattgattggccatgttgaactatccttgcatcacgatataaaacccacctgatcatagtgatatatatatatatatatatatatatatatatatatacacacacacacacatatatgcatatatatacagttgttatactttaagttctagggtacatgtgcacaacgtgcaggtttgttacatatgtatgcatgtgccatgttggtgtgctgcaccgattaactcatcattcacattaggtatatctcccagtgctatccatcccccctccccccaccccatgacaggccccagtgtgtgatgttccccaccctgtgtccaagtgttcttgttgttcaattcccacctatgagtgagaacatgcggtctttggttttctgtccttgcgatagtttgctcagaatggtggttaccagctccatccatgtccctacaaaggacatcaacccatccttttttatgactgcatagtattccatggattatatgtgccacattttcttaatccagtctatcattgttggacatttgggttggtttcaagtctttgctattgtgaatagtgccacaataaacatacgtgtgcatgtgtctttatagaagcatgatttatgatcctttgggtatatacccagtaatgggatcactgggtcaaatggtatttctagttctagatccttaaggaatcgccacactgtcttcgacaatggttgaactagtttacagtcccaccaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccattttttgatggggttgtttgattttttcttgtaaatttgtttaagttctttatcgattctggatattagccctttgtcagatgggtagattgaaaaaattttctcccattctgtaggttgcctgttcactctgatggtagtttcttttgctgtgcagaagctctttagtttaattagatcccatttgtcaatttaggcttttgttgccattgctcttggtgtttaactcatgaagtccttgcctgtgcctatgtcctgaatggtaatgcctaggttttcttctagggctcttatggttttaggtctgacatttaaatctttaatccatcttgaattaatttttgtataaggtgtaaggaagggattcagttttagctttctacatatggctagcctgttttcccagcaccatttattaaatagggaatcctttcctcatttctagtttttctcaggtttgtcaaagatcagctggttgtagatgtgtgtggtattatttctgagggctctgttctgtttcattggttgatatctctgttttggtaccagtmccatgctgttttggttactgtagccttgtagtatagtttgaagtcaggtagtgtgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtrgtttgtagttctccttgaagagatccttcacatcccttgtaagttggattcctaggtattttattctctttgaagcagttgtgaatgggagttcactcatgatttggctctctgtttgtctgttattggtgtataagaatgcttgtgayttttgcacattgattttgtatcctgagactttgttgaagttgcttatcagcttaaggagattttgggctgagatgatggggttttctagatatactatcacgttatctgcaaatagggacartttgacttcctcttttcctaattgaataccctttatttacttctcctgcctgattgccctggccagaacttccaacactatgttgaataggagtggtgagagagggcatccctgtcttgtgccagttttcaaagggaatgcttccagtgtttgcccattcagtatgatattggctgtgggtttgtcatagatagctcttattattttgagatatgtcccatcaatacktaatttattgagagtttttagcatgaagggttgttgaattttgtgaaaggccttttctgcatctattaagataatcatgtggttttgtctttggttctgtttgtatgctggattacctttattgatttgtgtatgttgaaccagccttgcatcccagcgatgaagcccacttgatcatggtggataagctttttgatgtgctgctggattcagtttgccagtattttactgaggatttttgtatcaatgttcatcaaggatattggtctaaaattctcttttatggttgtgtctctgcccggctctggtatcaggatgatgctgacctcataaaatgagttagggaggattccctctttttctattgattggaatagtttcagaaagaatggtaccaattcctccttgtacctctggtagaatttggctgtgaatccatctggtcctggactctttttggttggtaagctattgattattgccacaatttcagatcctgttgttggtctattcagagattcaacttcttcgtggtttagtcttgggagggtgtatgtgtccaggaatttatccatttctttgagattttctagtttatttgtgtagaagtgtttatagtattctctgatggtagtttgtatttctgtggcattggcggtgatatcccctttatcattttttattggatctgtttgattcttctctctttttgtctttcttagtcttgctagcagtctatcaattttgttgatcctttcaaaaaaccagctcctggattcattgattgttttgcagggttttttgtgtctctatttccttcagttctgctctgatcttagttatttcttgctttctgctagcgtttgaatgtgtttgctcttgcttctctagttcttttaattgtgatgttagggtgtcaattttaggtctttcctgctttctctcgtgggcttttattgctgtaaatttcccttacacactgctttgaatgtgtcccagagattctagtatgttgtgtctttgttctcattggtttcacaggacatctttatttctgccttcattttgtcatgtacccagtagtcattcaggagcaggttgttcagtttccatgtagctgagcagttttgagtgagtgtcttgatcctgagttccagtttgattgcactgtggtctgagagacagtttgttataatttctgttcttttacatctgctgaggagtgctttacttccaactatgttgtcaattttgtaataagtgcgatgtggtgctgagaagaatgtatattctgttgrtttggggtggagagctctgtagatgtctattaggtccacttgatgcagagctgagttcaattcctggatatccttgttaactttctgtctcgttgatctgtctaatgttgacagtggggtgtttaagtctcccattattattgtgtgggagtctaagtctctttgtaggtctctaaggacttgctttattaatctgtggcctcctgtatttggtgcatatatatttaggatagttagctcttcttgttgaattgatccctttaccattatgcaatggccttctttgtctcttttgatcttttttcatttaaagtctgttttattagagactaggattgcaacccctgcctttttttgttttccatttgcttggtagatcttcctccatccctttattttgagcctatgtgtgtctctgcacaagagatgggtttcctgaatacagcacactgatgggtcttgaatctttatccaatttgccagtctgtatctgttaattggagcatttagtccatttacatttaaagttaatattgttatgtgtgaatttgatcctgtcattatgatgttagctgcctattttcctcgttagttgatgcagtttcttcctagcctcgatggtgtttagaatttggcatgtttttgcagtagctggtaccggttgttcctttccatgtttagtgcttccttcaggagctgttttagggcaggcctgttggtgacaaaatctctcagcatttgcttgtctgtaaagtattttatttctccttcacttatgaagcttagtttggctggatatgaaattctgggttgaaaattcttttctttaagaatgttgaatattggcccccactctcttctggtttgtagagtttctgccgagacatccgctgttagtctgctgggcttccctttgtgggtaacccgacctttctctctggctgcccttaccgttttttccttcatttcaactttggtgaatctaacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccctatttcttggaggcttcgttcatttcttttcattcttttttctctaaacttcccttctcgcttcatttcattcatttcatcttctatcactgataccctttcttccagttgatcgcatcggctcctgaggcttctgcattcttcacgtaattctcgaaccttggttttcagctccattagctcctttaagcacttctctgtattggttattctagttgtacattcgtctatatttttttcaaagtttttaacttctttgcctttgatttgaatttcctcctgtagctcggagtagtttgatcgtctgaagccttctctcaacttgtcaaagtcattctccgtccagcttcgttccgttgctggtgaggagctgtgttcctttggaggaggagaggcactgtgctttttagagtttccagtttttctgctctgttttttccccatctttgtggttttatctacttttggtctttgatgatggtcatgtacagatgggtttttggtgtggatgtcctttctgtttgttatttttccttctaacagacaggaccctcagctgcaggtctgttggagttttctagaggtccactccagaccctgtttgcctgggtatcagcagcggtggctgcagaacagcgtattttcgtgaaccgtgaatgctactgtctgatcattcttctggaagttttgtctcagaggggtacccagccgtgtgaggtgtcagtctgcccctactgggggttgcctcccagttaggctgctcgggggtgaggagtcagagacccacttgaggaggcagtctgcctgttctcagatctccagctgcgtgctgggagaagcactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcacccctcccccagcctcgctgccaccttgcagtttgatctcagcctgatgtgctagcaatcagcgagactccgtgggcgtaggaccctccgagccatgtgcgggatataatctcctggcgtgccattttttaagcccgttggaaaagcgcagtattagggtgggagtgacccgattttccaggtgccatctgtcacccctttctttgaccaggaaagggaactccctgaccccttgcgcttctcgagtgaggcaatgcttgccctgctttggctcgcgcacagtgcactgcacccactgtcctgtgcccactgtctggcacgccctagtgagatgaacccggtacctcagatggaaatgcagaaatcacccgtcttctgcgtcgctcacgctgggagctgtagaccggcgctgttcctattcggccatcttggctgccagccgcattcagatagtttcatgctttttcagaacactttgacatatatcaatggcaagatctttatagcaatctcagtgaagaatagaattgatattaaaagcctatttttaagcatggtagaactgagagaaaaaggggtgggtggaagaggtgtcaaacatgacacagttttaaaagtgttttaagcagtataatagttttaataaggtaagattcacttgacctattccagctcctttctagtggagtatatttgggagggaccatactacagaggttggaaagataaaaaatacatttccaaggctcttcttgcatctgggactatgactcaggttctgcaaaaaagatgcatacctgtgagacttgtaaggatgaggtaagcagtatgagagtggccatgtttagaaaggttggaaagataaaaagatacatttccaagactcttcttgcatttgggaatatggcttaggttctgcaaaaaagatgcatacctgtgaaacttggaaggatgaggtaagcagtatgagagtggccatgtttagagagatagggtcttgttgcaatctagtggcagaagcatttgttcttttagggcagccctgacagagtttctcaggcccagttcctagtatcataggtgttgagtaatgagtggtggtagtagtggggtttctacctaaaatagagctatggtggcattagaagttgttcttggttgatgttcctgccttaatatcattcaaacctggcttttctgggccttgcagaaattctgtaaacaacccaataaccctgaacaaattcctttaccttttaaattagttagaatagattctgttatttgaaactgagatccctttcagatacatatgccaagaccagatttgtctctcaggagtatactcacattaactaagatcatgaagctaagatgtaaaatcagaacctattttaaatttataatgaaaaagttatgcagaacaaagtacacccacacaaccaatatgttctctcactgtagatggatcaatataggcaacataaataataatcagaagattgcttagtgagcatagagatagaacaaaggaggctggataaattgaatgcttaatggtgaaagttaaaaatcatcagattcatctatcctttctgtagagataatcttaccaatggggttctactatgtatggtttattatataaagctcttactctgttggaaactgtttggatgaatatcacmaactttcttttttccatggttgacacagtccctttttgattgataattcctttttttagatataccaaaacttttagttaatttatagtcaaggttagccattgaagcctgggatccattctgttactttaagatgactggtcacagtgcaatcaaactagaagtcaggattaagaaactaactcaaaactgctcaactacatggaaactgaacaacctgctcctgaatgactactgggtacataacaaaatgaaggcagaaataaagatattctgtgaaaccaatgagaacaaagacacagcataccagaatctctgggacacatttaaagcagtgtgtagggggaaatttatagcactaaatgcccacaagagaaagcaggaaagatccaaaattgacaccctaacatcacaattaaaagaactagagaagcaagagcgaacacattcaaaagctagcagaaggcaagaaataagtaagatcagagcagaactgaaggagatagagacacaaaaaacccttcaaaaaatcaatgaatccaggagctggttttttgaaaagatcaacaaaattgatagactgctatgaagactaataaagaagaaaagagagaagaatcaaatagatgcaataaaaaatgataaaggggatatcaacactgatcccacagagatacaaagtaccatcagagaatactataaacacctctaagcaaataaactagaaaatctaaaagaaatggataaattcctggacatatacaccctcccaagactaaaccaggaggaagttgaatccctgaatagaccaataacaggctctgaaattgaggcaataattaagagcctaccaaacaaaaaaattccaggaccagatggattcacacctgaattctaccagaggtacaaaaaggagctggtactattccttctgaaactattccaatttatggaaaaacagggaatcctccttaactcattttatgaggccagcatcatcctgataccaaagcctggcagagacacaacaaaaaaagaggattttaggccaataaccctgatgaacatcgatgcacaaatcctcaataaaatattggcaaaccgaatccagcagcacatcaaaaagcttatccaccatgatcaagtgggctttatccctgggatgcaaggctggttcaacatacacaaatcaawaaaygtaatccatcatataaacagaaccaaagacaaaaaccacatgaattatcttaatagatgcagaaaaggcttcgacagaattcaacaacccttcatgctaaaaactctcaataaattaggtattcattggacatatctcaaaataataagagctatgtatgaaaacccacagccaatatcatactgaatgggcaaaaactggaagcattccctttgaaaactggcacaagacagggatgccctctctcaccactccttttcaacatagtgttggaagttctggccagggcaatcaggcaggagaaagaaataaagggtattcaattaggaaaagaggaagtcaaattgtctctgtttgcagataacatgatagtatatctagaaaaccccatcgtctcagcccaaaatctccttaagctgataagcaacttcaacaaagtctcaggatacaaaatcaatgtacaaaaatcacaagcattcctatataccaataacagacaaacagagagctaaatcatgagtgaactctcattcacaattgcttcaaagagaataaaatacctaggaatccaacttacaagatatgtgaaggatctcttcaaggagaactacaaaccactgctcaacgaaataaaagaggactcaaacaaatggaagaacattccatgctcatggataggaagaatcaatatcrtgaaaatggccatactgcccaaggtaatttatagattcaatgccatctgcatcaagctaccaatgactttcttcacagaattggaaaaaaactacttaaagttcatatggaaccaaaaaagagcccgcattgccaagacaatcctaagccaaaagaacaaagctggaggcatcacactaccagacttcaaactgaactacaagactacataaccaaaacagcatggtactggtaccaaaacagagatatcaaccaatgaaacagaacagagccctcagaaataataccgcacatgtacaatattctgatctttgacaaacctgacaaaaacaagaaatagggaaaggattccctattcaataaatggtgctgggaaaactggctagccatatgtagaaagctgaaactggatcccttccttacaccttatacaaaaattaattccagatggattaaagacttaaatgtcagacctaaaacgataaaaaccctagaagaaaacctaggcaacaccattcaggacataggcatgcgcaaggacttcatgtctaaaacaccaaaagcaatggcaacaaaagccaaaattgacaaatgggatctaattaaactgaagagcttctgcacagcaaaagaaactaccatcagagtgaacaggcaacgtatagaatgggagaaaatttttgcaatctacccatctgacaaaaggctaatatacagaatctacaaagaacttaaacaaatttacaagaaaaaaatcaaccccatcaaacagtaagtgaaggatatgaatagacacttctcaaaagaagacatttatgcagccaacagacacatgaaaaaatgctcacaatcactggccatcagagaaatgcaaatcaaaaccacaatgagataccatctcacaccacttagaatggcgatcattagaaagtcaggaaacaacaggtgctggagaggatgtggagaaataggaacacttttacactgttgggactgtaaactagttcaaccattgtggaagacagtgtggcaattcctcaaggatgtagaaccagaaacactgtttgatccagtgatcccattactgggtatatatccaaagtattataaatcatgctgctacaaagacacatgcacacgtatgtttattgtggcactattcacaatagcaaagacttgaaaccaacccaaatgtccaacaatgatagactggattaagaaaatgtgacacatataccccatggaatactatgcagccataaaaaaggatgggttgatgtcctttgtagggacatggatgaagctggaaaccatcattctgagcaaagtatcacaaggacagaaaaccaaacactgtatgttctcactcataggtggtcattgaacaatgggaacacttggacacagggtggggaacaccacacactggggcctgtcgtggggttgggggaacggggagggatagcattaggagatatacctaatgtaaatgatgagttaatgggtgcagcacaccaacatggcacatgtatacatacgtaacaaacctgcacattatgcacatgtaccctagaacttaaagtataattaaaaaaaaaagaaaagaaaaaaagatgactggtcatttgaccctcaaaatataattcatttctattgtattcttgaatgtgagaagaaaattctttttctttttttgtatatctcttccatccattgtgtaagtgatgactgcagtttaattcccagagaataatcttatttcccgtatttttaaatgccattcctcaaatgctgctaataagtaaaatgcaggtttcttaatgtccagattactattatttctcccacactaataggagacgctttgggctaaagactctctcagttaattagtaacattttaagaggactttaaaatgtttagatttcgatagtgactcaagatgtttttccaggatcacagcttatgaactcatttctaataaaagaagcatttagaaagaatgacttgacttcaaagtaccagttagtatgtataaacctaggtaaaatgaattaaattttgtacataatatattattattaaatatagatttaaggggtatagttacaaaygatttttaggagctagtgtgtctaagtgcctgagggtctattatggagagaaaggagttgttgaactttattgaagagcatgttctttacagcaaaactgtttttatcacacacacattccatactaaattcctgctcaaattgaaatcacagttgaaagacaaaactaaaaggtgcaccagtgcccccaaatcagtgaaaatttaagatcacagaacaagagaagtttctggcaatgaaagagattgggtggtaaaaaaacggggttaaaaaagggccaaagaaaaaaattgatgaagaatccactcaaaatagtattgcatccattaatgacagactggatgaagaaaatgtggtacatatacatcatggaatactatgcagccataaaaagaaatgagatcatgtcctttgcagggacatgaatggaattggaagtccttatcctcagcaaactaatgcaggaacagaaaaccaaacactgcatgttctcacatataagtgggagctgagtgatgagaacacatgggcacaaggcgggaacaacacacactgggtcctgtcaggggttgggttggggagggagagcatcaggaataattgataatgggtgctgggcttaatacttaggtgatgggatgatctatgcagcaaaccaccatggtacacatttacctgactgtcctggcctgccactccccagtcctgtgcctataaaaacccccgagactctagcaggcagacacacaagtggctggatgtggagacaaacacatcttggtggaggaatacacaagcagctgaacattgagagggcgtcgatgtacaggtaacaaacctgtacatcctgcacatgtacccctgaacttaaaagttgaagaaaaaaaatagtattgcatgaaaatcatataatcattattccaagttggctcaaggatttggctggttcaggtctaacctctaacaacgaaaaaaaacctataagaaactataaaataaggaatgattgtacttaaatatgcatggacctgtaatatcaaatgcatccttgaattgtcgtattgtattcttgaatgtgcgttgttatccttttctgtgtgctagcacattatatgagataatacttctcatttttctttgcttttggacactagcggctatcaatgagatctcctgttttatcttcctcatcaaatattcagtctatactgataacccaaaagaaagaattagcaactcttattttcccttacttgcttcaccgtttcctccttctattccaaaatttttcattgctcctttttttacccaatatttttgacctcttctttcctctttagtctatggcatttacccagtttaataaataccagtttcaaacatccctgagggaggcatttggaagtgagagtttctattgatagtccactggttatggacagttgaacccctaaaatagtgtgattgatagtgaaacgggaaaagttcccttgtcctcctcagggggtgtgtgatgggagtgtggctcgcttcttcagtgccccgctgctcacatctctaggggagcatacagacgggcaggctgtggggctccaaccccacaacagtgtctaggggcgaatgtttacagctctgaagccccagtgggcatgtgttacagggtgctcttttagtttagccatccgtagacggcttgcgttagctcaatgagacccctgccttatctcaaggacagggctttttgtatcctggggttcttgccttggtgtaccagaagaattggatcacacatgggcttggagaatgagttcaagcttttattgagtggaagtagctctcagcaggtgggggagacagaaaggagatggtttcccctagaaaactgcctgactcttctccgactgcccagtaaaactccacgtcgttccaccggtcgatggcctgcgggtctgctcttgatgtcctcttcacgtccagccacttgtgtcttcttccaccgatctcctcctctcgacgccctctcaatgttcagctgcttgtgtattcctccaccaagatgtgtttctctccacgtgcagccgcttgtgtgtctgcctgccagagtctcgggagtttttacaggcacaggactggggagtggcaggccaggacagtcctgggaaatgcaacatttgggtgcaaagtcaggagtgcctgtcctcacctaggtctgtgggcacaggcctggaggtggagccctcgccaggaaccacaccctcctctacccagctcttctctgcctcctttccctgtcaatagcaagctgagatttatgatagactgagacacgaaagtttgctgaagctccatgggaaattcttctgtaagtttcatgggagtagccttgattttgacgtgataaatcttcacactaaaatatataaaatatgaacacagcagtgaggatacttttgccttttaaaaactccatgtttatttagtatgtttctctgagaactaaaggctttcacctattttctttatttcacctatttctttattctatgaataaagaaatttctttattctacggtaaagaaatttctttattctttaataaaagaatttctttattctttaaataaagaattcttaatttaaataatttattctttaaaaaaagaatttctttattctttaaataatttctttattctttcttcatttcacctttatttctttatttcacctattttctttattctatgtgtttccataatctttgtgtttgcataataaggatattgataccaaaaaattatgtgacttgctcaggatttcattgaaaggtagcgaacaaggtagatgagctggctgttgactcctgcagtatagtttttcactattatgctttggggtgaggagaaaattcatacctccttttgatattacactgggagcattatttagagctggctgagtattcttcggggaactatttaactgaggcatatgggaaattcctgagatgctaatattattagatatatgaatactgaagctgaaagactgctgggtcaaattttattcttttaagggataaactcaactttatgttgtctgggattttcaggcaaggtccatgtattcagcttaagatatgaaagccaactaaataatttttgaaaaagaatttttagggccacatttatatatatcaaaatggagacccttgttagttgtatgaactttttaaaaatgaagtgctttttaaaaaaacagattatgaattttattagttcatttatctcagatgagggatcagcaaacattctctgtgaawggccagaaagtaaatatttcaggctttgtgggccgtacattgttgcaagtatttaactctgtgtgttgaagaatgaaaatagctatagaaatatgtaagcaataaacaaaaagttatggttgtgttccaataaagctttatttatgtatactgaaatttacattttatataatttttcatgtcataaaatattattcttttgattttttcccaacctttaaaaatataaaaaacattcatagcttgtaggctgcacataaacagggcaggctggatttggcttgtttccatagtttgccgactctgtctgaagtaaaggaactaagaatacaaggaatttcaaaaatatttgacctcttacttgttaagaatctcaagtttctcagactgaatgtatcattggtgggaaaagtaaaaagaaaggacaattaaagctactgttaatttttgtgcaaaagacaactaatatttatagctcagagtttgcttttagctacaaaatgagctctatggggtctccagggatttccgagagagatgcattctgctcatggttttggggcagcatggtgaacaagatcgacaccctctacccccacccttttaatgatcttgatattccccccaaggagagaagttagctgcaatgtatgtaaatgttacttttctactgcttcattataataattactcactagtttttacagttattaaagtgacagtttccagtacatatacatacacattgatttttttttggtcccctctgcaggtatgtttttagccttgtgtttttgactacacaagaaatgtgcctatttttaaataataaaaaaaacttattcaaaggtccttactaaaacctctgtacatctttaattatgctttaataatttagattatatttatgatagaatgtcattttatgtgcttattgaccatttgtattttttctttggagaaatgtctatttagactcttcgcctattttaaaaacaggattgtctttttattattaagtagtaagtttttttttaatagattctggatataagccccttattggatatagggtttacaaacattttcttccattctgtgtgttgtctttttaccttcttaatgattttttttttggagtccaaaaggtttaagttttgattgtccagttcatcaattttttttattgcttgtacttttggtgttatatataagacattgttgcctaactcaagattataaagttgtattcctgttttctttttctaagagttttatagttttagctcttgcaagtaggtctatgatctaccataaacgtaaaggtttatttctgagatagcaattctattggttattatagcttcctagtaagttttgaaattgggaagtgtgatttctataactttgcccctctttttcaagattgttttggctattctgggtcccttgcatttctgtatgaattttaggatcagctggtgaatttctttgaaagagccagtaaggattttgttaaaagtgttagtccatttttgcattgctataaaggaacacctgagactgggtaatttataaagaaaagagatttaattggcttatggttctgcagattgtacatggagcatagcaccagcatctgcttctggtgagggcctcaggaagcttccaatcatggtggaaggcaaagggggagctagcattgtcacatgacgagagtgggagcaagaggagtgcgaggtcccagactcttttaaacaactagatctcatgggaactgagcaagaactcacttgttatcatgaggacagcaccaagacattcataagggatgcaccctcatgacccaaacacctcccactgggtcccacctccaacactggggattacatttcaacatgagatttggcggggataaacatctaagcgatatcagtcagggattattgtgaatctgtggaccgatatggggagtattgctatcttaacaatattaagtcttctaatccatgagcatgagatatgatcatttatttaggtcttctttaatttgtcagcaatgttttgcagttttcagtgtacaagtcttacacttctttgttaaatttattcctaaatgttttatttgttggatgctcttgtgaatggaatgtatttacttttgtaatggttcagaatcctggatgtttatcttcactaaatttttatgctcctttgggtttcactctgtactttcagtatgtacagttggccacattgacttccttgcaagttttgtgtgagcttgtgaactaagactttataatggggccctaaaataacttctgtcatttctgcataaggagcatatcaatagggccaaatttgaccttactgattaacagctgtagtactctgaatggggtgatatatgaaagaataaatttgttaaatatttattgctctgatcacagctgtgggacttgaatttctagtaaggtgaagcctgaattctactttattacttaacctcttgatgaatagaactttgttgaggctgattataagtgataattgataactggtaattttattttaaaatgattgagtgatcctttgatgtagtcactctcgtttttcattttttctcagagaacttttaaatcatacataaaatattgaaatctaggaattgtgcatatgaagaattattatacttgtattttttgggggggaggtgctatggaattatgtcttaatatactttaaggtaggtgtatctgaagatgctgacatttaaaaccaaacagaagaatcttctcattgaagtggttcattttcctatttgagggtacctggtggagaccatgttataatcgttgttgtataccccatagtgctttgcgtattttagtgctgaatagttgatatatgaatgaatgaactgtttgtaagggttaggtatcatttattaaaaattaactttcaacttcaaagcactagaatgagattcttttagcagatgtcaaaaaagcaaagatatcagtttttgccaattcatcatagtataatttaagtgtattcatggctaagcttactacatttagccataaaaggaaatattagaaaaaatgataaattaactttagtcggaaatcttagttataaggtttattttttcacctcaaaagaattaaatttacatcaagaataatataaaagtgtttattggtgggtggcatatcagtcaataggttgttgggaaagaaattcaatagagaataattatgggcagctatttcagctcaaagtttaaacatttatttaagttataaatccatactattttctttttattgactggtttacaatatggattgctttgttcctttgtcagtttgttttactgtaaaccactttaggtatatgaaacttctaaccccaggagatgataataatgttgcaggaatatattttgkgtattttattatcttaaaattattgtcaaatttagctcagtggggtgggtcatggctataatcccagcattttgagaggccgaagagggaggatcacttgaggccaggagttctagaccagcttgggcaacaaaaagagaccctatctctataagagatacaaaaaattaattgggtttggtgatgcatacctgtagtctcagctccttggaaggctgaggcaggaggattgcttgatcccaggagtttgagactgcagtgagctaagattacccctgtactccagcctaggtgacaaagtgagagcctgcatagaaaaaaaaattgtcaaatttaaatatgacatgaaattacttggtcaattttttgaaaattaaaaaatttcatttttctttgaaattctgaagagatgtttagctctattttaaaatcttccttaatattgaaatttatttaggtgcatagtttatagatacattgtacaaaatattttgctcataaaaagatattaataaagttttaagttaggagttgtgtacttttacatacaagtacataattaaagtttgactaaatgtgactgaaagttatttccagtgttttaaaatatagcagataatttttgcttcaagatatatttgttctcattattagaagtaaaaagttcattagttcattagttgtacacacacaaacgcataacttatatagtcgttttgaccgaaaccacaaccaaactatattgactaaaatttccagttttgstgtcttcatggaagaaaacttaatgacacttgcgaagctacctaactgcagaatctttcttgatcttttataatccttttccttgccttgccctgctccaacttttaccattttttccttccatacccaacttaacaactcatctttactgaatgtctctaaagcattaaaaattagtttttaaagaattaatagatatttttacacttatatttgataggtttatatagttaataaaactatataattataattacaactcacatgaaaagattggggagcaagccttttcaacttcttgattaacttcaattattggaagcagaaggtcttcagtatattttacataccrgaaaggagataccattaatatgttgctgagaggaataaaaagtttattaatctagagaggtggttaagaggaggtcttttaagacagcttctactatatcctatctatgatgttgggagatgtttctattacttttatagaaactarccccatcaaattttatgttttataaaacattttatataattttaccaacatggcacatatatacatatgtaacaaacctgcacgttgtgcacgtgtaccctagaacttaaagtataataataaaaaaacacagattagttatgaaaaaattttttttaatagaatcagcccaatcaaagtatttcccagcttattttgagagttcccaatggtgcagcgctcagtgactggctgctcatgtccttccattttcattaaatcattatgctagtctgctgttgcctttacctggctatctctcttctctgatgcatgaatgctgctggtcttgaaattgggaattctgttttctctgaattgctttgttagaaggcactagggcaatgttcagtctaaggctaattcttccccactattgaggcaagactcttctttgtattctatccaatgtcccatgagttatgaagttttccagtctggtggttggacaagcattattcccagtcctgtgtgagtggcaagtacagttacctcaaatccttttgggtggttctttccctagccttgggtggtttcctccagtatactggttgatcagtattcagctgaatactcaagagggagcatgtgcagattatcagtgttctttctctgtgtatctcttccctttatcattctctattctgttttatacatttactgccttgatctcccaggactctcagctttgtctccccagctcagagagtttgccaggctctgccttggtttccccttcctgtatcattgcctggaaagtctctcatggtggtaagctggggctatcaaagggctcatcctgttttttttggtccatttctcagggattactgtccttcactgcctaacatccagtgccttataaccatttttgcatttatttggtctatttttttgtttcaggtaggaaaggaatctggtctctgttattctcccttgactggaagcaaattataacttttaataagactttactgagttcgaagataataaaatggaaataagacatagccaatagtttacaatagcaaccatatgcagccacattcctagtctataaccctgccgtagcacccaaccttgggtccacacagcagtggctagctttgctgcccttccacctgccatgataaggttttcttttatcatacaaaacatgtttgctcctagtagtcaaactgtcttgaacattttaaaggggagtctttactatttttttttaacatctgtgtaagtttaggatcgaattgaggtcatcctcctctcttccctgccaaataaaataattgtctgctaaaaagttaaattcaagcttctacctcttcagagttttcaaattcaaaatggcagtttcccaaccaaaaacaaataaaaccaaaccctgaatgttgagtctcagtctgtgaaccctattatatattgaatcaatgaatatgtactaatgcatgttatatgtgtatgatataaaccttttaccatgatgtatttgtatcacttggmcagatgcatatattagaaatcttaattgaataataaacataatgtcaagtaaaagtttgggaagttttttatctttagtacctgccccttttcattttggttattctctttttcctctggatatttttcttatactatgttttccttgacttttaagtttataatcaatataagcacttttagaaagtagaattatacttttaaatgaagcaaaggaacttgtaaaataaccatataggaagctttataaaataaagaatatttggtaatatgtgtatttggccaacaatttttttgtacttctggagtttatttatttgatcatataaaaagtttatcagccagatttttgtatattcagaaattgtcatctcttacacttatataggtgtgtaaaagttatctctatagatatttgtagactatatactctagtacctaggcatttcataactgattttttttaacgattaaaaaaaatcccgtttttaggaaaggaactaaatggactcagtagaaagaagttttctaaacctagttcttctggcattttcaagacctttagtaaattatttttatgtatagagtgggatttcttgaagaaaaaatgtagttatttttatttgtatgtattttaaaagtgaaatttcctattcagcaaacttcaaagtaaaagcattataagcaagattgggaatgatatttcaaaagagtagactctccacatgtagactttataaaacatagatgctaatattctagatggaaaggaaacctgtacctttttttctatttaattaggaaaataaccattttctcctgtcagaaatcaatatgacagtgaactggctaaattctataaaccagctgtcgttgtcaataccttatcaatagttggaacatgtttcttttacctagaacattcctttgtatatcttctgacacctcaggcagaggtagatcctcctctgtgtctcttagtactttgtacaggcctgtaccagaaacctgtatcagtgtttgttgactttcacttgatctgaacttcttgggctgcaaaaatactgtttcatactgatatctatatcctggatacctaggatacagctgttttatagagggaacaacaaatgtttatcaaagaaaagttgaataatgttcattcatatattcatttggcagtagatagtcaatgtattgaatatctgcaacagagtaggcactcttctagatcctggaaatgctgtggtgaccagggccaatgcagctcttgcacttactagttttatgatccagaagaaaagacaggttttgatacaatttgttataataaattatgatgaaggttatgctagaaaacatagaatcttattgtaagacctatcttggtaatggggggtccaagcttcccataggaagtgatgtttaacttaggaccagagtgtgggctgaaaccagctgaaaagggttaggaatattggggaaattagggataagtccagcaataagaatttaagttgtagcatctttattaatgtattttgggagtgacttttctcttcccaacagagctacctgactggctgtttatattcctttaacaaagacaagaatatactaattgtttaaatgatctctttctgaatatggctctccagccagttgttcaacattccaacatttttagagtcaaaaatacataattttttgatatatatttagttttagtatgtgaagtcaaagacagtattctaaaaaggctattataactttccaactcagaatcacaaaaagaaaaaattaatcttttttgtgggcattcatctgctctctaaattctggaagtcagtttaacttttcacagtctcatagcagcaattctgacttgcagagaagcagatgaaaatcacccacttattggcattaaaaatttaccatctctattagaaatttcctccaaaataacagttaatctttgttgagtgctttccatgtttaaatactgtgctaaatatatgaatgctgtcatctaagcatccaagaaacactatgagataagtcatatttttacccctttcctatagataaggacattgaaggcatttactgtccaagttcccagaactagagggggaatatatgaatttgatctcagaagtgtctagagtcctagttcctaacttggtattgctaaagagatctaaatgagacatactaacatgttgagacagtctcagaccctcctcacaagttttgtctattataagaaacagtattctttattttatttaataaaataactgactcagttttctttatgttaaggttcatgagtcaatgaaactaaaatatttatggatgtaatccataaatggataagacagacccttttgtatatttttgatgggatgactgtattttggagaattttggggcaatatataacaaaacttaaaattcatttgccccttgactcaggaattctacttttaggaatttatcctaaagctaaacttgttcatgcatgtaaagatatatgtcctggacgttctttatagtattatataaaataggaaaaagttggaaatgacttatgtgttcaataggggcctggtaaaataagttacagtgtatcaatgaaatataacttatgtactcttatttaatactcataaaatagtaggtttattattttatattattaaaaaaagaagaaaacgaagagtaatgatgttaagtgacttgattragatactaggacagagacattgaagcagtctggctccagagtacacactgttaattactgtgctatattgcctcctggtcatctgtttcccagtatgaaaggaaaataaattgaaaagcaaaaagaagaaattacagaaaatctctctagtaggatactacttgctaaaggctctatatttttacattttcttcttataacatataaaatatgttttcttataaaatctgtctttataaaacatatttgtatatatgaatgtatatgaatatattcataaaacacatacatgtataaaacatacatatacatttatgtatataaaacatgtatctatatatgcttatacacataaatcatacattcatggaaaaatttctggacagatatgcaagagctgaatagttggtgctttgggggattagtttggagacttttaaaatttttacttgatgttctttagygtggtaaattatttaaaagtaatggacacgtattatagtacttttataataaaaagaagtttagatttaaaaacttaaaaaatagtggatgtggtaattatcaattatgttgttggatgggagtaaagagagttttttattaaatattttcattttatacccttttgaactgggaacttaaaacaatgaaagaatacatatttcttttataataaaatatattttaaatgaaaaggcattaaaaatagtggacacaatattctctaacaattakgtactatgaagtactatttctgtgactaaatttaggatatagtttattcattatattgatagtttagaataaatttgcctatgttaaacttttatcagagagctgcagtcctaacatccattgatttggaaagtaactcaataaagatttaccttgtttttataagcaggattgtttatgattgaagctttagtaataaaaccttttacaagaaatgagattcagcaaatgcagaagttggcagcaattttactagatgttcctagtcagttgagcacaactttcttgcaggaaaatgatattatgcttcttaattccaaaatatttgtgaaaaacaaatgttaatttgaaactgcattgtttattgagagagaaaattgtcaactgacaatatttttatattatgcttagtcttggaatttacttggaattaggttagctgataaatcctgaaataggcatagttgaaacttaaagtataacttatwtggggttgtatttttcaggtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagctgtaagtaaaagatggcttagtttaccttggcattgtcttcacttctaatttcattctctgaacctggcrtcgatcctagtgcatcttggcttcactctcatttcttaacatcaccccttcagaagcagactagactgggttgtgaagactaatgtatacctcaaaataaggaagccagagtagttctaaagccaatgggaaattaaacaggagatggcttgcttataaggaaatggctaggaaaagttctagacttttgatcatttaaataactatgctctctataaataaataaataacataattatatagataatatatgataaacatatgagtataaataacttgagaaatagaaaccttaaagttkaagacatttggaaatttatcctggtttgtaaatgaattctactttgccatgtcctcttgattcaggataaagagtgcatgtttacaggtagtctgtgatgtctgtagtaatccattaggaaaatgtagacatgtatttaatatgagtaaataatgtatattagctaggaggatataaagttagcaagatatcctgaatgctttattttgtcagacaaacccacttagcacatttttagtagagagagaattttattaaagcctgttttcagagtttgaccaaatcattagtagtgttcagatgaaaaggttgcaaagaactctttttatatctgttgtattttctgcttgaaataggacccttatactctgtctataaataaatctgcattttcataaagtgtctgtgattttaatataactactctattaagtaagcaatggtcttatttgattaaccttcatgtcaaaatcattttctctaactgctaagctaaacctttctttgcatctttctttttcttttctttctttccttttttctttttttttttgagatggagtctcgcactgtcgcctgggttggagtgcagtggtgatctcggctcactgcaatctctgccttctgggttcatgcaattctccagccttagcctcctgaatagcgggattacaggcacacaccaccatgcctggctaattttttgtattatttatttttagtagagacgggggtttcactatgttggccaggctggtcttgaactcctgacctcgtgatcctcccaccttggcctcccaaagtgctgggattacaggtgtgagccagtgctcccagccacatctttcttgtattcactattgcttattttaacgctagagtgaccctctctgtgtactttcatttttttcttttgatagttttattactgtaaaaacagcaattcaatacctttttttttttttttttttttttagtttaagtagctttttaggaaagggaattgctgtcatcaccaacagctgttgactagaagatttgtaggtgatataattgagcaaaggtttctgttacttgcttcttggtttgttgagtaaccatagacaaattactgaactgatagttttattacagtaaaaagagcaattcaatcttttttttttagtttaagtagctttttaggaaagggaattgttctcatcaccagcagctgtttactagtggatttgtaggtgtcataattgagcaaagatttctgttacttgcttcttggtttgtttaataaccacagacaaattactgaacatttctgagattcatttgtctcatatttgaatacagacactaacaaatgctgtaaacaagaaatgggtacaaaagattaagtggcaggtaattcctagttccaatgacccaataattcctattttagactctaaatttgttgagatagggcagaatgcagggcttttgtaaggtgaaaattgccaccttcataaccaattaggaggtaactgtatataaagaataaaaccaccttcactaccattttaattgagtgtccactaggagttaggcacagaggtaggtaattcacatacatcataccatgcaaatgaagcaggatggcattgtagatcaaacaaaagcaaagtacctcttgcagtaaaaattatagttaatatttgctgggtttttataatgtgccaaacactgtgctggattatttcttttaattcaattcttataacagccctatgatcatgatttctatttaacaaatgagaaagctgaggcacattgaatttaagtaacttgctcaaggaaacaggaaagaattaaaacttttggaacttaactactctaatggttagaacagctttaactacaaacagcttttaaaagtttaggcaaattcatggacctacaaccagttattaaagtaagttagatacaccagaaggtgttttaaattctaaccatcctctctcacacttggtgccttgttagagcctgaatttcaactggattatatgtcacatataagtatgtgtagtaaaacaattatatgttatgaaaaaggaagtggcatcttatcaaagagaagggaacatcttttgtggtaaatcgtgatagtttttcatggtttcatcctcatgaaaagtttatatatgaatcattatcaactcaattatttcaagacttcatgtagaatgaaaatcactaaattgtttctgagatcatcaggattagaattatttagcccaacatttccccaaaagtattctgtagagcatgctttgaaaatatggaagaggaaaaaagttgtttctttttgtaatgatcaatgctgcacatagaaattcccatgaatgttttgatgcacattagcgcgttaaaattgttgagaaatattgccatgaagaagcctgtttaactctgcttaactcagaatttcccaaatgtttttgaccccagaactcttccatagtatattaatcctggaaatttctgaaaccatactttgggaaatatcagtttggaatttttctaataatgtttatgacaatattagcttctacttggaatcaaaagaatcatagtggagaaacttcagtgcccttacagtttaatattttacctgacgtagaaagactctctgataatatgcaacatatgcaactgcctaacaatagatgatcactaacaatgataacaatctcaattttctgagacagtgaagctgattttggacacttctaattgttggagacaaatttctcaaactgagcttaaaactgcctccctgctatttcaaacagtgcgtctagttttgctttctggagcaacacagaatcaaggcaatagaaaaggctcttttcaaataactgatgattactcttaggacttacctatgtctccccttttctaggctaaaaattttttgacttttggatgttctttatatggtaaataccatagaatttctatatatttttcaaattggcttacatttctttgtatgacttttagtttcctgctgaaattttcagtctttattttgatctactcgacatggtgagcagaactgtctgatcctcatggtttgagaactctggtgtttggactccttgggtgcctgcttctgctatcattttccttgcttttactcatggtgtcttgtcttataatgtgaatggctatttttgattggatactgaacatcacctcttctgaaacccacttcaggaaatttctcactgccttattagctctgtgatgtttttaagatgaattattttatcatcaaaccttcgtttccttcagcagaggatcagactgaatttctaatttgctattacaagaaatagaagtcccccaaatcatctctgtaaatccttttctatgcattctagattgtaggtaacttccatgaaatgttgaaatcagtgtcttgaaatcaaaacaaactctctgatgtgaacattccatgatataaatggacaattacatccctgatttaatgtctaacatgatcttacctatcacagtagccttgtcatgttgttggttcatattgattttgaaagcaattacaacctccaactctctgagctcaaactactcctaatccaggtcttcctcctctgatactagtcttttttttaattatgtaaaggtagaagttacatttatattcattgaactttatcttattaattcctgctttttgttacagtccatcatcctttgactctcgattttgtcttcctttcctaacctgatatcattttcaaatttattcatgaaaaaatgtttaatgacatggaaaacagtattatatctttcttttagataataccaatcaaatatgaacatcctttgagtaaagttgttgaaatgagcttcaagcttgcttcattgggctgctgtataaaccatgcttctttatttcattttcaagcacttcttgaaagactttcttgaaatcaagatatactgtttgtggcattgtggatttatcagtctagtaatcccagttataaaggaaatgaagttagtttggcatgacttactttttaatgacccaataagagctctaagtgaccattgcttgcctgcttttattttcttctcctttgttctgaccttcattttttaaattacttataatccacttaattatgatgcaaaaccacttgttgctgggttcttcttgctcttaagatctcaatataattagtttaaaccctcattctgtgtcctatcaagtataatgttctcccccaaatttctgcaaattccttgggagctcatattttcagggtcaactctgtctccaagcttttgcttccactgaattattttcatttatagattgtctttctgtctctattctacattatattcacccagaatctggagttggccttttccccttgcacgaatagacacacagatacacacattctccaacctaccagagcagaccagaatacatgaatgtagtaaaccttacagaaacttacaggaagacggaagggagggatatctatattgcaacaatatattctaaagggcttcaatttgtatgttcgaaatcttcaaaatctcattgatagcaactccatctcattgcccttccacattttttctctagctactttccctcaaacttctaaattatgttcattggaatgcagtaaagaatagttatctctctagcactccacttggcccctgcttatttctgtccttaggatatcactacccaccttaaattactccttaaggtattttcttcagtataggtagtgcccttcctaagaagcattctgtagtcagccatcacactccccaatcctactatataataatctattatagatttttggtgggaggagggtatccactttaaagacatgaatttctcctgggaacacactttttttcccccaaaacagaggactgcctttttatttcttgcccttattttgcatgtaatgggccaaggcctgcctttcttctccttgtctttactatttcattcaggcttctggactttttttttttccctcctgacacttatacaagttcctgctacattttctgtttttgttctttatttcatagcattaaagaattcctctgagctcacaattttttttaagtggccttactcttattttccttcttatgacttttcttacataacagatttttttcaatcccgttgaagtatatttccttttagatgtcagataaatgagatgttactctcttttaatagcatgtatctatatatttcctgattttgtaaagctttcttatttctattaaattatactctttccactgagactgccccaggagaagcaattacaatagaacatttacaaggacacagtctgagaccaccaactagtgtaaacatgggtcactgagcaaccaaaaatggacaagtactgccaaattaaataatcaaggattcctgacatggcacttttaaacgtgtctagttccttaaggaaatgtgtgtgttcttttggggaaaaacaggtccaaatgaaaggtaataggggacagaggaaaaaagtgctgatatttcaatatttcatcaattgtagaaacttggaaaggtattttggctctattgtcaccattgtttataaattttttataggaatttaagttaaaatgtttatctctatgatactgttcaagtgtttcagacttttctgtactatttgttcttcttaggattccacatcttgttttattggcatatggatttcttttttttttttttgagacagagatttgctctttttgcacacctggagtgcaatggcatggtcttggctcactgcaaccttcacctcccaggttcaagtgattctcctgcctcagcctcccgagtagctgggattacaggtgtgcaccaccatgccaggctaatttttgtatttttagtaaagacagtgttttgccatgttggctaggctggtctcaaactcctgaccttgggtgatctgcccaccttggcctcccaaagtgctgggattacaggcgtccgccaccgtgcccaccttggcatctggatttctaagggtcaattttatttggaagaaaataggtttggatggcttctgcttactgggtcaggacatcgtgggaagaaaacatggcttttggcagcatggagaccttgcttgaatcctggctgtgttgttgattagctgggtgattttgggaaagttaaaaatctgcgagctttggtttcttcttctgagttatggggagaataaaacttattccgaataccttgaaagggttttgtgaagactgaatgatatatgacataaattacttggcaagaactggtataagttctctttcaccttctttccctgtcccatctttcttctccttggtatcttgctcccactttttggcccttggagtgaaatgttgtacttattcctaaaaatgaagggaaatttgactattgagttgaactaacttttctaactttttccatttatcataccatagtcatgttttacttgttttgggaatgttgatccctttggattaggtaatagaccagtgtcttacaggaaatgggtccagaatttaacaacttttgtcaaatgtatatttaacatttgctacataattttataaagcatttgtggacaaacaataattctgactatgacaaatatttatattgacagaaaaatcacattaccatgttggcagctgagactctccgaggccaccctctatttaaaaggcagatgtgtaccaacaaaaagattttctaaagccttttattactgaagatatcagcagctgataaagggaaaattactgtataattaagagctgttagaagctatgtatattttgtggaagatcttaggcaaaatatgtaaaagcatattaagatgtaaagaaaaagagcaagtcaagactggtatttaagatgtgtattctgttttcactctgctgataaagacatactttatactgggcaatttacaaaagaaagaggtttaatggacttacagttccacatggattccatgtggattccatgattgtgaggggaggcctcacaatcatggcagaaggcaaggaggagcaagtcacatcttacatggacggcagcaggcaaagagagagcttgtggagggaaactcctgtttttaaaaccatcagatctcctgagactcttccactatcatgagaacagtgcaggaaagacctggccctgtaattcaatcacctcccactggttcctcccatgacatgtgggaattgtgagagttacaattcaagatgagatttgggtggggacacagccaaactatatcattctgcccccagcccctcccaaatctcatgtcctcacatttcaaaactaatcatgccttctcaacattcccccaaagtcttaattcatttcagcattaactcaaaagtccacagttcaacatctcatctaagacaaggcaagtctcttctgcctatgagcttgtaaaatcaaaagcaagttagttactttctagatacaatgagggtacaggcattgggtaaatacagctgttacaaatgggacaaattggtcaaaacaaaggggctacaggccccatgtaagtccacaatccatcagggcagtcaaatcttaaagctccaaaatgatctcctttgactccatgtctcacatccagatcatgctgatgcaagaagtgggttcccatggtcttgggcagctctccccctgtggctttgcgggatacagccttcctcctggctgtgttcatgggttgccattgagtgtctgcggcttttccaggtgcacagtgcaagctgtcagtggagctatcattctagggtggttctggaggacagtggccctcttctcacagctccactaggtggtgccccagtaggtactctgtgtgagggctccaacaccacatttcccttccactcttcctaacagaggttctccatgagagccctgcccctgcagcaaacttctacctggacatacaagcgtttccataaattctctaaaatctaggcagaggttcccaaacctcaatttttgacttccatgcacttgcaggctcaataccacatggaaggtggcaaggcttcagaagctgcgttctgaagccacagcccaagctcgacattggcccctttcagccacggctggagcagctgggacaaagggctccaagtccctaggctgcacacagcatggggaccttgggcttggcccatgaaactgctttttcctcttaggcttcctggcctgtgatgggaggggctgctgggaagtcctctgacatgccctggagacattttccccattgtcttggggattaatatttggctcctcattacttatgcaaatttctgcagctggcttgaatttttcctcagaaaatgtgattttcttttctatcacattttcaggttgcaaattttccaaactttatgctctgcttcccttataaaactgaatgcctttaacagtacccaagtcacctcttgaatgctttgctgcttagaagttccttaaaccagatactctaaatcatctttctcaagttcaaatttccacaaatctctagggcagggcaaaatgccaccaatctctttgctaaaacataacaagagtcacctttgctccagttcccaacaagttcctcatttccagctgagaccacctcagcctgggctttattgcgcatatgcttatcagcattttgggcaaagccattcaacaagtctctaggaagttccagaccttcccacattttcatgtcttcttctgagccctccaaactgttccaaccgctgcctgttacccagttcccaaattgcttccacattttcaggtatctacagcagcaccccactctactggtaccaatttactgtattagtctgttttcatgctgctaataaagacatacctgagactgggcaatttataaaagaaggaggtttaatggacttacagttccaccttgctggggaggctacacaatcatggtggaagcaaggaggagcaagtcacatctgatgtggatggcggcaggcaaagagagagcttgtgtagggaaactcccatctttaaaaccrtcagatctcgtgacactcattcactatcacgagaacagtgcaggaaagacctgcccccataattcaatcacctcccaccgggttcctcccatgacacttgggaattgtgggagttacaattcaagatgagatttgggtgggaacacagccaaaccacatcaagatataagaggagaaattagaaatagagacaaatagggcatacttgctggatttgtcatgaatttcctattggaaattttagggaagaagaaatttttttttcaaacgtatattttttaaattttattttattttattttattttatttattgtattattattatactttaagttttagggtacatgtgcacaatgtgcaggttagttacatatgtatacatgtgccatgctggtgtgctgcacccattaactcatcatttagcattaggtatatctcctaaagctatccctcccccctcccccgaccccacagcagtccccagagtgtgatgttccccttcctgtgtccatgtgttctcatatagatacataatagttgtacttatttatggggtatatatgatattttgataaaagcatataatgtgtaatgatcaaatcagggtaattggaatatccatcacctcaagcatttatcatttctttgtgttaggaacattctgattctactcttttagttattttgaaatatgtgataagttattgttaactatggtctttctattatgttaccaaacaccagatttttttccatctaactttatttttatatccattaaccatcccttctatatccccctattttgacaagtaaaaattatatatatttatggtatataacatgatgttttaatacatgtatacattctggaatcgctaactcaagctacttaatatatatgcattaccttttatacttatcaatttttggtagtgagaacacttaaaatttactctagcaattttcatgtatataatttattggtattaactgcagtcaccatgatgtacaatagatctcttgagattattcctcctgtttaattgaaattttatgacctttgaccatacaaatttaaaccatgtaaaattttcattttttaagaaggaatcagcatctttccagttatctctgatttgattaattaatggattacctcagcaaatggttatttttgtgtgcttactttgtggcagtcaccatcactctagtatgtgctagggattcaaatttctaaaaataccatcatgatcctgctctcttggaatttacagactagataaaaagtaaattaacaatatgttattatggtagaggttggtacaaagtgttatggaggttggaattgtattaagagagggtatgttaaatgaatactgtgtggctgagtttggagagttgactagagaaagaaggtagtggggcagagggcattttacctgcagaagaggatgtatgctgaaagacttgtaatagtcctgaatggctgagatgaagggtgaactgtgtgagaggaacaagagttgaagctggagaggtaggcatagacctaatttgaaaggtctatgtgctaagttacaaagtttgaactatagtctgaaagctaaggggaaaccatgaaagaattttaagcagggtaatgatgaggggacttcacaaagttcatagaaaaatggaattaaaagaaaaaaataaaaaatataaactttatttctcatcataaactccatcaagttgaagacacttttgtaaataatgatactagccatttagttcatccctaaagaaytgaatgtcctggaatttaaccgtgccaatgcagtcttttttacattatcaactgaagaaaaatgagtgccctttaaatattttttgagatttggaaacaaaaagagtcagaaggagccaaaccaggactgtaaggtggatacctaatgattttatattgaaacttgcaaaattggctttgtttaatgagcagaatgagcagaatgagcaggagcattgtggtggagaaggactctggtgaagctttcccagtgtttttctgctaaagctttggctagctttctcaaaagactctcataataaacagatactatcattccatggccttccagaaaatcaacaagcaaaattctttgagcatcttaaaaaactattgccatgatctttgctcttgactagcttgcttttgcattgacaggaccacttccacctcttggtagatattgctttgattgtgctcagtcttcaggatcatactggtaaatccacattcatcttttgttagatttctccaaaggaatacttaaggagcttgatgaaattaaaattgttaaaacatttcattgaaagctctggtcttatctgcaattgatctatgtgcaacaattttggcattcatccaggggaaactttgctcaactgaaaattttcagtcagaattgtgtaagctgaaccagttcagatgtctatgatgttggctattgcttctggtgttaattgttggtcctcttcaattaggacacaaacaagattaattttttccttgcaaattgatgtggatggtctgctgctgtgggttttgtcttcaacatcatcttgacccttctcaaaatggattatccatttgtaaactgctgatttctttggggacattgcccataaactttttattttattttattttatcttatctttgagatgaagtctttttctgtcacccaggctggagtgcagtggtgcgatctcggctcactgcaacgtctgcctcctgggctcaagcaattctcttgcctcagcctcacaagtaactgggattacaggtgcatgccaccacacctgactaatttttgtatttttaataaagatgggatttcaccatgttggccaggctggtctcgaactcctgacctcaattgatctgccagcctcggcctcccaaagtgctgagattacagcgtgagccactgtacctggccaaacttttcataaagcatcaatgatttcgtcatttttccacccaagcctcaccataaatgtgatgtttctcacagcgtcaagcccagtgctttgcacagtgatgctgctctataaacaattattgaatgacccttttgttcagtccttattcactactgaaaggtgtcatgatcttaatgacaatggtcttttcaattttatggaacttttaagtttataaagcagtaacctataaagctagattgtaaaatctgttagggtaagagttgtttctcttttgttttcctctgtttcttacatgtctggtatgttgctcattgataaatatttgttgaatgaatgtcttttatttttcctcaactgatttcacarcaactgagtgaagtaggcaggcaaagacaatttgtcctgtgttatagataacacaatcaaaattggaataataatgacttgtccaaagtgatgcagttattaaatggcatagcaaggacttgaacctcagacctcaaggccagtgtgccttcacctacatagaactatttctaatttagatctcaagcccaattttgctctatgttcttaacttttatagtcattccttacagcaaaaaaaaaaaaaaaaaaatcatttgagatatgtatgtgagctttaattttctgcttcagttgtaaacttctttttattgagtggtattatcatcttgtaagttcatttggaaaatatgaaagtcaatggattaaattcagaaacattaaataatttctttctctgtaatactttatttttgattgctctgtggttgccatatttaagtaaggtagattagctatttcttatgcttaaaacaatttctttttactctaggtattaatatttatagagcatcaatatattatttttttgactattctttccttctgctttaggctccagaaacttttagcattgttttaaacagatgatttagggacactaagatcacacttggtgatataatgctttccatcaggcacttactgtatacccttttgtacacataacgctgcgggtatgggatttcttttcatgttacaggtagcacccagcacctcgtataaatgcatgaaatattaaataagaaaacatgatgactgtggagctggctcttgttttggagcaatgctacttgatgtttttaaattatgggaattagtaggctgctggagctctagagttatttgaatcaatcgatctgactacaaaaggaagccagggcgttggcagtgagggagaggaaaactttatttgccagagccttggctgcatttttttttcctgctgtttcagcctatttcttcgtgtctttctcaaattactccacaaatctacataatttacatgaactcattggatgcataatttgtatagaacactggcttagatttatttatatatgtattgtcaggaaaaaggagaaaaaatgtatctgggaaaagggactgctgagacaaagtagacattttcctgttgccttttctatgcttctctttcttgcaaaataatttgtcagctattttaatgtgagatgagcaattatagtttctgctgttttatttgatggattactattattatttctgagcagaaataatttgatgagaaaacacactctgggagtgttgacagtgcttacttttccagcaagtgctgggcttagggatattgttttcctctacccattcttatcttgtatgtccaaggtttgttttgggtttagtctaattcactgagctttttaaagtttgagtttggtttataacgagttaaaaaaaaaaacacaggataaattcaaggttcaacaaattattctggggtttttggctcattttaaattcccactcaaaactatgaataagtaaaatccagcagtattaaaaatctcttcaattaattgtgcttcctttccccaacttgtctccaactgggagatcatttatttggagaaataatcaatataagaaaattatcatgtactgaacaaatatagaaaatcttggaggtttgtttcaatgattaaccattgtggcctattagaaaaatcttcaagccaagtgaatactctttaaaacctaggcctcaacctaacttttatcttctgtacttcagcatcacttggaaagtaagattattgctttcactctttagtatctttaagcgtacatgtgtgcaggtggggatggggtgtgtttaatagggagctaagccagagctataccacagctttcatatgacctctccttgacaattaattattgttgtaagcaaaaaaaactgcttaaatgaatgaaattatcatggttttacagtattttgaactctttattatcaataaatggaggatataattcctgataacaaaagttcaagctgaaatctccatattatacaaagtccgacctttagttaaaacattcttgtgatcatgtattgttactggattttctccatttctcctttggccatgggcatattacctgaagtgttggttttctgtgtttcttattttgaacactytttttttttttttttttttttttttgagacagagtctcgctgtcgcccaggctggagtgcagtggcgcaatctcggctcattgcaagctccgcctgccgggttcacgccattctcctgcctcagcctcccgcggggactacaggcgcccgccacctctcctggctaattttttgtatttttagtagagacggggtttcaccgtgttagccaggatagtctcgatctcctgacctcgtgatccgcccgcctcggcctcccaaagtgctgggattacaggcgtgagccaccgcgcccggctattttgaacactctttacaagtgtgtttgctctaaagttcccatttggagttgtataatgtttacagagataaatatgaagaaaaaatattttaagaagtagagctaatatttcttagggaagacaaagtgcaggggctaaaacatgctttagagttaaatggatttgtcagtaaaatagcttgtattaattaaatcatagataaaattacttaaattttttagaatcttagataaggttttattttgatttgaacatagtgagaatgaaccaagaaatgggcaaggcacagaaatgattatacaatataataaatatttcatataaaggtcattaaaattatgttgaaaggaacttgtttattgttataagtgggggaaaatgaactgattttggctgtgtttaatatgttgggtagaattggtttccacgtcagactcttaaaagacttcctgtcctttggggcccaactcaaattgtcttacgtcttctacgtggtctgagtccctccgtcagtgtcagtatcagtgagttttccgagttttcaccaatgttacctttatctctctttttttgcactctctttactaccttgccttgtgttagagttaaggatagagtagaaagaacatgaatgttgtaataaaaacccagttcaatcaaactttctgaaacccagtttactcaattatagaatgagaagagaaataggaactcctgtggttcttgtgaagattaaattggaaagcatcaagtacctggggctgagtgggcactcagtaagtgtcagtgtccatctcatttccgaatttcatgtctagtttctccagtggtatgagttccttcagggcaggaaatgtcttttatattcatagtgctttgtgcatagtaggttctaaatgattatttgttgaatttaatttactgtcctgtcatggaagcttagcactgttatttcccatttcttttccctctgtcaccttggattgagataaacatgttgctttcatgaaattagggatttaattcagtagaatgccattttaatatgacttatttcatagagtttgatatagtaagggtcaaatcatttccctggaaacttaattatattctataaaatcttattagcctgtctcatggcatcatagtcacagtggagttctggtgtgtttaagatggtcaagtctctatctgtagaaatctgtctaatggcacagagtgagaatatgggaaataaatgacataaagagagagcaaatgcaaatgtcttgcaaattacattacttgacattttcaatcactaaccctccaaagtatgttctaatttatgaaaataaaccaagaatccaatttcttgtgagcttcctttgcttaattaattattagtagcagacagtattctgtggttcgttgcaatttttcacctttgtatttatctagtatctgatttaaaaagaataggagcattctgattcagcagaactgatcagaactctctttctgatcataactcatctgctcatagctcatctgtgttatagagcagaaatgaataaatgtttgctgaacatgccacatatgctttgatcatcaaaatgttaagttttccttccttctcaaaatacaagctctgagagatctttcttgctgaagtttgttgggtgacctattctgcatagatattattatagaggcaagccagattccatgccattatagcaaaatatcgtgtaagcaactacattttcataaatttgtttgtttccatgattgaaatgtgagcactctttaatgcttcctcattatgatttraaattatacattcacagtgctttctaaaaaattttaaagcagaagtatatcctaaaagatgaactttcttttttattttttttaaatgaagtatgctcttttgttagaatgaggactgaacaggcttctcatgcatgcagtaatgttggttatacttagaatatggtttataactctttctgtgtccctaattatttcattgaaagataattagctagcatttgttatcactgtattatgaatgggagaaactgaggctcattatcgactcttcgtgttagcaagttgagaatttgagaaaaatctgctgctatcctaatgatctacttttgttttcaatttcagtttcaaaggacatttgagtctctcaaaaatgttgccaacaaatctgacctccagaaaacctaccagaagcttgggaaggagctggaaaatttggattatttagccttcaaacgtcagcaggtaggagtcagagctctccttggtggaggagatgaacactttaggcttcctgccatcctgcctgtcagaggtgcaggtgggtctgaggaaacttatcttctaatggttagagcagatacaggttgtgctgtgctgatctgctgtgttcatatggcttcccacagtgttcaatgtggtccttgcttttagatgtgtactttaggggtttccacatgtgtccttatacctctcttaaagaaaattcctgctggtttgtgaaaatccaactaccctttgactagggacgcttcagaggcataaagggagtctctataatggcttggccagttggcttttatatttgacctggggagaaaaatcacctgaagaccaggataaggttgtgggtgtacatgcaacattaaggaaaatagtcataaatatgccaaaatatgaattgatctttagttttctttgatctttgaagatgagtaatttgctaagtgtggaagattgaaggaagatttacttttcaaatacaaggtttttaattgcctccttttgtaggcccctagataaatagagagctgaaataaacttttatagggtttgttttagaactggtactttataacctaatattcatcatgattaaatgctgtgtgttttggagacactgccacagtagctcactactcttcctaggctgaatctgctccagtttcttcacagccactaggtgtcagcgttgtcaagcttttacttccaccaaaggtttattccgatcagaacagccagttaaatgtttaaatgaggttgcatgaaattcggtaatgtgctccatgatggatagagtctagaaaaatgactaaatgtctgacttgcatggccaggcctcgagtcgatcacttgagagactttcctcttagagtagcaaagggtgtggcattctcaccattgcctaattcacaagttttggatccttttggatgaaggttttcaaagcagaattttctatttttagttaaatctcattaagtcaacatgatatggtctagaattactgggccaaaaagagaattgtgttctaggtattgctctatcacagatgttacatggacatttaacctttctatggccttattttcctaggggttatatttgttttatagaatgttccagggcaaatacattctttttgcagacacattaatttacatgaaaaaggatacaatgtccatttaagttttgtttttttaaaaaaattaatgatgatctaggtattagcacttgatggttactgagtgctactataacaaacccccagaggatgctgcttagcgttcacaccagagtcactcctccggcctatgcaatttttagtacagttttgtttccaaaaccatattttaccatggaggggtatttgagctggcaggcagtagtcactgtactcttctgttatcgtttctcattaacacattttcagtgattggattcttttattagctaattgtgaatttggaagaatgtaaatgcctcaggggcagaagggtagaactctgggagaatggcattgaggatagatgggtaaattatatgtgcataaagaaaagatgagcacatggagtgtatacatatatgcctatataaatcatctatactatttattaaatgaaaagcatatggcacatggtatgatttaaacatttatgaattgaatctttaaatgcttataacaatacagtgaggtggcttttgttagcaccattttacagatgagaaaattgttaaggaagttaagtaacatgcctaaggtcatggagctaataaggcgtgaaactgggcttcaaatctaaatcaagtctgacttcaaacctggagtgttatgtcttcttgatgggcagggtcaaagggtcagaacatcagctcttctctagcttgatgggatttatcttttatctcgcattctattcctttaaagctccaaaacctgatgaagcacacgccagaaagtgtttttcttctaatggaaaagattcaggcctctgtaaaattgccagtttagcaagaaagtttcctctttataaggtggtattctttgtattagagaattagtcatggtttgttccctggtccaaccatatttatcattccgcactgggacagaacataagctccaaaaggacagggcctcgtctgtcacctttaatgctgtatcctctccagtgctcctaacagtatctgactcatggcaaatcctcagtaaatattattggtggtgttgttgctatgaacaaagaaccatgccaaaaggtttgacctcagattataggcaattaaaatcaatgtgttttgctacacatttaaaattcaaaagagcataagcctttggtttcctggataccaagggctgagagattttcccttgcccctatgtattattgaggttttctcctaacatattttattcttctatccattttttaaaacaaacagaaaatgccagtgttaactctgaattatggatgtccaatgaattgactataattattttattggagtcatccattaggttttattttctgtccccttctatgatatttttaacatcatctttgagagatttctttctcggcacaagataagactactggagttctttgctccattctctcacttctgtttttctgaggttactgtgctttctttcctaggtctgaacttagtatttatttatttaaaagagtgagtgcctgcacatcagctattccttgggtcagggcacaacatctctacattttcctactttcaaaaagactaatgttgaaatagctttgattggaaaaggtgtgagaggaggctgtgataggtgaggtggtgggtttactgggatgaatcagcctaaagtaaacggatgacaaagcaggattaaccggagaatttggacactcttttggttcttactatcgaaaggcaggtacagtcttggagtttatctgcttggactacttggttttcatccttctagttggtgtgacataggaatggtaataacaagttccagctattatatcgatctcagatttatgtattaatttgagtgcttataaatcaagaggtttccttagagctttcgttttgtgaagtaaaacaaaataaggtttgataatgtggactctaatgtaattcattcctctctttatctacccttaaaacttataataacattataaaacacatccatttccagaggcttctgaagtcttttgatataaattaaagttgacattattgagttgaacattatatagactaaagcacatttagacattgatataaaaatatgtaaaattaaattattgtacttcagacctgcatgcatgttggaacacatcacgtatctgattcttgtctctctgatcacggcatactattcttgccttctgacctgtgcacaaggtttatataacttcgtatttagaatgtacagcccgtttcattttacatacttaaatcattctttaaagtcaaactgaagtctagcctccctcataacacctcctcctgtgacctctagtcaatataactcttcactctttgccattcttagcttttatttgtgtcatacaatttagcatttgattgatgatatactcattgagaatccatgtagtacagtgattagagtgtgagctttgtagttacccaaacctggttagactgtttgtactggatacctgagtttctttttaaaaagcatcggaaaaataaccctaacttaaatagcttgctttgaggaaacaatatatcaagtataaagtaagtcctatgaaatatgtataaaggacttaacattgcacctgacatgtgtttagtataattggtagctattatatgttttctgttattctcataagccattttcttaaataggttgtaagttccataaggatatggatatgttctttattttgtatacttctgtgctgtacatagggtccagcactgttctgaacatatgggatagaatgtttttggacatacatagtctagcagttggtgatctatgtaacaaaaagaacatgctgacacctctcaagaagggagctgcaacattttgttctaatatgtttctaaggtgatatctcttgatgggcagttaaagtactgaggacttgtactatgacaatctcttgggggaagtaggttcagtgttctggctaacgtccaattcaggttaataatacattctatatatccaagcttcccttatgcttcaggtattgttcagcacatggtacttttttagtgacgatgctcaggagtgaacaactgctttttttttcttttactaaactgggtgtgtgaccccttttaggtaattccaaagccagaagggtacataataccttgtaggataaaaattgaatttaaaacaaacttttattaaacagaagaaaaataaaaataagttagataaaatttatttgataaaaatgactgcgggttaatatttttcaattgaaaaataaaattctacttgttatctcttatctttttcatgatagccatcctaacaggtgtgcaagacaagagataacaggagttagtgatgatgtgaagaaaaggaaacctttgcacattgttgggaatgtaaattggtacagtcatttcggaaaaagtatagaggttgctaaaaacatatgaaatagagctatcataagacctatcaatcttacttttgggtatatatccaaagaaaatggaatcagtatcttgaagagatagctgcactcccacgttcattgcagcattattcacaacagccaagatattgaaacaacctaagtgtctattaacagatgaataaagaaaatgtggtatacatataagcaatgaaatattatttagccttaaaaaggaaggaaatcctgcctttgcaatagtatggttgaacctggaagacattttgctaagcaaagtaatccagacacagaaatacacatactgtatggtcttacttatatgtggaatctgaaaatgtcaaactcagagaagtagagggtagaggagtgctttccagggattggtgggtggaggaaattagtagatattgatcaaaggtacacattttcacttataagatgaacaagttctggggacctaataaacagcacgagtgatgatagacgtgttaatttaatggtggtagtcattacamaatgtgtatatatctctcaatcatcttgttgcacactttgaatatattcaatctttgtcaatcaaatatttcaaaacaaaaaataaaattctagatagataatgactgaccacatagaaaatactcttaggcttactctgggaacttgagaactctgaggatacaacaaaacaatgtagggatcctgtggaagaaatgcttagaaaatgaaactaaatagtgctaggcttgtggttgtactatagcatatagagaagaaaaagttgatgagttccgataatatccttcaatcatgtaaggacttatagcaagaaaaaagtagtgaatcagctagaataatattgcactgggaattgcttatctacaaggaccttataaggtagggactaactttccattggggctaacattaaaatggaattgtaaatatattttctttaagacctttaaaaataaagaccaacctgaccaacatggtgaaaccccgtctctactaaaaatacaaaaaattagccgggcatggtggcaggcaactgtaatcgcagctactcgggaggctgaggcaggagaatcatttgaatataggaggcagaggttgcagatagatgagatcatgccattgcactccagcctgggtgacaagagcaaaactccatgtcaaaaaataaataaatcaataaaataaaagataaagaacatgtgtatctggaattgtttagatgcagtctaaggaagggtgtaagtgggagctggactgaatgagtactaaggggaggtgctaagcttctagagcaatagttctatagccatggattaacttcagtgacctttgtaagatgaagtatgttaattgctcaattgggagaagattctttttttccttcttctgtaattaatctaactgtcctgaaagaattctgattgaattattccttttaagggtaagtgaaccaaggactgctatactaaaatattcatgtctgtcttaggtggtattctatttcttatttaccagatcaaataaaatgattttttatgccatttataaacctgtttctgaagatttcaaagcatttcagacatcatttaaaaatttattgcacaggtataaaaaatgttgaattattaaacagtgtgctaagttcaaaccaacccaaacatattctatccactacttatgcaatttcatttttattcaattgtacatagttgtttgtcccaaaggagaaaagaatgtgatgttacatttattctttagttttctgatatagagaaaagaaggttggatgcatcatgcmaggtcatcctgagtcagtaacaaattcagaattaatattcacatttcctaatatccagctttttgcaatagccatttgatcattttcactacttcataaactacagatctttatagggtgatttgtttttctatagttacagtctgaagaaaaaatcttatggattttttaatgtaagaaacttgcctttattttaaaatgaatgatgaaaatgatgcatattatacatttgtcctcctaaaatttgatttccacattggatagttaatggtcatgataactaagtgtcttctattaaattagcaaagtaaaaacattatagagacatcttttaattcctaaggtttgctattctgtttccgtctgttgtctctggggctcagtttattggtggcacttaggtagaaagctgttgagtcaagcgttagctgattttcatgcaccagagaagatttattaatttttacaaggttgtttgctatacagtagtttgcgttgtgggcagcttatagctactttatgtggggaatgtttattgaaacaagttaattctttgttatgggttgtttcaaaatttacaatgctgataggaattccagagatggcaaaaaaaaaaaaaacaacaaaaacaaaacaaaaacccaaaaccaaccaaacaaacaaacaaaaaacaacttcagtgtttgcatcaatatggtgcttatttgtgcatgtcttatattgacatacctaagtccataaggttgtcaataaaagttggtattgaggagaaataatgtgcacatgtaccctaaaacttaaagtataataataaaaaaaaatagacaagttaactctgaaaatgtcttctttagtctgttttgcactttgaaagtgatctgtgcatgaaaagaaggtaatctttcactactaagattatgacttttggtggtttaagatgcaaattacagaggctatgctatactagagaaccttaaaccaagtaaagaatctttagaattcatctaacctaactgttttattttattttattttttatgtttgagacaatctcgctctgttacccaggctggagtgcagtggcacaatctcagctcagtgcaacctctgcctcctgggttcaagtgattctcttgcctcagcctcccaggtagctggaattacaggcatccaccaccatgcccagctaattttttgtatttttcgtagagacagggtttcaccatgttgcccaggctggtcttgaactcgattcacccgtctcagcctcccaaagtgcaaggattagaggcatgaactactgtgcctggccccaactgttttattttaaagatgaaaaaaatgagttgcaaggagattaaatatcttgtacaaggccacatactttgctaatgacaagagttgggacaataacaggaaatgatatattctcacaacctttggttctttggtgagccctctattgatccttggtatctggtttgtatcctgaaaccaagagaggacctatagtatgaaaagcattcttttcctgtttgaaaagctgcatgatgctgagattggactggctgcagaaatctcttctaatgttaaaacaaagccaggacattcagtttatttcactggggttcatggtttgggaggccttgcttatatatggctataatgaaaggctctgatggcagcctttgtggaagtgagccccattctctccagggaaaaacatacttctgctacctcctgtgtcttgaggagcatttcctttgctggacacttgctaggtggtcgagtagtgacattctgtcctgtattcagggacatgtggaatagaggagcccctcatagtccccttaataaaagatgtgggtgcagtcttctctaaaacgcaagcctccagccactctacatttccactttcctactcaagaagaaaggagtgaacttctttgagtgttcacagaaatgtacaacaaaggactgaaatgaggatgcagcacaattgacttttcagtgaagtccacttctttctgattatgcttgtcctccaggtgggagttctgctctttcagattgagccctaggaatctgaagtagaacagaattttctaccaggatgaaaggagtaccagaatgggtatggactttcttgagtctgtaggaaccttgttgcattgggactatggaataatccaggaaattgggtttcatatcaaactgcaggaacaacaaagatgcttttaacatttatctatacatgcgaatatactgtattaggcggtgaggtgccagtaaatgaaaataattcagtagtgcctttttaaaaatgttaaatttttaaatatttatttatttatttttgagatggactctcgctctgttgccaggctggagtcagtgacgcgatcttggctcactgcaatctctgcctcccaggttcaggcaattcttctgcctccgcttcccgagtagctgggactacaggtgtgtaccatcatgcctagctaatttttgtatttttagtagagatggagtttcaccatgttggccaggatggtatcgatctcttgaccttgtgatctgcctgcctcggcctcccaaagtgctggaattacaggtgtgagccaccgctcctggcccttttttttttttaaagaagaaaatgcaataatattacaacactgtagacaaaggaaagacttataagcatcatctggttcagccactttatcgtggatacacaaacaatacagaaagtacatcattttgtagttttctactgcaatggaattttgatttattgacaatttctagaatcccgtgtcgtctaaacctttaaagtatatcctaggcacttaggttgtttctataccttgactatcatgaatgatgctgcaatgaacatgagagtgcagatacctcttcaaaatactgatttcatttcctttggatatatactcagaagtgggattgctggatcatataatagttctatttttttaaaatmtattttaggaaccttcatactactgttcatagtggctgtaccaatttacattcccaccaaggttcccatttctctacaagcattcccatttctgattacactcaccaacacttgttaccttttgttttttggtagtagctatcctatcaagtgtgaggtgatatcttattttgttttgatttgcattactctgatgattagtgatgtgagcacctttttatatatctattggccatttgtatgctttctttgaaaaatttctatttagagaagcaataaaagatgataaaggggatatcaccactgatcccacagaaataaaaactaccatcagagaatactataaacacctctacgcaaataaactagaaaatctagaagaaatggataaattccgggacacatacaccctcccaagactaaaccaggaagaagttgaatctctgaatagaccaatatcaggctctgaaattgaggcaataattaatagcctaccaaccaaaaaaagtccaggatcagacacattcacagccgaattctaccagaggtacaaagaggagctggtaccattccttctgaaactattccaatcaatagtaaaagagggaatcctccctaactcattttgtgaggccagcatcatcctgataccaaagcctggcagagacacaacaaaaaaagagaattttagaccaatatccctgataaacatcgatgagaaaatcctcaataaaatactggtgaaccgaatccagcagcgcatcaaaaagcttggccaccacaatcaagtaggcttcatccctgggatgcaaggctggttcaacatatgcaaatcaataaacataatccatcacataaacagaaccgactacaaaaaccacatgattatctcaatagatgcagaaaaggccttcaacaaaattcaacagccttcatgctaaaaactctcaataaactaggtattgatggaatgtatctcaaaataataacagctatttatgacaaacccacagccaatatcatactgactgggcaaaaactggaagcattcattccttttgaaaactggcacaagacagggatgccctctctcaccactcctattcaacatagtgttggaagttctggccagggcaatcaggcaagagaaagaagtaaagggtattcaattaggaaaagaggaagtcaaattttccctgtttgaagatgacatgattgtttattagaaaaccccattgtctcagccccaaatctccttaagctgataaaaaacttcagcaaagtctcaggatacaaaatcaatgtgcaaaaatcacaagcattcctatacaccaataatagacaaacagagacccaaatcatgagtgaacttccattcacaattactacaaagagaataaaattcctagggatccaacttacaagggatgtgaaggacctcttcaaggagaactacaaaccactgctcaaggaaataagaggacacaaacaaatggaagaacattccatgctcatggataggaagaatcaatatcatgaaaatggccatactgcccaaggtaatttatagattcaataccatccccatcaagctaccaatgactttcctcacagaattggaaaaaactactttacatttcatacagaaccaaaaaagagcttgtagtgccaagacaattctaagcaaaaagaacaaaactggaagcatcatgctacctgacttcaaactatactacaaggctgcagtaaccaaaagagcatggtactggtaccaaaacagatatatagaccgatggaacagaacagaggcctcagaaataacaccacacatctacaaccatctgatctttgacaaacctgaccaaaaaaaaaaaaagaagtgaagaaaggattccctatttagtaaatggtgcagggaaaactggctagccatatgtagaaagctgaaactggatcccttccttacaccttatacaaaaattaattcaagatgaattaaagacttaaatgttagacctaaaaccataaaaacactagaagaaaacctaggtaataccattcaggacataggcatgggcaaagacttcattaccmaaacacccaaagcaatgrcaacaaaagccaagatagacaaatgggatctaattaaactaaagagcttctgcacagcaaaagaaactaccatcagagtgaacaggaaacctacagaatgggaaaaaatttttgcaatctacccatctaacaaagggctaatatccagaatctacaaagaagttaaacaaatttacaagaaaaagcaaycccatgaaaaagtcaggaaaggatatgaacagacacttttcaaaagaagacatttatgcagccaacagacacatgaaaaaatgctcatcatcactggtcatcacagaaatgcaaatcaaaatcacaatgagataccatctcacgccagttagaatggcagtcattaaaaagtcaggaaacaacagatgctggagaggatgtggagaaacaggaatgcttttacactgttggtgggagtgtaaattacttcaaccattgtggaagacagtgtggcaattcctcaagggtctggaagcagaaataccatttgatccagcaaccccattactgggtatatatccaatggattataaatcatgctactataaagacacatgcacacgtatgtttattgcagcactattcacaatagcaaagacttggaaccaacccaaatattcatcagtgatagactggattaagaaaatgtggcatatatacaccatggaatactatacagccataaaaaaggatgagttcatgtcctttgcagggacatgcatgaagctggaaaccattatcctcagcaaactatcacaaggacagaaaaccaaacaccacatgttctcacttataggtgggaattgaacagtgggaacacttggacacagggcagggaacatcacacaccgaggcctgtcggtgggtggagggctgggggagggatagcattaggagaaatacctaatgtaaataacgagttgatgggtgcagcaaaccaacatggcacatgtatacctatgtaacaaacctgcacattgtgcacatgtaccctagaacttaaaggatttaaaaaaaaaaaaaagaaacatgtctatttagttcgggcacagtggctcacacctgtaatctcagcactttgggaggctgaggcaggcagatcacctgaggtcaagagttcaagaccagcctggccaacatggtgaaaccccgtctctactaaaaatacaaaaattagcaggcgtggtggcaggtgcctataatccctgctatacgggaggctgaggcaagagaattgcttgaacccaggaggcggaggttgcagtgagctgagatcatgccattgcactccagcctggggtacaagagcgagacttaggtctcaaaaaaaaaaaaatgtctatttaggtattttgctcatttttaattaggttatttgtgggtcatttcttttcttttcttttttgcttttgagttaaatgacttccttatagattttcaatactaacctcttattggatgtatggtctgcaaacattttatttcattccataggttactatttcattttgttgattatttccatttctgtgcagaaactttttagtttgatataatttcacttatttatttttgcctttgttgctggtacttatggcatcatatttaaaaaaattgtgaaaactaatgtcatagagcatttcccctttgttttcttatagtagttttatggtttcagggcttatgtttacagctttaatccattttgagttaaattttgtttgtgatgtaggataaaaataaatttgttttttggtatgtggatattcaattttcccaaccccacttattgaagagactattttttccacattgtgtatttttggcaacttttcactattgagcataacactaactatgggcttgtgaaatacggcctttattgtgttgaaatacattccttctgctaggcacggtggctcacacctgtaatcccagcactttgggaggctgaggtgggtggatcacttgaggtcaggagtctgagaccagcctggccaacatggcaaaaccctgtttctgataaaatacaaaaattagcaggtgtggtggtgtgggcctgtaatcccagctattcgggagtatgaggaaggagaactgcttgaacctgggaggtggaggttgtaatgagctacaattgcgccactgtactccagcctgggtgatagagcaagactccatcacaaacaaacaaacaaacaacaaaaaaaggaaatacattccttctatatctaatttgttgagaggtttttatcatgaaagcatgttgaattttgttaaattctttctctgcatctattgagttgtttatatgatttttgttctccattctgttaatgtggtgtaccacttgatcatggtgaatggtcttttaaagcttgttagtattttgttgaggagttttgcatgtttgtgcatcaggaatattggcctgtaattttcttttcttgtagcctccttgtctggctttggtgtcaggtaatgttggcctcataaaatgagtttgtagtattccttcctcttcagttttttggaggagtttgagaattggtattagttctttaaattttagttgaattcagcagtgaagtcatcaggtcctgggctttcctttgatgagactttttaattattgatttaattttctttttttttttctttgtttctttccttttttttttgagatggagtttccctttgtagcccaggctggaagtgcagtgacatgatctcagttcactgaaacctctgcctcctgggtcctggttcaagcaattctcctgcctcagcctcctgagtagctgggattacaggcgtgtgccaccatgcctagctaatttttgtatttttagtagagactgggcttcaccatgttggccaggctagtcttgaactgctgacgtcgtgatccacctgcctcggcctcccaaagtgctgggattacaggcgtgagccactgcacccggccttgatttaattttcttactcattattggtctattcagattttccatttcttcatgattttatcttggtagtttttatgtgtctaggaatttatccatttcttctaagttatccaatttcttgccatataatagttcacaggagtcttttttaattctttgtatttctgtggtatcacttctaatgtttcctcttttatttctggttttatttgagtctccattctttttttgttagtctagctaaagagactgaatatgggaacagctgagactaaggtacagggagctgaagaagagtaaaaatgtcatactttagctctgggttgtccactgtgacttggccaaactgatcatgggactgtctggtattgactcagcagcatttgtttcagaaaagcaagcttagtcacatatttactatacaactagtaaaaattataatctcaaatacactcatattaaatttttgtatccaagctgtacatctctacctgtgttcacaatcagaagacatcacaatgactgttacggtgtccttgtcaggcaaaaagactactgcttcaactacagctgttttgttaatagtagtgctaggagcatgcctagggcactgttggctaaaattcaaaggaaatgttgaggatgcctagctgagaccaacagttcagcttacagcagagctttaaacaggcacacaccagtcatgcagccttttgtagatgttaagctgtttgttaggggctgattacctgagggctaatttaatatgtaatgagaagtttagtttgttctgttattttttttaaggcgtacttatttttgctctctaaactatcatgtttggacaatttcatgtttgctatttaggaagaagctaatcatcttttataccctatctcatgctccaaatgtgacagcagtagaaacacttacactgaaatacatctaggtgagggaaaatgtcaccagaagatggagtagtgttgctggtttgctccatattttgttcaatgatttagaagagtatgtgtatgtacaggtttactttcatacactctagtttcaaatgacagaaaatataaattaattgatattcttcagagtcaacattaaattttagattggatgtctttaaatttttacaatgtaaattgcttttctctcttctgtggtcaactgacagttgcattcattgaccagataaactatatttagcttaacatttttagtatcacttatgggattttagcaagatgccacaatatgaacttgtaatattgcatttcttttttaactgtattattacaaayctgattttaaatcatttttttctattttagttacagcattaatacaggctaaaattctctatataaattctgctcatattagtatagcacctggtagcactacagttcagtatttatcatctactccattataaaacctttgttctaaaagagctgtatgagcctattagatgtatacacaattaagtaggtaatgatctgtggttgcatccacacagcattaacagctgacttgtgactgattttccaagtgaggtgctgattgttgatacggagtacttattggatgaaaatgtttagaatattttgaagaattatttttgtgctttgaagtttaagttacatattttgttttaaccttactgtttgcttaatgaagaaattataatgtttcctccctctcattttgatgttggtatttatctctattgttctaagctccccatccaaacattgggagttactgaagcccttcttggtacttttggtgcagaatgtaatggtccaccacatgtgtcattactgatagtgacacatttatgtcttcatgttaaatttgcatttttaaaattaaaggtaactgaattttagtcattttcccaactttaatgttaaagtcattgagaatagttatgatatttttgaaagtttgataatgatcatctgtgaatttagagaaactaaatatgggagattattctggtaagtatccaatttcagtcttctttgtcagtgtttgaacttaagctaaatgctcatgtttgtaggacaaaggcatttcttctcaccttgggtcagagcagcaagtcctgggaatatgatacagcattatgtgaataaacagaagttttggtaagcagcagtgtacaatttgttaagaaaaaaatcagacaggaagtttttgttggccttttgcccattctaatataaacatacatctataccatatattaagattgggcatagttaagatcaaattcatttaacaactgggggaatttattttacctgggatggaaaacattaaatccaaagatgaaacagaagcaaataaattaagcgtacctgaactttattttaaatttagaggaagctgtctttttggaatctctttgaaatctatcaggaaacatttttgtcttaaaaacagagagtaaataactctgggtttaagatatctaacatgtttgacctttgttatgctaaaatagtgggctagaattggatccrtaaaaaaatgatcggatgtttatccagggaaggaatcttaagttagacttggtattaaccaatgtgtgataagtaaggtaccacttgtgaacatgtggttggtgctcatgagtaacttgtatcagtcactatgcatttttcttctactccaaacacctggcctagtggatatagagaatgtcttgacatctttgttactctatttttttttctttcttctatgttcttctaatgaatgttactctgtttttttttttttttttttttttttgagatggagtctcactctgttgcccaggctggagtgcagtggtgcgatttcagtgcagtggttcttgccattctcctgccttagcctccggagtagctgggactacaggcgcctgccatcacgcccggccaatttttttgtatttttagtagagatggggtttcaccgtgttagccaggatggtctcgatttcctgaccttgtgatccacccgcctcagcctcctcaagtkctgggattacaggcatgagccttggcaccgacctgtttttttttttttgagacggagtcttgctctgttgcccaggctggagtgcagtggcgtgatctcggctcactgcaagctccaccttctgggttcacaccattctcctgcctcagcctcccaagtagctgggactacaggcacccaccaccatgcccagctgattttttgtatttttagtagagacggggtttcaccatgttagccaggatggtcttgatctcctgaccttgtgatccgcccgccttggcctcccaaagtgctgggattacaggcrtgagccaccgcgcctggctgaatgttactctgtttttaagcggttttggaaaagtttatttcttactcttgatataagagctgtgcacagtgctgctataaaaagttagtaattttttaatgtcagtaggggatcaatttgagagaagactaaagttgagaatatctaagaatgttggcatatatggaatagatgttatcaccctacattttaaaggtcttttttgtatacattctatatgtaatatgaggtcagtgaacacactctaagatcaagctcttatagtagactgaaaaacttggcaacactgaagaacaattgtgagtatttttagattaagtgaatgacactacaaatattatttttaagatatctggcattaaggcttatttattgtgaaaaccattaaacgaaagagagaaatcacacaccagaataataaaaaaaaatagttaagatagacatataggggcaagagggccgaataggaacagctgtggtctgcagctcccagcaagatcaatgcagaaggtgggtaatttctgcatttccaactgaggtacctggctcatctcattgggactggttagacagtgagtgcagcccacagagggtgagccaaagcagggtggggcattgcttcacccgggaagtgcaagggattgggaaactaccttccctaaccaagggaagccgtgagggactgtgctgtgaggaacggtgcattccggcccagacactatgcttttcccatggtctttgcaacttgcagaccaggagattcccttgagtgcctatgctaccaaggccgtgggtttcaagcacaaaactgggaggccgtttgggcagacactgagctagctgcaggaattttgtttcataccccagtgacaactggaatgccagcragtcagaactgtttgctcccctggaaagggggctgaagccagggagccaagtggtgtagctcagcggatcccaccccaacagagcccaacaagctaagatccactgtcttgaaattctcactgccagcacagcagtctgaagtcaaactgggatgcttgagcttggtgtggggagggatgtctgccattactgaggtttgagtaggcagttttcccctcacaatgtaaacaaagctgtgggaattttgaactgggtggagcccaccacagctcagcaaagccgctgtagccagactgcctctctagattcctcctctctgggcaggcatctctgaaagaaaggcagcagccccagtcaggggcttatagataaaatacccatctccctgggacagagcacctgggggaaggggtggctgtgggcacagattcagcagactgaaacattccatctgccagctctgaagagagcagcagctctcccagcacagcgctcgagctctgctaagggtaagactgcctcctctagtgggtccctgacccccatgcctcctgactgggagacacttcccagcaggagttgacagacacctcatacagaagagctctgactggcatctggcaggtgcccctctgggatgaagcttccagaggaaggaacaggagcagtctttgctgttctgcagcctccgctggtgattcccaggcaaacagggtctggagtggacccccagcaaacaccagaagcactgcaggagaggggcctgaccattagaaggaaaactaacaaacagaaaggaatagcatcaacatcaacaaaaaggacatccacacaaaaaccccatccgaaggtcaccagcatcaaagaccaataaaggtatataaatccatgaagatgaggaaaaaaccagcacaaaaaggctgaaaattccagaactcagaatgcctctttccttcaaaggatcacaactcttcaccagcaagggaacaaaactggacggagaataagtttgacaaattgacagaagtaggcttcagaaggtggagagtaacaaactcctctgaggcaaggagcatgctctaacccaatgcaaggaagctaagaaccttgaaaaaaggttagaggaattgctaactagaataaccagtttagaggagaacataaatgacctgatggagctgaaaaacacagcatgaaaacttcctgaagcatacacaaggatcaatagctgaatcgatcaagcggaagaaaagatatcagagattgaagatcaacttaatgaaataaagcatgaagacaagattagagaaaaaagaatgaaaaggaatgaacaaagcctccaagaaatatgggactatgtgaaaagaccaaacctacgtttgactgatatatctgaaagtgatggggagaatgaaaccaagttggaaaacactcttcaggatactaaccaggagaacttccccaacctagcaagacaggccaacattcaaattcaggatatacagagaacaccacaaagatacttctcgagaaaagcaaccccaagacacataatcatcagattcatcgtggttgaaatgaaggaaaaaatgttaagggcagacagagagaaaggtcgggttacccgcaaagggaagcccatcagactaacagtggatctctctgcagaaaccctacaagccagaagagagtgggggccaatattcaacattmttaaagaaaagaattttcaacccagaatttcatatccagccaaattaaacttcatcagtgaaggagaaataaaatcctttagagacaaaaaatgctgagagattttgtcaccaccaggcctgccttacaagagcttctgaaggaagcactaatatggaaaggaaaaactggtaccagccactgcaaaaacataccaaattgtaaagaccatcggcactatgaagaaactgcatcaactaatgggcaaaataaccagctagcatcataatgacaggatcaaattgacacataacaatattaaccttaagtgtaaatggtctaaataccccaattaaaagacacagactggcaaattggataaagagtcaagacccatcagtgtgctgtattcaggagacccatctcacgtgcagaggcacacatagtgtgctgtattcaggagacccatcgcacgtgcagaggcacacattcctcaaggatggaggaatatttaccaagcaaatggaaagcaaaaaaaagcagggtttgcaatcctagtctctgataaaaccgactttaaaccaacaaagataaaaaaagacaaataaaggtattacataatggtaaagcaatcaacgtgacaagaagagctaagtatcctaagtatatatgcacccaatacgggagcacccagattcataaaacaagttcttagagccctacaaagagacttagactcccacacaataatagtgggagactttaacaccccactgtcaatattagatcaacaagacagaaaattaacaaggatgttcaggacttgagctcagctctggaacaaacagacctaatagacatctacagaactctccacccgaaatcaacagaatgtacattcttctcagcatcacatcacacttattctaaaattgaccacataattggaagtaaaacactccttagcaaatgcaagagaacagaaatcttaacaaacagtctctcagactatagtgcaatcaaattagaactcaggtttaagagattcactcaactgcacaactacgaggaaactgaaaaacctgctcctgaatgactactgggtaaataaccaaagtaaggcagaaataaataaattctttgaaaccaatgagaacaaagacacaacatacaagaatccctgggacacagctaaagtggtgtgtacagggaaatttatagcactaaatgcccacaggagaaagtgggaaagatctaaaattgacaccctaacgtcacaattaaaagaactagagaagcaagagcaaacaaactcaaaagctagcagaagacaagaaataactaagatcagagcggaactgaaggagatagagatatgaaaaacccttccaaaaatcaatgaatccaggagttggttttttgaaaagattaacaaaatagatagacttctagccagactaataaagaagaaaagagagaagaatcaaatagacacaataaaaaatgataaagggatatcaccaccgatcccacagaaatacaaactaccatcagagaatactataaacccctctacacaaataaactagaaaatctcgaagaaatggataaattcctcaacacatacgccctcccaagactaaaccaggaagaagtcgaatccctgaatacaccaataacaagttctgaaattgagacagtaattaatagcctaccaaccaaaaaaagcccaggaccagacggattcacagctgaattctaccagaggtccaaagaggaggtggtaccattccttctgaaactattccaaacaatagaaaatgagggactcctccctaactcattttatgaggccaacatcatcctgataccaaaacctggcagagacacaacaaaaaagaaaatttkgggccaatatccctgatgaatatcaatgcaaaaatcctcaataaaagactggcaaaccgaatccagcagcacatcaaaaagcttatccaccatgatcaagtcggcttcatacctgggatgcaaggctggttcaacatatgcaaatcaataaacgtaattcatcacctaaacagaaccaacgacaaaacccatgaatatctcaatagatgcagaaaaggccttcaacaaaattcaacaccgcttcatgctaataactctcaataaactaggtattgatggaacgtatctcaaaatagtaagagctatttatgacaaacccacagccaacatcacactgaatggacaaaaaccggaagcattccctttgaaaactggcacaagacaaggatgccctctctcaccactcctattcaacagagtattggaagttctggccagggcaatcaggcaagagaaagaaataaagcatattcaaataggaagagaggaagtcaaattgtctctgtttgcagatgacatgattgtatatttagaaaaccccattgtctcaggtcaaaatctccttaagctgataagcaacttcagcaaagtctcaggatacaaaatcaatgcgcaaaaatcacaagcattcctatatgccaataataggcaaacagagacccaaatcatgagtgaactcccattcacaatttctacaaagtgaataaaatacctaggaataaaacttacaagggatgtgaaggacctcttcaaggagagctacaaaccactgctcaaggaaataagagaggacacaaacaaatggaaaaacatttcgtgctcttggataggagaaatcaatatcatgaaaatggccattatgcccaaagtaatttatagattcaatgccatccccatcaagctaccactgactttcctcacagaattagaaaaaacgactttaaatttcatacagaaccaaaaaagagcttgcatagccaagacaattctaagcaaaaagaacaaagctggaagcaccacactacctgacttcaaactatactacaaggctgcagtaaccaaaacagcatggtactggtaccaaaacagatatatagaccaatggaacagaacagaggccttagaaataacaccacacatctacaaccatctgatcttgacaaacctgacaaaaacaagcaatggggaaaagattttatatttaataaatggtgttgggaaaactggctagccatatgcataaaactgaaactggaccccttccttacaccttatacaaaaattaattcaagatggattaaagacttaagtgttagacctaaaaccatagaaaccctagaagaaaacctaggcaataccattcaggacataggcatgggcaaggactttgtgactgaaacacccaaagcaatggcaacaaaagccaaaattgacaaatgggatctaatttgaactaaagagcttctgcacagcaaaagaaactattatcagagtgaacaggcaacccactgaatgggagaagatttttgcaacctatccatctgacaaagggccaacatccagaatctataaggaacttaaacaaatttacaagaaacaaacaaacaaccccatcaaaacgtgggtgaaggatatgaacagatatttctcaaaagaagacatttatgcggccaagaaacacattcaaaaaagctcatcatcagtggtcattagagaagtgcaaatcaaaaccacaatgagataccatctcacgccagttagaatggctatctttaaaaagttaggaaacaacagatgctggagaggacgtggagaaataggaaggcttttacactgttgatgggtatgtaaactagttcaaccattgtggaagacagtgtggcaattcctcaaggatgtagaaccagaaataccattggacccagcaatcccattactaggtatatacccaaaggattataaatcattctactataaagacacatgcacacatatgtttatgggagcactgttcacaatagcaaagactggtaattaacccaaatgcctatcaatgatagactggataaagaaaatgtggcacatatataccatggaacactatgcagccataaaaaaggatgagttcacgtcctttggagggacatggatgaagctggaaaccattattctcagcaaactattacagggatagaaaaccaaacactgcatgttgtcactcctaagtaggaattgaacaatgagaatacatgggcacagggaggggaacatcacacaccagggcctgtcagtgggtgggggcctaggggagggatagcattaggagaaatacctaatgtagatgacgggttgaagggtgcagcaaaccaccatggcacgtgtatacctatttaacaaacctgcactttctgcacatatatcccagaacttaaagtgtaatttttttaaaaaaagatagacacatagtttatgccagaaaaataaaaaagttaagatagcttatagaaggttgagtgtgtattacctagaacttctctgaaaacagtaagtgtttatcattggaattatagacaacagatattatatatggcttatgattattaatgagaaatacaatttgtatttcttacttgctacatctcattttgaactgtattccaaaattgatggaattaggacagcgctacaaatttatttcattatttaatgttataagcaattaaaattttattcatatgagataaccatgctctcaaaattataactaatttcatattcagttacctatatgaaatccttcttaatcattctttaaaactgggttgtacaagaggttctcttgggccagtgctggagtagacaacagaggggtgagaacctcctgttgaaaaggaagaaaaattatcatgcaacaatttggaaggtttggattttttttaaaaaggcaagtgcattaaaaaataatgagatagtgtagtaaattatgaaaggctgggaacgtggcttcagtaaaggcagaaagtcctttattattatttttaaacctatctttctcctaacygtaaacataagccatatattcatgaatacaacccccaccagtgtgtgaggccagtctattaaaaataaaaaggcacataggagtctgtcacaccgcaagatgaaagctgtgttctttatgcatggatatcattttgttttagaagggttgtaaaaaataatacaattataaagaaagtcaatttatggaaagaaggtagactcttcccgcattatgtaaatactttctactagggtgctcgatataagaaatatactacacagcatttcactttcacagaaaatatgtgatgattattcacataataacaggaacttttagagcatgtgaatattcatttatgaattattgacagagaggttggaatgttaggagatagtgcctactggacattatttagtaatacagattttccatctctgaagctgtggaagtgcctactatacaggttaggtctttgatttacttaattcttacaataatcatataatgggaatattattttccccttataattcccatataatgggaatatcaattttctcccctattgggccactcacacaggatgtaagtttcaaatcaggcctaagtaataaaaaatggcaaattcttgatattttggaatgagagacaataggcataaccaagttgttatactgcctcttccatgtcacctcttctgtgcctcctgagcaaataccctccaacttggggagaagaggagagttggataggaatagaataaacttagacatggtttgtttttgtgctggtctaccactactgtctgccactacccgcccattcctccagggtaggagacatgatagaatttactgcaatgaaatttgggagatctgagatggccagtgaatctcaggccctgtatggacctatgactctaaaaaatgcttctaggagtcttagggaaacggagagaatgtttctgccatgttgtaaccttggagtctttttagttctgggatagtgtgtaggggcatcagaaattttgtcttaggtccagagtgtgggtagaagtcagtggagagagggtgtcagggagcttgatcacatggaggagagcaggggaagcaggcctcagtcaggaaacattgtaattttggaagtatacagaggtttagatggcggtgtgtgtgggtacagcactttatcatgtactttgacttttgtattccacttctgccatagccaggtgggagacaagctgttgctttggttagggttgccagataaaataatacagaatkcccagttaaatttgaatttcatatcaatgatgaataattttctagtagaattatgtctcaaatattgcatggggcacacttatgctaataaaaatatttattctttttgaaagtgaaatttaactgggaatgttttatttgctaaatctggcaacacaactctttggtgccctgagccagtgaaggaatcaaactatcctgtgctttatccatctttgaagtttgacaacaggtgggtgccccacaacaggtgttaatattacatttcatagaagaagtaattctcagttcaagaagtaattcttaattcttgatgggttagtctgtctttctgaggcagcccaattaggccaaatagaatggaaaatatttaatccctagaaaatttcgagagggtaacstatttagtagcttgttctagaacacacaaatagtaaatggcagcatcaggtttttgcaggtccaaatagcctccacaatacacattcaaaatttaaaaagctcctcaggaacatatttattgtgtaaagaaaggtgctcttaaaaactgactggtaggtagctgctgctattttctataatgtactcttgtgttatggtcaggcctacaaaagaaaccttacaagtctttcccaggaaacatccttttgaaattaattgaattattttaaagaaataatgagatattacttctttttaacttggcattttattcaaaggatgtttctgaaattaaaccagtgggagtttaaccaaaatagtacagtgacacaatgatgccatttagaagaatgttgtgctgagttaaatagctctaattatcagcaactttcaaattataaagcaattaaaaaaaccctcagttttcttcttcagtggaatccatagtgattgtatgaagcatttcatctggtttggatagytgggtttcagcatctattttgagatcccagagtcacaaaaagtatgctatccttaaacttagttttctcttgtgcccagaataatcctgtattctgaatcccattttcttctgtcccctgaggaccttcctttataggaagttgtattttgcctttactgtcaacttttcatttttttctactcatttttccttttcagcatattaacctgttaaagtttgatccaaacgacatgacgatgctggcaacaacagcagcagcaatggtaaccttctttcaaagcaataccccatccagcgacagtcctgtctttcttcttttcctcatgctaagtttctgaaagattttaggtgcgctgacctscttactaactacatccatttttggacagaagcgagggagtcgaatgtttcctggagctagttttgttaactggtgttctatttccattaagtatcagatgccacaaaaattccagttaatcatgaaaataattaaaaagaaatgttaatatataccttaaaaaatacatgttaagcatataaaatcaaacttttttttttttttttgagacagagtctcgctctgtcacccagcctggagtgcagtggtgcgatctctgctcactgcaagctccgcctcccgggttcacgccattcccctgcctcagcctcccgagtagctgggactacaggtgcgtgccaccacgcccagctaattttttgtattttttagtagagacggggtttcaccatgttagccaggatggtctcgattccctgacctcatgatccacccgcctcggcctcccaagtgctgggattacaggggtgagccgccgtgtccggcctaaaatcaaactcttaacataaaagctatgctgtacaaatattccttttgcgagcttttttttttttttcccccacgttgagctaggtgaagcttctgaaacaggaaatcaaagaaatctggcctgaaaggcaacccccgccttttaaaaaaacaaaacaaaactacctttaaaaagcacaggcatttttattgcttcaaggatcttcaaaatgcagctaaaattcaagatttagggcaatctattattaacatttttgttcattcaatgaacatgaaatactcccaacagtttaaaattgttaattgtagaggaggggaggtttccatggtcttttctttttctatgattccttcctctcttatttcaatatgagccagcttatttgcctccttgtgaccagctcaacagccctgccagcagactcagtgaaggcatggttttattagcagttgttgggtggatgtaagtatcagtatagttattactgtggatgttttaattatgtgcttgctaatctgtccttagtacttgctgttccctcttcgtggaatgattttcccctagagctcacaggacaattccttcttatcattcagggttcagcttaagtatcacttccttacagtggatttctctgattaatctaatgtagactttcgcctcttcatagcagttatcactgtaggaaattatcytgcacatttgatctttaagttgtttattgcctggcttctccattgggacataagcacattgtctctcttgatattaagtggcactcaataaacacttgttggagaaatgaatgatatgaaaggttaagtatacaagtgagtcagaagtcaaacatttctaaggagaggtttgtatatactattttttattaacttgacttttcacttctcagtaatctagtttctgcctttcacttgcacaaacactgttattatgatcacttatccaactgacatttttcagaccttttaacttcaactgttcttttttcctgtaaatcttaattttctttttttttctcccaatttttctcctacatgtctggactcttcccagttcctgtcagagtaaatgttgatattgcccagaacataacttgctcttccttttctctccttctcatttttctttctttcccctacaccctctgtatactctatagagtaaaatcatatacacccacggagtcaataactgcctttaatctaacaattggatgattcccatatctttatttctaccccatatatttctcttcaattcaagattttatccagttacttaatgaggtgttcaagctcaagatgtccaaaatttaaacgtattatatatcatatattgtaaatacatttttatatacatttaatatattatcttttctttcctccattcctatactttttttccacttatattccttgttggtgaatgcctgctaactggttatcttgcattcaaattcacccctttctaattcagcctaaatattattactggaaggattattttaaaatgaaaatctgaacatatcctcaagtaaaaatccttcaatggttctggttctctgttgcctttagaatgaaatctaaattgtataaagcaactgtgaccctttattttcccagagctttgttttcagccatatcagagtattttccgttctttgaatacatcacatttcttctgacttcatgcctttgcatatactgttacagctgcatgattattttcctcctggaattttctgatctggctcttacttgtacttcagttgcatatgtgatggctcctaatttggaggtagatactactttatggtgtttcgaaaggatttcctgtatacttttatcccatcacttgtcatactgtatgtgtttctccttctactgtaataagctccttgaagtcatagagaatgtttcctctctattccccaacaactaggacagtgccagggacaaagttgatttttaatgttttaataaatggttgccaaatgaactatggttgcacagttttgtgtatatctatattcttatttctatctatatctgtctgtaattttggtgaaagtcttcataatcttttgaggctgtttgattcactttgggatattatgctactattttattttgattcactattggtttttttgaggggatattttcaactgagtttttaaaatttttatttctgttttcctgtcatattagtttttttttctttttagaatacttgtaggttgcttaagcctcagcaattctgtgatggtttgggatggtttacaagatccctggttagaactcttctgttaaggttgtaaaagatagtttatttcctcagtagctttcttcaattaagaaaaattcttttgtcttactggattctgattttccctttcttatttcttcttatgttcactgtgtagtttccagagtgcttytccattcctttgttacccttctctctcccaaggcctttctaagaccacctcttagagccccacatactcattcctccttctagtaggctctgatctaccaggactctttttccattatttttgcaatgagagtagaatttctctttatagctgtgattttagatcaattttaaatttcattgctaggttctctcttctgttttcagtatggttctcccccatctcccaccatccctccactctggccccatcttgcccttgttccccaggtaggcttgcaccagaagggtgagaaattccatgctaagagttggtgttaattttttattcacgtgtaatttgaaatctaggttgttctctcttttctagttatgctgacagcataggttttctgtagttttatttattttttatttttatttttggagtatgtgctgggagattcagacttaagcagctgccatcaccttggctatccagaattcgatcataaatgtttaaagggattgaaaaacaatgttttcacttatctcttggtaaaataatttattttctttctttgaaacaaataacttgagatgtttcccaaaattgttgtgacatttctgtttggctacataaattgtctacagcatcaatttaagaaacaaagtgcttaacattaagagaaatagaagatgagatttcgcatcagtttcactcttggatgaattcagattagaacatgggcaatggaaagcaaattagggccttcaaaatttatgaccagtgggaaaatacatgagaataaaattacattaagattggtgctttgtgttaaagatacctgtgatgagttttcttttcaagaggaatgaaatgacctagatacaaaaagacaratattacatgatctcacttaaatgtggaacccaaagcaactttatctagttacttaatgggcttttcaagctcaacatgtccaaaatttaaatgaatgaatgaatatatgtatatacacacacctaatgtgtrtatatatatatatatawaaaatcatgtattataaatatacttaagtatatataaatttaatatatttttatttcctcattttctccatttctaccctttctttccactctatttcctgcctcagtgaatgcctgctaattggttttgttgcattcagtcctaggagcaatagtgagagctaagcagttttaaaacaatttggcacttcatttccatgatattgatttttttccagatacttatctaagcccctgagaaggtgggccaaggtgcttttcttggtctctttccacgcttaaatgtttggttactgtcaaaagagcaaagagcacctgcttctagtgaatacatgctcaaatgaaaaatgacaagttgcaacttaggttgagaagtaatgattcatttttctcaaccaaaaagactaatttgtttttgtgggtggtggtgcagaggtggcttgggtgaggaatgggggaaattacttacttttaaccagcacttggcattatgaaatgcatttccgataattaaatgaaaacacatttcattttgaattgagtttaaataatttactactgcaagtgaaatttaaatcttaggtacataaagaaaagactcccagggaaatctgtaaaagatacattaacagggatatagaaataattgttctataaaaaggaatttagtttggttttttacctatgtgatactagctgtactgatacatgttagggaaaaataatcaagtactataaaaaaatcagctgatccatctgggcgtggtggctcatgcctataatcccagtactttgggaggctgaggctggcgaatcacctgagctcaggagttcgagaccagcctgggcaacatggcgaaaccacatctctactaaaaatacaagaattagccagatgcgatgaccagcctgggtaacatggcaaaaccctgtctctactaaaaatacaaaaattagctggacacggtggcatgcgcctgtagtcccagctactcaggaggctgagacaggagaattgcttgagcctgggagccggaggttgcagtgagctgagatcgtgccattgcactccagcctaggtgacagaagggactttgtctcaaaaaaaaaaaaaaaagaggccgggcactttggctcacacctgtaatccctgcactttgggaggccgaggtgggtggattacctgaggtcaggagtttgagaacagcctggccaacatgatgaaaccccatctctactaaaaatacaaaaaattagctgagcttggtggcatgtgcctgtaattccagctactcagggggctgaggcaggaaaatcacttgaacctgggaggccgaggttgcagtgagccaagattgcgccactacactccagcctgggcaacaagagcaaaactccgtctcaaaaagaagaaagaaatcagctgatgcaagggatctctgacccatagagtcttgcccatttcatacttgtctttctggttcttggagagccatttatttcctttcaatgtcttcatttcttgctttcaaaagttaattattttggtatatttcccaaataccatccttgtatccctgtactgttctagccaggtgcttaatttttcatttcctgtctttcccttcctctcctccccaaacagtctgttaccccatgctgtcccttgttgcccaagaacctccaatttcgaaactcaacgaggktctgtatgtatgatttcttaacatctacctccctcacaaacatacttagatgcatgaatccctattaaattgttagacagtgtgagcgggatgctctcctccttctgtcctaagcttaaggtttctagagattctctcacatctgtcctcatatttcagagtttcctcatccatagaactctgagagcaacaagttttatgctcttgtgccttcccattagacatcctgtggtacctaggggtgaggaaggtcaagagagaagctggcagtcaccactgtcttggtgaggtgtgtgagtgctaaagcaggttgaaatgggatttggggctctgctcttcctgcaggaatgggacaacctgctggaccctttatcagttatatgtacagctcttcacactgcctatagccgtgttcccaaggatacaggttacaactctagcttttcagagctcatcctcttttcctccatggggaaccacccaggttgtgaggtggcttaattttagattttaaagacaaatgttcctgaaaatagtccttgattgccccagatgattttacattttttcccctaccaccaaaattaggtgtagggaaccccctttatgtttcagtgactatttgatttgagtgactcagccagaagttgagagaggacacacacgtacacamtcttccgtgggtttcctgctgtaaaggccagctgcgtctcagccagcaaaagcttaatcaacacacaggaggtgatcctaggatgatcaggagccttggcagccagtggaggagacattttttgccaagggggatgtcttactgtcaaaacctataacagttatgccttggatgattggtgttatctagctgttaactgaastatgcacagaaaactgacactttcrcaggcttttttggtgttgctatttcttcctggatccaagtgctggagtggctctttggtgcttagtgcagtcagtagcatcttggttcctctgaagcattgggcagaatggggagcattgcctgggacactgatggggcctcatcatggctgggggtgccaggtaatcatttgggatgataggtttagttaaatactttttggattggtatcaatattactggagatttgtatttttttctacaactaaaataagattggagaccttggaagaaagtagtaaaatgactaaagtgtgagaaaacatgattcattagaaagaaaatgaatttacttaacccttagaagagaaaggtaagaagagaataattcttcatatataaaacaaaggaatttctcttaaggtagcaaatggctattatctatttccacaaatgtagaacaaaatcagaggacaaagctcttattcargcataaatatgcttgagtgcagctagcagttatttggcactttctctatctcaggttatgctaatcactttacttattatttcctgtaatccttgaaatacttttacaataatcttactgtttttctcattctatgaatgagaaaactgaggcacatagaggttaaacttggggacctaccaaagtatggtagggaagcagaaattgaatgtagatacaaatactagatgtgaaagtcacaggtaagaaatgaagcaaaaatacaggaattaggaagacacagtgaagcaaaagtagtggttaaatatctagactatcaagaactagaagatctattggaattgagtactaggtgaagggtggagggtcatgaacccatatagtaaaagaagatggtgaagatcagaatccagataagtggtctgtttatcagatatgaggtgacatatacaaaaagaccttaattctggaggcaaacttcaacttcatccagcacgcctatgtatttctggctaaagtagattcttgttcccagggcatggacagtctcaaaaatgaaacaggtgaatgagtgtgaacaagactccttctgtgcctcatcaatcaacacttttgacttcatagcttaagttgtaacatctatgtcaccaataacttatcttttaaaattcccttaggtttgggttgctttttagcagctttataacataaaaggcttctaattaggaatttttaaatagcagaagatacggcattatttatatccctgtagggaaaatatgaatttcactgaaacaaaagaaaaccaacaaagaagtgtttcctatcagatgatcactgttggctttaaaaggaagagacgtctagttgacttatttgaaggaaagcttttctgagtggaatcagaccaaagctgaggccttttakgtttcttgtgctttggctaggtatgccgttagcctctgtctctgactgaaagtgctgcagtgaagccacatactcctgttcaaaggggagattaacacttgttactagtagaaaacaaaaagccaaggatgagaaagtaaaattgggtttaatttctatcatcactgggtctaacttccactgtgttatcaccacctaacttgggtactgctgctcttgctgtgaccttaaatgggtcagcatagtcactagggaggtttttatctttctttctgttttaattttaattttagaatcaaggggtacatgtgcaggtttgtacatgtacatggttatattgcaagctgctaaggtttgggctaagattcatcctgtgacccaggtagtgggcatagtacacaataggtagtttttcagctattactcctcttcttcctctaacctctagtagttcccaatgtccccacctctactagtccccaagaaagcttgttgctatccttatgcccatgagtatccaatgtttagctcccacttataaatgagaacgtgtggtatttggttttctgtttctgtgttaacttgcataagataatggcctccagctgcatccatgttgctgcagaggacacaacttcaatcttttttatggctgcatagtattccatggtctatatgtactgtgtcttctttatccagtccaccactgatgggcatctatgttgattccatgtctttgctattgtgaatggtgctgtgatgaacatatgagtgcatgtgtctttttggtagaatgatttattttcttttggttatatactcagtagtgggattgctgggccagatgatagtcctgttttaagttctttcagaaatctccaaactcctttccacaggggttgaactaatttacattcctaccaacaatatataagcatcccctttttctccatagccttgccagcatctgttgtttttttgactttttcataatagccattcatttttcataatagccattctgtgaggtggtgtcccattgtggttttattttgcattatctgatgaatagtgatgtggagcattgtttcatatgtttgttggccacctgtatgtcttcttttgagaagtgtctgttcatgtcctttgctcactttttaatggggttatttggtttttgcttatctaattgtttaagtttcttataaattctagctattagacctttgtcagatgcctagcttgtgaatattttctcccattctgtagattgtctgtctgctctgttgataatttcctttgcagaagctcttctgtttaattagatcccacttctcactttttttttggtaaatggttttgaggatttagtgataaattrtttcccaaagtcaatgtccagaatggtgtttcctaggaaatcctatagtttgaggtcttacatttaaatatttaatccattttgagttaatttttatatgtggttaaagataagtgtctggtttcattcttctgcatatgactagtcagctgtcccagcactatttattgaatagggagtcctttccccattgcttgtttttgtaaactttgtcaaatggatgtaggtgtgtagctttgattctgggctctctattctgttacattggtctatgtgactgtttttgtacaaataccatgcccttttggttactgtagccttagagtatagtttgaagttgggtaatgtgatgcctctggctttattctatttgcttaggattgttttgcctattcaaattctttttttggttccatttgaactttagaatactctttttctaatcctgtgaaaaatgtcattggcagtttgataggaatattgttgaatctgtagattgctttgggcagtatggccatttcaataatattgatttcttcctatccatgagcatggaatgttttcccatttgtttgtgttgtctctgatttctttgagcagtgttttgttttttttttgtttttttttttaatttttatttttttattattatactttaagttttagggtacatgtgcacaatgtgcaggttagttacatatgtatacatgtgccatgctggtgtgctgcacccattaactcgtcatttagcattaggtatatctcctaatgctattcctcccccctcccgccaccccacaacagtccccagagtgtgatgttccccttcctgtgtccatgggttcaattcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaagagtgccgcaataaacatatgtgtgcatgtgtctttatagcagcatgatttataatcctttgggtatatacccagtaatgggatggctgggtcaaatggtatttctagttctagatccctgaggaatctccacactgacttccacagtggttgaactagtttacagtcccaccaacagtgtaaaagtgttcctatttctccacatcctctccagcacctgttgtgtcctgacyttttaatgattgccattctaactggtgtgagatggtatctcattgtggttttgatttgcatttctctgatggccagtgatggtgagcattttttcgtgtgttttttggctacataaatgtcttcttttgagaagtgtctgttcatatccttcgcccactttttgatggggttgtttattgatgggacgtatctcaaaatagtaagagctatctatgacaaacccacagccaataccatactgaatgggcaaaaactggaagcattccctttgaaaactggcacaagacagggatgccctctctcaccacttctattcaatatagtgttggaaattctggccagggcaatyaggcaggagaaggaaataaagggtattcaattaggaaaagaggaagtcaaattgtccctgtttgcagatgacatgattgtatatgtagaaaccccattgtctcagcccaaaatmtccttaagctgataagcaacttcagcaaaatctcaggatacaaaatcartgtacaaaaatcgcaagcattcttatacaccaataacagacaaacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcgtgaaaatggccacactgcccaaggtaatttatagattcaatgccatccccatcaagctaccaatgactttcttcacagaattggaaaaaactactttaaagttcatatggaaccaaaaaagaggccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataaagccgtatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcacgatggattaaagacttaaacattagacctaaaaccataaaaaccctagaagaaaacctaggcattaccattcaggacataggcatgggcaaggacttcatgtctaaaacaccaaaagcaatgacaacaaaagccaaaattgacaaatgggatctaagtaaactaaagagcttctgcacagcaaaaaaactaccatcagagtgaacaggcaacctacaaaatgggagaaaattttcacaacctactcatctgacaaagggctaatatccagaatctacaatgagcagtgttttgtagttctccttgtagagatctttctttcacctccttggttagatgtatacctatgttttttgcttttcttttggtggggtggggcagttgtaaatgtgattgcattcttgatttgactctcagcttgaacattattggtatatagaactgctactgatttttgtactttgattttgtatcctgacactttactgaagttgtttatctgtttcaggagcctttagatagagtctttagggttttctagatacagaatcatattgtcagtgaagagagatcatttgaattctttttttcctatgtggatgcattttatttctttctcttgcctcattgttgcagctagaacttccagtactatgctgaagatgagtagtgagagtgggcatctttgtcttgtttcagctctccaggggagtgcttccagcttttgctcattcagtatgatgttggctatgggtttatcatagatggttcttattattttgaggtctcttccttcaacatgtacaaaaaaaatgtgattcaccacataaaaagaattaaaaccaaaaccatatgatcatcttgatggacacagaaaaaccttttaataaaatctaacactgcttcatgataaaaaactcctaacaaactaggcctagttttatttttttgtgtatgttgaaccaacgttgcgtccctagaataaagcttacatgattatggtgaattaactttttgatgtgctactggattcagtttgctagtatcgttgccaagaccagcttggtcatggagaccccaacccagcggcgttagaggaattaagacaaagacacagaaatagagtacaaagtgggaatcagggagctaacagccttcagagctgagagcctcaaacagagtttgacccacctatttactgacaataagccagtgataagcattgtttctataggttatagattagctaaaagcattccttacaggaaacaaagggacaggctctggcttgttatctgcagcaggaacatgttcttaaggcacagattgctcatgctattgtttgtggtttaggaacgccttgagcagttttctgccctgggtgggccaggtgttccttgtcctcattctggtaaaccggcaacttccagcatgggcatcatagccatcaagccatcatagcagcaagaaatctctgcagtcacagggctgcagagattttgtttatggcttgtttctcatggcctgtttatggccaggcttgaggcctgttcctagcaattgtgttgcggatttttacatctgtgttcatcagggatattggcctgtagttttcttatctttttgtgtctttgccaggttttggtgtcaggctgatgctacttttgtagcatgagttagaaaggagtcctatcccttctcctcagttttttagaatagtttcagtaggattgctataaactcttctttgtacatctggtggaattttgackgtaaattcttctggtccagggcttttttttttggttggtgggctttgtattactggttcaattttggaacttgttattggtctgtcyagggtttcaatctcttcccgattcaatcttggtaggttgtttccagaaatttatccatttcctttagattttctagtttatgtgcattgaggtgttcataatagtctctgaggatcttttgtatttctgtgggattggtagtaatgtcatctttgtcattttggattgcacttatttggatcttctttctttttttctttgttaatctagctagtggtctattgatcttgtctatccttgcaaaaaaccaacttttggtttcactgatcctttgtatgtattttggggtttcaatttcatttagttctgctttgattttggttatttctttcattcagctagctttggggttagtttgttcctgtttttccagttcctctaggtgtcatgttagatggttaatttaagatctctctaaattcctgatgtaggcatttagtattataaattaacattgcttttgctgcatccccaaaattttggatgttgtgtctctgtttttattaaataatttttttacttctgccttaattttgttgtttacccaaaagtcatttagaagcaagttgtttaattttaatatacttgtgtggttttgagaggtctccttggtattaatttctatttttattccactgtgccctgagagtatggttggtatgattttcatttttttgaacttattgagacttgatttattgctgagcatgtggtcaatctcagagtatgttccatgtacaggtgaaaagaatgtattatatattctctggctgttgagtggaatattctgtagatgtatattaaatccaattggtcaagtgtcaatctcaagtccagaatttcttagttggtgcctcagtgatctgcctaattttgtcagtgcgatgttgaagtccctcactattattatgtggctaagtcttttggtaggtctagaagtacttgttctataaatctaggtgctctactgttgagtctgtatatatttaggatatttaagtcttgttgaatcaaaccttttatcgttgtgtaatamccttctttgtcttcttttactgtagttggttttatctgataaaagaataccaactcccgccgtttttttgttttctgtttacatgatagatcttttcccaactcattacttggtagcctatgggtgtcattatgtgtgtgtgagcgataggtcttgtttttttttttttaattcaacttgccaatttgtgccttttaagtgggggtgtttagactgtttacattcaaggttaatattgatatatgaggttttgatcctatcaaagttgttacctggctgttttgtagtttctattgtgtgattgctttatgggttctgtgagctatttatttaagtatgtttttgtggtagcagttattgttctttcatttccatgtttaagactcccttaaggatctcttgttaggctcctctagtggtaatgaattcccttagtgcttgcttgtctggacaagattttattttttctttcacttatgaagattaatttagtgggatatgaaattcttggttgaaatttctttttagaatgctgaaaatgagctcccaatctctcctggcttayaaattttctgctgagaagtctgctgttagcctgatgggattcccctttatgtgatctgatgttttttcccagctgcccttaagattttttttataacattgaccttgagtagtcaccggactatacatcttgctagagatgtctagctctctagcatgattaggcaaatattcttgaagtattctctcaaatatgctttccaggttgtttactttttctcctctcacagaaattttgataattcatggttttggtcactttacataattccctaattctcaatgactttgttcatttttaaaaatagttttttcttatttttgtctgattgagttaattcaaaaagacctatcttcaagctctgaaattctttcttcatgttgatcttggcaattgataaagctttcaactgtattttgaaatttcttaagcaagttttcaattccagaagctctgactgatttatttttaagatgtttatctctttcctcatgtcctgcattgctttagcagtttctttgtgttgattttcaactttgtcttccatctcattgagcttatttgcagttcgtgctttgaattttttatctgtaacttctatgtttccattttggttaggtatcattgctggagagctagtgtgatcttttagtggtgttgcttcatccaggtttttcaggtgccagaattctttagctggttccttctcatctgtagtcactggtacttctaatttttgtaattattttcttgcagggaggatattttctttgctttctttccttgtaatattgttttctctccctttccctttccccgcttcttaggaagtgtgactgtagacaatgatgggtagtcttttggcttttctgttatagccctacgcactatagggctgcactttactggcaggttttgtattgggctatgcaggttttatattgggctgtgcagtttgacctacaagctggctatggtcagtgcagctgggtatatatttgatcattgtttactgggagaagctctctgttgcttcaggcagtgggctaattcatggagtgcacagtggtctgagctccctgctttgcccccgggggtggggtgggagcaagatgggtggggccatacggggtaggcccacctacaggtttcctgatggcaggtacaaacatctggactgagggagaatgtagtgagcatccaccgagaggtgtgcctaggtgttgagatggaaacctccttggatccaagttgtctgcacagggagagagggagcagcctaaactcttagtccaggaaagtgagtgttctagattccttgagatctgcctgggtgtggagtgtaaagggccctgctgcaccacacagtctctgcacaggaagggttgggcagctcaggctgttaaatcagattaacaggtgctctgactgcctggaggtatcgctgggcatgggacagagagggccctacttcatcataatctctgcacagcaaggctgaggcggctcaggatgctgagtaggtgagcaggtactctgaatgcctggagatctgcttgagggtggagtggagaggcgctcccctgtacctgaaactctgcacaggagggtggggtggctcaggctgtaactctgtgtgagcaagtgctttgaatgcctggagatatgcaggggtatggagtacatagggccccactataccacgatctatgcacaggaagtgtagggtggctcaggctgttgatctgggtgagtgggttctccaaacacctggagatctgaagtttaatcggcatggtgcaaagaaggctcagatgcactacgatctctttgcaggaagggtggggcagctcaggctgctgttccaggcaagcaagtgcttcaatgcctggagatatgcctgggtatggattggaaagggccttgctgcaccatgatctttgtgcwggaagggtggggtagctcaggctggaggagtgggtgctccgactgcctggagatctgtctgggagtggggtggagagggacccactgcaccactctctctgcataagaacagtgggtgtctctggctgctgaaccagcagagagtgccccctgatggctggatttttgcacaggactaatgggatggctcaggctgtcaatccaggtgagcaggtgctttagtgcctggagatctgcctgggcatggagcagtaccacggtttctgcgctgtaccacggtttctgcataggaagggtgggtggggacgactcaggctgcagtctgggtgagcaagtgcactcgcgggtttaaattttataggccaagttgccacctgagcctcaatttcaaatgaactttgtgtagcaaatgtgacatcatttctgggtattcagttaaatatggaaaagatacacattttgaatataatgattacaatcctctggctatcatcctggccccggccctcttcatcactgcagctatcttctatatctttgctttaatattttccttcaactcaatctcatatatgattactagactaattttcctaacataatattttgtcatgttccctcattctaaagaaacgatagtgatttcttacctccattcagattaaatccaaacttcttctgatctttgaaaatccaatggaagcttttattcattgctttcatctgtatttattgaactttcaccattcagtaactcatgataatgaatataaagtcatgataatgaataatcaaaattacagaaatctttgaaattaagagtttcagataagtgactatttctaatattggaagttaacgttttttgttgtttttgactggaatcttaaaaattaaatacctctatatatccatgctttttaatttaaattatttatattcactgaagtactatagggatatagtctttggtaatttggtattttaaacccatcatcttccctaccttcttcctaggtatgctgtgttttttgaaggaggaagccataggtaggaatttttttatgacagatttttttgaggtataatttgcatacagcaaaattaactgtttgttttatacaggtctatgagttttgaaaatgcatacagttgtgtatctaccaccacaataaaaatatggaacagttctaccacccacaaaattcacttctgtcccttgtggttaactcctcttcctgatatctggcaatgattgctttgtctgctatccttgtagttttgtcttttttcagaatgttacataaatggaatcatgtaataatgtggctgtttgtgtgtggcttctttcacttagcataatgcgtttaggattcatccagttgtttgtatcagtagtttatttatttttatggctgaatagtttaatatatggctgtgtcacaatttgcttttctattcattagctgaaggatatttgagttgtttgcaatttttgattatgatgaaaaaagctgccataaataatcatgctctgatttttacatgaatgtaagttttcattttacttggataaatatccaggagtaggatttctaggtcatatggtagcatataattaactttataagaaattgccagaatgtttttcagagtggctgtacctttttgcattcccagcagcaatgaataagagtttcagttgctctgtatcctcacaggcattttgtagtaagacttttaaaaaatgtttttaattttagctactcttacaagaatttagtggtatctcattgtggttttaatttgtacttccctaatgactatgttaataatcttttcatgtgcttatttgctttccatagatctttttttagtgaagtatctgttaaagtcttttgcctttttttaggggaggtgtattagtatgctagatggccataataaaagaactcagactgggtggcttaaacagcagaaatttttatcttcacagttctggaggctaggagtctaagataaaggagtcaacaagtttggtttcttccaaagccttagcttgcacacagtcaccttttagctgtatcctcacatggtttttcctctgtgtacacacattcctggtgactctgtgtgttcaaattttctcttcttataaggacagcggtcgtattggattagggtccaccctgatggcctcattttaatgtaattacctttttaaaggccttatctcaaaatacagtcacattctggtattcaggaccctccatggataccaaaatcatggatgctcaagtcctttatataaaatggcatagtatttgcatatacctgaagtatatagacaaagccagagaagttttggcagagttaaagcattttccatataagaccaattacaatgatttgtttggttacagattgctatattccaaggaagtttactttattactcaatgaggaggggtaaagatctaagggaatcttatctctgttgtcatgtggccttcctaattattaatatttacaggaaaaaaagtcagaagttgcagctgcatatgccatgtgactcgggctacatagctacattcctgtcaaggctcagaataatataaagttccaatagatttaaatttgaattatttaatttcacatagcctatacacatcctcccatatagagcttaaatcatctctagattacttattatacctataaaatgtaaatgctatgtaaatagttgttataatatatcatttttaaaatttgcattatttttaattgttgtattgttattttttatttttaatttttttccaatgtttctgatctgcagttggttcagtctgtggatttggaatctgtgaatatgtagggcccactgtatttacagtgtaatttaatgagcctcttaagttatgcaaaggtatacttagactctagtcttggatggaaagtgatagctaattgctctgcataataaagtaataggctgaacatggatatctgacatgaaatattattagtttcatattctgtgttgttgtgtatttctctgttatcgctaatatttagtacaaatgttatggattttttttagtcaagtatggagaatagtagaggaggtgtggtggagacatatagcgtgagcatatatgaaaagcatggcaagtatagaagacagtgagtgagaattccatgagaggtgtcctgagagtgtaaagctcctgggaatctttgaaaatcctggaaagcatgtatgatgagggcttgagacattttatctggatattaaagaaaaggatgatcttagccagattgtaatagttaagcatttcatcatgtaataatagtcttcacttcatatattgttcattcattttgtcatacatctaacattaatttgttgtactgttttacaaggttacaacatttaaagatagcattcaagtattcatgaaactaggtataggaggagagagaaacatatgagcaagtgattgccttacntagtgataattcagtaaacatgtacagctatggagaaaggtaaaaggggaacgtgatcaactccatttggggaaagggtcatgaagggctttacattttgaaggtggagatgttgcaaggtgaaatgcagaattggggctcaactcagaaggccaagttggtccttggctttggctttgtgcaggaaagaattcaagagtgagccaacagagagaaatgaaagcaagtttattggaagaacaaaggaacaaaaggaaggctactccataggcagagcaccctatccccccagtcccaggctcgtcattggttataattgtggttatttcttgattacatatgcttactaaggggtggattatgcatgagttttctgggaaaggagcagggagctcccagaacggtggttttctcccctatccagaccatacagagttaacttttgggcattgccatgacatttgtcatggcactggaaggagtgttttttagcatgctaatgcattataattagcatataatgagcagtgaaggtaactggagatggctttcattgccattttggttctagctggttttggccagtttccttcactgtctcttgttttaccagtgatgtcttgtgacctgttgtcttggaaactagtcctgctgcatttttatctaagatagaacagataagaggggaaatgtaattctatgtatagagtgattagtattcatatctctgtgtagaagtgcagagatatgaaatataggtgmaagtccaggaagtacaaatactttaatatggctggagtgtaggctgctgtaaatcaaacttctctcaaaagtttgtgagttcctttatgagtgaatctatgcagtgaaacttacacatttgccacattgcctagcaactagtaaataactaaataatcattgaatcaagttttgtgatgattttggaaagtattcttattgtgaggttataatttttggtacgatttgatttaagaaagacacaattttgctactttgctttagcaaagagtttgtaggagactaaagagcaatggtttccatcattgatctgtgtatcttatagttgtttatttttttatatttggagcaaacattctcattctttttgcagaaagaccctagaacagtttctggcccttaatagttacataataaatatttcactgactaaaatgtcttccttttcacagagacaaaagcatacataattaaggccaaaatgtacatggtctcatctttggcaagatgcaggcatgtctaaaaacatccactcccgatttaactttcactttgcccctcttgtaccaaacctgttttctctttttcttactatcctcaacaagaaggatttgcaactcttattaggggaatccagttctttttttcttcagtttctgaagagttaaacagaattaagttttcttttaatgaaatttttaaaagaggaacttgagattgggaaggaattactgaatccgtaaagtaaaagctgtagacgatagtctagcaccactgcttcagcagaagtttaagccattgaagttcagatttagcttcataatagatgcttgctttgtaagcttagtacatccttacgttctgatattccaagagaaatggaagctttttgctggtgcagtggttttcaactaggggcagttttaccctagaggggacatttggcaatctttagacacatttttggttgttatattgtgtttaaaaggggaagtgagtgctattggtatctaccatgtagaggccagggatgtgagaacatcttgcaatgcaaaagataacccccacaacacagaattacttgttaagactaaaggtcttggctgggtgcagtggctcacaccggtaattgccccacccccccgtgctttgggaggctgaggcaggaagatcacctgagccccagggctttgagagtagcctggccgacatggtgaaacctggtctctacaaaaaatacaaaaataaataaataaataaataaataaaaaagacaaaaattagctgggtgtggtggcacatgcctgtagtctcagctactcaggaggttgaggtgagaggatcactttatcctgggaggtcaagactgcagtgagctgtgaccatgccactggactccagcctgggcaacagagcaagactctgtgtcaaagaaaagaaaaagacaaaaaatcttaacccaaagtttttttctggccccaaaaactcaatagtgctggggttgaggaattctgtgttaaagtaacacagatttgggtcatagttatagtctcactgcggtgtgtgtgtgtgtgtgtgtgtgtgttgcaaacttgccaaataacacaaattctagtctgttgaataaggaaacatcacttgtctaaggcagtctgtatgtctagacaagattcaagtgatctatcaaatatataatgtgcctttaaaaaaataaactcagttacgtatttacctaaaaggctggattggctttgagaagctgattttaaaaagaacttttgtaggaaatcagtatgttgaagagatatctgtactcttatttttattgcagcactgtttacaatagctaagatttggaagcagcctaagtgtccatcaacagatgaatggataaagaaaatgtggtacttatacacaatggagtactattcagccataaaaaagaatgagatcctgtcatttgcaaaacatggttgggactggaggttattatgttaagtgaaataaaccaggcacagaaagacaaacatcacatgttctcacttatttgtgagatctaaaaatcaaaacaactgaactcatgaagatagagagcaagagaacggttaccagaggttgggaaggatagtaggagggtggcaggggaggtgaggatggttaataggtacaaaaagttagttagaaagaatgaataagacctagtatttgataccacaacagggtgattatagtcaataataatttaattgtacatttaaaaataactaaaagagtataattggattgtttgtaacataaaggatatatacttgaggggatggatgccctattttacatgatgtgattataatgcattacatgcctgtatcaaaacatcttatgtaccccataaatatatacacctactatgtacccacaaaaattaaaattaaaaattaaagaacatcacttttcttttttttattttttattgtactttaagttctggggtacatgtgcagaatgtgcaggtttattacatagatatacatgtgccatggtggtttgctgcacccatcaacccatcattgacattaggtatttctcctaatgctatcactcttctagccccccaccccccgacaggccccggtgtatgatgttcccctccctgtgtccatgtgttctcattgtttaactcccgcttatgagtgagaacatgcggtgtttggttttctgttttcctgtgttcgttttctgagaatgatggtttccagcttcatccatgtccctgtgaaggacatgaactcatccttaaaaaaacccacttttcctaaacatgcatatgtttttcagaggttgaacaaagcagcttcaaaaaggattaaattgatttcaactttagggggatttatgtgtccttcataagagattcttacatttctattatttcatttagtatatttttaagggtgttaggactttgaaagtacggagaaaaatcaggaaatcagaatgattttggatagaatgaataacactgtatgtctccttttagtaactctcatgaaattttttatgcagtgctttttaaagctttaagtgaacagaaaagactgttttttgttcttagagttttcagctcacagaattttcaaaaaattagcattggtcccaggtacactcttccaaccctttcttatttcccaactacctctgacagtagacagtaagatgtacccatctgcctcaaagcagtgaacttaagcttaagcttccttatacgaatgcaagttctcatcaaaacaaatgaaaataaaaataggagaagtgattgttttaggtaagctgtcatttgctgttgtgacaaagaaaccccctcatttcagtgggggtattcacaataaaaaattttttgctcagtcacctgataatccaatgtgtgtgttcccggttgctgggcagctttcatctacctggtaattctgggatccaggaataaaaagctgattccattgtgtgacttctgtatcatctgcctctaaccagtaaaaggggaaagagagaaaaatccctacctgcttcttaatagcaccagcagaaaacggcatatatcacttacgttcacatgttcttttgatgagaactagttagaaggcttgtacacagatgtgagggggcctgagtgcctccaagctacatctctgtaccctggaggggcaatccatgctacataagatttgttcagtcttttaaagacttctatactgacactctgtggctgaatatatgtggtcacatgtctacaatggcggtgcatacactaatttttttaaaaaacttttaaattatttttcttcctttcttttccattttttttttaaaaggaacagggtcttgctatgctgctcaagctggcctcagacttctaggctgaagcaatcctcccccgtcagcctcctgagtagctgggactacaggcataaaccaccacaactggcctattccctactttattaacctagagggaaacaacacatactggggcctatcagaagatggcaggtgggaggagggagaggatcaagaaaaacaccaacgggtactaggctgaatacttgggtgatgaaataatctgtacaacaaactcccatgacacaagtttaccaatgtattaataacaaacccacgtgtgtacctctgaacttaaagttaaaaaaaaaaaaaagaaagttggaggctaggcacagtggctcatgcctataatcctagcactttgggagtcygaggatggcagattgcttgagcccaggagtttgagaccagcgtgggcaacatggcaagactcagtctctacaaaaaatacaaaaattagccaggcatggtggggcacacctgtagtctcagatactcaggaggctgaggtgggaggatcacctgagcccaggaggtcgaggctgcagtgagccatgattgcaccactgtgctccagcctaagtgacagtgaggccccatctcaaaaataataataataataataaataaaataaaataaagaaacttacagtcacactagtcacatagtcatgagttacaacctagagagtcaaccatagagcctatgtttttaaacacatgttctctaagatgttagattaaatgagtatttagaatgaaaatatgttgttcaataaatgggaatcagatgtttatcattttaggtgtaaaggatgtgtgaaatgatgcctaggggtagataataaaggatttttttttaaaaaaagcaatatttgaatggcatgaaagtctattagagaacgaagtctaaaagtagggaaaactgtgaaggactaagatcatccaaacttatgtagggctaatatcataatatttcaaatttagtgtggttattgagcatgaaaaaagctggaagattctgtcaatatttggtttaccaagacaataatgtgtagtcaaaaacttaactagccatgctcagactgtagatttttagtgattaaagtaggttttccctctgaaattttaaaatgtgaaactttgttactatgagatttggttccagttcaacaattttctttttctttttttttgagaggagatctcactctgtctcccaggctgaagtgcagtggtgtgatcatagttcacttcagtcttgaactcctgggcttatgtgatcctcccacctcagcctccctagccagtgggactatagatgtgcgctactgtgcccagcaacattattctttttgttcagtgtgccttttggttttctgtctgctccctcgttattccacattgaaatttagggagcatctattgattgctaccttaattgtggatcttcaccataacatagctatgatcttttaaagtgcttgtaggttagagtctggtattaagttatgatgaagaatcagtgggaaagtggtacaaatccagaaagacaaacaactgtttgtcatatgtaagaaacaattttataggcatgtcttggctaccatcagatattatttagattttcaaacaccgcttgacatctcatagtttgtgatatttctctaccctcatttccccggaagctcattttgtcccgctttggatatagcaaacccatattttactcttgccatcttctttggctttgttcacacatgaatgtacagccaacactgaaattcttcctagggagaaaaatatgtctcagtttttggctctgcatatctgattatcctaaaagcaatggtagcacctaaacttttctatagtagaacaattataattacgtagaaagagaagaaaacaattgattataccacagtattgctacttcattgttgtatttgattatttgactgcatgtagaaagctattgctgggttaatctcacaaaaaaacttgttgtattgttttccaactctattttataattttgtggcacaactttgaacatatttagattgcttacattttaaaaaagaatctgggcatatttcccctatgagataccattaataaagcatcacatataattagaaaaaatagcattgtacagatgaagagagaaaatttttttttggcagaaacaaattatggtgcatattagtatgtctttagatccaaagaacatttgataattgtgtacaattaactccaaaataagttttgattcttctttggaagcatatatagaattttagatacaaactaaaatggcaaataaaaaataacctgacaggtagaaaacatacctgcaggaattctatagagataaaaccatgcaagtgaaaatactatacaaattgaaacaaaaatatgactttgggaggagaggaattgttctcagttgacaaggtaaatggcagtgtctttcgatgtgggggaaaataactaaatgcttgattttcatgtggttattattaattttttgtgcatgtgcagtacagaggctgtttttcaccttctccaaataaaagaacattctacagtctcctctgtgttttattttcttgttgtttatttttctgataggcagtagttctctcccctgggtgctgagttgacctccatgtgagttataaccatagctggggacaagggcatacagtattatcaaggataattgttttatggtacatctttccctgaaggctgtggacccttttttgaaatgtgctctttacttgaaacctctattatttatttgcttgttttggattttttcctttgaacagcaggcatcataaattgataaaactttactagaaaagttgattctagcctcatcgttttcctctcttttcckttcctttcctcgtctataatctagaatatacaaactctcttattgtgaaatacttggggagggcagctttgaaaccatctttctattgcatgagagtattatagctggtattttgagttgggcgattaaggctgaaaatggttttgttgttagactggagaatgagagtaacagaattactttaaaaaaataaaattctgtgtaaaaacagggtccttttataaatagaatgcaacatttttcagatatcaaaagttactgcttataatgacaccacatgcataagactttattattttaaatgatgcaaaatgtcactgaatctttccagcttgaaactaaaatgcttccatggcacttgacagaagcaacgctaattctcaattacccatctatggttatgagagacagcaaaaacacaggcaattgccttcataaagcattaaaaatcttttaggtatttgttactatttctcccccattaaacttttctcccccgaagcytctaagaaggaagaatactgaatgatctgtactttctttttcttttttttttttcttacctacagttttgaagaggatgataagaaacggtcaatgtggaaggttttaggtaaaacaaaaacaaaagtccagaattttatacatcctgaataatcattccctgggttctttcttggggacaaagtgtcctttttctttatagaatcatttcaaactccttttttgttaaaaggcccactaattgctgaaaggcacttactgcaaaaagggatacatggatatctttttgtcctttagctttaatgaattatatattcagtgtatgtacaaagtaccccaaaaggtctgctgggctcttcaaagaggtttaatactcagccactactttcaagaaacatacaggctgtctgctcttccaataaaatgacatcagcagcagcaacacaaccaacacaagttggatgagtaaatagtatgtgataagggccgcaggagtgatatgaacaatagcttttatttgaaaagtcacaagaaagataattgggatctaaagggatcaaggtactttttattcgcgagttattatttttgtttctggaccttgaagaatataaaaaatttgaattggtgaagaagataggggagcgaaagactgctatagtggggaaaacatgaggaaaagaattaagaaggaaatatccaagggcaagcatgaatagatcagtttatgggatgatttctgtaaaagagaagaggaatataacatgggaaaatcagttagagccggattatagaatgttttaaataacaggatcgagtttcaatgttttgttttaggtaatagaaatgcttgaaggattttgagctggaaaatggcatacacaacagtattttagaatgattcatctgatggtgatgaactggggttagagcattcgtaggagcataattgaggatcatgagaaggggtagaaggaggtaggaagggagggaaggacttttgtatctaaactaggaattggcaattgacagcctatcagccaaatacagatctctgtttgtttttgtaaacaaaattgtattagaatgcagccatgctcattataaaaaatgtattgtctatggctgtgtttgtgcttcattgaaaagttgaatattcacaagagagactatatggcctgcaaagcctatagagaaaatttactaacccctgtctgaaattattaggtaattcaagataaatcatttaaataaaccttatttatagttgtagatgctggtttggtaacaaaaggctcccagaaaaccagatcttttatgtattagattaaattgaacacatgtattgaggtgaatgtgcattgctcccttctccagaggacatgactgtaatcatggattccttttatcttgcctttgtgtcatttaagttcagctagaaaggcgatgtcctttttgagctgataacctgatatgagtttgtgtggtcagttttttcagatggtctttgggtgtagggtctagacatcaagcaaatgaaatcaagggtaaattttggtttcttttgccaagaaaactgatggtgattgttcccacttagctgaagcatcctgataatgataaaaacaaactactcagatttactgagcacttacaatatattggatgccgtgcccattgcttcatttgtattatgtaaaataatccttacagaggtcgggtgtggtggctaacgcctataatcccagcactttaggaggtcaaggtgggcagatgagctgaggttaggagttttgagaccagactggccaacatggttaaaccccgtctctactgaacatagaaaaattagccgggtgtggtggtacacacctgtaaccccgctactcaggagggtgaggcaggagaattgcttgaacctgggaggtagaggttgcagtgagccgaggtcatgtgactgcactccagcctgggtgacagagcgagactccatctcaaaaaaaaaaaagaaaaagaaaaaaaatccttgcagaaatcttacgatgtaaattttaaaaattattttctcttgatggaaaagaaaactctgtgttagtgagattccataacaatccctaggtcaacagctggcaattagcaaagctaggatttgaacacaggtataataaaaatctactagaatatctgtttatctcaccttctcagatcaccacgtcttccctttactcattgttagaggagtggtttctagcagacacctttttattatgtgagcttcattctagtcacaatagattggtccagggatgcatgtcagagccagattcaagctgagccaatcagagtcttgccctgggattttgtataagacactaaactttctgcttctttctttccctttttgaagagaggaagtatgcaaatttgtgatgtcattttcccaggcactagaaggtgccctttccttgtcttgcttgttaaatgtttttaaaatgaaaaacacacttacagattcagataactgtgagtgtttttaacaggcaagacaaagatggtaaggagtttgaaagtgtgtgttaatcgaggatattaattacctgaatgttgagtagtaacaaggtgctgacttacagcatctcctgctgtggaagaggagtcagagaaggcatctgtcaatgagttcagtgctggaaatagcaaccactctagacattttcacttggaattgagggaacagagagaattaggtgcttataacacctgctagaatggctggggcagtggaagccagaagggatatcatgaaactgagatccagagctgagattcagaggtcaggaagctgctaccaccaacatattacaacaacttcctttcatacctacaaaactggtgactacaaatataatgaggaatttggctaatgcaaacataagtagctgtgattaaaaacaaaatcatttcttttctggagttgattgatggccatctagatttcttctgtgaattcatacttcttatgtgaataaataatgaaaggttaatcagagcttctctttctaggactggccatctcctaatgcatcatgttgtttgtgttgctggatgtttaatgaaacatacatgatgtttttaagacagaatggccaatgatataaatattagattaatgatataaagcctggaggttaattgactaggaaagacttgcattaaatagagctcaaagaggaatagagattttatgatttcttcatgtcttatgatttctttatttggcaaaattttgaaataattgtgattcttctgtggtcattttatacaacctttttgcttccctatttatttctttttggtgattcagaaaattgcaaatagtgagattgtcctaagtgtggtcatataaataaatctgattgaaaaatataggttgtatattgaacattgacaatttttcacttttctttatcttactgtggttccttttcatagactacaagctaagtaggtcaggaatggggattttggggcacattgctgataggggcataagacaggtacttgggatatccttctaagatcttggagtacccttctaagatcttggaatacaattttaatggttagtggcactccaaatgttctactctgaagactcactgaaaaagagaaataacctaatatatcagtgttctctcaatgtcctcttgggatatttccctctatagtgtgttcattctattctaccaagccaaatgttcaggaaagtgcttgtttctagaccatagcttgagaattgctgttctaggaagaacttgcctcttttcctagtaaattttagtgagacagaaagcctgataatttttagtatccaagtastgtaaattctgtaaattcagcatgtttaatcaaattactcactgatcttgctttcaatgccagcttcatacatcaccaactcacaaatcatataaagtacaataggaatggatattcacatgacagaacattattaccttagtaatttactgtatagtattgggagatttagattgtcttttatcagagaccttctaacctggacacaatatattttcatttctcttttttctcctttttttggttagtatcttcttttatgattaatattacctccataatgaaatttgtattggaaaaataaatggcctttttaaagtcttttttttcctactccctgtaatcaaaaataatgccagaagagtctcaggacacttggcagcaaaataaatgaataaatgtaaagaaaatcttaaaacagattactatcatagaaaagtaataaaatgaaaaagtaagctatttatgctgtttcgttttgaaataataatctataagtcttgaaaacttctcaaataatttttactaattgcagtatgtctctttttttgagattggtagatagaaaagctggattgtcaactacaaaaaatcacttgggcaaatttatttaatttttaaaaaattctcttaaaccaaacgagccagactttggcaaatttaaacaatgtgctgccattacacactttacatattaccagtattagtcagttacacaactggtttccacacccagggactatgtcctggaaataacatcaattcatttgggttcaggtccaaccagtggccctatatctggaagtcaaagctctaattcaacagttagaatgaaaacaaagccataggaaagtgctttcttcattctttgcctatctcctggacagtgttaagtatataaacctatgttgaatatgtacagtatttaaagaatattggtatgaaggaataccatgtcattagcctgcctagagcactcacatgctttaatcttattattgggtaaaatcagggaattataaaaatgtatttgaaggataaagaatgtagaagctacgataacaatgtgagaaaagcaagtcataaaaatgaaagttaatatacaatgtttcaagagagaaaaggaatatatcagattgactttggagcatgcttggttttagtgtagattcttggagcatgcttggctgtaatgtagattcttcaggttcagagatggaagtataagaagtagtgttatattgttgtagggcaaagctaaggcatttaatctttgctaagaggtaaaagataattttaaggcatatgtcaaaagagtaatttacttacatggtgattttaaaaagtgatgaagacattttgcttttgctccatgacatgagacaagtacagtttatgatctgagatagtgaaactagttttcaggacatgtcacagacagtcatgaattctaaatcttattcatgtccaacagaagtgttactatgaaggagagaaaatagagaagacttataaaacattcatcaaagaaaaaatacatggcttgaaaagatgaaaatatcctatttgaagcagaagaagcttaagttggttttcacttatccactttcctgcaaaacatactaatggtggctgaccacgtgggcagaaatcagacactgatattatcctaccccatccccactactaatgcaaagcctgatattcggacatgatgtgaatacatcagccttggatttgcatgctctaccaatttctgattacatgagaagttgcactgtagatcattgtcatttsttctacactcatactaattgggggaaaggattctattatttgggtgaaaatattgagtgtattagagcaaggacagtgagtttctactgatggcactgttgtaggtatatattgaacatggaatatatggttaaaacagacatagtgctcaatattcatatattaatagtggtgctcttttctcacaaatttgttctattctaggcttcaccttcttaaaactattgtttgatgctattgccatggtgtgtactttccttcttttagcaccattgctagggagttggagaaaaagtgttgtttgagaaagtcacatgagaaataatccacgttcttggggattgatatggtttcactttttgtccccacccaaatctcatcttgaattgtaatccccacatgttaagcgaggaacctggtgggaagtgattcgattatgggggcagtttcctccatgctgttctcatgataagtgagtgaattcttaagagatctgatggtttcataaacctctttttgtatttttagtagagatggggttttgtcatgttggccaggtaggtattgaactcctggccttaagtgatctgaccacttcggccttccaaagcgctgggattacaggcatgaaccatcgtgcctggcctgtcctcttctagaagaggactccttttctctgttcccttgagattcatcactgttagaatcttcttttctacttccagaagttttacactggaatatcaacttttgtagtcataaaagagcttgttcctgccccagaatcccacaggcagcatagaataatcctaatggtgctacaagtattcttgtacaagctatgctgcctactgattttagaccttgggcaagttactctttgttctggtcttgtttccctcatttataaaatgaagtgattggaatagagcatttattatgtgtcttttgattctaatactatgattcttgacagtatggaagctctgctggagttgatgtaactggttaattgggtcatccaagaagaagatgttcacacagtatcagatatgcaagagatttattagaggaagatttctgatggtaaatgagggagggaagctggggaggctgagaaaactattattttgtggactcatgctacatgccaactgctttatatacattatggcatataattctcacactctatatgatgatgtggtagcataataatagaccccccaacccccaagatttctatgctctaattctgtactataaatatgaaatgtgttacatggcaaagggaattaggatggcggagggaattaaagttgctaatcaatggacctgcaaaatatggagatgatcctggattacctgggtgggtccggtgtaatcacaaggatctttaaacatggaagagagaggcaggagagagatggcagcatgagaaggacttggccccatgttgctggctttgagaacagagaaatggggtaaagagccaaggatgtgtgtggcctgctgaagctggaaaaggcagagaaatagattcttccctaaagcctccagaaggaacgcagtcctactgacaccttgattttagcccatgcggcctaattcagacttcttacctccagaactgtaaaatgataatttgtgttgttttcagcagccaaatttgtgataatttgttagaacatcaatataaaactgttagaaattcagaaatggatattttttattctgatttgatgaatgaaagaactgcgtcttagagcagttaagaaagattcttatggtcacaggtctaattaaaggcagaggattcaaattcagatttatttccaaagcctgcactctatttagtgtgtggccttccactgttacttggaatccttcaggtgtccttggcaggccctgggctcaagactttcttgcctgtcttagtgggccattctagtgtttttcctagctgagtgccttgcttggttatgcaaagcatcttcagctcttcttggccataactttggctttggggattgctgtccataccttttcatccaggaccttggaaatgtccacagtttttcttgaaacttcagtgctgctgacagttagtggaaaaatcctgttcacagagtatttcttatattagctatccttcctttctatctaatattataaatcctgctttccacctctatccactctctgaaacactgcaactggcttaccctggatgcttactttccattttctttagaaaacatgaggtggagtctgaatagggaataatccaggatatgtttttttgtttgtttgtttgtttggagggggctcgctttctgctagagttggctcatagtctattttcagggcagtagtcaccttggttacattgctgtgaacatcttttattttacgggttaaaaagttttctgaactagactgcatttagccatcctttataagaattttgtcattgagaacatgtgttataaattatacataacagatatgacagcagtttaaaacacaatttgattataasttggggcctgacagtatttttagtcaattaaggaattagactacatagcaattgttgactacactgctcatgttcatacagagaaagaatattaccatttgaaccctaaagggtggttttgaccctgtctcttgagcaaaaaatcagatggctcaaataaatcagtttagttctatttgttttatgagctgtatagcagttgaagcccaagtttaatgacttgtttcacatattttcccacaagtctttcttggaaacccaagacatccagagttatgatgggttatcagaaaaagggaggacaaggttcattattctagaaatattgctatccataggagtgtacaacagttgaggatttaactattttgatggttactttgtactaaatggactaacatataattcaggtcttgtcacaaatgaaaaattgttcccatggtaagaattgagataagagcctcttaattctctttggtacattttatcttcctgtattattacacttattagcttggttatttttctaaaaatctggattagtttaggatctaattctcttccattttgatttgttgggtcattttattgtagaatatgtrtataaaattatgcatggcttggttttcttaaataaacttttaattttagaatagttttagatttacagaaaaattacagatagtacagaggagttcttgtatacctttcttgcagtttcttctattgtaaccttatattgctatgatacatttgtcacaaccaataaaccaacactgatatgttattgctaactaaactctacattttattcagatttccctaatttttcctttaatgtcttttctgtgccaggattcagtgttacatgtaatcatcatgtctccacattctgctctgtgacagtctttcagacatgaaaaacaaggaagtttttcatgactttgacagtttcaggaatactggtctggtcaggcattttgtagaatggcccttaaatgggatttgtctgaacattttccttagggttagactggggtttgggttttggggaggatgaccacaaaggtaaagtgacattctctgacattatataaaggggacattctattgacatgacttatcaatgatgatattaactttgatcactgaccaatgtagtgtttgccaggtttttccactgcaaggttacttcctcaccctgtcccttccccttcctactctcctgtttggaagtaagtcactaatgcagtccacactcaaggtggggagatttaagctcctcttcctggagggggagtatctgtaaactagttggaattcttcggtatcccaacaattgggattttatttttcttttatttgtttattatgacttgatattgatttcttgcacagttctattttttccttctcaaatacaatatgatagagaagataaggcatgcctattttaaaaactaccctattttattgtatctaagatgccatcacttggaagacatatcctaatttgagaaatgtgaacatatgggaaaatgtgcatgttaaaattgatgccatgcagtataatagaaagtacaatcgaatcatctggaggacagtttcacaaattcctttagaaagaatttttattaactgtattatgaagaaattctttcttaaatcttggatgcagtgatttaaggtaattttttcctgtttcataaaattggaaacatcacctaaatttaaatcagtttgaaattctttatatgcacaataaactaaagtagattttagggtcatatctttattttgtaattctctaaactgtgttttgcacaaaatagattgaattatattttatttatgagattagaatggtacaaaatgttttgtcttttcaatgtaaattgagtatagttctctgttagttattccactttctttaataccttttattttcttttgtttggctcattttcttatacattgattccattggtagaggttcataaaatgttagagttgaacatcgttagaaatgatctaattcactcctcatttaataaggcccataagagacttggcataggttatcagctagcaagaacaaagtgagattggaatgtagaacttttgatgcgaggccagcattttcccccactatacaacaatgcttcatttttatttgactcggaaatttcactgtaaatcagcatcctatgtttcgaaatagacgtttgcatatgggaaaagctagattgctttagttcttcttttctctttgactttggcctaagctttccaatacagccagaaaaattttccctgaataacttgttttcagcatgtttatcatatagaggaaacataagctcagttgtgaattgaacttacttacatatgtatttcttaaataaccacgagaattctgatccatctcctgtctattgaaggtaccaatagcttcaatagatgttaaaaagtcacttggttcaaatttaaaagatgttgtattagtaatgtaccttaaaactaaaggataggcaacctaaaagtgtttgagagtcttaagagaatgtattcatctctaatatagtgattctgcctgataaagaaatgaatgttttcctctgtagatttcatatgatattatctcatatccaatgcatattttatttatattgtttacatacagaggaaattcttattctgtgtgtatgggtttcagagaaataaaataaaataaagtgaataaaaataacagtgtctgttgtttttaagtatacatatggctttgatggtttctatccacattgtcaagaaacagtaatcatattgctctgggattgatcacttttgcatttaggggattggacttaaacatttaaattccaaattaacaaaaggaaactctacataatacggtttacaattttgttttgacagccatgctatatttattcacaacaaagcctgggaatcttgcagatttttctcttcctctcttatctgcacatttttacagataacagactgttctgcatttattaatgaagcttgctctgaagtagttgccttgttttcttttcttttccaaatggatgcatcatctggtttgacagaattggaatttgggaaagtgaagtttgttttccatgctggaaataccttgcagtgtccttgttgatctagatctgactaatgttttactataagtttgcaacaacaattgtagcaaggacaaaagcaaaagttaaaccttggaaagtttcccacagagttagtaccttatattttcagaaataacatggccaagttgaccatttgacaacattttttccctaatgcatattcaaggatttctatgtgtctacttaatagaattctttatataacccatgtttctctaggccttacctgctaggagtacatcataactgtcatgacaaaaatgtctttgtatatctattgtgggattttcatgtctttcatatgtgttcataaggttagcactggccatacaatcactattttctctccacttggtaactggctgcatggccctagctctcaagctgatgatcagtggaggcagctggcccagtgcccaggctgtagtgctcctacataactggctgcctccgtctctatctggtaacatggccccactctttctccactaggtaagtgtcaaaaagtaacacactgccagccacatgttgaagtgtggctaataccctccactactatttgtgccaagttgtgttcaccagttccttttagagattttgctgatatgattatataatttttaatttgctattatattttagtcttctcctcccaactaccccctgacccctgactcctaggcttcagctgactctaaggacaattttaacaacacattactgtgctatttcaaactcagtcctcacttggaaactattatctgtgttcctgcctatccttttcttcaagacaagtttcattaagcaaagagaaccctccgctcctcctggacatatctgaattttcaaagcatgtgccacaaccattgaaaaactttttctgccttaagcactcttgtttttggaggcttcagtcacttcatagcaaatgtattaaaatatacttacaatgcaacccaacattaaacgtagtttttgatatagaaaaatttggaaatatttttataaatgtactttgaaatttaatatcttatgagtaatgtttaattcatgtgttgtgattcttgctcacacataaatactatttaatttaaattagatgttaggtaccattgggaattcttttgtagtaagataaactaatatacaaactttttaaatataatgaattgtttatgatagcataatttaaagttaattgagtctcataatacattttgcaggcaattacgttattcatttttactttctttttatattttgatatcaatattagtttttcacagggtattgcaaacattatatttcccccaaatgcatctataatgcctagtaaattaacaacgccctggaatttgtatttgctttggatgctttaaagtgttgcttatatgatcttccctttttttctccctactccttccttccttccttccttccttccttccttccttcccattcctccctccctccctccctccatccctttctccctcttcctattcttccttccttatttccttcggaactctaactatgtgtttgcatgtagttatcacaacacggatcattgtacattgtgtatgggattacttaacctgtttggatagtgtatataaaagaaaaagtgatgaagaataaaatataggcctttatgtagcagcactgaatgaataaaatggtaaaatatgaagtaaggaaaatagagatttcctatggttttcttacccttccataaggcagggcatagaaaagctgggaactgagaatgtgtgaaagttagaacagaagatgcagcaatgaagtatcaaattctagttgaaaagcaagggcacagttgaagagcaaaatggaggctaattattggctgtcaggaagcatcaaaccaagagttcagtggactggataccagaagcagaatctaggataagagccagaacctgcttcatatgtctttttgctagatgtatttcctctttcatgaattgtctgtttttgacctttgctcacttatcttttgggattttagtgtttctgttatctgcttgtttgatctctttattcaacatattaagctagatctatcatgtttacaacaaaaactttttctcataattgcttttttttttaccataggtttctaacatcacatctttctagtctttttacatttatttttatagtttcctagtctgttttctcctgctataacagaataccacagactgcgtaatttataaagaaaacatatttatttggcttgtgattctggtggctgggaagtccaagatcaagcggctgtatctaatgagtgtcatcccatagaagaaggcagaagcatggaagggtggaagtgagtaccctagatgaagagaaagtgggggccaaacttatcctttatcaggagcccactcctgagataactaactcactcctgcaaagttggtattaaaccattcatgaggatggagccttcatggcctaattacctcataaaggccctacctcttaatactgttacaatggcagtttaagtttctaacacatgaactttggggacactttcaaaccatagcaggttctaagtctcgaaaggccatctatagatatatagatattatatctaaaagaaataaatatatatttataaattacatacaatttatatatctagaataaagtctttttttcataaagttgtctatgattcaatctttaacttttttttaaacttttattttaggttcagcgtacatgtgcaggttttttatataggtaaatttgtgtcacagtggtttgttgtacagactatgtcatcacccaggtattaagcctagtacccaatagttattttttctgattctctccctcctcctactctctaccctcaaataggctccagtgtctgtcattcccctctttgtgtccatgagttcttatcctttatctcccacttgtaagtgagaacatgtggtatttgattttcgatttctgcattagtttgctaaggataatggcctccagctcaatctatgtcccttcaaaagacatgatctcattcttttttgtagctgcatagcattgaatggtgtatatgtaccatattttctttatccagcctaccgctgatgggcatttaggttgtttgtgaattgtgctgcagtgaacattcatgtgcatatgtctttatggtagaatgatttatattaatctgggcatatatccagtaatgggattgctgggtcaaatggtagttctgtttttaggtctttgaggaatcgccacactgcgttccacaatggttgaactaacttacactcccatcaacaatatataagtgttccctttttaccacaacttgaccagcatgtgttattttttcacttttaaataataaccatcctgactggtgtgagatggcatctcattgtggttttgatttgcatttctctaatgatcagtgatattgagctttttttcatatgcttgttggccacatgttatgtcttctcttgaaaagtgcctgttcatgtcttttgtccactttttaatggggttatttgttttttcttgtaaatttgtttaagtttcttatagatgctggatatcagacctttgttagtttgcaaaattttttcctactatttaggttgtctgtttattgatagtttcttttgctgtgcagaagctctttagtttaattagatcccatttgtcaatttttgcttttgtcctgattgctttaggcatcttcgtcatgaaatcattgcttgttcttatgttcagaatggtattggctagcttgtcttcaggggttttatagttttggattttacatttaagtctttaattcatcttgagttgatttttgtatatggtgtaaggaaggggtccagtttcaatctttagcatatggctagacagttatcccagcaccatttattgaatagggagtcctttctccattgcttgtttttgtcagatttgtcaaagatcacatagttgtaggtatacagcattatttctgggctaggtgcctctttttgtaacactaccatgctgttttgttactatagccctgtagtatagtttgaaattgggtaatatgatgcctccagttttgttctttttgcttagcattgcctcggctatttgggctctgttttggttccatatgaattttaaaatagttttctctagttctgtaaagaatgttattggtagtttggtaagaatagcatggaatctataaattgctttgggcagattggcccattttaatgacattgattctttctatccatgagcatggaatgtttttccatttgtttctgttttctcacatttctttgagcagtgttttgtaattctcattttagagatctttcccctcccttgttagctgtattcctaggtttttaattcgttttgtgtcaattgtaaatgagattcggctgatttggcttttggcttgactgttgttggtgtatagtaatggaagtgatttttgtatattggttttgtatcctgaaactttgctgaagttgtttatcagctgaaggaccttttgggctgagactatgaggtttgctagatatagaatcatgtcatctgccacctatagatatataaatattattatatttaatatatatttagaaattaaaataatatatatttctaaattgtataacaattatatatctataataaatagtaattttttatcaagtttttgataagaaatcctatgcgagttaaagagttaaagatggaatctttaagaattccatcttaattcaatcttaaagaatctttaagattccatcttaactcttcaactcgcatagaatttcttttagtataaaatgtacaacaggtgctcaaattattttttctttaaatacataatcaattatcccaaaagcgtttattaaatgatatgttttattattcattcattcattcattcttctttgattaggagttttttaartcatgaataagttctttctattttaggctagctatcctgttttattaatctacttttatatccgtagcactttgttttattattatagctttaggatgcttaatctctttctttttagaattatcttacctgcttaattttccagatgaattttagaattattctatcactttctgaacaaattgcattggagttttgattggagttgcataaatctataaatgaattggacagaatttctttaatttctcttcatacacaggaacatttattcatatattctaatatttcacttttcattattaaaaaccagtccctttccctgctctcctccctcattatttgattagtgaggtaagaccatacgaatcatatgaattggtgcatgaagatgacaactctttgctgtccatcacaaatttgcagttattttgaaagcaggggtgacaagaagcactcagctatcataaattcttgctcaggtgtttctgtagccaaaagctcagctcttttatagctctagctatacagagttgcactttctgcaaagttaagtggctcattctaatagcactttatttgaatctcttttgctttgtataattaacaataatttattcattgaactaacattgaaagagctcttcctttgtgccagactcttatctaggccctggaaatataagaggtgaatgaaacaggaaaagtctctgctcttggggagactttatcctggtcagagaagacagacaatgagcaggtaaacaaacacatacacatcaagcagttataagagctatgaggatgaataaagacaggtaaagtagaaatgtgatgaccaaggggtgttgtttgatacaaggtggtcagggatcatctttctttgaaagtgacattgagcagcgacctgaatacatgggaggaaatgggccaaacagatatgggtggtagtggtggggaatgttctagactgaggggatatgtgcagaacaaaggtggaggcttttctttgaaggaacaaggagcaaggagaagagtggtagtatttggggaaatataattaaaaacaaaatcttccaacccagatatgctcttcacaaaggtagttgagaaagaaaacacttttatcattgaataagcattaaactagattgtgttgcatatcataggcaatctactgaaagatttcaaagaaaaaaatctcattcttttacatagccaagaagatacaatctattacaygcatgttttaagataaacaataactagtcctcaagcaagacaacttcccagcaccacttgccacatatagcttacgctagattcacctggtaattggagtgaccatcaatgttagctaattggcattatccagaggaaaaccaacttgtcattttttttattgttttttattttttgagacggagtctctctctgtcacccaggctggagtgcagtggcgcggtctcagctcactgcaagctctgcctcctgggttcacgccattctcctgcctcagcctcccgagtagctgggactacaggcgcccgccaccacgcccggctaatattttgtatttttaggagagacggggtttcaccgtgttagccaggatggtctcgatctcctgacctcatcatccaccctccttggtctcccaaagtgctgggattacagccgtgagccaccatgcctggcmtaggatgtagttttgcaatgtggaacaaagtgcctacctaagttgggctattatccttccacaaaaactgggagatagggctcctatctcccttgatgtctatattcaaagagatggctccaaggtttttgagaaagacattccttggtcatgaaactggtaagatcctatctagttttcaaaaggatttatatacatttcaaagcgagaagaaagtacttacaagttttctgaagtaaatgctataagaaaagatgaggagggtctcttattttcaacagggaaaattaagccttttaaaaattttgtatttgtccttacatagatgataagtgagagaaggaaacagaccttatgaacagtggtcagcactttagattttactctgagtaagatgagggtcctgagaagttttgagcaggggaatgacacattcctttggggttttagaaggaaaccctatctgctgcattgagagttcggtctaggagagctcaggtggaggttgtagtttttgaaagttctgtcaggggtggactagggagtaggggtgggagtgtaggagagcacagtatagattttaagggatacagtggaagggtttagatgttagaaggggtgtaggcttaagttaaatgaggagatgtacaaagctcacaaatgactgattcggttcaaaatacaggcctttttcttcatgtttgccttcccttgcattccatattgtaaggtgcttgagggcagagactgtatctcgcgtttgttgaatgaaagattaacttgccatctatgctttaatactatgtgagggaacaggtcagtgtgtcaactggtatgtcccttttatcttttctctctgatgtttattgagcatctgtcatgtaccagacactaggacaaaatgaagctttctctgccctcaggaagctcactgtctacttgagatagatgagtaaatgggttattgcagtgcaagatgataaattctatgatggctgtatgcagtaatttgctgaaataaaatttatatgtaatcccataattgtatatctcaaacataaatttctattgatgatcctgttattattcaaagaatacctgcttaaactcagcctacctttggctgctgaatagtggtattgctttaagaaccaaagacctctctgctatgcttagaatatgtctcccaaaaagcatgtgttggaaatctaatccccggtacaacagtttggaaggtagggcctaataggaggtgattaggtcatgagggctctgccttcttaaatggattaatgttgttatcatggaagtgggttgcagtaggtttgttatcttgggagtggggcaaagggcaaagaaagggttcacccctctcttttcttttcttgtgtttcttataggcaacagatcaacaggtctttttttttttaatgcatttagctcctctacatcatttgattgcagagtttagttcatttatattcaataatattatttataagaacttatgcctgttattttgttatttgttttctggttgttttgttgttttccttttttccctatgaaggtgcttttctttggtgttatgatttaatttcttgctttttttgtgtgtgtatttgttgtatgtttttttcaatttgaggttaccattaagcttgcaagttttcttttttctgttatgtctttgtctggtctgcttttggtgtcagggtaatactagcctcatggaatgagtttggaagtactccctcctttatttttcagagtagtttgagcagaattggtattagtttttttttcctgattatttgttcttcataarctatattgtagtaattagttcttctttaaatgtttgataggattcagcagtgaagccataggtcctgagcctttgtttgctggatgacactttattatggcttggatctctttgcttattattggtctcttcaggttttggatttccttgtggttcaatcttggtaggttgtatgtgtctaggaatttttccatttcctttagattttccaatttgttggcatatagttgctcatagtagctactaattatcctttgaatttctgtggtatcagttgtaacatctctttttttaatctctgattttatttatttggattttctctccttttttcttagttattctggctaaaagtttgtcaattttgtttaggctttcaaaaaactaacttttcatttcatcgatcttttgtattgttttcttcatttcaatttcacttatgtctgctctgatcattattatttattttcttctactaattttgggtttggtttgctctggcttttttaggtctttaaaattcatcattaggttatttatttgaagtttttcttctttttcgatgtaggcatttataggtatgaacttgcctcctggagctactttcactgtgttttacaggttttggtatgttgtgtttccattgtcatttgtttcaagaaatttgtaaattttcttcttaattttttcattgacccactagtcattcaggagtatattgtttaattttcatatgtttgtatagtttccaaaattcctcctgttattggtttctagttttattccactgtggccagaagagatccttgatattattttaatttcttgaatatcttaagacttgttttgggacctaacatatgatctgtccttgagagtgatccttgtgctgaagaaaagaatgtgtattctgcagccattgaaatgttctgtaaatttctattaagtccatttgttctatagcacagattaaatattacatttctttgttgattttctgtctggaagatctgtccaattctgaaatgaaagtaattcaagatggattaaagacttaaacattagacctaaaaccataaaaaccctagaagaaaacctaggcattaccattcaggacataggcatgggcaaagacttcatgtctaaaacaccaaaagcaatggcaacaaaagccaaaattgacaaatgggatctaattaaactaaagagctcctgcacagcaaaagaaactaccatcagagtgaacaggcaacctacaaaatgggagaaaattttcacaacctactcatctgacaaagggctaatatccagaatctataatgaactcaaacaaatttacaagaaaaaaacaaacaactccatcaaaaagtgggcaaaggatatgaacagacactattcaaaagaagacatttatgcaatcaaaagacgcatgaaaaaatgctcatcatcactggccatcagagaaatgcaaatcaaaaccacaatgagatatcatctcacaccagttagaacggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcactcttcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactattgcaaggatgaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacaagttaatgggtgcagcacaccagcatgacacatgtatacatatgtaactaacctgcacattgtgcacatgtaccctaaaacttaaagtataataataattaaaaaaaaagaaagtagggtgttaaagtctctagttgttattatattgaggtctacctgtctctttagctctaatgatatatatctgggtgctctatcattgggtgcatatatatttacratttttatatcctcttgctgaattgaccctttatcatgctgaattgatcctttataatgatttttttgtctctttgtacagtttttgtcttgaaatctattatgtctgatgtaagtatagcyactccttttttggggggctgttcattcagatagagtatcttttatcattcctttgttttcagtctatgtgtatttttgtaagtgaagtgtgtttcttgtaggcaacagatcattgggtctctctcttttttttaatctgtttagccactctgtgacatttgattgcagagtttagtccatttacattcaatattattattgataagtaaggacttattgttattttgttatttgttttctggttgttctgtggtcttctctttcttttttccccatgaaggtgattttctttggtggtatgatttaatttactgctttttatttttttgtgtatttgttgtctgttttttcaatttgaggttaccatgaagtttgcaaatactatcttataacccgttattttacactgataacaacttaacactgattgcataaacaaaaaaacaaaaagaaaactaataaaaactctacactttaacttcatctccctgctttttatcatttggttgtttctcttaggtcttattgcactgcttatgccttattgcactgcttatgctttgaatagttattgtagtaattatttttgattggttcatcattagtttttgtacttaagagtagtttacacaccacaattacaacattgtaatagtctgtgtttttctgtatgcttacaattaacagtgagttttgtaccttcagatgacttcttatgataatgaatatccttttctttctgcttgaagagatccctttagtatttcttgtaggtctggtctcgatgaaattcctcagcttttctttgtccaggaaagtatttctccttcatgcttgaaggatattttcacagtatatactattctagaataaaagttttttccttcagcactttagatatgtaataccactctctcctggcctataaagttaccactgaaaagtctgctgccagatgtattggagctccattgtatgtgatttgtttcttttcttttggtgcttttaggatcctttctttatccttgaactttgggagttttgttattaaatgctttaaggtagtctttgggttaaatatgcttggtgttctatagtcttcttgtatttgaatgttgatatctttctctgggtttgggcagttctctgatattgtatttttgaataaactttctatcactatctctttttctacctcctctttaagaccaataattcttagatttgccctttcgaggctattttctagatcttgaaggcatgctacattgctttttattctttttttttttgtgttctctcactgtatattttcttatagtctgttttcaagctcactgattctttcttctgattgaccagttctgctattaaggtattctgatgcattattcagtttgtcaattgcattttttaactccagaatttctgcttgcttctttttattatttaaatctctttgttaaatttatctgatggaattctgaattccttctccatgttatcttgaatttctttgagtttccttaaagcagctttttgaattctctctcttaaaggtcacctatctctgtgtcgccagtattggtccctggtgccttatttagtttgtttggtgaggtcatgttttcttggatggtattgttgcttgtgggtatttgtcagtgtctgggcattgaagagttaggtatttattgtagtgttctcagtctgggcttgtttgtgcccatctttcttggaaaggcttcccaggtatttgaagggatttgggccccaggcccaataatgctgtggttcctgcaaacttatagaggtgcagtcttggtggtcttgtatagaatctagaataattttctggattactaggcagagactcttgttctcttctcttactttctctcaaacaaatggaccttctctctctgtgctgagctgcctgcatctggggatggggtaacacaatcccccctgtggccaccaatactgggactacagaggtcagacctgaagccaggacagcactgggtctcaccaaaggcttactgtaaccactaactggctactgactagctcattctagggttctacaatcagtaggttcggaagccagctaggtttatgtccttcccttcagagtggaaagttctcctgggtcttgagtaggttcagagatgctgtctaggagccagggattctagtaaaaaaaccttagaaatctgccttgtgttctgttttactgcatctgagcttgccctcaaaccacaagacaaagtccttcccactcttccctccactttccacaggcggagctgtctctttccatcgccaccaccaccaccacaggtgacaagagttacttccaggccactgctgatgttcacttaaagccaaagggctcttcagtcagcttgtggtgaacgctgccaggcctggaagtcacccttaagggatgtgggctcccttctggcccagggtaagtccagaaattctgtttaagaacctaggtctggactcaaggaccccaagagtcagcttgatactctacctcactgtggctgagttggtacctaatgtgcaagaaaaagccccctttacgtttccccatgcttttctcaggcagaaagaatttttcaccatagttcccacagctgggaatattctgcatctcccctaaagccagcatgtctcagagtttcacccaaggcccatggcatattacctggatattgcctttggttgttcggggccgaagggctccttagtcagatgatgaatcctgccaggacttggtctttcccttcaaggtagcaggctcccttctgggcaggttcccagggtgtgttgagaaatgttgcccaggagctacggactggaatgggggtctgatatggtttggttctctgtccctatttaaatgtcatgtttaattgtaatccttattgttggaggtggggggcctagtgggaggtgattggattatgaggacagtttcttatggtttaacaccatcccccttggtgctgttgtcacgatagtgagtgagttctcatgaggtctggttgtttaaaagtgtgtagcaccttccccctctctctcttgctcttgctccggccatgtaagatgtgcttgcttcccctttgccttttgccattgattgtaagtttcctgagacctccttatgagctgaacagatgccagcatcatgtttcctgatgctgattggcagaaccatgagccaattaaacctcttttctttataaaattttcagcctcaggtatttctttatcacaatgcaagaacaggctaatacagggcctcaggactctgcctgatgccctatcctgttgtgggtgagctggtattctagatgcaaggcaaagtcctctttgctatttgctttcctctcctcaagcagaaggaaagagtcactttcatttctgcgagcagggctgcctgggcttgtgggaggagtagaaaaaacaccccgtttttcactctgtccctaggtcatgtgccaccctagtccactggctctaagctcagcagtaggaggaatttcagtccttgtgtcatagactgcctttaaagcttaccaaggaccccagagctctctggcccgcagtggtgatgtttgtcaagaaactcaagttctgaccactgggatgggcgatttccctctggctagggcttgtccaaatgttccctttttgggcaggagctggctaagcccagcatggctttgctctctgctgtgacagggcataagttcaatcttccttcaaggcagcaagtgccccagccactgtgctcttccacccccttgtgcacagattctctctctgtgccagatggtcactgcctggagattggggaggggtggcaccagcaattcaaagctgtctttcataccctcttcagtgcttctttcagcaatatgaagttaaaaccaggtgctgggattgcttacctgattttttgttcttatgtcagtgcttttttgtgtgtagttagttgttaaaatttggtattccggctttagggacaattgatggtggcttctatttggccatcttgctcctcccttgaatatttaattttagatgctagtggtgttgtaaggagtttcactgtcaggatctgatgctgaggccaataaggtctatgtactgccttcacggagcagatgtttagagagagcctgctgtgtgtcagatacygtcctgagagatttcagcagtgaatgaaactctcaaaaatttctaccctcatgaaatttatactttattgatagttttggcagccttgcctcttgtatgttgacatacaatttttcttcttttaggaggggtggtgggaacattcccatcatgcccaaactgccaagtactgcttatgccagtaagtgggaaaaacaacttggctgtgagtcggtagtgctccctgaccctttcctcttaatttatttattttcctccaagccattatttgttgctctttcaaatgcagtctttttctttttttttagcaagtttaaatcttttatttcatatttctccagaaaaagtaattataagcttattctaccatttttataccaaaattctaccatttttataattattttatcttaatttattttcctccaagccattatttgttgccctttcaaattcagtatttttctttagcaaatttaaatcttttatttcatatttctccagaaaaagtaattataggcttattttaccatttttatacccagtcagaaagttagctaaaacagctcttttttcctattttcatttcattccagaaaaaagttataaaactaattaccacatcaaccttaaaaatatctaagaatatttaagttctatttctttttttcttactaagaaattgataaaagaaagacaaagtgaaaaatttttactaatttatattacaactcaaatggccagttacataggttgtagttcctacatgattagatcatttctaaaattagttgtttttttgtgtaatttttatatttttaaattttattaaatttattggggtatttattaaatttattggggtatttattaaatttattggggtacagatggtatttggttacatgagtaagttctttagtggtgatttgtgagattttggtgcacccatcacccaagcagtatacactgcaccatatttgtagtattttatccctcaccccactcccagtcttcctctcaggtccccaaagtccattgtatcattcttatgcctttgggtccttattgcttacctcccacatatcagtgagaacatatgatgtttggttttccatccctgagttacttcacttagaataatagtctccaatctcatccaggtcgctgcaaatgctgttaatttattcctttttatagctgcatagtattccatctatgtatttactgcagtttctttatccactcattgattgatgggcatttgcattggttccacgattttgcagttgtgaattgtgctgctgtaaacatgcatgtgcaagtatcttttcgaataatgacttcttttcctctgggtagatacacattagtgggattgctggatcaaatggtagctctactttcagttctttaagaaatctccatactgtcttccatagtggctgtactagtttacatttccaccagcagtgtagaagtgttccctgatcaccgcatccatgccaacatctactgttttttgattttttgcttatggccattcttgcaggagtaagatggtattgccttgtggttttgatttgcatttccctgataattagttatgttgagcattttttcatatgtttgttggccatctgtgtatcttcttttgagaattgtcttttcatgtctttagcccattttttgatgggattgtttatttttttcttattgatttgtttgaattcattgtaggttctggatattagtcctttgtcagatgtatagattgtgaagattttctcccactctgtggtttgtttgtttactctgctgactgttccttttgctgtgcagaagctctttagtctgattaggtcccagctatttatctttgtttttattgcatttgcttttgggttcttggtaatgaaatccttgcctaagccaatgtctagaagggttttctaatgttatcttctagaattttaatagtttcaggtcttaggtgtaagtccttaatccatcttgagttgattttttataaggtgagagattaggatccagtttcattatcctacatgtgtctagccaattatcccagcaccatttgttgaaaagggtgtcctctcctcacttcatgtttttgtttgctttgttgaagatcagttggctgtaagtatttgggtttatttctgggttctctattctgttccattagtctatgtgtctatttttataccagtaccatgctgttttggtgactatggccttatagtatagtttgaaatcaggtagtgtgatgtgtccagatttgttctttttgctttctcttgctttggctatgcaggctcttttttggttccatatgaattttagaattgttttttctaactctgtgaagaatgatggtggtattttgatagggattgcattgaatttgtagattgtctttggcagtatggtcattttcacagtattgattctacccctccatgatcatgggatgtttttccatttgtttgtgttgtgtgtgatttctttcagcagtgttttgtagttttccttgtataggtctttcgactgctttgttaggtatattcctaagtattttatttttttggcagctattgtaaaagagattgagttcttgatttgattatctgcttagttgctgttagtatatagaagagctactgattggtgtacattaatcttgtatccagaaactgctgaattcttgtatcagttctaggagctttctggaggaatctttagggttttcaaggtaaacgatcatattgtcagcaaacagtgacagtttgacttcctctttattgatgtggattcccttcattttttttctcttgtctgattgctctcgctaggacttccagtactatgttgaagaggagcagtgagagtgggcctattccctttctcagagagaatgctttcaacttttccttattcaatgttatattggctgtgggtttgtcacagatggcttttattacattaaggtatgttcaaattcagtctttaagagtaaaatgtgaaagcggatgtatggatgtttgagtttgtctatgttgctgaacagtatgaatgtgggtttmcttcagagctgttgccagaaaggagcagtaattacacttgaaattactgttgaaattgggcttaaaacttaatagaaaaagaaacctttatgtctgagcactagttacaaataaaaggcaatgagagaaagaaaaagctaggaacatttgaatacataacaaaaagaaatgctttatttgtaaattgtagaacatggagcagattcctatagcaatatatcggaacaataggcataacatcacactgcttcggaggctacctgtatatacatctactcctttattattgctaaggttactttctgatttcacaggtactcaggtgattgaagatagagggaatgtgggtttagatatgaaacagtaatactttcaaatctgggaggcagcaacaaggctctcctatgtactcactatgctgacttggtaagtcatgactttcatcaaactcaggttccttatcagaaaaatgaagaagcgaatcaggtgctttttaggattccttataggtttcagctttaaatttccatgatgtcgcttgggttttggtgtgaatatagttgagctgctggcagtacatattttaggcaattctttgagtctaattgagcaatttctttattagaatgggcttaaacatatacacacagacacacacatatatggatatatagcaccgcctgagtttttatagtcagtaaatgccattcagcaaataataggggatgctttctggatttaaatagatttaatctggacactgttaaaatgtgtaccttgtgaagctttctgttttcctaaaggaaaaataattgtagtgttcattaagcacccatactttaagtactattgatggcattattagtattctagaaactgtgataggggcttatggaccttatcctatttagtactaatgacaaccttacaagatagatactattattgccaacttcaaatgaggacattgagatggagagttgaggtaacttacccaaggctactcagcttgcaagttaacagaaacacttaggattcaaattaaggtctgactcattccaaagctgtggctcttttgttcttttaggttttaggaatatattaaaaaatagtcaaaagcctgtcttgaaggagtttcagattaatagaggagacaagaaagactaatatgtggttcaaatgaaaatgtcactgaaatgtcaaaattataaaagtgtattgaggagattgtacccaggctagatagaaatctcagaggtgagaaagggtgtgttggagagggaagttcaagaaatccaggcagttctgactgcctagtacttagtagatgtaggattataaacttcaggaaaataattttttgaacacttcatttttagagaggtggtatggctagggttgattcatatttgtccacttaaagctattgtgcgaagtggtgtctaaggaatatatgatgatggcacggacaggaactttcacttgtttattcacttgttcatttattcattcattttatttattcaatacattttcatgatatattcatccaatacatattttcatacatattaatttgatacattcaatacattgaattcttactgtaaatgttcaatgtgtttgataaaggcaatacaaagaaacacaggcatacctcgttttattgtgctttactttattgcactttgcagttactgcattttttacagatagaaggtttgtggcaactctgtattgagcaagtgtatcagctccattttcccaacagcgtgtggtcacttcctgtctgtgtcacattttggtaattcttgcaatatttcaaaatttttcattattattacatttttatggtgatttgtgatcagtgctcattgatgttactactgtaattgttttggggaccaaaaaccaagcccatttgagatggtgaacttaacaaatgctgtatgtgttctgactgctctactaaccagcctttccccatctgtgtctctctccttgggcctccctattacctgaagtacaaaatcattgaaattaggtcaattaataaccctacagttgcctcaaagtgttcaaatgaaaggaagagttgcatgtctctcactttaagtaaaaagctaaaaatagttaagttcagtgaggaaggtatgtcaaaatctaagacaggctgaaagctgggcctcttgtgccaaacagccaagttgtgaaggcaaaggaaaagttcatgaaggaaattaaaaatgcattctatcaaatatttaaaaaataatacaagtgctacacatactcttctagaaaaattgtagaaaaaactccccaaatcagtctataaagtcagcatcaccctgatgccaaaatcagacagaaacattgcaagaaagaaaaactatatctctcatgatcgttgtcatgggctgaatggtgacccccaaaaagataaattcatgtcctaatcctcagaatctgtgaatagtaccttatatggcaaaagagtgaatgttactttatatggtaaatgatgtgatcacattataaggatctcatgaggatgaggttatcctggatgatctggttgggatctaaatgcaatcatatgtattttatatgaaaaaggcagagagagttttggcacaggcacatagaggagaaagtgatgtgaagacagaagcaaagaccggagtgatagcaccacaggccagggaacacctggaaccaccaggagctggaaaaggcaaagaagagattctctcttacagcatctctctatagggtgtgcagccttgttgacaccttgattttggattcatggcctctaaaactgtgagagaataaatttacgttgttttaagctacaaaggttgtagcaatttgtttaagcagccttaggaaactaatagaaacataggtactaaagttttttagcagaaacatatatgaaatttttaatgtaagtgtacattttctgttttattaatttctaattttatctttattatttctttcttattggtttattttggctttaacttgatttttttctagttttaaaggtgggagcttagttaattggttccagaccattttaattttctaatataggcatttagcgatataaattttcctttatacactgcattagttgcatcctgcaagtttgaaatgctgtttcatttttattcagttcaaaatatttttaatttcattttttgaatctaagttattataggttgaatatgtgggttggaggagaaggtggagttcagatggttcccaggtttctaattaagagagtagtggtgccataactggaatacgaacactggaggagaaacatgttttggggaatgatattccattttgaattatgggattaaagtccctatgagatagtgcttccatttttggaaaggctcctgtttgattaatttcattttaagccatgtgggttcattttcaatcttatttatattccttaaaaaaattaacacttctaaccctgtgtctcttaaacaagaggagatttgttcatcttggtttaatgggtatttaatataataagaatgctgtacatgttaccccagagtccattttgggttatttcatattctcagtgtacccttcaggctgcatcttcttgtcatttgctgcattttgtacccgtatctacatagttaaaagtatctacatggggccagactacctggattgaattctatttctgccatacaagctgtgagaactgcttgctcatctgtaaaattagkataacataggtatctatctcatggggtttgttagaaggactaaataagtccctattcttaaagcatttagaagagtacctgaaacaaccagtaaaggtagttcatgagcagatactctgattctgagatatgttaagtctgcggtcaaagaccctgaaaactgcaaagggaattgttttccaagacaagtttagagttcctagggaataaagctgcactgataaccaccatccttttccatttcaggcatgggatgtacttgttccttcagttgctgacatcagaagaaaaattaatatagtccattagtggttgacttcaactgatatccaaaggtgaaaatacctatgacagtttgagaaagatgataggcaggagcaacaggacaatagccttcccttaatggtcaaattcatgcttaatgccatttacccattttgttaacttaaggagctatctgaagtttcaattataaacaaactcagaggaatttagcaagaatgacaaatttatttatctttgctaaagataatatctttaggctggggacaaaaggtgattttcttgcccacttggagaacagttttctttttaggcgaaatgtgtgagggtgtgtgtgtgtgtgtgtgtgtgtgtgtgtgtgtagttatgtttgagtcatgctcattcattaaaagaggaccattttttccagcccataattgcatatacagtattttaatctttcattagaccctaagctgcattaaaggatgtttcacacctgtttactgttgtctaatgcttgatatgtctagcacataccaagttttaataactatttttgaataaatgaatgacctggacctgagtatacatgaaggaggggatcataaccattttcctattatctccttccatctcccttgtattaggaaagtaaaaaaaaattctgggtactattaaatatatcatttccttctactattaaatataaaattgccctttggagtagaagttcctaatcacaataataagatcccatacttcttttaatgggaagagattttagaggacatctagtccaattcaacctccaccattaacatatgtgaaaatggacactaggggagttgaagtgatactgccttgattacacagctggtaaatttatatccaagactacagtccaggtctttagatttctaatctagcacttttctaggaaccaactgtgctccttgagctgaattgggtaattgtgaattgtttacttccgtggctaaagcaacagataaagaacattgtatttttggtcatatttggaatgtttaagagtaggaggactatagaggtgggagccaagtagcattgcttgaaaatgaaatataaaggatttggacaagagatttggcagagcaaaccaagagacagtaatacactcttctcaccaaaaataaattttatggagaactatcaatggaagtctttttcctttatcagttaattcttggtaattccctcaattgatgattctttggtttgtgtcgagtgagagagacagagatctttttttctcagcacactttttttgtttctcttttaagtgctaaccaaaaaaacatgtgcatccaaattggtatgcttacttactttgagagaacatttataattggttttctcaggagaatagtcttctagataattgccttaccagtttggagtggagagatgctggattgggctctgatagacaatttgctttatcaaaaaggcctcgacatgtagaaaaaaacctacacaattgatcaggcaraaataagggatttggatgtttttatactttttcttgatgttgccttttgtttctctgtttctagcaaatacaaatggaaataaataatgatcagactattttggaatgttgctgagttctactagctaataatgagttctatttagctaactatatacaacacaaataaatgcctgtatttcttgctttggggaatcattaatctcttctaattgtcctcaaaattattaagaaaacagaactctgggtctttatacacttattcattgatagcattgcaccaccactattatagtcaaattgtaatttgttatttctattcaggctctttgccttttataaaaaagatgtaaaatatataagaatatgggagaaatatggatgcaaactaaatcattttattcttaatctattttaatgaaagcatttgagaaaagtttgaagggttgattttgataattttagggcttttatttgtaaggaggggccaaagttctagtaagtaacttaatactagacaaacacaaatcaaaaactaattcgtagagttaatgtgtgattgccatatccaagtaaggataaaaacaaacatcataatcaagttctggaagaagtatattatttgaggtttgcaggagtaaagaaagtgtcactgtattagtgtattagggttctcttagagggacagaactaataggatatatataaatgggcatttattaagtattaacttacatgatcacaaggtcctgtctgcaagctgaggagcaaggagagccagtctgagttctaatactgaagaacttggagtccgatgttcaagggcaggaagcatccagcaagggagaaatatgtaggctggtaggctagccccatctctccccttttcacatttttctgcctgctttatattcattggaagctgattagattgtgcccaccagattaaaggtggatctgccttccccagcccagtgactcaaatgttaatctcttttggcaacacccacacagacaaatccaggattaataatctgtatccctcaatccaatgaagttgacactcagtgttaaccatcacagtcacttatgtttggaatgaaactactttagtaattaactcatctccccaggtatttgtccatttattaagctatgttataatgctaatatttccctttacaactacaattattctagttgtgttcctggaaaaacctattaaagtattttcttaattaatttacatctctctaattctattactaaggcccattttaaaatgatttgttcatttacgtgtcttcaactcattaatgatatataaataatttccttttattgtatattattatagtagaaaaatgttgtaaatactaaaattactccaaaattataaaggtaaactatggaatttgataagagcatttaattcatcatacttacctaggatgccaattgttatttctgaactactacatatgtactgtcaagtcaagggatattcaatatcttatatccatatgaaggctgttcatgaatgtttatgttaattgttttgaattcttacttggatataatataatttaaaattgggtcctattttcctcttaacccttgttctcaaaagagtggactgaatttctatgggagacctgagggggaagaagacttttcatgggaaaattttttctctagaagcagggagatgaaaggtggaccttgagacctcactgttcactaagctgtctccctctattgaactaacagaactagagctaaccaactgggaggtcttctgtaagcatcattattttctgcaagtccacccatcttctgggcccagaatcatccccatgcatactgaactctggtgaggacagccttcaacaggtggtgtcaaagctcagctgggaatggatctgaatcctcagacccccagctcactgtctagttttttgccctggtcattttattgatttataaaaatgagactttgcacttaacagagttaaatattttggatcttagtttactttatataagaattatatatattcatatacacataatacgtatgagaaaagtatctacatccacagtttaagttgagaggaaaaataatctcgagaaggcagtgagctttctcggcagtaatatgagttttttgaatttttacaaagagaaggggccaaaacatgacataattttgtttaaggcaagaatatctaattgctatttaatgatatcaaacaatatgacatatctaatcacaacattacactttttagtactcccttcccctggcatatctccctccaggaagattctccaggaatataggaacttatttggggctttgactcagagtggattttctaggacagttgtatatgaagcagatctcctcactcttgggagtgaggactgttggagaaactagccatactgtgtgcccagtcacccctcctttatttagccttttatagaagcaaaattggtagatcttttaaacatcccccaaaagatgcctggtacccataaagaatcagatagaatcattaatgacatacagtaattttgttaaagccatcaagtgaaaccatctggtttctgttcatttataaattaaaaattaattaccacgcactaagttaaataataagaaatgaaaactcatcttcaaaattaagttaactgtctcttgatgactgaatctggaaaaaatactgtttcttcctgtacattgaaaattttcagcatgtatcataaatgcactaagtagttagctatttaaattgcatctttatttcaagatttccttgcaagttgctactacttaacaactttcttttttttttttaattatactttaagttctagggtacatgtgcacaacatgcaggtttgttacataggtatacatgtgccatgttggtttgctgcacccatcaactcgtcatttacattaggtatttctcctaatgctatccctcccccaggctcccacctcccgacaggccccggtgtgtgatattccctgctctgtgtccaagtgttctcattgttcaattcccatctgtgagtgagaacatgcggtgtttggttttctgtccttgtgatagtttgctcagaatgatgatttccagcttcatccatgtccctgcaaaggacatgaactcatcctttaccaactttctactctttcttctattacaacttactattattacaaacagcatcatttgctttaattttgtgtatttcctatctacagttcatgaggaactgttaataagttgcacttggaaatcagaaatagttttcccctttgcttttaggttctctttcaatccatctttcttgctaccaccatagttatcagccagacatatttgtttgctccatttctttgcttcaaaagtgttgttggttccacattgctaggaggataaagtcataataatttcattatcctagaatataaatctcttcatatgttagttcaaggtcattttctgcttcttctactcatttgttctatgttttttctacccatttgggaattcttgctgatctctgaacatttcatgcgctggaacactcgtgtgtgttttatgctttatgacctttaaggaaagtctcttccttaggacctgtgacaccccatagggctatgcaataaacagagggtgaccctagttctcaaataagccaaggtctctagtcttcaaggcccttcccagaaacaggatgtctctctgcagcatggaggagtatatgaggtaagaatgttgtggttggaaaacaccataggctgataattttcactccacaaaaagcaacaaaaacggtcataacacctctctccatcccccttctctatgagtggtgatgcatggccacagtggcccagctgtgagtagcaaaagacccctctgtgattcatctcattatggagtgagtgatatcagcttcgagattttgcaccatttgggcacttgaagaaccctaccttcagatggcgggctgaggcaaagcagctaatatatggatattgcttgccaccatatttgatagcaaataaaggaaaagtaaattcctagtggctataccctgcttctgcacggtttttttttcctcttcaaaaaacagatgaagagaaaaagcattccagttctgcagaaccaagaatgtactatattctttgtatggaattaataatttcctattttctgcctgatcacccatctctttttgaaactttcttccttcctgtcattgagagtgcctctctgctgcattgtgctccagcagctcttttgtgtatacttctattacagaggtttcatattataccattgttgtttgttcacctgtctccttcactaaactatatctcatccatttgggtatgtctagcacctacatggctgagtataagccttcaataaatattgaatgaatgaaagacaccacaaaatgagcaaaaataagttaattaagacatcttttagttttgctatgttgttaaatttttcttatatttcacaggtagaagcaaagtaacttttattacatgtaatttatttcaatttaacatttagggagtacttttgaagcattatactaagtgctttgagtgacacactgatgtctaagcccccagttaattccgaaaacatttctaatacacgctttttaaaaatagtattagggactgaatgaatttggattaaattaaatgttttttgagtattttcaaaagaagtgggaaagttagcagacctatgtattcatttaacaaacattgattgagcaccaactatggaccaggtttgatgcttgggtaacaaagattgacaacatcatcaaacacaatctctgttcatggaacttacaatttagtcgatgagcataattagacaaataaatatagaaataattgtttagagagttaagtgctaggaagaaaattattgagtataatgatgattctattttttctgttttggaaagaaatagtagttagaaattgtttgcctcaaaatataaaaaagaaagtttttggaaaatttatctagggtaccttgaagccttagcaaatgttatataatcagaatccttcagttatctttaaaggtattaataaatgaaatgctatagaaaccatattgataagaagaatgaattaacttatttattttctattgaaatttttatttatggtttggtaggaaaagcaaaaactcatatgtaaatatcaacattaaaaagaatgatcatacatccttagctcctcagcagtttctgtcatatctggctttcgtttcatttttagtgctgttttgttacaatgacaagaggattgaattgaaagcctgttgaagaattttattatcttttaaaatctattgtcaaagacagttggggttgaaagcttggtgataaatgtcaacagtaatatgaaatgtatagaagcagggacccctttatctgttcatttaaacatcctcatcagtcgcacacctacagataatgggtgaaggtgagagatggtaacagaacagctcattagggctgactgtgttaattgacatttgacccacattttgtaggtcctggtaattttttgagtatttattgattctttttcctgactagaacagcatttatgctttcataataagaagatccagaaagagctatgtttgaaatttagaatatatttctaagggaagatgatatgctcattctctatcagttattattttgaggcactttcgtttttgataacaatagtaacttgtaaagattgaagagtccccgaccttcatttattcagcaaacattgattgagcacactatgtgccaagtccttttcttggcactgcctgtataggtggggccctgttctatgaatctgagagaataatacactccattatcaatcatcaataatgttaactttgtctcatgtattactattgtgttgttgattcatttctttttgtggtatgtttggtggggagaaggttgcaataagaaaataaaatgaatattctagttctcattttgaatttgatttaaaactgaaaagtgtttagtgtctatctttttgaattagataaatctttgtcttcggaaaacaacccaaagtagctgttgttttcctctgagttggctctgttctcaggctgacttctctatgaggtagcaaagcgagttccttgaaaccttaggcttccatggttctttttattagctgataattaccctctttcttctatgtcaatatctctaaacattcttattggctctgcctgggtcatgtaaaatcttgggacaagatgttctggttggtcaattgaggttgtgtgctactcctaggagagaaagataaagtgaaaatattgacagcatttatagtcatatgaagtgatgaaagggcagagtgctaactgggggttggggagggaggagagaggtgctgtttcctgaagaaggactaagagatgctagcaggtaaaacaacggatgtctaccacaaatatatgcaaagcctaattgtttgggtggcttatttaaagaaaattccttaatatattcaaataaatctaggctttcatatcactttgcataataaatttaccaaagagcataaaatctaagagtatattggaaatcacctctatttaaaagatcaaccttttcttgtttgtttaattactaggccttttagaaagaacattcctctattccttttgacagattaatattttgggggagtgtattagtttgttctcacactcctagaaagaactacctgagactgggtaacttatgaagaaaagaggttgaatggactcacagttccacaggctgtacaggaagcatggctgggaggcctcaggaaacgtacagtaatggcaaaaggtgaagaggaagcaagcacatcttaccatggtggagcaggagaaagagagagtgaatgagaatgtgcccacatgtttagccatcagttctagtgagaactcactcactatcatgagaacagcaagggggaaatccacccccatgatccaatcacctcccaccaggcccctcctctaatttgacatgagatttgagtggggagacaaatctaagctatatctggggtaacttcatttcagtttaacttaaaattacaaaaaagttggagaaatagtacaagaagctcttgtttacccatacacattttactcagattcattaattgtttacaatgtatatcatttcctttctcattctctctctcttccttctggactttttgagagtaagttggagacaccctgcccctttacccttacatacgttattgtatattttctaagaacaaggacactgtgttgaataatctcaatacagttatcaaaatcaggaaatttaacattgatataatattatctagtttagagtccacacatattcaaattttgtcagttgtccccagattatgtctatttatttttcacagtccaggatccattccagggtcatgcattgtactgaatttttttcccttagtttcatttaatgtggaagattttctcagtttgtcttatgtttgtgtttttagtttgtctgatgttttcatgattaaattcagactatgcatttttgataacaatagcacaaagcgatattgtgtcctcagtgtgagcatgatgttggttgtcccaatattagtgatattatacacacatacatatacatacatctatatttctatgtatatattttcaaaacaatgagtttattctaatgccaccaatactagtccatttgtttgtttatatcagtattttttttaagtttatataacatgcagaataccttatcagtcattctggagaattcagaaagagtagaagaaaatatctgtatcagaaaagtcttattaatctgattagcttctttcatttcgtgatgaaaaaacataatttattaaaatttgtaagaaatctaagaagaaatcattattcagatttattgttcaagaaacccaaagaagggttgtgtaaattgagtgcttaatgtacctaaaaacccaaagcccatgatgtgtagagaggtgttcatggtccccatgtgacaatgggaaaggtgcccttgtgggtagtcttctgaagctgatgtgttattctacctgagacatgtttacttgtacatacaatctatgaggatgttagagcagatgcagtttggtctacaaaacaaaaacaaaaaataacaacaaaaacaccctgaaatactgggttgtagtaagaaattaactttgtgagttatccatggaattataatcataaggaaaatctccacagctgaatccatgatggatattttctattttatacagacatttctcacatcctgcaacctgcaaagtagcagacatatttcaaattctttagttctttcactttggttttagtgaaagaccatgtctttgtcaatctaggaggcatgctccatagattttattgatgtcttttgattcagataaatgaggagaattcaacttcttcctttcctgttccctagactttagtgaagtggagatgtctgatgatgttctaaaatgataagatgaaggtgatgttatttcattataaagaagaggcctttaacatgtaccttgtgtctgtggcatactcattattttattataagtaaatttgaattattttctttagaacaacaacaacaaaactattaagtttgataaaagacactctttacttcaactgagactcattaacccctgaactttatacgtattaatatcaataataagaaacaactattttacaatttggtttaatatcgtataacaatactttgtgctctaagaaaataaataaagataatactactttgctcatgaaatataactgaagataataacaataaaataagaaaggataatagtaataaggaaaataaagataatactctgtgctctgagaaaataaataaaataaatataataatgtgagctaactcatgtagtactgattatgtgccaggaaacaccgtaagtgtgttacatgtattagcccattgaaccctcctaaaatccctctgatgtaggtactaatattcttcctagtttcagatgtggttcagagaggttaaagtactctccaatgtcatgcagctggaaaaggcagagctgggatttgaacccagagaatctgtcttgtgagtccaggatcataataaattgtctttattcagttaccagttatgctgacttattgctgcaaagtttttgtactatatgttaaaattatttataatttagaaatattgaaaaagagcattttaattataataaaaaatcatactatcatgcataattcacttaaccatttgttagttcttgattttgttttagaggattgaaataaaaaactacacagatagatttaaatgtttttttcattagtaaaaataaaatgctgttagcttattagctgatgttggcttttaaaatgtcctgtttagcactttgggaggctgaggcaggcggatcacaaagtcaggagttcgagaccagcctgccaatatggtgaaaccccgtctctattaaaaatacaaaaattagctgggcatggtggtgggcacctatagtcccagctaytcaggtggctgaagtgggagaatcccttgaacttgggaggtggaggttgcagtgagccaagatcgtgccactgcactccagcctgggcgacagagcgagactgtcaaaaaaaaaaaaatcctgtttaactctggaagaacactagtgcatcagatatgtgactaatttaagaaaagggattatgtgaatatagctactgtactggtgtttttacaaaagaataaattttaatcatagctcttgagtatctagattggcatgtatgttccctggcaagggaaagattcaaattacattagtttctaaatttctgaagaccaactgttttgctaatattcatttacatccttcagagatatgagaaagcgctttaatttatttgtaattgatgacagaattactctagaggcatatgtagaaaattggaaaaaaacaatcaacactgtatagattactagagggtgaagtgggctgggtgggttaaaaagctacctatcaggcactatgctcactaccagggtgacgagrtccatgctccaaacctcaacatcatgcaatattcccacataacaaatctgcacatgaaccccctgtatctaaaataaaagttgaaattaaaaataaatttaaaaataagaaaattggaagaaaaaatatccttttggttttaagacaaggataatgcatgttattgtattgtcctatctaattatataatttgtttaagatttattttattaaatgtcttcattgttccattttttgttttttaagtgtttctcagattttaatgtacacatgaaccacctgaggatcttgtttaattcagtcaccatggtagaggtggaataatttaccaatcactggagcccatgggcacagttcatgaagaacctcacaattactattggaaacaaagtcaatgtaacaagaatcctgaaaaatataaatatgcatactgttttttcttttgtaaacaaaatttattttaattgacaaataaacattatgtatatttatcatgtgaatgatattttaaaatatgtacacattgtgaaatagttcaattgagctaatcaatatattcattacctcatatatttatcattttttttgtggtgagaacacttacgatttattctcttaacaacttccaaaaatacaatacgttgttattctgttgtaatacttccttgcacggattttctactacatgttttacaatagatttcttgaacttattccttccatctaattgaaattttctattctttaaccaataatgcccctgaccctggtaactagcattctactctctacttgtgtgagttcaactttttttagattctacatatgtcagatcatgtggtatttctcttactgtgcctgacatatcacttaacataatatgcttgaagttcacccatgttgttgcaaatgacaatattgtcttttttttttttttacagtgaaatagtattcaattgtgtgtgtatacccctgtttctttatccatttatttatgtgtcgatagatacaggttgatttcttatcttggctgttgtgaataaggccacaataaacatcagaatgcagatctctttgacaaaaagttatatgtacccagaaatgggatttctggatcatattgtagttctatttttacgattttgagaaaacttcatactatttcttataatagttgcactaatttacatttgaatgaacaatgtgcaaggtgaattggtcagtttgaaacttttccatatgatatttattgtcatgttactgttaataactttctcttgctttccaaaataataaaggaataaaagaygttatttcatttttctttgatgaacaaaggttgcactatggtggagaatgtgagggcataattcttctaaggtttatccatgttgtagcatgtatcagtacttcattctttcttattgccaagtaatacttctttgtatggatattctgctccatgctgcttatccatttaccagttgatggacatttgggttgtttccacttttgggctcttatgaaaaatgttgctatgaacattgtgtaaaagttttgtgtggacatatgctttaatattgaattatgcttcgccaatatgtcaataaaatttgattttattcacaatatgtaagaatttaaatggagagatataaatataaaaaatttaacatattttcctcatatttatacagtggatgggttcgaaattggatttaacccaatccaaactggatttaatccaatttaaattggatttaaaccaatttaaattggatttaaatttaattggatttgtatatgaatgaagattatatttacaacatgtgacaaccctatcttttgtcttagagttatttcctttcttttgttttattgaataaaataaaccggctttctataaggacttttagggtagatccactctgaaaacttacaccttgataataccttcccccaccccaggcacttttactttttattattgttattatttaatttcaacttgtagatacagggggtacatgtgcagatttgttacatgggaatattgcatgatgccgaggtttggggtatagatcccgtccactgttgtagtgagcctagtacctggtaggtagatttttaacccaatatcccctgccttccaccctcttggagtccacaatgtctatttttcccatactgatgtccatgtgtgcacaaggcttagctcccacttataagtgcaaacgtggtatttggttatatgttcctccattaatttgcttaggattatgacctccaagggctccatccatgttgctgcaaaagtcacattttcatttttttttatggctacacagtattccatggtgtatatgtactattttttctttatccaatctaccattgatgggcacctgggttgattctatgtctttgctattgtgactagcacagtgatgaatgtacaagtacatgtgtctttttggtagaatgatttattttcttttgcatatatacccagtagtgggattgctgggtctaatggtagctatgttttaaattatttgagaaatctcccgactgctttccacagtggccgtactaattacattcccaccagcagagtataagcatttccttttctctgcagcctctgcatctgttgtttttttggctctttaataatagccatcctgactggtgtgaggtagaatttcattgtggttttgacttgcatttctctgatagtgatgtggagtattttttcatatgtttactggccacttatcttcttttgagaagtgtctgttcatgtcctttgtccacttgttttttttttttttttttttttttgagacagagtctctctctgtcgcccaggctggagtgcagtggcgcgatctcggctcactgcaagctccgccccccgggttcacgccattctcctgcctcagtctcccaagtagctgggactacaggcgcccgccaccacgcccggctaattttttgtatttttagtagagacagggtttcactgtgttagccaggatggtctcgatctcctgacctcgtgaaccaccctcctcggcctcccaaagtgctgggattacaggcgtgagccaccacgcctggtcatttgtccactttttaatggggttattttctgcttgttatttattttttaccatagattctggatattaggctttgttggatgccttgtttgcaaatatcttgtatcattctataggttgtctctttgctctgttcatagttttttttgccatgcagaagctctttagtttaattagttctcactatatttttgtttttattgcagttgcatttggggacttagccataaattctttgccaaggccaatgttgagaagactatttcctgggttttcttctaggatttttatagtttgaggatttacatttaaatgtttaatccattttgagttcattcttgtatatggtaaaaagtatgggcccagcttcagtcttctgcatatggctagccagttatcccagcaccatttattgaatagggagtcctttccccattgcttatttttgtcagccttgttaaatatcagatagttgtaggtgtgtggctttatttctgggttctctaacctgttcaattggtctatgtttctatttttgtaccaataccatgctgttttgattaccatatccttgtagtacagtttcatgttgggtagtgtaatgtctctgtcttttttccttttgcttagtattgttttggctattcacactcttttgtcgttctatatgaattttaaaatagtgttttctaattctgtaaacagtgacattagtagtttgacaggaatagcagtaactgtaaattgctttaggcagtatggtcattttaacaatattgattctttcaattcatgagtatggaatgtttgtccatttatttgcattatcactgatttctttcaccaatgttttgttgttctccttatagagatctttcacctcctggttagctgtattcctagatacttcattttatttgtggctattgtaagtggaattgtgttctagattttactctcagcctggatgttgctggtgtatagaaatgatactgatttttgtacattgattttatcctgaaactttgctaaagttgcttattaattcttggaaccttttagcagtctttagggttttctaggtacaaaatcatatcgtcagtgaaaagagtttgacttcttcttttctttttcaaattccttttatttctttctcttgcctggttgatctggcaaggacttccagtactatgttgaagagaagtggtgagagtaggcagccttgtcttgttctagttctcaagggaaatatttccatcatttgcccattcagtctgatgttggctgtgggtttgcctggatggcttttattattttgaggtatgttcctttgtttattgaggatttttataatgaaggaatgttgaattttatcaaaaggtttctctgcatctattgagatgatcctatagtttttgctcttgattctgtttgtgtggtgaatcatgtttgttgatttgcaacatgtgcaacaaacgcaaatatgatttgcaacatatgcaagtatttgcaatcttgcaacacagcaaatcacaaatcacaacaaatgtgatttcagtattgaatcccaagaataaagcctacttgattgtggtgtattaactttttgatgtgctgctagattcaatttgctaatatttgttgaggatttttgcatctgtgtttatgagggatattagtctgaagtttgttgttgttgttgtatctctgcctgattttggtatcaggctgatgcttgtcttatagaataagttagggaggagcccctgctcctcagttttttggaatagcttcagtaggattagtatcagttcttgtttgtatgtctggtagaattggggtgtgaattcacttggtccagggctttttttgcttggtaggttctttattattgattcaatttcagaagttaaaattggtctattcagagtttcaatttcttcatgattccatctttggagattgtatgcttccaggaatttatccatttcctttagattttctaatttgtgtgcctagagttgttcatagtagtctctgaggttcttttgtatttctgtgggatcagttgtaatatcattagtgttgtttctgattttgcttatttggatagtctctttctttttctttgttgatttagttagggattctaccagtcttagtttttcaaagaaccaattcttggtttcattggtcttttgtatggtttattgcatctcaatttcattaagatcttctttaattttagttatttcttttcttttgctagctttggagttggtttgttctctttctttcttgttcctgtaggtgcaaagttagtttgttaatttgagacctttctaacttcttgatgaaggcatttaggactattaattttcctcttaacactgctttggctatatctcagagattttggtaagttgtgttcctattttcattaacttcaaataattttttaaatttctgccttaatttctatgttcacccaggagttattcaggaataagttgcttactttccatttatttgtgtaattttgagagatcattttggtattgatgtctagttttattacactgtggtttgagagtatacttggtatagtttcaatttctttctgaatttattgaggcctgctttatgactgagcatgtggttgatctttgaatatgttctgtgtgcagatgagaagaatgcatattctgtggttgttggatggagtgctttataggcccatttggtcaagtgttgagttgaagtccagagtttctttgttagttttgtgctttgatgatctaatgttgtcagtagggtgttgaagtctcccactattattgtgtggttgtttaagtgttttcctaggccaagaagaagttgttgtataaatctcagtgctccaaagttgggtgtgtatatatttagtatagttaaggcttcttgtcggactgtatcctttattgttatgcagtgcccttcattgtccttcatttttatgtgtttaaaatctgttttatctgatgaatgaatgaatgatgaatgaatgaagaatgaatgatgaaacatgaagaatgaatgatgaaagatgaagaatgaaaattgaatgatgaagaatgaatgaatgatgaggaatggtgacacctgctcttttttgttttctgtttgcatggtagatcttaccgcatacttttacgttgagtttgtgggtgtcattacatgtaagatgggtctcttgaaaacaacagattggttgggtcttgtctttttatccagcctgccactctgtgtcttttgagtgggctgtttagcccatttacattcaaggttattattgatatatgtgattttgattctatcattgtattgttagctggttcttgtgtagttgctttatagtgcctgtgagctatgtgcttaagtgtgcatttgtggtggcaggtgtcattcttttgaattcatgtttagaactcccttaaggacctcttgtaaggctactctagtttaaacgtattccctcagcatttgcttgtcagagaagcctcttatttctccttcagttatgaagcttagtttggtaggatataaaaatttttggttggaatttcctttctttaaggacactgaaaataggcccctaatctcttctggcttgtaaggttttttctgagaaatctgcttctagcctggtgggattccctctgtaggtgacctgcactttctctctagctgccttttagatttcttcttttgcattgatcttggtgattctgatgactatgtgcctcgggtagggtcatcttgtatagtatctggctgaaattctctgtatttcttggatttgcatgtcaatgtctgtagtgacactagagaagttttcatgcctgtgtcctcaaatgtattttacaagttgcttattctctctccttatttcttaggaatgctgatgaatcatatatttggtcataatcccatatttctcagatgttttgttcatttttctttttgttgaattttattaaaattctattcaaattgctaatgaatgcatgaaacaagaaggcaaagacatgcatgtagtcagacttaggtcataattaaaaattacactttctcagaaaagtgttgtaatataaatttaaatacatataatatacttgatgttttaggaaaaatatttagaaggatgttgcatttgccaactcaatggagtgtactttgtgcccttccaaattaaacaaattgctgccaagtatttacaaaatcatttatattctaaagaacattgacacacaaggcagaaattaattacagaaataattttagctgccattttggtctcagaaaggcttctttgcacagattcaacagatttatttttttttatcaccaaagttaagaataagaattaaatgacagccagtgctggtaagattgatttctatcaattcgttacaactttaaatgcaagacagaaatattttgcacaatcaccagtccagttatccctcagatatggagctctaagtttgatgttagttggaaagtcaaatcagaattagaaggcctagttctcctgtaaaactcaaaatctgacactcccacaaaaaaggaaaactctgttatatttgccagagtatcattttttattctatttaatattgtcttacaattgaaatttcaagtttcaaggcagaaaactgtgcattgatctacagttgtcatggagttttctagaagcactagactttcccctaactcagatacacaatccaatgaatattcttctcagttgtggacaaaacagaaatataacagggtacagatcctcatttggaatgggctgctacacagagccaagttactgaaaactatgaccataaaaaggaattgagtcaatgacctagaaatgcctataagcaaatcccttgaaccactcagttttggtcatattaaattaacctttgagtaaattcggcctttaaaaatttttacttgacaaaaattgtatatatttatggcatacaacatgatgttttgaaatatgtagacattgtggaatgattatatcaagctaattagcatacacatgacctcatatacttttcatttttttgtaatgagaacacttaaaatctgctgtctttggaaatttaaggtacacaactcattgccattaactgtggtcctcatgttgtacatttctcgaacttattcttcatgtctaactgaaattttgtatcctttcaccagcatttttctgggtaacccatctcctcactcccagcctctgttaaccactatttttactctgcttctatgagtttgacttttctggattccacacacaartttgatcatgcagtatttgtctttctgtgcttggctaattttatgtaacataatgttctccagactcatcaatgttgtggcaaatcaaaagctttcctttgtttttaaggctgaacaggttccccctgtgtatatataacacattttctttatctactcatctgtggatggacacttaggttgattttgtgtcttggctgcagtgaacataggggagcagaaatctctttgaaatactgattcatttactttgggtatatacctagtagtgggacatactttattacatattgggattgctggatcatatggtagctttatttctgtgggtttttttttttttttgggtggggggaagcatcatccataaggctgtactaatttacattctgaccaatagtgtggaagagttcccttttctctgtactcttgccaacactattttttatatttccaacttttattttaagttcaggggtacatgtacaggttgtgcagatttattacataggtaaatgtgtgccatggtggtttgctccacagatcattccaccacccaggtattaagcccagcatccactagctattcttcctcatcctctccctcctctcaccccttgccctttgacaggacccagtgtgtgttgttccccccatgtgtctatgtgttattatcatttagctcccacttgtaagtgaaaacttggtgtttggttttcagttcctgtgttggtttgctaaggataatggcctccaactctatccatgtccctgcaagtgacatgatctcattcctttttatggctgcatagtattccattgtgtatatgagccacattttttaatccagtctatctttgatgggcatttatgttgattctatatcttttctattgtgaatagtgctgcagtaaacatatgtgtgcatgagtcttattacagaatgatttgtattcctttgggtatatactcagtaatgggattgctgggtccagtggtatttttgtctttaggtctttgaggaattgccacactgtcttccacaatggttgaactaatttccactcttcaccaacagtgtgtaagtgttcctctttctccacgacctctccagcatctgttattttttgactttttaacagtagccattctgactggtgtgagatggtatctcattgtggctttgatttgcatttctttttaaaaaatatttgtccttcaacttttattttaagttccagagtacatgtgcaagatttgcaggtttgttacataggtaaacatttgccttgatagtttgctgcacaatcaacccaacacttaggtattaagcccagaatcccttagctattcttcctgatgctttccctccccctaccccacctccacccctaacagcctccagtgtgtgttattcccctcaatgtgttcatgtgttctcatcattcacctcccacttataagtgagagcatatggtgtttcgttttctgttcctgcattagtttgctgaggataacagcttccaactccatccatgttcctgcaaaggacacgatcttgttcctttttatggctgcatagtattccatagtgtatgtgtactatattttctttatccagtctatcattgatgggcatttgggttaattccatgtctttgctattatgaatagtgccgcaataaacatacgtgtgcatgcgtctttatagtagcatgatttataatcctttgggtatataaccagtaatgggattgctgggtcaaatggtagttctgcctctagatctctgaggaatcaccacactgtcttccacaatggttaaactaacttacactcccaccaacagtgtaaaagtgttcctatttctctgcaaccttgccagcatctgttgtttctggactttttaatasttgccattatgattggcatgagatggtatttcattgtggttttgatttgcatttctctactgatcagtgatgttgagctttttttcacatgtttgttggccacatgcatgtatgtcttcttttgagaagtgtctgttcagtcctttgcctactttataatggcttttttttttttttttttttgtaaatttaagttccttttaaatgctggatattagacctttgtcagatacatagtttccaaaaattttctcccactctgtaggttatctgttcacttgatgatagtttcttttgctgtgcagaagctctttagtttaattagatctcatttgtcaatttttgcttttgttgcagttgtttttggcatcttcatcatgaaatctttgcctgtgcctatgtcctgaatagtactgcctaggttttcttctagggtttttataattttgggttttacatttaagtctttaattcatcttgagttgatttttatatatagtgtaaggaaggggtccagttttaattttctacatagggctagccagttctcccagaaccatttattaaatagggaatcctttccccattcctcatttttgtcaggtttgttgaatatcagatggttgtaggtgtgcagtcttatttctgggttctgtattctgttccattggtctatgtgtctgttcgtgtaccagtactgtgctgtttgggttactgtagccctgtagtagagtttgaagtcagggaatgtggtacctctagctttgttctttttgcttaggattggctatacgagttctattttggttccgtattgattttaaaatattttattctatttctgtaaagaatgttaatggtagcttgatgggaatagcattgaatctataaattactttggacagtatggccattttcaaaacattgattcttcctattcattagcatggaatgattttccatttgtttgtgtcatctctgatttctttgaacagtggtttgtagttctccttgaagaggtccttcacttccgtgttagctctattcctaggtattttattctcattgtggcaactgtgaatgggagttcatttatgatttgtttctctacttgcctgttgttgaatgatttcccatttgtttgtgtcatctctgatttctttgagcagtggtttgtagttcttctcaaagaggtccttcacttccctgttagctgtattcctaggtactttattctcattgtggcaattgtgaatgggagttcatttatgatttggctctctacttgcctgctgttgttccacaggaatggtagtgattttcgcacattgatttttgtatcctaagactttgctgaagttgcttatcaccttaagaagcttttggggtgagtcagtggggttttctagatacgcaattatgtcacctgcaaacgaagagagtttgacttcttcctttcctatttgaatacacattatttctttttcttgcctgatttccctggtcagaacttccaatactatgttgactaggagtggtaagagagggcatccttgtcttgtgccagtttttaaggggaatgcttccagcttttgcccattcagtatattggctgtgggtttctcatatatggctcttattatttagaggtatgttccttcaaaaccgagtttattgagagctttttacatgaaaggatgctaatttttaccaaaggcctttcctgcatctgttgagataatcatgtgttttttgtttttagttctgtttatgtgataaatcacatttatagatctgtgtgtgttgaacgaaacttgcattccagggatgaagactacttaatcatggtagataagctttttgatgtgctgctagattcagtttgccagtattttgttgaggatttttggtatcaatgtttatcaaggatattggcccgaagttttcttttttgttatatctctgccaggtgttagtatcaggatgatgctggcctcatagaatgggttatgggggagtccctgcttttcaattgtttggaatagtttcaataggaatggtaccagctcttctttgtacctctggtagagttaagcggtgaatccatctggttatgggctttttttggttgataggctattcattactgatttgatttcagagcttgttgttgatctgttcagggactcagtttctttctggttcagtcttgggagggtgtatgtgtccagggatttgtccatttcttctagattttcaatttgtgtgcatagaggtgttcataacattctctcatggtcgtttttatttctgtgggtcagtggtaatatcctccatgtcatttctgattgtgtttatttgaattttctctcttttcttttttattagtctagttagcagtctattttattaactttttttcagaaaattagcttctggatttttgatcttttgaaaggtttttcatgtttctatttcctttagtttagctctgcttttggttatttattgtcttcagctagctttgttatttgttcactcttggtttcctagttcttttagttgtgatgttaggttgttaatttcagatctttttaacattttgatgtgggaatttagtgctgtaagtttccctcttaacactgcattaactgggttccagagattttggtatgttgtatttttgttctcattaatttcaagatttctgccttaattttattatttatccaacagttgttcaggaacaggttattcaatttccatgtaattttgtggggtattaatttgttttcatgctgctatgatgaaataccccaggctgggtaatttgtagagaaaagaggtttaattgactcacagttccacatggctggggaggcctcaggaaacttatagtcatggcagaaggggaagcaagcatgttctttttcacaaggtggcaggagagagaagtaccagcaggggaaatgtcagattcttataaaaccatcagctctcctgagaactcactcactattatgagaacagcatggaggaaactgcccccatgttctgattacttcccaccaggttcctcccatgagaggtggagattttgggaagtacaattcaagaggagattttggtgggagcacagccaaaccatattatgtgggtttgaatgcatttcttaatcttgatttctaatttgattgcactgtggtctgagagattgttcattatgatttcagttcttttacatttgctgaggagtgttttacttctgattatgtgaccaattttagagtaagtgatgtgtggcaatgagaagaatgtatattctgttgttctggggtgtagagttctatagatatctgtcagttccacttgatccagagttgagttcaggtcctgaatatttttgttaattttctgtcttgatgatagagatattagaaaatattgtcaatggggttttaaagtctcccactattattgtgtgggagtctaagtctctttgaaggtctctaagaacttgctttatgaatctgggtgttcctgttttgggtgcacatatatttaggacagttagctattcttgttgaattgaaccctttatcattatgtaatactcttctttgtcttttttgatattttttggtttaaagtctttttttgttagatgctaggattgcaatccctgcttttttctgttttctatttggttggtaaattttcctccatccctttatttttagcctgtgtatgtttttgcgtgtgagatgggtctcttgaagacagcttaccagtgggtcttggttctttatccagctttttactctgtgtcttttaattggagcatttaaggttaatactgttatgtatggatttgatcctgtgatcatgatgctagctggttattttgcagacttgtttatgtagttgctttataatgtcactggtctgtatacttcagtgtatttttgtagaggctggcaacagttttccctttttatatttagtgcttccttcaggagcttttataaagcaggtctggtggtaacaaattccctcagaatttgcttgtctgaaaaggatcttatttcttctcttatgaagcttagtttggctagatatgtaattctgcattggaatttcttttctttaaaaatgttgaatattgtcccccaatctcttctggcttgcatggtttctgctgagaggtccactgttagtccaatgggcttccctttgtaggtggcctcgcctttctttccagtggcctttgacattttttatttcattttgaccttggaggatctgatgattacatgttttggggacgatcttcttgtggagtaagtatcttactggggttctctgcattttctgaatttgaatgttggcttctgtaggtaggtcagggaagttctcctggatgatatcctgaattatgttatccaaaatggtcccattctcctcatctttttcaggtaccccaatcagtcatagattcagtctctttacataatcccatatttcttggaggttttgtttattccttttcattgtttttctctatttttgtctgcctgtgttatttcagaatgacattcttcaagctctgagattctttcttctgcttggcctattctgctattaatacttgtgattgcatcgtgaagttcttgttgtgtttttttcagctctatcaggttggttatattcctctctatactggctattttggctgtcagctcctgcattgttttatcatgattcttagcttccttgcattgagttgcaaagtgctcctttagctcagtgaagttcattttttagatccacatttggaatcctatttctatcatctcagccatctcagcctcagtccagttctaaatccctgctggagaggtgttgtggtcatttagaggaaagggagcacactggatttttgagttttctgtgtttttgtgctgattctttctcatctttgttggcttatctacctttgatctttgaggttgttgacctttggatgggtttttgttgttgttgttcttgttgttttgctcgttttttctttgaacagtctgaccacttttctgtagggctgctatgatttgctgggcggctgcttcagaccctagtcacctcagttttttcagtacctgtaggtattaccggtgaaggctgcaaaacagcaaagatggcagcctgccccttcctctcagagctctgtcccagagaagtactgacctgttgccagcctgaatgcacccataggatgtggctggaaaccctgttttggaggtctcacctagtcaggaggaatgggatcagggacctccttaaagaagcagccttcctgcgtttttgtagagcagctgtgctgtgtttggcttcccttcacccccatatagttttgcactttccaaggcccacaggttggactgggtgagatgcccaaacagcacaggtggcagcccacctggccccctgggcactccatcacagggagaaattagaactttgtcagccatagaacatgggtgagggtggttggaagcactggttgggaggacctgcccagcaaggaggaatggattggggttctatttaaagaagcagtctggccacaccttgacaaaacagccatgcgttgctggggatccatctctgcctgtattggcttggattctgcaaagcctacaggctggaatgggctcaaagcaacattggcagctcatccctccccactgggcactccagccaagggagagatcagagttctttcctagaatatgggcaggggtggctggaggtccctattgggaagtcctgcccagtggggtggaatggattggggtcccacttaaagaagtagtctggccacattttcatagagcagctgtgctgtgctgtgctgggggtcccttacttgtccagactgtttggactctccaaagcccacagacttgaacagctgagttgtccaaataacaaaggtgacagcccacccctttccctggcagctccattccatctcaggcaggcactaccctgttgctggtggctggctgaagttccaagccagtgggtcttattttgtgaggtgccttggaaatggggcccacagatggacgctgttcagctccctggattcggcccccttcctaggggtatgtatggacctcccgccttgactgagttgtagtcacctttgccagggatcctgtggctggggtatgtaaatctcctgggtctctgtgcatacctgagtggctgccctgctgagactccacacagctctgtgtatctgacccaaggtcctggtggagtgggtttatgaggggatctcctgatctgagggttgcaaagatccatgggagaaatgtggtttcccagggtggcacattcacttaccacttccttggctggggtgggggttcccttggctttgcgtcacttccaggtgggctatcatcctgccctacttttctctgttttctgtggattggttatttccctgatcagtcccagtgcgaaaacctggatatttcagttgaaggtgctgtatttactcactgcttttcttcctctttatgagtgccatgcaccatagctacttctaattggaggtctcggcccactctctgctcttcatctttctcaattctcttttctgtatttttgtctgactgtgttaattgaaagaattgctctttgagctctcagattctttcctcagcttggtctattctgctgttaatacttccaattatattatgtaatttttgtagtgaatttttcagctcaagaaattaagtttttgtctctctttaagtgagaatttcacctttcagcccttgaatcattttactggattgcttggcttccttggattgagtttcaactttcttcttgatctcaatgagcttctttgccatccatattttgaattctatgtctgtcatttcagataattcagactggttaggaaacatttctggggagctagtgggctcatttggaggtaagggggcagtgtggctttttgaattgccagagttcttatgctgattctttctcatctgggagggatggtattcttttaattgtggtgtaaattgagtgtactttgttggctttgtttctgaaagtttttagagaactaaggctctgtatggtgtcttcgttgcagaattcttactcttggttttgcaagggcaggattagtaaagtgattttggtgttgtagtttgggctacaatctagtagatggtccttgagagcaatgggcagtagataggcttctactcagccttgtggttcctttgtctatgttaacatttgcagctgtgttctgcagtgcaagggggaaatagatgaccccctcatcaggtctgcttgggggagccacatccaatcactagcactgtaccttcgattttgttgttgtttttattaggtctttggggccacggggctcccttagggagaggtctggtatggaaataacccatatccttactggaccaatccccttccccaggtacctttccagtttggaaatcagccttagcattcaggcaccccacattgggtgcctaacttccttcttcttcagtctctgggactgcatcttttctcaatccatgtttggtagtttctctctgaagatttgttcaaattatgttggtgtatattaaattgggtctctttctgtgggagtggcaatttctgactgtatctagtcccaatctatattttaaaagtatggcaagttttgaattttcagtatatgctgaaactgggtggtttttaaagagcagaaatttatttctcatagttctggaggctcaggagttcaagatcaaggcactgacaggtgtgatcttgtgagggctgcttttgcttccaagctgatgctctgttgctgtcctaatgtggtgggaggtggaaggggaaaagggtcacttttatgatgtcatttattttaatgtgatcactagtcatcagtattttttgttttgtttttgtttactttttgtatttgcctaggaatagcctatatgaaaattttatatctgaagtatacacaacacttagtccaggatcatattattagataagcactcacatttgaggatgacagcaaagttttttaattgatagagtttcttaatttagttgtaaatttctctgtaatttaattctaatattcttttctaagtggttttaaatttagccttatggttcagtgtattagaagcaaagtccaataaaattacatctttataatatcctgtaagacattaaattacatattattaattccacttttgaaaagtaattaggatctaataactgccaatagcaattgcatacattcactaaaatttacttgtttgtgtatataatttgggggttattttcaaaaattatgtggtttgcagtggattatttattagcacttaaaattttccacatgaaaaataagcctttgatwaccaaacaaagggatatgatctcaatatcatcttcttcctaaagtatttattccagagtgaatatcaggatgcccatttgtagggagacaaaatctatctgaaattattttcccgtgaattgctcatttttattgttctcataatcaacacaagatgttaaaataaatgtatttgtaagcttatttcttatttcataatacatctgtaacatttatttaaaagtaaatctattcaaaatattggagaatcatttgttatactttgtcacagtactttgacatgtttatgggtgatagattgttagatgtgggaacaatatagttacaaatgacaagcactcacaacagagtaaaattcttattggcatcttgaaggttttggtatatgtattcaagagtttctgtgattttaaagattgtaattaaattgaacaatgagaacacatggacataggaaggggaacatcacacaccggggactgttgtggggtggggggaggtgggagggaatagcattaggagatatacctaatgctaaatgatgagttaatgggtgcagcacaccaacatggcccatgtatacatatgtaacaaacctgcatgttgtgcacatgtaccctaaaacttaaagtataataaaaaaaaattgtaattaaaatataactatagaaattcttccacttttctgactatgtagtagatgcagaattcatgaatgtgtacttgatctatggtactgaagtattttgggagatacaaaagtttaaaacagtcttggttaccataatgcttatagttatttgagacttatgaaaattatcagaaacataagacaaactttggtaagtaccttaatggaggaaaagatctccaacagttgacaggatcagggaagtctgaactaaggacataggatgtsagttgggtggtgaagatcaggtattattttaacaaggagaaatggagggtgttctacctggaaaaaaccttgggagatgttgtaaaagtgagaaagcataaaatgcccagtatatttggattacatggtagaaaatggtgttgaaagagttaggatgggacagagcatggagtgttgtcaatgacttagccaaaaactgcaaattttatttgattactaatgaaatgatttacaattttgatgagagtctaggggatttaatgtgacaattgtatattcatttaatgaaaaaatgctgataaaatgctataaaattaataatattggttttacaatttgagcaaaggtggtacttgtctgtcactctaacaaattcgtttatagttgacccttgaacaacaaggatttgaactgtgcaggtgcatttatatgtagattttaaaaaataaaagctacatggagggtgcctgtctctcttgcctccctttctgcctcctccatctcttctgcctctgcccccactgagacagcaagacccaccctttctctttctcctcctcctcatcctactcagtgtgaagacaacaaggatgaaggccttcatgataatccacttccacttaatgaatagtgtattcgttctgttctcatgctgctaataaagacatatctgagactgggtaatttatgaaggaaagaggcttaattgactcacagttcaacatggctggaaggcctcaggaaacttacaatcatggcagaaggggaagtaaacatgtccttcttcacgtggagacaggaaggaggagtgccaagcaaaagggggaaaagccccttataaaaccatcagatctcatgagaactcactcactatcatgaaagcaacagtgtagaggtaaccacccagatgattcaattacctcccaccaggtaccctcccatgacacgtggggattatgggaactaaattcaagataagatttgggtagggacacagccaaaccatatcattccacccctggctcctcccaaatcttgtgtcatcacattttaaaacacaatcatgccttcctaacagtcccccaaagtcttaactcattccagcattaacccaaaagtacaagtccaaagtctcatctgagataaggcaagtcccttccacctatgagcctataaaatcaaaagcaagttagttacttcctaggtaaaatgggggtacaggtgttgagtaaatacacctgttccaagtgggcaaaattggtcaaaacaaaggggctacaggccccatgcaagtccaagatccaatagggcagtcattaaaccttaaagttccaaaatgctctttgacttcatgtctcacatctagggtacactgacacaagaggtgggctcccatggccttgggcagctctgcccatgtggcttttcagggtatagcaaccctcctggctactttcactggctggcattgagtgtctgctgcttttccagccacaagctcttagcagatctaccattctggggtctggaggacagtggccctcttctcacaactccatttgacagtgccccagtggagactctgtgtgggggctcccacaccacatttcccttccacacttcctagcagaggttctccatgagggctctgcctctgcaacaaacttctgcctagacatccaagcatttccatacatcctctgaaatctaggcagaggttcctaaacctcagtttttgacttctgtgcacccacaggctcaacaccatgtggaagctgccaaggcttggggcttgcaccctctgaagccatagcctgagctgtaccttgaccccttttagccatgtctggagcagctgggatgcagggcaccaagtcccaagtctgcatacagcaggggggccctgggctctgcccatgaaatcattattttctcctaggcctctatgcctgtaatgggaggggctgctgtgatggtctctgacatggcctggagacattttagccattgtcttggtgattacatttggccttgttacttatgcaagtttctgcagcaggcttgaatttctccccagaaaatgggcttttctattctattgcatcctcaggctgcaaattttccgaacttttatgctctgcttcctcttgaatgctttgtcacttagaaatttattctgccagataccctaaattatctctctcaagttcaaagttccacaagtctctagggcaggggcaaaatgctgccagtttctttgttacagaatgacaagagtcacctttgctccagttcccaaaaagttcctcctctccatctgagatcacctcagcctggactttattgtccatatcactatcagcattttggtcaaagctgttcaacaaatctctaggaagttccaaactttcccacaccttcctgtcttctgagctctcctagtctctaggatgttccaaacttccccacattttcatgttttcttctgagccctctaaactgttccaacctctgcttgtgacccagttccaaagttgcttccatatttttgggtgtctttacagcagcaccccactctctgtggtaccaatatactgtattagtccattctcatgctggtaataaagacatatgtaagactgggtaatttataaaggaaagaggtttaattgactcacggttcagaatggctggggaggcctcaggaaacttacaacatggcgaaggggaagcaaacatatggtgccaggaaggagaagtccaatcaaaacgggggaaagccccttataaaaccatcagctcttgtgagaactcactcactatcacaataacagcagcatgggggtaactgcccccacgattcaattacctcccaccgtgtccctcccatgacacatggggattatggaaactacaattcaagatgagatttgggtggggacagagccaaaccatatcaaataataaatatattttctcttttttatgattgttttaacaacattttcttttctttagcttgctttataacatacaaaatgtttgttaattgtttatgttattggtaaggcttctgatcaacagtagacattcctgttaaattttggggaagttgaaagttatatgcagctgaaaatctgtgtggggtttgacactcctaactcccatgttattcagtggtcatctgtacattgattttgatgcttatawtaaaacatgatcaaattacatagctggaatgataattttaccaatatgataattttgatgatgataccatattaataatgataatatctattgaatttagtcaaatgtcagaagcatcttatttaatattttatttgaatgttcttttttatagtgtcatcatcaaataaattataagtttaaacatataatcctatttttctagattcatattgagtttcaactttgtgtcttcctaggatatattctgtttcctttctgaataattgatgtttacaagttgatgttgttatttgctttcagatagttttgtgattatttctttttggttacagtaatcatctaaagaaatttttatgtcatttaaaattttcaatgatctttctttaaaaatatactctgcttttattttacaaacatacatttaaagtgatgtttttaaatgttaatttaatatttactgttaataatactaaaaaatatacatagataggcagcttaatatattggaaagagctctgaaatggaaaccaagacttgtggctttgccattaaactaattrttgccttgaggtcaccctgaaatcctctactttcttgtttgtaaagtagggaaataattctatccacataggttgttgggggattaaattggatagtgggattaatggaaatgttaaaaaatcttaactattgttgttatgtaatgtcatcatttagaatatatgttgttataatctgaaaatgtttcctactattcacattctgaaatttgttccattatgcttctgttagttctgtttgtacttttccaatatagatattgctatgatgtactaatctaagtttaaaggaaagtgctggatctaaattttctaccacttccctgcctgctgctgtcagcaccatagtgttgatgttttgtgttaacactatgaagggaatttatgagaataattagttttgtgttgcttatattagagctggttatcttaattcttgcttggtgggaggtgtgttccttgccatcatttggctcctggcccacagctttaaattatgtggaggagaaaatgattataaatggctccttcctgtggtgtcccttacagtttttctcctaacagaaagtctcttagttttttctcatcaatttctccttgtgttgcagtctaaagtgatgtcccatctgctggtcaagctgcaaagcaattcttttaagcatcattagcctatggttaagaattagattcctttttttgagaataaattttaattggttatggtttttactgaaatgagttgattagatgtgtagagaaactgctataatttttcatgtttaagggaaagccaataaaatatatatgaggagaaagtgtacttaagaattatttaagataaatttggtgggggaaaatctgcaagtgtaaaaatcaggattaaaatagatgctttcaatgtttctttttgttgatggtgaataactgatgtagtatatcatgtttttgacatctttgggcatataagccaaattttatagaatttttgatttatattcttatgatagcttttcaatttgtcagttctttgcctatgatgtgcctgctgagcatgaaaggcacttttgagctatgtagtaataaaaaaaaatgccacaaatacattggcccaggggataggctttctgtaaaaatgacctgaataactacagttgctgtaaataatttttatggatatttgatgctccctccctgtatttttgtttgaattagtaatcagattggtattttactaacatcctggaggtgagaattgtcattctaatacaggtattataatgcaatatctggctgggtcatactggatcagaatgaccttagccagtattgtgcagaaatgttgtaagattttggagaattactctttctttgtaaaaaggtaactctgtggcaggtactgtgtagtgctaagattcttaaggggtatttcaaagcaaacatgcctcttatagctgtctgtgctatctttcattttatgaaagattttatgtattttacaatactgatgtcagctgctgttttacagcattgcccacttcccatactgatttaactaacgggcttctttttttttttttgatattcattcttctattcatgctccattattgatacggtgtaccttaaatactgagatataaagttaagcattattaacacatcttattttacatgattagggaatgagggaagaaagaaaataaagtaaacattgtgtatgtgatatcacacacacaaaagagtcatatttatataaagataagaaatactcataattaagttagtccatatatccgcaactggtctcatcgttatagctggtatgtttaaacagcttcttccactaccatttttatatcctttgcccccagcaagaacttcagtttgtttaatttcttgcctgatgaagttacctaaatcattattgctgaaggatctgggtgattatcagtccatcctgaattgagctgtgctagttttccactgatttcaatcacaagaaatgagaatactaataagcactctggaagatctcctccatttcaggtatatatatctttttattttttagtagaaacctaattttaccttgatagctagaagaatcactccaactagtacagaaaccccatttgttgcctgttaattgaaggccctaatttggctgggtcaagtctcaatgtctagttcaatgcaatcattattgcrttatcacttgatagaagcattacttcctttgaaattaagatctctaaactcacagggcctaaaataatggcaatgagcggcaaaagtttgctagtatatcacctgaagaaatagtgatagtacattctaattttttttccctccttttgattccttgacccatacatttggactgtaagcgatatggcaccacacatgtatgctgaccatgcagaatatactggggatattacttcagctctgaaaagtgttgccatatggctgacatcataaatgagtcttcaaaaagccattccaccatactattatccatgctatgaagaaaatcatggcaagattagttaatttcatgagcaagggccctttgccacattttatttgctgtaaaataaattccttggtcaacaatgatggtatgagtaataatatgatcctgaataaggtattctgtagcacacagatggtattgttggcagattttgaattcagcagtttctgtgaccagtaaatattgatgagtagaagtccatactgcaggtctgaggtaaatcttcctccctgtcatcatggccacattctttttatttttatttttatttattttttttttattattatactttaagttttagggtacatgtgtacattgtgcaggctagttacatatgtatacatgtgccatgctggtgcgctgcacccactaactcatcatctagcattaggtatatctcccaatgctatccctcctgcttccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctcttgtgaagagtgccgcaataaacatacgtgtgcatgcgtctttatagcagcatgatttatagtcctttgggtatatacccagtaatgggatggctgggtcaaatggtatttgtagttctagatccctgaggaatcaccacactgacttccacaatggttgaagtagtttacagtcccaccaacagtgtaaaagtgttcctatttctccacatcttctccagcacctgttgtttcctgactttttaatgatcgccattctaactggtgtgagatggtatctcattgtggttttgatttgcatttctctgatggccagtgatgatgagcattttttcacgtgtctgttggctgaataaatgtcttcttttgagaagtgtctgttcttgtcctttgcccactttttgatggggttgtttgtttttttcttgtaaatttatttgagttcactgtagattctggatattagccctttgtcagatgagtaggttgtgaaaattttctcccattttgtaggttgcctgttcactctgatggtagtttgttttgctgtgcagaagctcttgagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacaaatgggtagccagttttcccagcaccatttattaaacagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgtgggctcttttttggttccatatgaactttaaagtagttttttccaattctgtgaagaaaggcattggtagcttgatggggatggcattgaatctgtaaattaccttgggcagtatggccattttcacgatattgattttcctacccatgagcgtggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttgggtctctgtttgtctgttgttggtgtataagaatgcttgtgatttttgtacattgattttgtatcctgagactttgctgaagttgcttatcagcttaaggagattttgggctgagacaatggggtttctagatatacaatcatgtcgtctgcaaacagggacaatttgacttcctcttttcctaattgaataccctttatttccttctcctgcctaattgccctggccagaacttccaacactatgttgaataggagtggtaagagagggcatccctgtcttgtgccagttttcaaaggcaatgcttctggtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagtaggaatggtaccagttcctccttgtacctcttgtagaattcggctgtgaatacatctggtcctggactctttttggttggtaagctgttgattattgccacaatttcagatcctgttgttggtctattcagagattcagtttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccccttatcattttttattgcatctatttgattcttctctttttctttattagtcatgctagtggtctatcaattttgttgatcctttcaaaaaaccagctcctggattcattaattttttgaagggttttttatgtctttatttccttccgttctgctctgattttagttatttcttgccttctgctagcttttgagtgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttgtctcattgatctgtctaatgttgacagtggggtgttaaagtctcccatttttaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctgttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgattctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcggctggtactggttgttcctttccatgtttagcgcttccttcaggagctcttgtaaggccggcctggtggtgacaaaatctctcagcatttgcttgtctataaagtattttatttctccttcacttatgaagcttagtttggctggatatgaaattctgggttgaaaattcttttctttaagaatgttgaatattggccctcactctcttctggtttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacgtcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgtgttcctttggaggaggagaggccctctgctttttagagtttccagtttttctgttctgttttttccccatctttgtggttttatctacttttggtctttgatgatggtgatgtacagatgggtttttggtgtgggtgtcctttctgtttgtaagttttccttctaacagacaggaccctcagctgcaggtctgttggaataccctgccatgtgaggtgtcagtgtgctcctgctggagggtgcctcccagttaggctgctcagaggtcaggggtcagggacccacttgaggaggcagtctgctggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggctatggtgggcgcccctcccccagcctcgctgctgccttgcagtttgatctcagactgccgtgctagcaatcagcgagactccgtggggcgtaggaccctccgagccaggtgcgggatatactctcgtggtgcgccgttttttaagcccctaggaaaagcgcagtattcgggtgggagtgacccgatttttcaggtgccgtccgtcacccctttctttgactcggaaagggaactccctgaccccttgcgcttccccagtgaggcaatgcctcaccctgcttcggctggtgcacggtgcgcgcacccactgacctgcgcccactgtctggcactccctagtgagatgaacctggtacctcagttggaaatgcagaaatcacccgtcttctgcgtcgctcacgctgggagctgtagaccagagccgttcctattcggccgtcttgggtcctccctcaactaacgggcttcttgttacagatcagaacttcagatgatttaaagaaggataggaaggtaggacggaggttttggaatgaggtcttaacaaatacttaacttttgtgagaattgtatgtgctttcacttgcttttgatcagacttgaattaaccaaaaaggaacttgtggtttgctttgttattaacattatgtggaactcatgttaatgtgcatggccaactttcttaaggtaattatcagtcatgtaatcattaagtgacagacactatttcctacctttatcattctcagtatttcagtcataagtaaatgaaacccctcatttttcgtgttctggcactattcttaaaacatatacaaaggccattgggattaaagtataagactttttctatctttttcctttaagatgatcttcctcagtgctttgtttttctttcctttttgttcacttccccctaggatctattgtcagtctttttttctgctgatgtttaatgaaggctttcaactcagttcaaacaagtgttgaagtcagatcttaggtaaaagaatgtgagaaacgcccattttaccatctgaagagagggtaagaagggtggtatgtggtatgttagaggggcagaaggagatggacatggagggggtgagtagcctgagacctgtgagttatgtaatgtctgtataaagaaaaatttctgctcagaagaattccaagtagttgaaaacaggaccgaacgtaaataaatgagatgaaattcaatgtgtaattataaaaagtaagaactccttatgctttcgtcagactgtccaaataacttattgcatatttttagaagcacattccctatggtgcatggcaatgtaaagaattcagaatcaggtctaaccctatacctaatttatgagtaagttttatttggaagttagaatattggcatatacttatattgtacattatagtttctgagtgcctttttatgcatttcatttttagatgctcgaaacartgtagagacataagcagataaggtgatggtatttccattttgtatattatttaaatgtccctttactgcactgtatgtgaccaggaggtcacattaatattaaagctcccgtgcacaggctggtagcttccacttgcatgactgtgaaacttctgctgtcctccaacactccccaggtttttttttttttttttgagatccttcagggtatatccccaccaggcactgtgggaccacactggctgccaaaccctctgtaggaatgtagttcctggacacagctgtcttgctctgatggtgctgttgctttgcgctcagaatgctcaagtttcacatgcagccttggtttaggagaatgaagtggggaagagaaaaaaaagggtgaagagttgggtaattctcctatatatgattccttcttcctttaaactagtgtttttaactatacacatatagatatttgtacaatcaaaggtaacagtggtgcaaactttattctattagagtttgtgaagaaggctgaaaaccattactttgatgaatgtgtgatcactgaaagattctgggtctcaatagagattaggggcacctcaaaaactatattaggtagaagtgttctttttggttcaagtttccttattatgctttttctagtttctgaaagaaaacttctgaggtttgaaaaaattaaaaagtcccattcttgcataagtgaattctggacagaaggagaagtcccttgtcaaccacaagtgtgcagatggctggagccacaggaggccctgggatgccattattctatactgaggtcattagactataagctgcataaagcaagccatctctttcccttttttggtagcattcacattgaaagaagcaacaaagtagcatataaaataattgaaaagaaattcaaatctttactactttttcttatcaaaataggcccttttttggtagcattcacattgaaagaagcaacaaagtagcatgtaaaataaccgaaaagaaattcaaatctttaccactttttcttatcaaaataggcctttttggtggcattcacattgaaagaagcaacaaagtagcatcaaaaataattgaaaagaaattcaaatctttaccactttttcttatcaaataggcaaaggggaataattgcataatactcagtaaggctttcttaaatattttttccttattctctcatttttacaatcttctatatgtagcagctgcctaatttcttcctctcattccatgctctatttctaagctctcagaaagctttttctctaaactgagtcatacgagcttcctgtatttgttccctttcttcactggctcagagttttattaaacagttctgcctagccttagggagctgtttcagttttgggctcccctggaactttgagcctgcacaatggaagaagacctgggaatttatcaaacaaacaagaatctgttattttagtgggtggtgtgtgtgtaagtagtgggaatctagaagaatgcaaacatgtaactcagtaccttttcttttattcctggaacaagaaaaaccatgtctatgaagataatgcatatatttagtggatgaagcatgaaaatagttgtttattaggtcacatatttttaaaagaggtttggagaaattaaaacatcttaattccaaggatatcatatattccttaagcaatgagaaaaatacctttggaattgtaaattcaataagtgataagttttcttatttcaggtaggttgctagaaagaaaggagccaaatttgcagccaccacagtgatgtatagcgaccttactttgtctttacctttatttttttttaaccaactttaaatttatgctaatttgtgttttatgtatccttataaaacactttatatcctttctggcacaaggtgatatatacatatataagtaatgataaggagcaaaacagtaatgtttctcacgctagtgtagatttatcttaatgctatacaatctaatggtgtaaatggtaaggaatctgttagtgacccttagtataagagcattaaccttggcttagaaaataaatcaagaaagctggtttgatattaagtggaacataatttcctcagtagtctgaaggaaaaagttaaaaagcaactacagattatttttacttctctgttacctacatcaaagattctagtaaacgtcactgtttaatgttagaagtgggttattttcaccttattcatcatatacaatgttttgcatgcagctgccatataatagaaactcaatattatatctactgactcattctatatttaaatttattgttaactaatcattgaactccaagatatgccttagcatagctctagttaggttagtgaggtaaagtggactgtaaacaccttaaaaatcaaggaccacattctagttgtgattctgagtctacactacattttaagttggtctttggtactacataaatggtaagttagtacttgttgtgagactacattatgtagtggtgagaatcttaatatgcagctaggcaaatgagttcaagtcccaactccactacttactggtatattctaatctttctgagctttagtttcctcagctgtaagatgggtatggcaatactttcttaccacgactgttgtgaagattaaatagcattacgcatgtaatgccttgttcacggtgcttgccacggggtaggtaccatggctttttcatcttcctgttgaataaatgaataaatagatgaatgagaacattatacttcctgtttagaaatttattttaaacaaatcacctagtacattaacaattaattgttcttaatttttaatgagaatttattaatagagattatataatatgtataatatgtaacattaaaactaagcaatgaatacagttccaagacttacattaagtcatgcctttgataaacactgcattaacaacttatggagtgatgtagtttggatgttttgccccttcaaaatcctgtgttgaaatgtgacctccaatgttggaggtgggcctagtggtagggtttgggtcttggggactgatcactcatgaatggcttgatacagtctttgtgataatgaatgaattcttactgtatgagttcacatgaaatctgactgtttaagaaagcctggcaccccctcctctctcttgttcccgctttcatcatgagatatgctggctccccctttaccttctgctatgagtaaaagcttcctgggcctcaccagaagccctgcagaatgagccaaataaaccatgagtcaaataaacctcttttctttataaatcacccagcctcaggttatttcctttataacaatgcaaatggactaacacagggaggcatatacacatacatgtataaatgtatgtatagtaagaaacagatgggtccacttatagcagatgatgagagccatgttgtcaagaagatcataacaattaatgaaaccttaattttagtagttcctacaaatacatattatatttttctaatataatttctatcacatgaacctttgttagttgatttttagttgatttttattttaattctgcttattttatacatgtatttatcctacactgttttaaagttttttgaaaattgataggataaattataaattgataaaaatgaatacaattttgttaaaatttttgtttagtgtgccatgtgaatgctgtgccttagcagggcttagtgctttgggttctgtactggtaggcatcctttgcttatggaaattattgcactgttcttagtagacatttcaagaattcagtagataaaacatcctggaaaacttgagagacttggattgctgacagaaacctccatttcttaactatgtttagttaaaaataattaaaaagttagaatgaaagaaactaacattgaattctcataaactgttagtcaaacagcttctgtggaaaaaaatctttttgattatctatttttcattgaacatggtttaagtaaactgatataattttaagtattagtcaccaaagaacttccaatgtacatgtaagtaaaatgaatatgctcagagctggatagtgatattgtttcagttgatcacactggactggaaaaaaaaagaaagaaaacaaggcagcagggcaatgattgatagacagggcttcacctgtcagaaagggctggaggtgctatttctgagtgagcrttttcaattctagaaagaacttaatgcctgagttcctcctttgaaagtgcctatatagaaatggagtatctggagactgtatgtatgttgtatatgtaatttccatgggcagagagtacacagataacaggaacttctttgaagttaaaatgtactattttttatatgaaagagggtcaggggagggtggtggtatgaggagagggtggtacatttagctcaagctttgtgtcagatcttccagttaacctccttaaatttttattggaaataattacagtgcacgaaggaagggaaacacatctgaatagatcattaaacttcttttttttcattttcagaaggctgtggagcagagcatgtagttcttgatatgaaacacaaaatagagtcttttggattagaatatgtgggacagtaacacatactggaaagatgttaagaagattgaatttatagagaatgtttttaccactaaattgctttgtggccttaggaaagtctgggttttagtctccttacacgtagtttcattttgaaacctaaaagttatatgaaagtctttaattttattatgcagatgtttccccttgacttttcagtgtttttatggctagcaaatgggaatattgatttgtgtacttaaaatactttaatgatcttcagttcatatctgtagactattctgaaacaaggaagggaattgtttcataaaatggtgagctcttggttcaaggagatactcaatcagcagagagacagtcatcaggactgtggtaatggagcttgagttcagggcaatagatttgttatatggtacctgaagcccttgaggttttaggattctaattcttggtattatatttctcttagtgctctctgctaacctattttagtcactaaaaagtacaaagtgaaatagaaaaatgaagactaaagtaacttcttaaagatttccttccaagattgcaaataaggaatttgctccatttatagtagttgctctctcccttactcaaatcatatcagttctgtaagaccagtctctggcctccacttcttcatgaaacccttcttttgtattcctactgttttcgtcttccctatttgcccttagtactcattaacaaatgtggaagcatctgtgcatatagaatatgtaccattcatttagacagttgagtatatcaaactttctcttagttgtaaaagatattgatcctttagtctttcataagtacaggtcatgccacatactgtttcctccctattacctatgatattttaggtactaactcaatgcatatttgttgaattaacttttatacacaacccatgaaaggagccacctatgcacctatgcctcttggaagattacagttaatctccaggaatattcttttatttattgaataatctttcatgaaaaggttttacttgaattttcattcccatttcactggttatagtatgttctcttttttcagaatttctaagtggaatgaaaaatttcatgttgctcacatcgtaccttagattttcttagactttagaactttatctgatccattttgaatgaaaatataatctttcaaaaattagtttctaagacctctcagattcctcttatttcttcttcagcaaaatacaaaagaacattgccttacatagaaattagattagtttgataacaggcataatgcccctactgtaagtgttctgtttgctctccagactaattcttttttttttttttttttttttgagacggagtctcactctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatgstctcgatctcctgacctcgtgatccgcccgcctcggcctcccaaagtgctgggattacaggcgtgagccaccgcgcccggcctctccagactaattctatgctctactcatggtttaggattttcacctcattgtrctctaaagtcttggatttcctattctagatcagatggcttgtattaagtgtggacctgtcacctattgatcctatttaaaaaattaccaagagcctttaaagtataaacttgtttgctttacctttgggaaaagcaatgtgatgttcatattcgcatgatactttctaaatatatttttagtccattttccccaccaagggttatatgccatattcttgtttatatttaactatattaatatctttgtataatgcctttcaatttataaacactttcataaggatcatagcatataatgatcatagttgccctgtgaactaggcaaggaagttatatcaccttcgttttgtagaagatgaatctgaggcttgaggattttaagagacttgtccaagcggggggctagagctgaaacacaggcatcctgactcctacttctatgctattttcactatacaatgtggtctttggatgagtattaaaaaataaaagacagaattatgctcatggcaactttataataatgtaatattatgttttaaacagagaaatattttaagacatatgtagtattttccacaaaaggtcaaatcttgtatttagaattcctagacatagatttttagataccttttaaatggttgatgcagttaggtacacaaacacagtgaagaagctctgcatttgtcaatgtagacaaacgacaattgaaaatgacaaatggcaacagaaatgtatcaagtgcccattatttgacatgtatctcataattgttcagttacctagccaaagtccagaatgcttcaatggaattgcccttatatgttacttattatgatagcaactaaataaattctaaagggcataaaatgatctattaaataaaaaatgtggtatatatacaccattgtgtatatattccattaacactattcagccataaaaagaatgaaatcctgtcattcacagcaacatggttggaactggaggacactgttaagtgaaataagtcaggaacagacagttaaaaactgcatgttctaagtcatacgtggatgagggactttccaaacatgtcaaggttatgaaagaacaggaaagatggagactgtctttctcacagaattctcacagatctgaggagacaaaagaagatgaccacaaaatgtttcataacatctttgattggaccctgaaacagaataaggacatccattaaaaaagaatggtagaactctaataaagtctggcatttgttaatagtgttctacacaaatattcgtttcttagttttgataaccatacctggttatgtaggatgttaacattagtgatgttaacatttgagaaagctgggyaatagatatacagaaactctctgtatcattatgacaactcttttgtaagtctaaagttatttcaaaataacaagttaaaattttaaaaattctcaaaatgtttaaaatcttttgttatattaagtgtcccagtttgaggtttggaacaaatatcactgtaattatacaaaacattaaaacataaaaaaaagtaaaaagtagaacataggacactagggtctgagaagggtagggggaagaaggtgatagagatttgttaaagggtacaaaattaaagctagaagccttgtttcgtggcatgcgcctgtagtcccagttacttgggaggctgaagtgtgggggtggcttgaacccaggagttcaaggctgcagtgagctatgattgtgctactactccagcctgggtgacagagcaagactgtctcttaaaaaaaaagttacagcaagataggaggaataagttctggtgttctctagcactgtaggatgactataattaacaataatatattatgtagtttcaaactcctagaaggaagaaactgaatgttcccaacacaaagaaatgacaaatgttttagatggtagatatgctaattaccctgctctgatcaccatacattataggcattgaaacatcactatgtactccataaatgtatataattattatatgtcaatgaaaatttttttaaaataagctatttttatagagaaagaatagttagagcaaaaacatctcagaattcagcaacctgcaaaaaatttaaaacaatttatccccaaatttccagaccctgtactttaaatcagtcgttgaatgttagtgtaaaataattttatttggaaagtattaggatgagaaattcaagtttataatagaaaagtacttcatagaatttccctctagagaaggaaatgctaaactgaaaagacctaggagatttcaactagtccctactcttaacttattctgacaaattttcctattggtgacttctcattctttccttaatatacatcttctttcttctccctgatgctgctacatacacattctactttctagtacagaaggttttctttttaacagcaatctcagaggttaaatctttttaggtctgtttgaaaatctgaatatattacatctactgtggattacataaagtttagcagggtctacattgttactgtaccaaacagaaatccaaactaaagtatgttaaactggttaggatatattcatccctagaggaagagagcacttttatctgtgtactggaatgcaaacatgcctttttcattttaaatataagccaaataatcttgaatttataccacttgcttggatggcgctgagcagattcaaaaggcatcatagctatgggctctaacatatatctttgagctttgatgtgtattgactttctcgtatcaaggctgtaatatctctgaagtgccctggcaggttagttaggaatggcttttcctgcagcaattgagattgttctctgtaattaaactacttttccaagagttcccttaagagggtttccaagatttttcacgatgttagtctctggttgatagctttttagtttgtctcttactctgctatgaaagagggatacttggcttactagtttcttttgtctacgtcctaacttaatatctaaccatagcataacataaagctgaatgtgtgaacagtgggtcaattaaagaagaaagcaccactttttaaatgacattgtccacagagcatcggtgagctgtatgaattagatttgtagtccttacgcacctattctttcatctctaccaaggaggaaatcccagaaatcaactgtttgatgaggacttatttattatttagtattcatcttaattcatgtgagaggatattgactataaggtaggctctattaactgattaacctaagaccaatttccaatcctcttctcttttgccagactccactatgaagtctaaggaagctaagtgtttactagtccagcctcccttgcaggcagtgagggttaagtgactttcctgacctcccttgaaggtagttctgtcccctaaggtgttagattttgctttcctgataaaagacatagatgtggctagtactactgctttctccctgtcttagtccatttggtctgctgtaacaaaatgccacaaactaggtagcttataaacaactggagtttatttttcacagttctggagtttgggaagtttaagatcaaggcactggtatatttggcagctggtgagggcccactttctcatagacagtgccttcctgctctgttctctcaaggtagaaggtaaatgggttccttttggcctcttttataagagcactgatcctattcataagggttccgccttcctgaactaatcacctcccaaaaggtcccaccttctaatatcatcactttgggggttagcctatgagttcttgaagctgttctgttgttggcagccacccttatgaatttgttttcagaaaattaaactaccatttatttcaggttttgttagccagaaggattcctaattaatatatgatagtcattgaccaccttcaatgaagtagagaagaatccttttcattaggacagggtttcttaaccttggcactattgacatttagtgttgaataattattgtgtgagatgtcctctgcattgcaggtttttgttttttttttgagacagagtcttgctctattgcccagggtggagtgctcttggctcactgcaacttctgcctcccgagttgaagcgattctcttgcctcagcttcccgagtagctgggattacagtaacatgccatcacgcccagctaggctaatttttttgtatttttagcagagacagggtttcgccatgttggctaggctggttgtgaactcctgacctcaggtgatctgtccacctcggcttcccaaagtcctgggattacaggcatgagccactgcacccggcccattgcaggtttttaagagcatccctgaccttgactcattgtgatacccaataatttatccagatattgctgaatgttatataggaagagtaggcattatctagttcaactcctgtgtttaccattaaaaacttgtcacatggctagttagtggtagagttaggataagaaactagatcctctgatgtctctgtgctcttctcacaatcatggcaagaccaagcatacactaaaataatttaaataatttgggcaggataataaatagcatcttcaacttttagtatgtcggtgtcaaacatgtcttagggctatgtgcctcctggagttgtatcattaaatgattagtctatttatgtcctaacttaatatctaaatattttcattttggagttgtgttcttaagagatatatatttgtatattaaactaaataagttgtatatttggtgttctataatgtagaattttttgctttaatgaaattattaaaaatagttttaagacaagccaagcaaattttctcttcaagtagcttatgttgactgtttcttctccctgaggccctcttcccttagctaaccatatagattgctgctttacttccttcaagtccctgttcaaaagtcacctcactagacattatttacctgtaacaaaatatctcatgtactccataaatatatacacctaatatgtaccaataaaaattataaattaataaaataaaatgcagtggatttaaagcaaaaaagtctcattagagatacagtatcatatagcccagtataaaagaagtaaatctgatgaataagatcggatgaataagaatatgaataactcttccttatggaaaagttggttaatatttatttatttatttattcgttcattcgtttatccaatttttttattttgaaagatggaaatcttacatacctttcaaggttcaactgatggataatcagagaaacaaaattccagaacagagttgggcaaactacagcccttggaccaaatctggctggctacctgttgttataaataatattttattagaacacagtcacacccacttgtttacttattgtctgtggctgcttttgtaccataaaagcagagttgagtaatcgtgacagagaccatatggccaacaaaccttaaaatatttagtatctggctctttatagaaaaattttgctgaaacctactctagagctgtaaggaaatctagacataatttactacagtggtctgaaagtttttaaaatgtgcacttctatcaaaaaataagttttacaaaagttctaccatttgctaggaaccatttgaggcactggagataaacataaacattacattaaacattacaactaagtgcctgaccccatggggcatagcatgttgttttcaggggagagacagatatataaacagatcagaaaaattatatatgaaatgtacagtgaagtttcccttgacttctctgccctcatctatacaaccccacccatccatcagggtaatcaaaattatgtgtttcttatgtatctttccagagactctttatatatataagaaaacataaatatagattcttattaccccatcattttacagaaaagtaacaactatacaactcctctgtagcttgctttttttcacttaacattgtgggagatctttttcacttaacaagtggagatcttggtgcagagctgagttcaattcctggatatctttgttaactttctgtctcatggatctgtctaatgttgacagttgggtgttaaagtctcccattattgttgtgtgggagtctaagtctctttgtacgtctccaaggacttgctttatgaatctgggtgctcctgtattgggtgcatatatatttaggatagttagctcttcttgttgaatttatccctctacaattatgtaatggccttctttgtctcttttgatctttattgatttaaagtctgttttatcagagactaagattgcaatccctgccttttttttgttttccatttgcttggtagatcttcctccatccctttattttgagctatgcatgtctctgcatgtgagatgggtttcctgaatacagcactctgatgggtcttgactctttatccaatttgccagtctgtgtcttttaattggagcatttagcccatttacatttaaggttaatattgttatgtgtgagtcatcctgtcattattatgttagctggtgattttgcacgttagctgatgcagtttcttcctagcctcgatggtctttacaatttggcatgtttttgcagtggctggtaccggttgttcctttccatgtttagtacttccttcaggaggtcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccagtctcttctggcttgtagagtttctgccgagagatctgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatatcctgaatttgaatgttggcctgccttgctaggttggggaagttctcctggataatatcctgcagagtgttttccaacttggttccattctccctatcactttcaggtacaccaatcagacgtagatttggtcttttcacatagtcccatatttcttggaggctttattcgtttctttttattcttttttctctaaacttctcttcacgcttcatttcataattcaatatggattaaagacttaaatgttagacctaaaaccataaaaaccccagaagaaaacctaggcattaccattcaggacataggcatgggcaaggacttcatgtctaaaaaaccaaaagcaatggcaacaaaagccaaaattgacaaatgggatctaattaaactcaagagcttctgcacagcaaaagaaaataccatcagagtgaataggcaacctacagaatgggagaaaatttttgcaatctactcatctgacaaagggctaatatccagaatctacaaagaactcaaacaaatttacaagaaaaaaaaaacaacccatcagcaagtgggcgaaagatatgaacagacacttctcaaaagaagacatttatgcagccaacagacagatgaaaaaatgctcatcatcactggccatcagacaaatgcaaatcaaaaccacaatgagataccatctcacaccagttagaatggcaatcattaaaaagtcaggaaacagcaggtgctggagaggatgtggagaaataggaacacttttatactgtaggtcagactgtaaactagttgaaccattgtggaagacagtgtggtgattcttcagggatctagaactagaaataccatttgacccagccatcccattactgggtatatacccaaaggattataaatcatgctgctataaagacacatgcacacatatgtttattgcagcactattcacaatagcaaagacttggaaccaacccagatgtccatcaatgatagactggattaagaaaatgtggcacatatacaccatggaatactatgacaccataagaaagatgagttcatgtcctttgcagggacatcgatgatgctggaaactatcattctcagcaaactattgcaaggacaagaaaccaaacaccacatgttctcactcattggtgggaattgaacaatgagaacacatggacacaggaaggggaacatcacacactggggcctgttgtgggatggggggaggggggagggatagcattaggagatatacctaatgtaaatgacgagttaatgggtgcagcacaccaacatggcacatgtatacatatgtaacaaacctgcacattatgcacatgtaccctagaacttaaagtataatagaaaaaaaatatgtatatataaaaagaaaaatgggaagaaaaaaaggaacaatttcttgctgtaaaacttcctcttggccgggcgcggtggctcacgcctgtaatcccagcactttgggaggccgaggcgggcggatcaagaggtcaggagatcgagaccatccaggctaaaacggtgaaaccccgtctctactaaaaatacaaaaaattagccgggcgtagcggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaarcaaaaaaaacttcctcttaacatgtataggattatatttaatgtaatgcaaacaagtttcttttcatctgttttttctctgaaatagtgattagttgaaaacattatatgtacatatacacacaaatacagagttctccttatccacagaaaatatgtcatatgtcacattaaagagcaaatataccaaatagtgagttattatgcctttgataagtagaaaatcttactaaacagagtttagttataaggaaccatgaagggaaattaacaatatgcattcctaacctacagatgtaaaatgtataaccaggacccccaaattatgaaactatactattgtaagatttcttagctatttgtcgttattcgcatgcaaacacatgcctgcaagtacttgtaaactgtcaaataaaccatgatcaaatttagaaaaatacttcagatttttcaaatttacctagaaataaaatacatggtaaaagcagagtatagataattacccagttacctgtcacttcaaataaacaaaatatcagaaataaattatatatcaaaatgaattgatgtgagtcacatacacaaattttgtgaaaaaagtaaaatgatgaaacctgaataaaaaaaaatcaagtggagatctttccacatcagcatatagagatctgccttattttttgtaacagctttatagtattcaattatatagacataccaaaatttgtttgaccagtcctttattgatggacattttaatgattttcaatcttttgccattacacagaataatgtaagtaataactatatatatacacacatacatacatatatacatacatacacttaagtatgtagacacacctacacatgcatatatacaacttcataggcatgcaagtgttatttgtaggataaattctcagaagtgaaagtttggggttaaagggcatatgcatttgtaatttgtacagatattgccaaagtgtcctccaaaatggtggtactaatttacattctcatggtgtatgagaatacctgcatgctgaagcctaactaacagtgtctttaactttggttatttttctaagctgataggcaaaagatattatctagtgttattttaatttgcattttttattagaaaggttaagcatctttatctgtacatatgcatatttgttcacattctttacccattttcttttgagttactggacttcttttgcttactgatttttaggagcttttaaaatattgagtagattaactctttgtaatatgacttgcaattacactttttccagattgttgtcttttgaatttgcttatggtgtattttcrccatggagaagattttaattgttgtcagatttatacatttttttcttttattgactcagtcatagttagctcgcaggcccaaggttgaaaaggaattatcacatggttgcactttctacaagcaaatctttgatctatttagaatatatgcatctggaatataatgatataatgtgaggtatggattcaatcttatttaattttttctggatgtttatccagtttttccaagagcaagtcttgaccagcaagtctcctaacttgtttgagatatcacttttttcacagaatgcattcgtttatgtatttgaatctatttttggatttttaattcttcctattcatcttacagcatcagtattttaattaccaaggctttaaaaatagatttattgaggtttaatatatgtaatgcattatacatacatattttagtgacagggttttgctgtgttgcccaggctaccttctagcttttaggctcaaaagatccccctgcttcagcccctaaagtagagtgcatacattttaagtgtacaatttgatgagttttgaaatatgtcgatggtgaaaccatcaccatagtcaagatagtaaatgtaccaatctctccctaaagttttctcttgcccgtctgcaatgtttcccttttctgcctcctgtgtctctcttcctcctctccacaggtaaccactgatctgctttatgtcactgtagattaattcacatttctggaattttatagacatggaattatataacatgtgctctttttatgtagctttttttcactcagcataattattttgagattcatccatcatgttgtgtttatcagtagttttaaatattgtgaaatagtattccattgtatggataccattattcgtttatttatttagctgctgatagatgcttgggttgtttccagttttaggctattacgagtacaactgtcatgaacattcatgtatttaagtttttgtgtaaagagacattttgatttatcttgagcaaatatctaggagtgcagtggcttagtcacatggtagatgtatttttacacttttaagaaatcatcaaactgttttccaaaggagttgtgccattttacattcccactatctgtgtatgagagtttcagtggtccacatccttgccaatagtctttttatggtcagccttttaaatttcagccattctagtgagcatgtagaactatctcaatttggttttaacttctatttccttaataactaatgatgttaaacatctcacgtgcttatttgccatctctacatcttctttggtgagatgcctgttaggttcaatcttttgtttgtccttctatcaagttgtaaaacttctttaaatattctaggtataagtcctttgtgggacatttatttttcgaatattttctccyattccgtggtgtactttttcattcattttttttggagctctgtaagcccttttcccaccagcttctgttttagattcaaggggtacatgcgcaggttttttacaagggtgtgttgtgtgatgctgagatttgggatacaattaarcctatcacccacatactgagcatagtacccaatgattagtttttcaacactttcctttctccctttttccgcactcttgttgtcaccatttttatgcccatgtgcatccaatgtttagctcccacttataagcaagaacatacagtatgtggttttctgtttctgcattagttcacttaggatattggcttccagctgcagccatattggtgcaaaaaacaagacttcgttattttttatgggcatactgtattcgacattttctttatccagttcacttttgacgggcacctaggttgattccatgtctttgctattgtgaatagtgctgtgatgaagatctgggtgtgtgtgtctttttggttgaatgaataattgtcctttggatatatccctagtattgggattgctgttcgcatggtaattctatttttagtactttgataaatctccaaactgtgtttcacagtggctaaactaattgacattcccacaaacagtttataggcatttacttttctctgtagccttcaccaacatctgttttttttttgactttttattaatagacattctgacttgtgtaagatgggatctcatggttttgattaatgatgttgaatatttttttcgtatgtttggtggccacttgtatgtcttcttttgagaaatgtctgttaatgttctttgtccactttttaatggggttatttgttttttgcttgttgaattttctaagttccttatagagtctggattttagaccattgttggatacctagtttgtgaatattatcaccaactctgtaggttgtctttttattctgttgatagtttcttttgctttgcagaagcactttagtttaattaggtcccactttttcatttttgttgcaattgcaggacttagccataaattcttttccaaggctgatgtctaaaaaggcatttcctagcttttcttctagaatatttttagttttaggttttgcatttaagtctgcaatccacctttttttttaaactttttgaaaatttttaacctaaacaacaaatttatttctcacagttttagaggatagtttaatccatcttgagttaatgtttgtatgtagttagaggtaggggtccagttttattcttctgcatatggatagccagttatctcagcatcatttattgaatagggagtagagagttctttccccattgtatgttttcatcaactttgtcaaagagcagatggttgtaggtgtgtggccttatttctgttctctattctgtcccattaatctatgtgtctttttttttttcctttggacgaagttttgctcttgtcacccaggctggagtgcagtggcaggattcctgctcactgcaacctccgcctcccaggttcaagcaattctcctgcctcaccctcccaagtagctgggattggaggcatgtgccaccactcctggctgatttttgtatttttagtagagacggggtttcaccatgttggccaggctggcctcgaactcctgacctcaggtgactatgtgtctatttttttttctgaatgtcagtgaatttcttttattttattttattttttatactttaagttctaggatacatgtgcacaagatgcagatttgttacataggtatacatgtgccatgttggtttgctgcacccatcaacttgtcatttacattaggcatttctcctaatgctgtccttccctcagccccccaacccccgacaggccctggtgtgtgtgatgttccctgccttgtgtccatgtgttctcattgttcaacacccatctatgagtgagaacatgaagtgtttggttttctgtccttgtgatagttgacttagaatgatggtttccagcttcatccatgtccctgcaaaggacatgaacttagtattccatggtgtatatgtgccacattttcttaatccagtctatcattgttggacatttgggttgggtccaagtctttgctattgtgaatagtgccgcaataaacatacgtgtgcatgcatctttatagtagcatgatttataatcctttgggtatatacccagtaatgggatggctgggtcaaatggtatttctagttctaggtccttgaggaattgccacactgtcttccacaatagttgaactaatttacactcccatcaacagtgtaaaagcgttcctatttcttcacatcctctccagcatctgttgtttcctgactttttaatgattgccattctaactggcrtgagatggtatctcatcatagttttgatttgcatttctctgatgaccagtgatgatgagcattttttcatgtgtctgttggctgcataaatgtcttcttttgagaaaagtctgttcatatcctttgcccactttttgatggggttgtttgtttttttcttgtaaatttgtttaagttctttttagattctggatattagccctttgtcacatgggtagattgcaaaatgtttctccctttatgtgggttgcctgttcactctgatggtattttcttttgctgtgcagaagctctttagtttaattagatcccatttgtctattttggcttttgttgtcattgcttttggtgttttagtcatgaaggctttgcccatgcctatgtcctgaatggtattgcctaggttttcttctagggtttttatggtgttaggtcttacatttaagtctgtgctccatcttgagttatttttttgtataagatataaggaagggatcctgtttcagctttctacatatggttcgccagttttcccagcaccatttattaaataggaaatcctttccccatttcttgtttttgtcaggtttgtcaaagattagatagttgtagatgtgtggtattatttctgaggcctctgttctgttgcattggtctatgcttctgttttggtaccagtaccatgctgttttggttactgtagccttgtagtatagtttgatgtcaggtagtgtgatgcctccaactttgttctttttgcttaggattgtcttggctatgtgggctcttttttggttccatatgaattttaaagtaggtttttccaattctatgaagaaagtcagtggtagcttgatgggtatggcattgaatgtataaattaccttgggcagtatggccattttcatgattttgattcttcctatccatgagcatggaatgtttttccatttgcttgtgtcctcttttattttgttgggcagtggtttgtagttctccttgaagagggccttcacatcacttttaagttggattcctagattttattctctttgtagtaattgtgaatgggagttcactcatgatttggctctctgtttgtctgctattggtgtataggaatgcttgtgatttttgtacattggttttgtatcctgagactttgctgaagtatcctaattgaataccctttatttctttctcctgcctaattgccctggccaggacttccaacactacattgaataggagtggtgagagagggcatccttgtcttgtgccaattttcaaagggaatgcttccagtttttgccattcagtatgatattggctgtgggtttgtcataaatagctcttattatgagatacattccatcaatacctagtttattgagagtttttgacataaaaggctgttgaattttgttgaaggccttttctgcatctattgagataatcatgtggtttttgtcattggtactgtttatgtgatggattacgtttattgatttgcatatgttgaaccagccttgcatcccagagatgaagccgacttgatcatggtggataagctttttgatgtgctgctggattgggtttgtcagtattttattgaggacttttgcattgatgttcatcaggcatattggcctaaaattctcttcttttgttgtgtctctgccaggctttggtatcaggatgatgctgcctcataaaatgagtttgggaggattccctcttttttctattggttggaaattgtttcagaaggaatggtaccaactcttctttgtacctctggaagagtttggctgtgaatatgtctggtcctggactgttcttgattggtaggctattaattattgcctcaatttcagaacctgttattgstgtagtcagagattcaacttcttcctggtttagtcttgggagagtgtatgtgtccaggaatttatccattttttctagattttctagtttatttgcgtagaagtgtttatggtattctctgatggtagtttctatttctgtgggattggtggtgatattccctttattattatattatttttattgcatctatttgttcttctctcttttcttctttattagtcttgctagcagtctatctattttgttgatctttttgaaaaaaccagctcctggattcattgattttttgaagagtttttttgtgtgtgtgtgtgtctctttctttttcagttctgctctgatcttagttatttcttgccttctgctagcttttgaatttgtctatttttatactggtactatgttgtttgtttactgtagccttgtagtatagtttgaatttatgtagtgtgatgcctctggttttgttctttttgcttaggattgctttggctatttgggctcttttttggttttatatgagtttcagaaattttttttctaattctgtgaaaaacggtggtagtttgataggaatagcattgaatgtgtagattgctttgggcaatatggccattttagtgatattgattctttctgtcaataagcagggaattatttttatttttattttgtgtcatctctggtttctttgaaacagtgttttgtagatctccttgtagagatcttttacctccttggttagatgaattcttaggtcttttatttttgtgtgtggatattgtattaataaataggattgtgttcttgatttggatgtcagcttgagtgttattggtgtatagaaatgttattgattttaatacgttgattttgtattctgaaactttgctgaagttgtttatctgttctagaaaccttttggcagagacttcagggttttctaagtatagaatcatatcatctctgaagagagagagtttgattttttttttttctatttgaatgccttttatttctttttcttgcctgaatgttctagctagaacttccagtactgtgttgaaaatgagtagtgagagtgggcatctttttcttgttccagttcttaagggggaatgcttccagcttttgctcattcagtatgatgttggctgtgggtttgtcatagatggctattattattttgagatatgctcgttaggttttttaacatgaagggattttggattttggcaaaatcttcttttgcatctattaagatgatatatggttttgtttttaattctgtttatatggtaaatcacatttattgatttgcatatattgaatcactgttgcattattggagtgaagctcacttgatcatggtgaaataactttttgatgtgctgctgaattcggtttgctagtattttgctggggatttttgcatccatgttcattagggatgttggcctgtagttttcttttttcatcctgtctttgtcaggttttggtattatgatgatgttgctggctttgaacaatgagttagggagaagtttctcctcctctgttttttcgagcagtttcagcaggattggtagcagctcttttttgtatccctggtagaattcagctgtaaatccatctggttcagggcttttattggttggtagaatttttattattgattcaactttggaacttgttattgatcaggtcagagttttaatttcttcctgtttcaatcttgggaagttgtgtgtttccaggaatgtattcatttcctctagattttctagtttgtgtgcatagatagtgttcataatagtttctgaggatcttttgtatttctatgaaattggttataatgtcaccattgtcatttttttattgtgtttattggatcttcttccttttttctttgtttctgactagcagtgtatggatcttgtttattgtttcaaagaccaacttttggttttgttgatgctttttgtggattttcacttttcaattccattcagttttgctctgattttagatatttatattttctgttagctttgaattagtttcttcttgttttttctagttcccatagttgcaatgttagattgttaatttgagatctttctgactttttgatgtaggcatattgcactctaaactttcctcttaatgctgcttttgctgcatcccacagattttggtatgttgtatctctgttttcattaatttcaaataattttctattttttgccttgattttgctgtttacccaaaagtcatccaggaacaagttgtctaattttaatgtaattgtgtggttttgggatgtttaattgttattgatttgtttttattgcattgtggtccaagagtatggttggtatgtttcattctttaaagttatttgagacttgctttatggctgagcatgtgatcagtcttgcagtatgttctgtgtgcagatgagaagaatgtatattctgtggttgatgagtggagtattctgtagatgtttattagatccagttggtcaagtgtcaaatataagtccataatttctttgttagagttctgcctcagtgatctgtctaatgctgtcagtggtgtgttgaagtcctcctctattatgtgactatctaagtctttttgtaggtctataggcagttgtgttctgaatctgggtgctctgatgttgggtgcagagatattttagatagttaagtcttcttgttgaattgaacactttatcattatgtaatacccttctttgttcttttttttttttactgtagatggtttaaagtctgttttatcttatgaaagaatatcaatcactgctcttttttgttttccatttatgtgatagactgatatagtttggatatgtgttcctatccaaatctcatgtcgaattgtaatcctcagtgttggaggtgtggcctggtgagtggagactggatcatgggggtggatttctcatgaatggtttagtaccattcccttggtactgtctttgcaatagtgagtgagttatcatgagatcgattgtttaaaagtatgtagcacctccccctctctgctcttgctcctgccatataagatgcctgctccctctttgccttccaccatgattggaagctccctgagacctccccagaagcagaagctgctatgcttcccgtatagtctgtagaactgtaagtcaattaaacctcttttatttataaattacccagtctcaggtattctttatagcaatgtgaaaactgactaatacatagatgcttctccatccctttactttgcccctatggctgttatgtgtgattggtctcttgaagagagaagacatttggttcttgttttttttttttttttttcctgcttgctctctatgccttttagatggggcatctatatcatttacattcaagattaatattgatatgtgaggttttgawccagtcatgatattattagcttgtagctttgtattctcaattgcattgtttctttatagggtctgtgggctctgtacttacatatgtttttatggtagcaggtgttgttctttcttttttatgtttagggctcccttaaagatctcatttatagctgggctagtggtaataaattcccttagtgtttgcttgtccagaaaagattttatttctcctgtactatgaagcttagtttggtggggtttgaaattcttgattggaatttcatttctttagggatgccgaaaataggctcccaattttttcttgcttgaaaagtagaaacctactgagaagtctgctgttagcctgctggggttgccttttgaagtaatctgacccttttttctagctacctttttgatttttccttctttgttgacttagaaaagtctgattacaaaatgccttcagaatgatcttcttgtttagcatttcatgagggttctctgagtttcttgggattgcatgttgacttctctagtgagacttgggaaattttcctggactaggtactcaaatatgtttcaaagtttcttactctcctctctcaagaaagccaatgagtcatagatttggtctctacataatcccatatttctttgaggctttaaaaggttcatcaaaaaatttttttctttatttttgtctgactaagctctgaaattctttcctcaggttggtctagtctgttattgaagcttccaactgtattttgaaatttctgcagtaaaattttcaattctataagttcagtttggttctttcttaaaatgactatgtcatctttcaactcttagatcgttttacttgcttccttggattggctttcaactttttcttgaatctcatcgagcttcctacccatccagattctgaattctatgtctgtcatttccacattttaatctagttagggtgtattgctgggtaggtagtgtgatcttttgaaggtaaggaaacactctgacttttttaattaccagagtcattgtactgatttcttctcacctgagagggctagtgtttctttgtttctttctttttttttttttttaaagttatgtcatttgaatgggcctttttgtttttgtacttttttcacttgagggtttgactgtatatagtcaattggtcctttttctaggtgctttcagagaaccaaggctctgtatgggttccttcgttgtgattagttttgctgcattgggtttcacaggtgatgcatatttatggaatttatttatgttttcgtggtgtcatctaggctgcattctattagatggtgcttaagagtaagggctagcagataggatcttgctcagccatgcatgtctcttatatttcattctgttcacagcagtgttctggggaggagaagacgagggggtgggtgcaagtgatgacccccttaccaaatccattctggggccttgggggagacctctttaatcactgttgcagtgcctgcatttccttagccccaagggggtccctggtgggctgcacctccttctcttttgggggaagcctgagctgaaggtcagttgtaaggagacttacaactctctgacgacccactggtcctctgtgcctggcaagagtcagaatgggttgtggggtatgtctatgggtggtctgttgatgtagtaggtcaagtgtagaagatacctgggcagggtatccttgtagctaggactcctgaggtccccagaattccttaactcaccccttctttagggcctttgcaggactaggagcttgttctggcactcagggactctatgtaggcttcctagcttcctccttcttcaaactgggtgtctgtggttcttttttgtcaacttttaatgttttctctcaaaagatctgtgcaaagtgtgatggtttaccccatattttgttttttccttggtgagacagatgtttcctggctgtgtctagttggccatctggtccaagatccccttttcatttttgtaatagtgtcttttgagaagcaaaatgttttagtgttgatgaagtccagttcagttttcttttatagtttcgtgccctgcttaaaatatctttgccagacccaacatcactaagattttcttctatgttttcttctaggagttaaagtattaactctaaaatttaacaggtctgtgacccattttgaattaatttttgtgtatcatgaggtaagtgtggagatttttttttgcatatggttagtcattcttccagcatggcttattgaaaatattatccttttctcatcaaattgctttgctcttttgttgaaaattaattattcatatatatccaggtttatttctggactctgtattttgctccattaatttatatgtctatattcaacccaaaaatgtgttgcggtgattactgaggctttatgttgaattctgaagtcagacagttcaagttcttggacttttaaaattaattttttagcattgttttggctcttctttttttctcatttaatgtatggtggtgctcataccctcacccctttattgttctttgtaatagcttcccttgctattcttgcatgcttactatttataagaactttggggtcagctactttgttcaaaaataaaagaataacatcaaaagtcccccaaaccaactgttgtatttttattatgatggttttatatttataaattatcttaagaagaattgacatatttatgatgtcgtgtttttctagctgatgtaatttcattttctgaagtcttcttttgtgttttcagttgtgttgttaggttttcttcctatagatcttacatactttctattaagtttactctagtgtcttttctgctatcgtaaatggcatattttattgaatatatgaagccttgtgctttctctgtattaatatgcatcatgatattgtagtaaattctcatattgtttatagtatttttttcagttgattctcttgggttttccagatatattttatcttctgggagatataacatyatgtttgatgtaaattaaatgatccacaattgagaaaatagtgttgatacaatgagagagaagaggaagagagtaatgcatttcagacagtgaggagagttaaaagttaggatacatgtggagaggttttcttagataagagcttggatagtttacactagtgggtgtatgaatgctaggctgctagatatggtggtgtatatctgtgaatatgtttcatctattatagtgaggatggtagagaaaatgttggaggtttgaggaaagagacgttaaacggttgtgtaggagaatgaattgactgcagaaatgcataaaagatcactgggaggaactgaagccccattgaagattatcattatgaatttaaagtgaaaccagtaaggatggtgtgtaatcctctcagcccatgtttagatatttgggttcaagtgggtggaaagctgtatttagtcaaagtataagttttaccaggttgattaaacaagggaagagagggccaccagggagctgattgtaatgatggaccatggaatctaagctaagtaaggaggcaatgtaactagaacagaaggaggtaaaatacagcaaaaagttgattaaggattgttatcaaagaatgagagggcgtgagctggaaaaatgggaagtaatattttggaactggatacttggagttgaggtcatggagggctgctgttattgataataaaaaagaggtccagatcaccatgaaatggctgaggacaagctcattgaagtttacaatttaaggatctgaggattgagggtactgggagattcagttatgtggaaatgacagatgcaaatgataaaatcataatcaaaatcttgtagcagttatagaaactgaagttaactgcagccagtagtagtaaaagttgtctaatttgatggcatgagttgcaaggctggatttttggagggaggtagaagggacacagttttctacaatgatgaggaagtaggacagtgatagttggaatatgagagagaaaatagccatcatttgtggaccctacaggggaagagagtccttggggaataactggcttttatttacagcaaagaggtggaggcagtattcaggaggagatagaacatgagggactttatgttctccagaggacatagtgtaatgggctctgaacttgggaagacagggtgaaattaaggatgcatagaccagagacctagtagtgagggaaaacccaggaactttgggtttcctgtggtgataaagaggttgatggaatttctcttgatggtctttaaagttgtaaggctatgagtgttgtggagacagatatagaactttgatactctctaactcctgtagatgatggtgtggaggctgggagaagggcagtgtgacttggagaataaggtctgggattccctcttcactatgaattatgcatatgtactactgacctaatacagattgtacacagtgcaatatataaagggaagaatgggataaaggtgaagtaatcaacatttttaaacggtttgaaaacgatgatagctttgtattatcattgcataatatctcaaggcattctatatacttaaagctaccttgacttttaatgatggtggatgaatgttcatattttaatattatgaaaaggtttttttttttgcttgacttcttgtcaggctgatttactcaggaatgatgaagaactcaccgcaggagcagaagttacagctccacctttttttttgtgcttacattatttgtatagccaccaattattatcaatcatcaattatttgtgtaatcataaattccatgattctttgcaagaatttttttctttcttttttgttttgtagggttagtttaaataaaactaggtaatgtattcagtaaatccactactcgtggctacacacagtatggtactttgcaacctgatgaaagctaggagatgagtgagtgtttcaccaacaactacttccttctgcctatctcatgaaatctgcctgtcttgtttacatttgatatagggacagggaatggggtcagtgtaatttctttttaaaatatcaataaagtttaatttctttctgtttttgataaaaataagtacaagtagaagttctgatattttcttctcacatcacaatgacataccccactttgacaaccattgacaaagtggtggtgttattgttaataagaaaacaaataaataaatcaatgttaatcttaaactatcatttggacaatagcaaagtattaatttggaagggattaaatttttttctatggtaggtttatgggtctagaattttcatggtcttgcattatcacctacacataggtgtaggaaacccttcattccttttcaaataagaaatagataccctaggttgttattagcaaagttttcagggaaagctcatatcgtcacccaaatttaaaatgtttgctttattgtaagaccagcaattaaatgggacctacccattgttgttagtattcaaatacagttttaaagaaaaaccataacttttttgctgcacatacttttccaagcctacttttgtaagatttttccttattaatatggatacttttgcttggatgcaattgcattccctagatatattgtttgtttcataagtaacatagtttgtgagtattaattagattgtagaataaatctattgtttattgctgaaggggccttttggcttcctaccaccggaaaacctttaaatctacagcaatgagattttttagtatctcttctctttctagttttattctcctctttaaaaaataaaaaatgtaaatgaataattcaagttacaaacatacatacaaatgggtaattcagccaagatatttgcagcatttatccttgcaagttgaaggtacttatcactttagttgctaggtgctcagacaaaggatgttaaaaataataaactcagcaataaatttttcttaatctgagatctgcagcaaccttgtagggttattttggagaatgtaagatgctacacaggcagttggtcaatttatctcccaggccccttggctaacccagctgggtagatcatgtcttttgtcttccttgttttatactgtgcattaactagctcttaaagcaggtatccaatgctcagaaagcaagacttttgtaatgttcctagtaatgagaaatgtttgttttagaaagctagccttgtgccaattgttaatgttagaagtttggaggagagtcagaattgggaccaagaatggaggcggagtgggctgctgtttgaaagatttaactgaaaatgcaaggactgcaatttacctttcaaacctgaagttcggtctcttcattagagacattgcagcttcattggtggcagtggctgagacttatttttccaatgaaaataccttcctcttcattccagtctttagtgatgactcttggtaaattcctgtggaaatcgttacattcatccgttcactcacacattcatctacttatttaacaaatatttattgagttctgtgcactgtccttgatgctgmaactatttttaaaaatcatggtacctgacctcaagcatcataaagcttatcccatcatcatactcctttcatttttggcacctaagaagtgactttaatcatttaatgtatatatcttgttttctcagctccttgtaacaattctcagttgttgaaaatgatgatttgcttgtcaagggaggcattctaagtaaacatcaaatttaactattgaattactagcaatctttatgtaacgtgcataacaggatgagttcaatggtacttttaaaacacaataataaattgtgaaatgctgcactgaattaaagtttagggagttcttgcagttactataatgcagaggttgttgcccagctgtaaagttgaataccttggagatgtgctgcttcttctctctctctttttgtagttcatgccccacagtagaccaatgaaaacagagtctcagagtggtgcccccgaattttagcatgcagtgggattgagaatcagtcttgtatggcacctaatctcaagaataattatgcaaagtagcagttcctatcatctacattttgtggaagtgaacactgacattcagacaggtgaatatgttgtctaaagctacagagctagtaagtggcggaagcaggatctgagcccagatcttctagctataaaacctttcccattttggaaacgtagtgctggccctcaaagatgtgacacttaggttttccttcccactgttttgcttttaacattttctaatgatttattttctgctagttggccattgtgtacatacctggaattaatatctgtgatggatagaataaaaaggatgaaggaaaaaagatgctactttctgtgacggatagaatggaaaggatagaaagaagagaggaaagaaagtgctactgggttcttctctgttagggctagtagtttcagggaagggcttgaagacacaggagatagtaggagttccattatttcggaatgcttacttttacttgtttaatccgttgtgagagtactggagcaatagttacatttcgtagtaacagtgaattggaattatgtgttagatatgatcactgctaacatacaggaaaaatggaacattcatacctttctatcttaattttaagtagtgtagttagccacagtgaattagcatgaggcatgagaccttttttttttattcttttgcataaagggatcttaggtttcagtaaggaataatactacttggaacttttccactttctggaaagggagactttagattattattcctttgtcctgtgggaatttcatcacctggaggattatttcaagtcaaggaataaatacatcagcacaggtatgccttgctcagtgttttcaaaactgtcatggaagatggtggtggtaaatataaaaggaatggcctcttcaaatcatgcagctttctatttgttcctgttagcattttaatcatctgaaggcagatttagggggtcctaggatctggttgatgtgctttttgttagaactcagacaatcactttttcccctggttgtccccgtacccgatcacacttctatcatcacacttagattattgtatggaagtatatttgtttattacttgtctctatcccctgctagtttgtgcaatctttaaaggcaaatattgtgttattttcagtttgtttacctaatgcctagcacagtgcttggcatatattaaatgcttaatacatgtttggtgaattaaattgcatttgtcttttgatgatcattttcaggaaatggaatgttaagcctgacttctggttaatattaaattattttctctaacagagtatgtcagagtgtttcagagagtgcattaaaatcccagcagttatcttcccaggccaccacttttcctcttgttaggaaacagtatttatcatagtaaatagcccatttgaggtggttcattcaggctttagtaccaaatttaacataacaggaagtcacaaattcccttttggccagaaaggagtttgacagcttctctcagaaaaataactttgcattaatttactctgctttattcatgaaaggtataaaaatctataaacattttatagctattcagaggtggtaaacaacacgctggccaactacttatgcttttaataggcatgttttatgccttgtatataatttttaaaaaattatagcttggttttttgtttaaatactcagttacattatcttttttgtagatggtgctttgtgaaatgtttcgtggtttataacatttagaatatgtgaaacttttgctgtatgctttcttgtagaagagatttttttatttgaaagtgtagttttaattcatatacagtaaaattgacttttttggtgtatatttctatgagttttggaaaataggtagagttatgtaacccattaccacagttaagataaagaacaatttcaatatacctcctctaatattctcttatcttctccctttgaagtcaaatcttccccatacctttaacacctgacacccactcatctgttttgcctattccagaatgttatatgaatgagtggaatcatactatatctagccttttgagtctgacttctttcacttagcataaagcatttgagattcatccctttgttgcatgtatcaatagtttatttatctttattgttggatactatttcacactatgggtgtatcaccatttttaaaaacacatgtctatttgaggggaatgcaggttatttacagcttttggtaattatgaataatgcatatatatatatatatatatatacacatacttttttcacatacagattttttttttgtatgaatagaggttttcacttgggtaaatacctagaagtaggatttttgggtaatatgctaaatatatgtttaactttataagaaactggaaaactgtttttcacaggactatgccattttctattctcatcagcaacctatgagagctccagttgctttacatcctcaccagcatctggcattgtttgttttatttagtcattctattaggcaaatagtggtgtaaagatgtttctcagtcatctttgggtaattttctttgttgttggtggtgggttttttattacataatttttttttttttttttactaaccatttggtcatcattcacacagatctttatggttataatcttaaaaacttaagtttagtgctggtattccaagctactgctttagtccatttattaaggaaacacactagtgctatgagaaagtataaatattattgtggattaggactgaacttttactaattaacattaaatgaaagcaacaagtttcccctcctccaactatctttctctcctatacattgtccccagcaatccagtctttctataatggtgctttcttcataccaacatttgttcatgaccctttactgattctctcacaaccatggtatggtctagtagttaagggcagagactctgacattcactaggcatggttttattctcagctctgccacacgctagctgagtgaccttgacagattaatatagctaaacctcagtttgtcattttcaaataggtcatgataagacctaaataaaacattttgcacaagtggtcagggctcaatacatgcccgaaattggtaattaaattaccatctgcaacaggactcatcttatttgactagccttgtctgtcacagttcatcatcacaaatcttctgacataattaagctgatatactgagtgccctgataccttaccttaatcctcctgtgtaggggttcccacttaagtgtgattaatccatgtctgagtatgagtgttgaacaactgtgtaggtcataaggagttgctttgcctgggagctctaggctgaggttggaggaaatcaattagcaaagcctactggaagataacctggaatagccattacagcatgcttctttgtcattttattttttatgttattttattgttgtaaaacatttaatatgagatctactttcaacaaattttttaagtgtgcaatatagtattgataactataggtacaatgttgtacagcagatctctagaacttatttatcttgattaattgaaactttactccccttgattatcaacttccctttttcttctcccttgagtccctggcaatcaccattccattctttgagtctatgaatttaactattttcgatacttcatataggtggaatcatgcagtatttgtcctttgatgactggcttttttcacttagcacaatttcctcagtcatctctggtgtcatatattgcagaatttccttctttttaaaggctgaataatattccattgtatatagatacaacattttctttattcattcatttgttgatggacatttagattgtttccacattttagctattgtagatagtgctgcaatgaacctgggaatgctaattgctctttgaagtcctgatctcagttcttttggataaatacccagagtgggactgctgaatcatatggtagttctatttttaatttttaaagaaacttcatgttgttttccatagcggccataccattttgcatttccactgacagtgtgcaaaggttccagtttctccatatccttgacaacacttatctttcatctttttgataatagccattctaacaggtgtgagatgatatctcattgtggttgtgatttgtatttccttgatgattaatgatgttgcgtatattttcacatagatactgtgacatagtctgttcaagtttttttgccccatttaaaaaattgggttattagtctttttgctgttgagttgtgggagttccttatatattttaggaattatctccttatcagatatatggtgatatggtttggatgttttgtcccctccaaatctcacgttgaaatgtgacctccaatgttggaggtgagcctaatgggaggtgtttgggtcatggggaaagatcccttatgaaaatcttggtgctgtccttgcagtaacaagtgggttctcattctgtgaattcatgtgcgatctggttgtttaaaagtgccgggcacctcctccctctgtctcttgctctctctcttatcatgtgaaacgcaggctccccctttcccttccaccattgttggaagcttcttgaggccctcactgggagcagatactggtgccacgctttgtgtacagcctgcagaacagtgggccaaaataagcctcttttctttataaattaccctgtctcaggtattcctttatggcaatgcagaatggactaacacatatggtttgtaaacattttttcctattctgtaggttgcgttttcaccctgtcaatcgtttcctttgctgtgcagaagctttctcctttgatgtgggctcatttgtttatttttgcttttgttgcttgtgtttttgatgagatattcatgaaatcactgccaagaccaaggtcatgaagattttccactatgttttcttctagaagttttatagtttcaggtcttatgtttgtctttaatctactttgagttgaatgttatgtatggtgtaagggttcaatttcgtgtttttgcatatggatatgagtttttacaccatttgttgaagagactatcctttccccattgtgtatttttggcacccttgttgaagatcagttgacctttggcatgctgcttgttttttatattgacgtttctggtttggtgaagcagagtacaggtagtgctgaaggagttgttttcatgagtgtagtgttggtgtttagttgaaaaaacaaatgccacagaatgtggaagagaagcctccattgtatttggtttttgtgttttttttttttttttttcaggaaaacactaaattttactttctatctgatgcatcatataaattcttttctatgagtagtctcttgagtggattctcttgattaaaaaaaccagatttttctggatacacctcaaaacctaaattacctttgtacactaacatttactaaaaaattgataagagcaacatgttaaatattgaaactaagagtactcaactttactatccatcctaactttcaaagaatttacttctgagttcagcagactcaaattctacaaggatacagtttgtttcattcatcaacatatatccagcacctaacatagtagtacacggcacagagtgggtgttcagcaaatatttgtcaatgattgaacgaatttttttaccagaaagtgaaaaaagtgactttaaataatggcaagagaatactgtttcattatgcaacaataggagcttttgtaaaaattctgggattactggctgggtacagtgtctcatgcctgtaatcccagcactttgggaggctgaggtgggaaaatggctttgagctcaggagttccagaccagcctgggcaacatggtgaaaccccatctctacaaaaaacaaaacaaaacaaaacccaaattagctgggcattggtggctcatgcccatagtcccagctacttgggaggctgaggctagagaatcgcttgascctgggaagcagaagttgcagtgagctgagatctctagcctgggagacagaatgagaccctgtctcaaaaaaaaaaaaaaattctaggattacttattataagtagatcaagaattagataaaataacttcctccaataataaaaaaattctcataattttaactcattagagtgattctgactcagggaggactgcaggaaatagaatgcctctgtggtcccttggaggcaggcagctctttgagtatcacatctgctgtctcaagctgagggcacaagcaggagggacaatgatgtggcattgatatcagtgggaaagggtttctaaatgtaagttcatgagggaatgatcttgacactctttaaggcttcacagaaattcttcaggaaggagacctgacattagatagttgagggaagaaatttggattatttctattaatgaactctcatctatcgccacgagattaggaaggcctgcagaaactcacttataactagaagtttctctctccatattttctacttgtccatatacagtgtgccctttaaggtccaagcctcgtctgttctaataaggtccatttattcattaatttaatttaaagcacttaaggaaaaaaaaacttttactctagaatagtatatctggtgaaaacatccgtcaaagatgaaagagaaataaaaacattcccagacaaacaaaagctgagggatttcaccaacaccagacctgtcctgcaagaaatggaaaagagagtacttcaattagaaagaaaagtatattaatgagcaataagaaatcacctgaaggtacaaaactcattgataatagtaagtacacagaaatacacataatattataacactgtaattgtggtgcataaactactcttaagtggaaagactacaggatgagccaataaaaataataactacaaagcttttaaagacttagatagtacaataaggtataaatagaaacaaaaaagttaaaaagtgagggaacaaagtatagagtttttattagttttctttttgtttgtttctttctttctacaaacaacttaagtagttatcaggctaaaataataggttataagatagtatttgcaagcctcatggaagcctcaaaccaaaaatatacaatggatacaatcagaaaataaamaaaacaagaaactaaacattaccagagaaaacaccttcattcaaagggagacatgaagggaagaaagaaggaagagaagaccacaaaacaacyagaaaacaaacaacaaaatggcaggagtaagtccttttttaacaataataacattgaatgtaaatggactaaactctccaatcgaaagacattgagtggctgaatggataaaaaaataagacccattgatctgtgccttacaaaaaacacacttcacctataaagacacagatagactaaaaataaagggatgggaaaagatattccatgcaaatggaaactaaaaaagagcagaagtagatacatttatatcagacaaaatagatttcaaggcgaaaacaataagaagagacaaagaaagtcactatataatgataaaggcatcaatccagcaagaggatataacaattttaaatatatatgcacccaacactgaagcgcccagatatataaagcaaatattattagagctaaagagagaggcccctaataatagctggagacttcaacaccccactttcagcattgaacagatctaccagacagaaaatcaacaaagaaacattggacttaatctgcactatgaaccaaatggatctagtagatatttacagaacatgtcatccaatgaatacacattctttccttcagcacgtggattattctcaaggatagaccatgtgttaggtcacaaaacaagtcttaaaacattcaaaagaattgaaatatcaagcatcttctctgaccacaagaaataaaactacaaaccaataacaggaggaattttggaaactatacaaataaaaggaaattaaacaacctgctctagaatgaccactgggtcaatgaagaaattaagaaggaaattgaaaaattttttgaaacaaatgataatggaaacacaacataccaaaacctgtggaatgcagtaaaatcagtaccaggagggaagtttatatctataaatgtctatatcaaaaaagaaaaaaaaacttcaaataaataacataatgaggaattttaaagaactggaaaagtgagagaaaatgcaaaccccacattagtagaagaaactataaataaagattagagcagaaataaatgaaattgaaatgaaaacaatataaaagatcaatgaaacaaaaagttggtgttttaaaaagytaaacaaaattgacaaacctttaggcagagtaagaaaaaggagagaagatccaaataaataaaatcacatatgaaaaagggggacatacaactgataccacagaaattcaaaggatcattagtggctactatgagcaactataagctaataaggtgaaacaatctagaagaaatggaaaaattcgtagacacatacaacctatcaagattgaaccatgaagaaataaaaaacctgaacagatcaataccaagtgacaagattgaagctgtagtaaaagtctcctagtaaagaaaagcccagacccagtggctttactgctgaatcctagtaaacatttaaagaagaactaataccaatgctagtaaaaatattccaaaaaatagaggaggagggaaaaattccaaactctctctttgaggccagtggtaccctgatgtcaaaaaccagacaaagacacatcagaaaaaaaaagagaaagaaaactacaggccaatatctctgatgaatattgatgcaaaaatcctcaacaaaatactagcaaaccaaattcaacaattaattaaaaaggtcattcatcatgaacaagtggattttatccctgggatgcaaggatggttcaacatacatgaaacaatcaatgtgatatatcatatcaacagaatgaaggacaaaaatcatacattcatttcaattgaaattgatgctgaaaaagcatttcataaaatttaacatcctttcatgataaaaaccctaaaaaacctgggtatagaatgagcatacttcaacataataaaagctatagtattatactataataaaataaaatataattaatataatataataaaatataaaatatataatataataaaagctgtagtgttatactagctggggatctgtcatatagaatggagaaaaaattgaaagcctttccactaagatctggaacacacaaagatgctcacttccaccactgttattcaacatagtactggaagtcctagatagagcaatcagacaagagaaaaaataaagagcatccaattggaaaggaagaagtgaaattatgcttgtttgcagattatatcatcttatatttgcaaaaatctaaatattctgccaaaaaactgttagaactgataaacaaattcagtaaagctgtaggatgcaaaatcaacatacaaaaatcagtagcatttctatatgccaacagtgaacaatatgaaaaaatattaaaatggaatcccatttacaatagccacaaataaaattaaatacctagaaattaacttaaccaaagaagtgaaagatctttataatggaaactataaaacactcatgaaagaaatagaagaagacaccaaaaaatggaaagatattccatgttcatggattggaaaaaatcaatattgttaaaatgtccatacaacctaaagtaatctatatatttaatgcaatccctattaaaacaccaatgacattcttcacagaaatagaaaaaaactatcctaaaatttatatgggctgggcgcggtgcctcacacctgtaatcccagcactttgggaggccaaggcgggcagatcacttgaggtcaggagttcgagaccagcctggccaacatggtgaaacactgtctctactaaaaatacaaaaattagctgggtatggtggtgcacctgtaatcccagctactcagaagcctgaggcacaagaattgcttgaacgtgggaggcagaggttgcagtgagccaagatcgtgccactgtactctagcctgggtgatagagcaagagtcagtctcaaaagaaaaggaaaattatgtggaaccacgaaagagccagaacagccaaagccatccaaaaaaagaaaaaaacaaaacaaaacaaaactggagaaattatattacctaacttcaaatttactacagagctatagtaaccaatactgcatggtactggcataaaaacagacacacaggccaatggaacagaataaagaatccagaaactaattcacacacctgcagtgaactcattttcgacaaaggtgccaagaacatacattggcgaaaaaagacagtctcttcaataaatgctgctgggaaaactggatatccatgtacagaagaatgaaactagacccctatctcttccatatacaaaaatcaaatcaaaatggattgaatatttaaatctaagatctcaaactatgaaactactacagaaaacgttggagaaaatctccaggacattggagtgggcaaagattccttgagtaacaccccacaagcacaggcacctaaaacaaaacaggacaaatgggatcacgtcaagttgcaaatcattcactcagctaaagatacaaccaacaggccgggtgcggtggctcacgcctgtaatcccagcactttgggaggccgaggtgggtggatcacaaggtcaggagattgagaccatcctggcttaacacggtgaaaccctgtctctactaaaaatacaaaaaattagccgggcatggtggtgggcgcctgtagtcccagctattcgggaggctgaggcaggagaatggcatgaacccgggaggcggagcttgccgtgagccgagaccgcgcctttgcactccagcctgggcgacagagtgagactctgtctaaaaaaaaaaaaaaaaaaaaaaagaagaaaaataaataaattaaaagaataaaaaatatatactgggaaactacgaatcaaaagaaaactggaatagctatgttagaatagatggagtttgaggcaaaaaaaagacacataaatggcaaaaaggcatatggaaggtgctaaatatcattgctcatcagaaaaatgcaaagcaagactataattatacatcatctcaccgtagttaaaatggcttatacccaaaagacaggcaataacaaatgctaatgaggatatggagaaaagggagtcattgtacactcttggtgggattataaattagtacaaccattatagagaacagttttgaggtttctcaaaaactaaaaatagagctaccaaatgatgcagcaatcccattgctaggtatatgccccaaagaaaggaaatcaatatattgaagagatatctggactcccatgtttgttgcaatactgttcacaatagacaaaatttggaagcaacttaagtgtccatcaacagatgaatggataaagaaaatgtggtacatatacacaatggagtagtatttggccataaaaaagaataagatcctgtcatttggaaccacatggatggaactggagatcattaagttaagtgaaataagcaaggcacagaaagacaaacattgcatgttctcacttatttgtgggatctaaaaatcaaaacaattgaactcatgtagatggagagtagaatgtggttaccagaggctgggaagtgtagttgtggggaggtgacgcagagatggaaatggtaaatgggtacaaaaaaaaagtagaaagaatgaataagacctactatttgacagcacaacagagtgactatagtcaataataatttaattatacattctgaaataactaaaagtgtaatttgattgtaacacaaaggataaatgcttgagacaattgataccccatcctccgtgatgtgattattatgctttccatgcctgtatcaaaatgccttatgtaccctataaatatttatacctactatgtacccacaaaaattaaaaattgaaaaaataaataaaaacctatatgtcttatttcaataactagattgtaaaatcctcgaggacttaacactcctttgtcttgccatccctgtttactctgtttacgcttctacttcctccatccctttaatatgtagtaaaagttgaaaaaaatgtactattcagtttccattgacaccaaaaagaaatatcaaacatgacaatatccactagatgtttttcttccttttcaaagtgtaatactatattcatcagaacatttcattctatataaaaagctacttattttaagccacatcttatgtaaaattgcttaacaacttgatacattcaattagagtagaagttctggggaaacagcagtagcaggtgaatctgaacggttgtgccatagttaaaaggaagacttcctgattggctttcctggagcagattatgcctcttagaggccaaactgcacctgggatttggtcctacaaaaacacagcagagcagcaaattcaggacaatctttgcctgttagtcttaagtaaaacaattatgaaatcattttttgaacctgatatattagcatgctgagtgtgttaaaggcaatcttatcatagacactgcatgggcagttttttgcattcaaaccatgtctatggagataccaaagagcttcaggaaagaccagataaatttcacaagattttttattttttacttcattttttcttcataaatttgagaagattttaacattatttttcttacctttgacttttattttggaatattctggtaatattatttaaacataattttaaatgaaatttgacttttaaaaatacaatmagcaaacttataaatccctcctccttcctcctgcccttgttaggtattatattttatttgtacaaagccatagcaaacattccaagcattcttttctatatctcatacttgaaatgactaattggatactgaaaatataagcaggacaattaatatattaatgaacaatattattttattaggcatttaaatattttgggataaagaagaaaaactgaaagcacacatctttttacacatttatttggagataaataatacacatctcactttctaggctgaagtgagaaaatatttttggtcgtatattggcataaggaataaacatcatattccaactgaacagttcttatttattacaattttctaaatcaatcaaaacaaagcacatcttcacaaagtaatggctagaacaacaataatttcttagagatatgttacatctgatctattttcactgtaagagcactcacttttaataacagctatttcaacataagagtattcttttcatggactttgtaaattaggaacatgatcattgcctagagcataatatatcagaaacatgttgtatttagttctcttttcattttagatttttctagttctccgtagtaaaaagtattgtaggtataacttatttgacatgaaactgggatattttatggaataccggagttggataaacattaacatttctgattgtcactctaactccaacaactaaacattgtaggcttttgagtttgcctataatccttaggatatatcgtgtatatcctaattttgcttcagtattgccattatttagttggaacaagatctgggaattgtgatatttaatttctttattgaaccaccatgtgatattggataagtcattagctttgcccaaacttgatgtgattatgtgtgcattactaataggtaagctaggatttatgtccactttggaaaaaaaagacaataaaaatatagtcttaataaggacaagattttgctttctttgctcagggatagaatttatcctgaagaatgagtgattgcaagaagcccaccatggccatgtaaaggtgacaaccagtacctggtctagagcctctccaaggatttttgcaactcagccacttctccattctacaagacttcaattcattttcttatgagctagaagagaaatattggtcaactttcataatttattgaggcagctgaggttaggtgggttatgaagaccccaatgattccatgaaagaggggagcaaacttcaagtcttatgactcttatctcatgctgtattcattggttgaagaataggttgcttgttacatggaaacaratgtttacagatatcatcaaagaaatgttgacatcgaaaagactgttacatattttttgctttttggtggctacagcaagattggcagaaatgtcttttacctcatccatcttaagtgagatgatgttgttagctattgtaggcaagctactgcagtttgcttatacacaattgcttcatgagacatttactggaagaaggttgttttgattttcctgtcatttgcacaactattttaagatattctgagtctcatttatgattccttatcagtgattgccattagctacaatttttttttctgttattttctctcctgggctttattggcatttgtataataaagagaagaattggtctctgatatggtgtggatgtttgtcccctccacatttcatgttgaaatgtaattcccagtgttgaaactgtggcctggtgggaggtgtttggatcatgggggcaggtccctcggtccctcataaatggcttggtgtactccccttagtgatgagggagttcttgctttgagttcatgtgagatctgattgtttaaaagtatatggcacctccccccacaccttgctcatgctgtcaccatgtgacaagccagcttccctttccttctgccatgactgtaagctcactgaagccctcacaagaagcaaatgccagctccatgtttcctgtacagtctgcagaactgtgaaccaattaaacctgttttctttataaattacccagccttgggtatttctttacagcagtacaagaatagcctaacacaatctggctcctgaagatgaaacaaattaattaatacatttcaagtattttcctaggtctccctctctttatatatagaggcataccttggagatattgtgtgttttatttcagactactgcaataaagcaaatattgcaataaagtgtcgctcaaattttttgatttcccagtgcatataaaagttatgtttatactatactgtagcccattaagtgtgcaattgcattatatccaaaaacactgtgcatatgttaatttaaaaatactttattgctaaatgctaatgatcatttgagccttcagtggatcatgatctttctgctagtgaagggtcttacctcaatgttgatggctgttgattgatcagggtaatagttgccgtatgttgggtggctgtggcaatttcttaaaaataaggccacaatgaagttagacctattaattggctgttactttaatgaaaaatttctctatagcatgtgatgttgtttgatagcattttacccataatataacttctttcaaaattgtggtcaatcctttcaaacccggctactgctttatcaactaagtttatgtaatattccaaatcctttgttgtcatttaaacagtgttcactgcatcttcaccaggagtagattccatctcaagaaactactttcttggcacacccagtagaagcaactactcctccattcaagttttatcatgagattgcagcaattacccatatcttcaggcttcacttctaattccagttctcttgctatttctcttacatttactgttacttctgccattgaagtcttgaagccctcacagtttttcaagcaggttggaattgacttcttccaaactcctgttaatgctgattttgacctcctcccatgaatcgtgaatgctcttaatggcatctagaatggtgaattctttctagaaggtttttaatttactttgctcaggtccatcataggaattactatctatgacaggtatagcctatgaaatgtatttattaaataataaggcttgaaagttgaatttactccttgatccatgggctacagaatggatgttgtgttagcaagcatgaaaaatccatttatttccttgtatatctctatcagagctcttgggtgaccaggtgcattgtcaaagaactgtaatattttgaaaggaatcttttttctgagcagtaggtctccacagtgagcttaaaatattcagtataccatgccataaacaaatgtgctgtcatctaggctttgttacatttataaagcacaggcagagtagatttatcacagttcttaagggccctaggattttcagatggtaaatgaacattggcttcaattaagttgatgactttaagagtcatcagctgcattagccccagcaagagagtccacctgtcttttgaagctttgaaaccaagcattgacttttcctctctagctctgaaagtcctagatggaatcttcttctactaaaagggtgttttgtctacactgaaaatctgttgtttagtgtagccactttcatcaattatctgggctaatctcctggataatatgctgcagcttctccctcagcacctgctgcttcaccttgaacttttatgttatgaaggaaacttctttccctaaatcttataaaccaacctctgcgagcttccaacttttcttctgaagcttccttacttctctgagccttcatagaattgaaaagaggtaggtcttgctctgggttaggttttggcttaaggaaatgtttagcttttggtggaaagtgacagacctgctacagtttctttcatttgaacacttagagtcattttaggattattaattggcctaatttcaacattgtatctcaaggaataaaaaagccctaggagaaggagagatggaggagatggggacaactggttattggagcagcyagaacacataaaacattgagtaattaagttcactttcttttatgggtgctgttcatggtgccccacaacaattacgatggtaacatagatcacagatcattgtaacagatataataataatgaagaagtttgaaatattgtggaaattaccaaaatgtgacacagagacaggaagtgagcacatggtgttggaaaaatagcagttgacaccgatttgccacaaaccttcaatttgtaaaaaaaaaamaaaacactatttgtgaggtgccataaagtgaggcacaataaaacaaggttatatacacacatttacacacagtaagttctcaacgttgtcgataggttcttggagactacaactttaagcaaaatgatatgtaataaaacyaactttaccttaggctaatttacataaacaagcagtaagctcctacagcatgtttgtcatagaamtatcaaacttctaagtaaagactcaaaacacttttaatattaaacattgaaataaatgtgagccaaacatacattcaagaaagattaataaaaacaagtaagataattatttacccaagttttggtgaatcagtgagtgatagtggttgtagtggtgatgggttgaatcaaggaataaatgtttgcaaagtgagaattataaggagcacctcctatcaccacacagttcaaaaacaaacaataaatatggcaggcttgctgagcacttttggaccccactgtttggtgtcaaaataaatttattttacaataatttatattcattcattttccaacctgcttattcctgttcagggttgtgggtggctggtgcctatcctggcaggtcagggtgcaaggcaggaaccagcccttgacaggactccattccattgcagcctcactcatacacacactcccacactcactccaacttggacattgtagatacaataattaatctaatgtggacatctttgggatacgggaggaaactggtgtcccacgagaaaactcaaacagatggggagaatgtggaaaccccatactgacagtggctctggctggcagtagatttttttttctcatcaacgtgtgtgtgtatatgtgtgtgtgtgtgtgtatactattgaggaaacagtgtcatgaagttaagtgattttcaatatagaaatcattttatagataatctatacaaccaagctgttttttaaagaatttggattgtttttgtgcacagaaaactcaacagtgtacattaacccaggttagtggcaagttctttagtctttgccttttctagcttggcaatgcaagccacagattttggacccaggatgttgcctcctcagtgctgacagatctcattatatctaaccttgtagttagtactgatagcttccaccagctcagccagaactcctttgtcttctgagttaacatgtgtgaaggccacagtggcacaagtattcctggggactggatgtcttttaggcttgccttctcttgatagtgcagtaaggaactcccatcttaggatacagggcgagccctcagcaatcagcttgatggaacccacatcacgtgcagtcactaccatctgagccttcttgttttctaccaaggtggtgacagtgttaacccttgctcaaaggacaggtgttatcttagtgggaacatcttctttgccagcagctttcttcttctcttgctttgtctctgctctgtacttgtgggtcagtttcagcatttgagtagctgtttggcagtccaaagcctagatgaactggttaattgcaggaggcactttcagccattcatagaggatagctttttgctgatgcagccagatgcagtggggccctttgacaaaacaagtgaggttccttttgagatggatgtgctgtccaakgccaaaattcttagaccttttctcaaacaggggattcaccaccttgttggccttctgcttctttatgataagggactagarccaccttctctgccttggccttctttcctttcagcagcttgggtggctggaggaagcaacaagaccaaacattttgtataaaggatcttatgatattttattgtaaaatatsctttatagactgtaactaaaggaaatcctagtggtcctttgggtcaaataaggaaaatatattgcatatgtacagctatttcctcaatgtccttatggaagacttarcaaatcacccatgacactctacttttgtccagaatcagcctcataatccttcttaacacagtgcttcagccagccattatcagttgattgtaattgatgtgagagatgaaagtaagtgccatgtataatctagtagacctctcatttttcacatgaggcaactgaggcccaaggaggccagtgaccttaaaggacagtgtgatagctgaaattagagctgatgttcccagattttagtttcaatgttctttttactccatcatgtactcagtgagccaacaaaatagcatgggtatgaaatttccatgcctttttagaatcagccttattcaattttctaatcttcaggtttctgagttattgctattattatctgacctgtctacagtctttttaaatggggacaaaaaagtacagttccttgaagagcatttaaatccaacccagcataaaaccagcccacagaatatatgagctgttgatgatattatgtatataaaactgcaattaccataaaaatacagcaagaaatcttagcatcccaatgtaactgtaaatctaataacagcaataacagaatttcttagagaaaaaagctgcattggcctgttgttatttttgatcctagcttattatctgggtcaactgggaggtttttaggaacatcagccattttagtcttagttctgtttggtcatcagaagcttatgatgacctagtgcagtgaaggaagcactaatatacataactgattgtttcctgtttctttaattccatgaatacttgaagaacaaaggaaatgaacatgctaggaatctgcatttgaaagtagtcatgcttacacttttcattgcagtacgctttgataaagtatgtagactattctttctgatctttactatctaaaactggatcctcctccttcctttctacatttttgttgatttatttattgactgtgtgaatcataggggatcttcatataatccactgtgtagagacttgacgtaaagagtcatataaagaatgcaggggcattcacgtgctatagcttggagctaaattaaattacaggtaggaaaaagctttcagaggtgagtgtaatgcttactaactgtttgcaagctttcataaaacagttccagagttagagctgtaggagaaataccttcttattgagagtggacaatcgactccaaatcatgggatatgaaattagggaaaattgcttttaaaaaatgtgtaaagaaaaagagatataggctaacaggataaactgagcttgagtagatcttgaggaagcttagggcagtttacctgatttcattctgcatcaacagaacaggtaagtgttgtttaggtcaacatttcttaaaaaatgggatctgtatccatgaacctcctgcttatttaaaaatgtggatcactagttcctaatggaggagtcagacatcttacagaaatctatctctacagttcacagaaagtagttttatgctttagttctcaagcactggagctctgttatgaggaacaaagtttcctaattcaccttctttaagtgaatttttaggtttgccatttaggttcccaaattcagttctgctgaggcccagttaccatttttcaacactaaaaagaataggaaaatgcccttttgtttcactttataaagtttcaaaagcatgaatcagaaaatcattttactttggaacaaagattttctaggaaatttaatcttttattattcaagataattcaaccaaacactttgagccaattttaaatattttgtctacatctcattagactaatgcacttttcttccttttatttttctagacttaatcacacagattcctataagtaattaggtttttcattctttctaaactctttatcttagcacttcrttcattcagtcatgacatagtaatgtttgtggaatcccagttgcttttattgagaatggctatatattctctcattaagtaattatttttctttatgtttaataagggagaaagtagcctattgcctcagattcaggagtaaagatgaaattcactgggaagacgttatgtttgaaattttccttagggttcctcttcactgggtgaattcagttttagtgataaagcctaaaagttctcaacatctctaaaaatattatctttcttactctaaagcatgtggaaaaagttggctttggagaagttatgtttggctaggaaagatactatatctcatctcaagaatgttaacacatatatattcatctcactctgctaccaaggaagggaaagatgttcagatggccacatcacttgaatagctgagtgatagaactgccttctaggtcactgttccaaatctgaactagcccattctgtccctcccccggccctcccccagttggaggagaatcctttgttgattctcacaatactatgactagacaacatttgggagcaaaaataaaaaaatatgcttctaaatagccttaaatgaattgttttgtctttgtgataattccctgtgactttatgcttgtgacttcctgctgcctgcaagtgatgttggaaaatggaaacacagcagtttattcacttttctttatcctgcatgtctcaagcttggactttggcagttgaagtaagataatcattttgtgccataaaagaagaaaaacagtttgccaacaggagcctaaatttaacattagaagactgggaaatatggaagagaggtgatatcccagcaacactactccaacacagtaatctggcagtttctgtattcccaatttatttttaaaaaacaatgtcacttttgtcagtaaagacttaaaagcaattttgaatgtgtgtgggaaaaaaatacccagaaaatttccccctaaacctgatttttattgcttgatttgtggtttaaagtattttcataatatttataagtaaaggtggtttcagcaagtaygaattccaccattttgtccacaggattagtggggagggattttgaattcagatcttagctttggtgctggatgcctttaacaaattgcygtaattgcttttcctttatccgtattttacttctctttggcagggtgaaataccagtttatcccaggtatcgtctgaggaaggtttggggagtgatctgtatgtttagattttctgcctaactttattaatgtggtatgaataaggagctttttttttttagaaaatgacactttatacaagtcagttcctctctattttctttatggacggtactggggtggcagcaggactcaccatgaaaactgtagtggtaactctgttcttctgactgcctcccatgatcctgtgtaggaagctattaagcctgtagttaagttacttccatttcctcttgactaaattgatataatgatagtaatatatgctgcgcttatctttcagtgtgtcagtcactgtgccaatcgctttatatgtacgaactgattaatctttacagctcctaggagtagatcttactgttatctccatttcacagatgaggacccattggagactgtattcaaatccaggcagtttaaatatagaaatatttaagagctgcttcatgctgcctcctacagcatggctgggcagaatagacacagaacattcagaaatttgagttttgggaaacatrcaggagagagatgtgacagtgagatgttgcctccaatatgaattgtccttgtcttctaaaaacagaatcctgctaaattaatgaccaacagtaatagcagctatacctcccagtttcccttgcagctgtaattatgctttgagatgcaagtaagattaatgacatataagtgaaatttttattgggtaacttttgcaaacttccataaaagttagtctacctgcacactttggctcyatcctgctgcctggaatgtggatgtcatggttggaactctagctggcatcttggactatgaggataaggccayacctaaggtggcggagtgagaagttggaagacgcctgggttcctaggtattttataaagcagaaccactacatcagctcaggagcactttacctccagactttttttgtgaaagcaaagtaaacttctgtctcatttgaagcactgtgattttgagtgtctttaacttgcagctaattgctcatttcatacctacttaacaatgtggattgtaagtagcttcactatttgtgcatagtaagccctccgtaaatatttgttgatttgagttttttatctcttcccattttaatatttagaatcatctatttgagttactttataagaacagtgacaatatgtatgtatattctacattcaaaatcatgctgtaaatgtaaaataattgggcaacagggcctgagtggttttccttttttcttaaagtaatgaggaagatccaaatattagaatacaacttacaagtatcaaggtaaaactcccttgccacatccatgtagcaaaccaaatgtactttaagtatgttactatttattaccatttgacttttatttgattttatttttgagacagggtctcactttgtcacccaggctaaagtgcagtggcatcatctcagctgactgcagccttgacctcctgggttgaagcgatcctcctgcctcagcactccaagtagctgggactacaggcatgcatcactatgcccagctaatttttgtatttttagtacacatgggttttcccatgttgtccgggctggtcttgaactcctgagctcaagcggtccacccaccttggtctcccaaaatgctaggattataggcatgagcccttgcacccagcccatttgccattttatattaaacattagatcagtggggtaggatcaatggataaatcaattagaaagagtgattactggaaaaatcacttatgggtttatctggatgttacaaatcagaattctgatatttaatattatgctacatttatggtacaatgaaaaagtacatgtgtttatgtatgtttatattgaaaaagtttcaaaaccaaataagtcctataatatcctattaatcataaaaaaagaaaaagaattggygggggacaagatgaccaactagacgcaggcaggtggaacggctctcatgaagggactcagatgactgacacactcctaacacatcttcagagataaaggcactaagaatggacagagggaagacgcagaagctgggctgaagggtgagaaagctggaaacgctacatggggctacagtatacycacactcattcctggcccccagtggctctgagggaacaggtgagttgcactggcaaggagcaaactgcttttgccacaggcctctggaaccctggcagggggagaccccttgaccactatggacactcaagatggcatggagagctgcttagagaagggttaggggcagcagccagctgatgtggagcccgaagagtttggtgcaggactaggggaactgtcagtcctgaactctgcagggtggtcttgcccatcagacgaggccagtctgacctgagaaccccttggtctgctgtcctttcccagagccccagcctggctacacctgcttgcagagcagcctcgggtgccctggggtcccacaccatagcttctgcactggcagattgtgcctgactggtagagagctccagcaggatggcccctacagccatgcaccaacccccatgctccctcccatactgcagctttctttaggcctaaggcaactccccacattgctttgctggcatgtgtctgtggaggtgggttttgcttttcttgaccatcagcatttgggtgtgcagtctacccttcctctccccactgacctctgttgcagacagagtcttggtgggcacagagtcagccagccctgcccccgccagtgctctgcccttatggtaacactctgcagagaatggtggatcctcccatgcctgagcaatcattcctgcttgcgaggcacagagacctatacacccagacctgcacccatcagtgccccactcctgagccaaaacaccaccttcagggtgaccacacacacagtcaccagcggaggccccccagctgcgttgactttgccactgtggtgaacacttgcagggaggcaggcatcctggcacctgccacccactatgccacagctgttgctactgctgctactggcacttgtgagcaagaatgggtcccactgtcattgcactctgaaacactttggctgacaccacccgttggagtgtactgaccagtggtctgggagcacctcattctcccccacctccccagtgaagtggattcctaacctcaaggagccagagaacaaagttggggctcaatacaagtcccccagagttacagcatgcagtccaggagttgggagctaagcattggccctgtaaaatcttccagaaatgaaggcagttagctgaattcactttataccacaatcaaacttcaaggtcatcaaataggataaaaggaaaaaaaccccatccaaaggtcagcagttttaaagattgaaggaaggtaagtccacaaagatgagaaggaatcagcacaagaaccctgataactcaaaaagccagagtaccttctttgctccaaatgaccacatcacctctccagcaagggttctgaactggattgagatggctgaaatgacagaaatagaattcagaatatggataggaataaagatcattgagctacagaagtattttgaaacccaatccaaggaagctaaaaatcatgataaaatgatgcaggagctgacagtcaaaatagccagcctagaaaagaatctaattgacctgatagagctgaaaaacacactacaagaatttcatagtgcaatcacaagtattaatagcagaatagaacaagtggaggaaagaatcccagagcttgaaaactggctgtctgaaataagacattcagacaagaatagagaaaaaagaatgaaaaggaacaaacaaaacctccaagaaatatgggattatgtaaagagaccaaatctgtgactcatttttgtccctgaaagagatggggaaaatggaaccaacttggaaaatatatttcaggatatcatccagaacttccccagcctagctaaagaggccaacattcaaattcaggaaatgcagagaacccctaagatacttcacaagaagatcattctcaagacctataataatcagattctctccatggttgaaatgaaagaaaaagtgttaaaggcagctagagagaaaggtcaggtgacctacaaagggaagcccatcagactaacagtggagctttcagcagaaaccatacaagccagaggaaattgggggccaatattcaacattcttaaagaaaagaaatttcaacccagaaattcttatccggccaaactaagctgcataaatgaaggagaaataagatccttttcagacaggcaaatgctgagggaaattgttaccatcaactactttacaagaactcttaaaggtagcactaaatatggaaaggaaagactgttgtcagccactacaaaaacatactgaagtacacagacaagtgacactataaagcaactacataaacaagtctgcaaaacaaccaggtaacgtcatgatgacaggatcaaatccacacatatcattactaaccttgagtgtaaatggcttaaatgccccaattaaaaggcacagagtggcaagttagataaagaaccaaaaatcatagtatgctgtcttcaagagacccatctcacatgcagagacacacataaattcaaaataaagggatagagaaaaatataccaagcaaatggaaaacagataaaagcaggggttgcaatcctagtatctgacaaaacagatgttaagccagccaacaaagatcaaaaaatgcaaagaagggcattacataatagtaaaggggtcaagtcaacaagaagatcctaaatacctatgtgcccaacccaggagcacccagattcataaactaagttcttagagaccttcaaagaatcttacattcccacaatataatagggggagactttaacaccccactaacaatattagccagatcatcaagacagaaaataacaaagatattcaggacctgaactcagctctggatcaaatgtacctgctaaatatatacagaactctccaccccaaaacaacagattatacattcttctcatgaccacatggcacacattgtaaaattgatcacataatcagaagtaaaacaattctctacaaaatgcaaaagaactgaaatcataacataccatgtcatggactatagtgtaataaaatgagaaatcaagactaacaaattcactcaaagccacataatttcatgggaattgaataacctcctaaatgacttttgagtaaacagtgaaattaaggtagaaactaagaagttctttgaaaccagtgagaacaaagatacaacataccagaatctttgagacacagctaaggcagtgttaaaagggaaatttatagcactaaatgcccacatcaaaaagttagaaagatgtcaagttaacaacctaacaccacaactaaaagaactagagaaccaggagcaaacaaatcccaaagctagcagaagataagaaataaccaaaatcagagctgaactgaaggagattgagacacgagaaagcatttaaagatcaatgaatccaggaaccatttctttgaaaaaattaataaaatagaccactagctagactaataaagaaggaaagagagaagattcaaataaacataatcagaaacaacaaggacacattaccattgaccccacagaaatacaaataacaatcagagagtattatgaagacctctaagcacataaactagaaaatctggaagaaatagataaattcctagacacatacaacctcccaagactgaaccaggaagaactgaatctctgaattgatcaataatgagttctgaaattgagccgtaataaatagcctatcaatcaaaaaagccaagaaccaggtggattcatagctgaattctaccacatgtacaaggaagagctggtaccattactgctgaaactattccaaacaaaagtgagaaggagggtcttctttctacctcatctatgaggccagcatcatcctgataccaaaatctggcaagacaaaaaaaaaaaaaggagaaaatttcagactaatatccttgaagaacattgatgcaaaaatcctcaacaaaatactggtaaactgaatccagcagcacatcaaaaatattatccaccataatcgattaggctttatccctagaatgcaaggttggttcaatgtatgcaaatcaataaatgtgattcatcacataacagaagtaaaaacaaaagccacatgattatcttaatagatgcagaaaaggctttttgataaattcaacattccttcatgttaaaaacactcaataaactaggtattgaaggaacataccttaaattaataagagccatctatgacaaactcattcagtcaacatcatactgatgggcaaaagctagaagcatttctagtatttcccattgaaaaccagcacaagacaaggatgccttctctcaccaatcctattcaacatagtattggaagtcctggccagggcaatcaggcaagagaaagaaaataagagcatccaaataaaaagagaggaagtcaaactatcccttttttgcagatgacatcatcctataactagaaaacttcatcatctcagcccaaaagcttcttaacctgataagcgacttcaacagttttgcaacagagtctcaggatgcaaaatcaatgtgcaaaaattactaatgtttctatgtaccaacaacaatcaagctgagaatcaaatcaggaacataatctcattcacaggtgtcacacacaaaaaaggtaaaataaaacaccacagaatacagctaaccagggaggtaaaagttctctacaaggaaaactataaaacactgctcaaagaaatcagagattacacaaacaaatcgaaaaacattctatgctcatggacaggaagaatcaatgttgttaaaatggccatacttcccaaagtgatttagagatttgatgctatttctattaaactaccattgaaacacttcacagaactattttaaaattcttatggggccaaaaaagagcctagatagccaagaccatcctaagcagaaagaacaaagctggaagcatcacgctccctgacttcaaattatactacaaggctgcaataaccaaaacagcatggtactggtacaagaacagacacatagaccagtggaacagaatagagaacccagaaataaggccacacacctcaactatctgatcttcaacaaagctgacaaaaacaagcaatagagaaaggattccctattcaataagtggtgctgagataactggctagccatatgctaagattgaaaccggaccccttccttacaccgtatacaaaaatcaactcaagatggattaaagatttagatgcaaaaccaaaaactataaaaaccctgaagagaaaatagtcaataccattctgtacataggcatgggcaatgatttaatgacaaagacaccaaaagcaattgcaacaaaagcaaaaattgacaaatgggacctaattaaattaaagagcttctgcacagaaaaggaagctatcaaaagagtcaacagacaacctaaagaatgggagacaattttagcaaactatgcatctgtcaaaggtctaacatccaacatttataaggagcttaaacaaatttacaagaaaaaaacaaccccattaaaaagtgggcaaatgacatgaacagacattttgcaaaataagacatacatgtggccaagaatcatatgaaaaaaagcttaaaatcactgatcattaaagaaatgcaaatcaaaaccacaatgaggtatcatctcacaccagtcagaatggctattgttaaaaagtccaaatataatagatgttggtgagattgtagagaaaaaggaatgtttatacactgtttgtgggataaattagtttgaccattgtggaagatggtgtggtgatttctcaaagacctaaagacagaaatatcatttgatccagcaattcaaatactgggtatatactgaaaggaatataaattattctattataaagatgcatgcacttgtgtgctaattgcagcactaatcacaatagcaaagacatggaataaacctaaatgcctatgaatggtagactggataaagaaaatgtggtacatatacactatggaatactatgcatctataaaaaatgtgatcatgtcctatgcaggaacatggatagagctggaggccattattcttagcaaactaaagcagaaacagcaaaccaaataccacatgttctcacttataagtgggagctaaatgatgagaacacatggacacacagaaaggaacaatacacattgggcctattgaaaggtgggtggtgagaggagggagaggatccggaaaaataaccactgggtactgaacttaatacctgggtgatgaaataatctctacaacaaaccctcatgatacaagtttacctatataacaaacctgcacatgtaccctgaacttaaaataaaagttataaataaaaaagaaaaagaaacacaagtgtgttccattgaacacacgtatgagacttcttaaatgcctgtttaaaatttgtaatgttataattttataaaaggtcttttttttttcaagtataagcatggacttttctccccatgctgaaacccaagtgaaaaatgacacagtatcttggactaggaccttgtcagtgtataagaaaaggtttgacaggtttgtgatctgtgtggcacacacactaggcctggctgatggattcaatgtggggtgtgtatggagggaggtgaaaaataaatattaatatgacacaaatattccacctgagcaaatgagtaggtggaggggctgcttatagggatggaagaagttgaagagaagcagatccaaggtgtgtggtagggtgaaacagttcaattttgcatacaagtttgcaatgcctgtgagacatccaaaaacagaaatcaagttgtatatgtgagtttgaatttaagaggagaggtgtggactcgagatttaaaatttggagtttcagcttagagatgatatttaaagttatgacagcatttgagatcatctagagagaaagtttaggataaggtaagaagagggctctgaaaccagtctcatgaatgtaataagaaatctacatggtatggtcaaaagattatggtctgtgttgggatctgatgtggatttctttccctctgggtgccgctgatctgcctgttgagacccgtcccattggtctaggatggcacttaatcatgcagaatcctgactgaagatacgggctgtttaagtcataagtaggaatgaagagtagaatcacataaatgcttccatcaaagaactgatgacatgggaattccagaggctccttctagagatacatagaattcagtgtgtaaagaagttagaatgtttctttctgcatctttaatctatcttctcttaggtgytttgagactagcttaaaaattaattcttgattgcactttgcaacyataaacatggggattggtgattgaataattagtgcttatcttctctctttgaaattggctacctttgaggttttacagtttttaacaatatcatgataagatcatatgttaagtgcagttagtgttgggccacaaagaactttttctgcaaagaaatcaagattcttacaggttttaatggaaccaaaagcgttgtgtggggtggagcaggagggaggatggtttagagaagaagctattgctaagtaatttagtgataaaatttgcaaaaattgaataaagacttagaatctattttaacagctaaaataactactttaggatttgttaattaaaaacagcagaaatgtttccttccaatctcaattctcttcttttaattcactgactaagggtctgcttttgtaatctcccccaaattctgtaatrtgcccagacttactatagaaagtaattaagacctgtatgatttgcactaaggctataatcaacgtgtagcccagtgtcttgcacacatttattcatttcactaacatttattgaatacctaccaggcatgcttattaatttcactagcatttattgaactcctactatgcccccataacagaacctactcatatgctccctttgagtacccagcatgaaatttagttctgtgagcattttgtctacaagtgggcatctttcwtgccaaaataaatatattgrccaatatttcttgctaccagaaaagattaaatattttaaaatgtaggcttgcacccaagctgctggttatctctattgtagtattgctgacatgagagggctttgcacattgttttttgattctgacaggattcagttaacagtaataacaactttttcttcctctcccctccctcatatgttctgcacatattcaaagattggctctgttctcagagttggctttttctaatttcctctttaaaatttctttaactttccatgtttttcatttttaaaggaggccgtgagactccctctagattaacttggctcagaagattactgagcttcaaaagtctggctttaagaggctttcccaaatctaattttgaagctatggtatccaagaaaaatggaaacctcatatttccatcaagggctcatgtgtagccagggtttttaccaagtttacaacatgccrtcacacttaattctgaggacatgtgcctagtttggccaactaaaacatatacagttccttctacttttccataaatgtaagcattttcaggaagagaaactagttcagagacagatcttcttgcttagaattttttttttttttttttttttgagactgagtctcgctcttgtcacccaggctggagtgcagtggagcagtctcagctcactggaacctccacctcccaggttcaagtgattctcctgccttagcctccaaagtagctgggattacaggcacccgccaccatgcctggctattttttgtattttcattagagatggagttttactttgttggccaggctggtcttaaactcctgacctcaagtgatccatctgcctaggcttcccaaagtgttgcgattacaggtgtgagccactgcacctggccattgcttagaattttgaatcttcaaattataaggagagcatcttggaaaggagtccttaccagtatcaatgattagcactttttttagggagctccattaactttcttaaattaattgcaaaattttgcatgtacttatttaataaatattaatcaagcaccttttatgtgctaggcataattcatgagtaaattttagtgtgctaccgggttggggttaccggagattacccctggtccctatgacttgctaggaggactcacaggacttgtatatggttttactcacagctatgatttatcacagtgaagagatattgggcgagatccacaaagagaaaagggaaaagaagcaaagtctgggaaagactaagttacacacttcttttagtgaagtcacacaggatacacttaattttccagcaatgagttgtgacaacatatatgaaatgttgtctaccagtacagtttattggagactcagtgctcagggtttttattgggggctgatcacacagcaccctccctctgcctagcacataccaaatttgtatactggccaaaggaaagcagatggtcagcataaactacattgtttgcacaaacacttaggtatagtgagctactcttaccagttctaggcatgtggaaaccctcctgaaacccaagtttctagatgccagccaaggaccaaccttttaagccttccttttgaagggtagcagttaggtctgctatgttaagttttttgtgaacagctagattatgacaagtgcattggggaaaataattttacagcaaggagcaagggctagtaaagctggaaagcaacgtggtctgcaattttaaataaggtgatcagagtaagcttcactgagaaggcaacatttgagcaaaggcttggaggtaaaaaggaatattccaggtgaggagaacagtcaatgcaattaccctaagttgatagtctgcttgtcatgtttgagaaagagcaaggaggccaatgtagctggagcagagtgaacatggagatgaaggtggaaaattagggtttggggagaggactgctggctataccatatgggaccttgtagaacattgtttgttctttggtttatgcatgtgtgcattttactggggaaagatccattagttttcatttcttttgattctgtgagcccccaacatccactaactgcagatctagggtaacttccatcattttacaggtggaaaactaagccctaagtgatgacaggtagcttgcttaaggtcacatgatcttcagtgggagaatgggggataaaatgtagaacattaatgtttcaatctttccatcaagattaggagaatcctaattattaatgtagttgataataaatggatgccacactgcttcaggatagttcaggcagaatgtgttcaattatttcttttggtttagaatagaaggggactggggtgcctaatcctgagtaagtagggggtaaaacaagtagtaaatacctaataggcattttctcctacatattagaatgtctgataattcaattaaatgtctttacacctcacatctatccctccttatgtaaaaaaaaaaaatggttttcattgcctgttaagccatccctcttttgcccccattatgattatatgcaaacaaagaaaaagtttattaagctgtctcctgattttaaagattcaactgtggtttttcacaagggctataaaaataaactaaagctgactttaaagttaacttctctcattggcaactctgcaacagtcacaccaagaaggtctagttgaaaagggtgaaacatggccaaagcatacctactgaacacagatccagaaagtagtatgtttgaccttaaaacccccgatgatggccaggcgcggtggctcagcctgtaatcccagccctttgggaggccgagtcaggtggatcaggaggtcaggagatcgacaccatcctggctaacatggtgaaaccctgtctctactaaaaatacaaaaaattagccgggcatggtgatgggtgcctgtagtcccagctacttgggaggctgaggcaggagaatcgtttgaacccggaaggcggaggttgcagtgagccaagattgtgccactgcactgcagcctggcgacagggagagactcaatctcaaaaaaaaaaaagaacaatgagaacacatggacacaggaaggggaacatcacacacgggggactgttgtggggtggggggacgggggagggatagcattaggagatatacctaatgctaaatgaagagttaatgggtgcagcacaccagtatggcacatgtatacatatgtaacaaacctgcatgttgtgcacatgtaccctaaaacttaaagtataataataataaaatttaaaaaagaagcaaaaaaagaaaaaaacaaaaagaaaaaacaaaacaaaacaaaacccgatgatatgtgctgcttatgaaatcaacagataattgctatctaattttttctttcaaaagaaaattatgctgaaaagaagatctacagtttttgaaacatttactgcttttaagcataaagaaatgaaatgttagatgcaaatagatcggtggtatatgtgtgctaaaggtacaatttgggtgacagctacagaagggaatttaataatgccttttactattttgaaagccagaataaaaagtaaaagaaaccctttagaataaattttgaaargttaagttcagagctacttaattattatatggatttggaagtataggcatttaaaaaatactttatattttcaagggggaaaatcattaatcacctcctctgaatgtgaggaggtaaaacatggcttatgctattttacagataaaaaaatttctgtccattaagcagtatttccatattgtcatctttagggtggttgctgttaaatactttatgctatattatctcaaccaatgatgcaatgaatggctctgtcatggctagatgacataaaaccaaaattatctattactgttgaagagatgagatcaatgtcatacccaaaaaagcaagatcttgaggtctttccctctgagctttgatcccttccatgtattttgaactgcaaaaggccttgcttttgttgatggtggtggtggtgggagttactagatttaactattagaatatttctgtttgtactaaggcccttgacaaaaaatttaatagcttttgttataaaatgatgtgattattataaaatttaaacaactcagaaaaataagaacgcagaaaaacactccaaattccactttccagaaataaccattctcagcatttgaacatctttccagacatttctcagtgtgtctatattgagcaaaatatagctagatgtaattttaggaaaatgggatcacagtatacatggcattttaaataccaagtattaatttacttttacttgaatttaacataagaaagagagattgaaataaaactggaggagctgttgattccactcagataaatatttcattaccataaatgatatagccgatttacaaatcccattatcactattcaaaaagaataaactcagtctaagagtttgaaattaacatattttttctttcaagtacgactatttattaggagtcaatttcaattgttttctattctaatgtagtgatggtcataggaacagagcatgtttgaaagttatgtagaggcttgtagagcacaaagttaacatattaaagcagtgcaatcactagtgattttctataaaagatgaaaaaataacaaacatactttttaacagatcccctccccctcctctgatttttgatatcttattctttatacattgatttagtacattttttgtttgttctgtaactgtagttattaaagctatttaataacatgttccttgttccatttaaaaatagagtttgtgctcaacaccagccctattactattatttcgatattactgagtttgtttgtttgaatggttagattttgtggtctgggaatttgttaaggaagcacttgtaagtgctttttactaagcacttacaaagtgcttaattttactaagttcttaatatatttgagatggcctatcagtttagtttatagttaaaggacaactttgctgaatataaaattcttagttccccctccccgttactgagatactttagatattattatggtcagttcttcagtggatagattaatgagaggggtggaggtaaatatctgctaagttgtcaatcaatttgctgaataaccaactcacccaatttaatgatcaatggtaatattttggggtaaggaaaagatggggagtttactttgggtatgaattttgaatgcctgttaggcaataaaatgaagatgctgagtgatagagaggttgggctgaagatacatacttgaggtagacagaataaagatggcaattatgacatggaattggatgatagtacagatggagaaaagaaaaggtctgaggactgggcactgtgtgtgtactccagcagttagatgtcagaagaatgaggaggaatagcaagggaatctgagaaggaacttcattaagctggtaagaacactacttgaaatctcaaggacaaagtgaccagctgtgtcaaatgctgccaagaagactgaaacttgaacattggaatgggccacttagaagtcatttgggtcgctgataaaaatcaatgtagcaggcaaactactgataaaccttcttagagaagaaaaatataatcttacatataattatagaaaatactttttaaacaataataaatgatagtcaactctaacaataaatttggacattagcaattttatccatatgccataatgcttcctatgtcataatgtcttcctttgataataattttatgaacaaatgaaaccaaaacaaaacccttttatgagcaggagaaaggagtgagagcataaatgcagaacattttactcttgttgagtatttgttgccttcggggaataagacttcagagcaggttggggaatattatttatattttctgcatttatctctgtattgtttgatattacaatttacttgtattattttcatagttaaattatatactaaaataaaaaataaactatgtaataaacagaaaatatcaatagtggcaatatgtgacacacgaatgattgcttctcttgtcctgagcccatggctttaatgttacctgagagttatgggagtctttcctttgaattccatacttgacctcagagtctattgacacagttttatagatagtcatgcgaaaatgactgcagttagtcttgaaactgatttcctagccgtagtatagatgatttctttctttttagttttggctttctaattattcattttaattattaaatgcctatactatgcatgaaattacactaagaggaactctacttggaggaactaacggtctatgattcaaattatgtgcatcttctttttggggttcagtagaagcccaaatacttgctgtttatcttaaaagtgatattattccaggttctgtctgtgtgacattctcttttgctaactctatgcactctctctaggcttttacacctctgtttcaggaatcctgaatcagtacctctattccagacctctttttctcagtttggcatccttgtatccaagtcagcatgtctaatatagaacttcttatctttcctacctagtatgaccctcttcttttatatgctgtttgaccttgttgtttaagcaaagccattttgcctaaggtagtgaatctaattgatgcataagtcttaattttattgcttatttacttctcttttccttttcttttctacatatttgttgctactatcttggttcagactttctccacctctcacctatacttttgtagcagtctcctgcctcaggtctcatacgctccactaattggcattgccacaaaagtgatttttctctagcacaaattacataatatcaatcctattcttaaaattattcaatgactctctgttgccttcattagagtcacatgactggtgatttcacatgccttgtatacttcagtgatttgcccaactttgagaaacgctaaagtttattttattattattattattatttttttttttgagacggattctcgctctgtcgcccaggctggagtgcagtggcgcgatctcagctcgctgcaaactccgcctcccgggttcatgccattctcctgccccagcctcctgagtagctgggactacaggcccctccaccatgccttatttttttgtatttttagtagagacgggatttcaccgtgttagccaggatggtcttgatctcctgacctcgtgatccgcctgccttggcctcccaaagtgctaggattacctaaagtttattttttaggaagtacagacttcaataatttataatggccacagttattagtagtttagcagtggtaatttactatcaataacagcttataatagatgtgcatttattggtgaattggctaaaattccttactttaccactcagtaaagtaaggaatgaacatgaaggtagtaatgtaggggtaatcttgaacagactctaatttaaatttaaaaagtaaattattcacaaattatggtactttgactttaatttctaacaaattacttgtgacatacttcataaatgattgtctattattatggttagcaaaagctgggttttagatcaaagtccagactttttaccacaaacaaaaccctccatgattcaggccagtcatttatttattcatatatccacccatctgtccatctatttgtcaaatatttgttgagcacccagtacatcctagaaaattgttacggtccagggacatgctaatgaacaaaacacaggtttcattgtcacagaatcaatggctatcgtcctcagacttctaaggctggtctttgctatgtgcatgtccagtctcctcttctcccccttattatttccagcgagaytgactatttatgattcccttgatgcactgaactattttgtttttgttggcttattttcctccctctgtgtagaattttctcaatatggtgatcactcagctttactgtcacttctctgttccttgtttctgaatgggacctccactgaaagccaagatacacttaaagccaaatttcttttaaatgtaatttaaggccaggtgcagtggctcatgcctataatctcagcactttgggaggccaaggcaggcagatcatgaggtcaggagttcaagaccagcctggccaacatggtgataccccgtctctaccaaaaagtcaaaaattagctgggcacggtggtgcgtgcctgtaatcccagctacttgcaaatctaaggcaggagaattgcttgaaccccggaggcagaggctgcagtgagccgagattgtgccactgcactccagcctgggtgacagagcgagactctgtctcaaaaaaaaaaaaaaaagtaatttaaatgtatatattttttcacaagccttgcagacttaacactttaaaaaatcagctcggtgtggtgtgattgtagtgaggtgaggtggtacgtgtgcgtgtgtgtgtgtttgtgtgtgtgtgtgactaaaaagttgatataattgatggatttggtgatccaatgtggtagaaagaatgttggggttgggatactaggggaaatgaattgaaaaaatgggaggctttaaaaacataagcttcagtattcaataaaatttactcttctagaacacattgttcctaaagattatgggatagttttatgctttccttgctttatttattcgtgcaagtttctttttagcagcctttttggtgttctctttcttctatacacttaaatatatgtctgtgagtgtgctttactaaacattcaatttttaaaatcaactttattgaggtatratttgaatacaataaaatgcacccattttaatggttgattgagttttgagaaatgtagccattcaggtaaccacaaccataattgaaatataagatttctatcactctagaaatttctgtctgcctttttataggcaagctcccttctcaatccccagccacaggcaaccacagatctgcttttggtcactatcaattagtttttcaggtatttggttttaataccatttttcttgtttaaagttacctattagattcccaacccccctccttccatgatcctttatagagcttggaagctgctctcattcttcctttatctgtctcacttttttgcttctttttccaatacccctcactcctcttgcttcattcttcctcttcaaataccattattaattcattttctgctatataagtctactgtagactttggccacaagtggttgcctaaaaggcttcagttttttccagagtcaaaatcttttcacctccaaatttcaatagtatcacctcttttaaggcgcagaaggtacagaataaacctcataaattataattttgtaaattcctttatactagttaccttctctgtggcacctggatattgtgtatgaaactggggaaaagtaaaacaaaagatgacagttaagctcattttcacaaattatctttattataaaatacagtaatttataataactaggagtaagaataaagtggttgatatgctttggctatgtcccctgtgtccccacacaagtctcatcttgaattatagtttccataatccccatgtgtggtgggagggacccggtgggaggtattgaatcatgggggcagttaccctcatgctgttcttgtgccagtccgtgacttcttacaagattgatggttttataaggggcttttcccctgctttgctttcacttctctctcctgtsaccatgtgaagaaggatgtgtttgctttgccttctgccatgattgtaagtttcctgaggccttcccagccatgtgaaactgtgagtcaatttaatttctttcctttataaattgcccagtctcaggtatgtccttatagcagcatgagaacggactaatatggtaatattaaaactttaaaaattgtgagcacatttggggaatgaatgagtctgtgttgattttttcctcttacaaatttaatatctcagaaaactttgcttttaaaaagaagtttttttgtgtgtgtgtgtgaaggacatcacagctggttttagtgctgtttactttccttgttttatttatggaagtaggagggaattacttaggggtagtaatttaaggctatttcagttggcatttaattgggtttagatgtcggaagatgcatasagctagatacttaaatagagggtttacagtggtaaaatagactaggagaacaatcttatgaactttgcaatatgctttcctacttaaatatcttccaaggtgtgagcctttaagctttgccttcccttatctccacctacttatttaacccttctatcactctgaactgtgcaagaaataacattcttggttatttatttattctgagtaacgtatagctttattctgcctaagacacttcacgtaagttcctctggagcttgtttgggtaaatagaaacatctatttagttgctcctttaatatctacttttggwggcaattttttttaaaggaaggatacatttgcaggctaacagttcttggtacagaacaatgttgcactgacattttcagaatactctcaggagtataattctgctccttttggccggcaatggtatgattaataagggtagaatttcatttttttgttctatttgggatttctgaaatagycttggattaatttagaactacttattataattgtggtatattgatcaatagtaagttgaccctgtttgctgctgttttcatcacagttcctgttctgcaacagatcagtcaaaacaacataataacgacttctttctgactgtatttctgtgaccagctgcacacaaacacacatgtacacatcaacacacacacctgtatacacacacttattcttattagctcccttcatttctctctttgtgcctcttctattgtctcccaggcttctcatccatgtccacatcattttttctccttaattctcttttatcttacaatcatacttccacctcccataccttttcctacagagtgaaatgtaggaaaggtttatgaagctctttagacttgccacaaacatcagccaggagatgctgctgtaagatgacatagtatttcacttgatgatggtgagtgagtagtataatttttttacttggtwaatttatgtaagcaagcactcaagaaaaagtttgtgcatatttttttcaaactgagtcacaataaaggaagtgagagattttgtggctcttgtgacagccacaaaaaaatagagtgcattaatcatgttgcataaaaagacaataagaagcaaaggttgaaatgttaaactttttgagatgagtcataattgtaatggtgctatttatcttcaaagtttttcacaaaatgaagtaacatcctctcagyagtcacaattatatgagcacctttcaaagatgttggaattaaggttaagaggttaaaaagtcacttcagaccaagagtagaagtaaactttttgagaattaaaattcactaataggaaaaaaaaagttttgaagtaggaatttgtacctctgattctggttttgcctttgcctctaaatagctgtgtcatttttgacaggtctctcagttcctagtgacttacttcctggctcccaatgtccttaactttcaaatgagggattgattaactgggtctctaagtgaactttagtacttaaatagtttgattgaatcctagaattctttctttcctttgaatattatgctcagtcctcttaaatggaatgtttaattaatgaagtctttccatactcattatgcatataccacttaacatttaggctagaaaaaaaatgtctcaaagatgtatgtattagtctattttcatactgctatgaagaaatgcccaagatggggtaatttataaagaaagagagatttaatggactcacagttccacatggctggggaagtcttacaatcatggcagaaggtgaaggaggagcaaagtcatgtcttacatggtggcaggcaagagagcatgtgcagggaaactgccctttatgaaactatcagatctcattagacttattcactatcacaagaacagcaaggaaaaaactcactcccatgattcaattacttcccccccgggtccctccgatgacacatgggtattatgggagctacaactcgagatttgggtggggacacagctaagccatatcaatgtaattctgtaatttagtctcttgaatgttgaaaggatgatccagtaagtatgtaggccaaaagaggggaaggaatgataattaaatgctataatgtgctagtttggcaatttcctgtcatggagaacatgaatgattggagttttatgagaacacatgtagggtagagtagcagaatcccacaggaccttctgagaatggggaccagataatgttattcctcttagtggtagtttcatggatcttgactctagcactctaccattaataagactctttctttttgtgtgttaattcctaattccactggttaatttcatccatatttttcctttataggtcccgagtgatgaaatctgatttacctagccacttaccacttccacccattgtacagaatttaatgtacacgagaattaatgtactggtcacctaatggccactttgagatgcttggagcacagtctgaggtttgggggtataggttgtacactcagtcttagaaagaggtgataggcaaagcaggactcaatatctgatactgacatatctagaatactgaaattaaccactgtagcttttcaaggatagtcttcaaataagcatgatgttttccttcatgaaattagactagacaagcactgaatgggtctctgatactagtgctrtggtttatatgaatgggatatttagttgctgaggtaaaaacaaccaaccaaccaaccaaacaaacaaacaaacaattaatcagtagcatgttgtatagaaggcagagattcaggactgcaaaggcttttcatgccatctgttggaactcagtatatgacgatatgctatgacttttaatcaattagcattactgccmgtataatttgatcagttattagatactgctttctgctagttgacaagttgatttcctttacttttctataagacactgaagagagaaccgaaaatgtagcaatagaatccatttgcatttttttgcatttattaattatttaatcaacataataaaagatatttttttccatactttcctgatgaggaaaatgaagtccaaaaatactaagcaacttgttaacagccatgtgtctgttaaagcataatgccagagtttgaattcaggtagattgtttccagaacctgcagtcacccacaatgcataactttcccttcttgatttttacatttttttgtatcttccttcctttttatctcctgctctgagtctttgataggttttctctgtgtgcaaaatgtttactttcacttcccatgaacacttacattaaagtggaaatagtgtttcctctggaatactcttcccaggaaagccagatatgtgaagggttttaccttggatggatgggatctagaagtcaggtaaaatccttaatccttgtatttttttwwaaaaaaatccaccagcagagggctctagagaggctcagagccaaagctatcaagaaaatggtccaatgcagtgtgatgatctggggttgtgggagactgatggagaagaaaytctgaggagctattagctggtaaaatatcatcagcacacgcatgctgatttttcctctttttccggccactcattgccatttttgaaacttcctctgtaaaacttctttccaactcttgttcctgaggtttatggtcctggttttattaattaaggttcctggatgtcatctttagctacrtgttaccatttaaggatgtcaggcagtgtgtacctgagagttttctttgattaataaagagctcttcttcaatcacctatcttgcaacttgcataactttattggaatattgttcatgcttttgggagtttattccaacatattatttaaaagacattttgtgtcagtagtgtctcttactcaatataccccaatgtctggtataagaagaatacaatcctatttttcccaaactttatcttttattagctcgttctgatgaaggttccagttcctcccatctaaaaaaattaaaaggccaccactttccctgggctctataaatttttttttgctatcagttctttctatccctgactgttaagcttttttaaaagagaaatttgcacctgctttatctgtttcttcacctcctattttctcctcactttgcttatttgacttctagttccaccccacttctgaaactcctctggcaaatttcactgacttcctacttgtcaagcacactgattctttttcagacctcatttactcaacctataccatagaccaatatctcctcaaacgcttgttttgggtgtgaaatgccataatagtttttcttgtgttttctgatcattctgttttggtcacctttgcttatttttctttctgagctcagtcctgtattagcatccactgatatctcttctagctactcaaccagatagtcaccaggtcctattgagtctgcttccctaatctctcaaatgaagctacttccctccactttcacatctaccactctagtgcaggttcatccttttttctttttttaactgtaatggtatcctaacttatctccccacttctagtcttgcccctccaatctagctttatttatttatttatttttttacaattcacattgtgaccttttaaaaaggaaaatattactcttcaactccctgatttaaaattcttccatgattctctatagattttagcatagttagcatagggtacaagacccttctttatttctcccctacatacctatctagacttttcctcttcacttttcactttttactttaatacctcccattgtctctctctcttttttttttttttaatttttttttttttattatactctaagttttagggtacatgtgcacattgcgcaggttagttacatatgtatacatgtgccatgctggtgcgctgcacccactaacgtggagtctcgctctgtcacccaggctggagtgcagtggcgcgatctcggctcactgcaagctccacctcccgggttcacaccattctcctgcctcagcctcccasgtagctgggactacgggcgccccccaccactccctgctaattttttgtatttttagtagagacggggtttcactgtgttagcaaggatggtcttgatctcctgacttcgtgatccgcccacctcggcctcccaaagtgctgggattacaggcatgagccaccgcacccagcctaatacctcacattttctaatgcctttatacctttttatatatagcttcttctttgtacctcctcctcttcccttatcctcactccttctgcttgacttactatactctttaggtcatagttctgggatgtctcctccagaaagcctttctctgatcacagagtctagagtacataacctgctttgtaccttgatgaaatactaataactataactacctgcttattttttgtttccctttgaaggcagaggacaattttcctttttcctttgagtcaatagcaactagcataacgtcagacacrtagcagataccaagtaatgattgggtgagattggttagctgatccttccaacacctcaaaagatacaccttttattttatttagtagaaaaaaaaccaaaaatagttgtaaatagatttctttcatttcagagaaagccaagaggtaaatttgcaggacacatttgagggacacattcataataatcagataatatttatttcagtcttacttttattttctaacaaagctcagtttaaaacaagtttctgctgactgtccagaatcctttctaattcaagttatcagtgtcgtgaaagatgaaacattgatgagaatgtgtgtggtaaagcagtctataattataaacaaggcttcttattcttgtgtatgtacttgtcctatatagtgaagtgcctatggagagatgggtttgacaaggatggctgagacttcacattcagacaaattctgaatagatggatacaagcattgtataatagaaatagatggagataggggcacggtgaagtggtgctgtctaaaagtcaataatggggatgcagacccttaattttgcccaactccacattatatatgtttacatctcaagcatcaaggcaatgcgaatgttaaagtgtagtatagaactaagaacaaggaggaggctagagcagtttgtctagctgaaagcaagagtaagcccaaaacggtacataggattaaatgcaaataaagaaatatagcttataaaagagaaaggaattaagtaagtcagtaggttgtagcttgtgggtgaatggagcttagattatggcattcagaagagggaagggttctgatatgaacagaaatcctaggagaattcagtgacaggttagatcctcacttagcagatgcggcatggaaacaaggagagacttaaatatctaaataggggaaaggaggtgattataaaatgaataatagtaacaatccctgacatttctttaatatctacaatatactgtattatagggaacaagaaaaggggttggtcactaaccataaaagaactttcttattggaatctagttattagcttaaatagtaaatgaccattcctgagaaaccattcttgccatggaaattgcaaaatattttaaatttctagcttccttaaatacatgttttggagttttatcaaaacttgggtgtgttaacaaaagcaaattaggcctgcatgccggatctcctctatttgttccttcagatacatctttcttcttcagcctggaaggctgtaatgtacaaaattatctggttccctcgccttctagattctggttgaatttggccacttgggagtccaggttgacaactggaagaagggagaaaatgagactttgttatttattatattatccccttgttattgggtttcctagggtagcctgggtctcttgaccaaaggtcactgattctctcaaggtggttgtctctatggctttctctggtttcaaatacggatctgttctcttgtctctttggacctaggattggtaacagcttcacagctattagcacttggttactgcattataccttatgtcagtggttctcaaacattggtgcacattagaatcacctggatgagtttrttacamtacagatggttaggcctcactcccaggatttctaatttaataggtctcgggtgaggtccaaaatttgcatttctgacaggttcccaggtgatgttggtgctgctggttcagagaccacatttaaagagcctatgttttccttgtcccttgcctatagctttattaaattgtccttttattcaatcctttttcaattattctaatttggttataccatctgtttaatgctggcaccctgcctagtactctttcccactttaccaaaaatgttcctagtcaacagaaccaaaaatgaaattccggaattagttttgtcatgtattcaaagtgtacagcggaagaaaatgggacatgggcagtttatggcaggaggtggcataattactcagattatcactggtggtaacatggggatgaagtgtacatggaagatagattattggaggtcaagtggctgtggttcttaattgtatgtcagtgataacttatttaccattttattttattttaattgacaacaattgtttatatttattgtataaacattacatttttaaatatgtatacattgcagaatggctcagtcaagcgaattgatacatgcattacctcacatacttatcatttttgtggtgagaacacttaaaatctattttcttattgatttacataatacaatacattcttattaattgtagtcaccatattgtacaatagatctcttgacttattcttcctattgaactgaaattttgaattgtttaaccaacatctccccaatcccccattcctccagcccctcgtaactaccatcgtactctcattgtactctctgcttctgtgagttcaacttttttagattccacatataaatgagatcatttggtatttgtctttctgtgccctggcttatttcacctaacataatgtcctccaggttcaccctattgttgcaaatgaaaggattttctttctttctttctttctttctttctttctttctttctttctttctttctttctttctttctttctttctttctttcgttctttcgttctttctttctttcttttttctttcttgacgagtctcgctctgtcgcccaggctggggtgcagtggcgcgatctccgctcactgcaagctccgcctcccgggttcacgccattctcctgcctcagcctcccgattagctgggactacaggcgcccaccaccacccccagctaatttttgtgtatttttagtagagacggggtttcaccgtgttagccaggatggtctccatctcctgacctcgtgatccacccgccttggcctcccaaagtgctgggattacaggcgtgagccaccatgcccagccaggattttcttatgtttaaaggcaaaattgcattccttatatatatatataccactttttcttcatttatctgttgatggacacttaggttgattctatatcttggctattgtgaataatgctgctatgaacatgggagtgcagatatttctttgacatgctgatttcatttcttttgaatacatacccagtagtgggattgctggatgatatgatagctctatttttagttttttgaggactctccatgctgttttctataatggctgtactaattgaccttcccaccacagtgtacaagggttgccttttctccacattctctcctatacttatcttccatctttttgataaaaaccattctaacaggtatgaggtgagatgtctcattgtggtttttaataattgtaaagattgtggagtccctggcttcttcttatgtctctcaggaagttaaatagaaaaaaggagtaatttaaaaactaggcacatacaattaaggacatgtgtggacaaacgaagctctccactgcagacttgaaagagtttcccatctcttccagattcagaccaggtatggctgaggagcctctggccctaaatctaactcctcctggctcactaagggatttggctactcagtgtataaaagtattttacttttgctacaaaacataccataacatcatgttgtataccttaaatttatacaataaaatttattttaaaacttaaataaaaaatattgtacataaaaaaattcttacctgtctcacaggcagatgctgattaacctcaggaccaatctttgccacctcttattgactcaacatagcccagatgggaaggtacaaggcctggtccaggagaaacagtttatacactgaaagaggtcaagaaggtcaagaccccaccagtctgtattggcatacatggggagtgaatgctaatgttcatcaggctaaattgttgacattggtgtactcacctggaatttagggtttaatatgttggtctgagcacttgggagaggcattaatagtctatgaatatattaattgaagcctgaactcaatgatgacctatagtcaataaggtagaaatgtttgagattacctgacctactctagaggaaggaattcacaggcttggggaaacggaaatgctagaatggatcagccaactcctaaccgtactccctaggaaggccagaggatgctgttttgatgaaagcactataatatgcattggtgagggggataacagcattgttaaatagctctgtggttgctgtcctctgtaggaaggagatgactgtaggttatgccataatggaactgagtttcctgatccagtaggattcatgatggtttgacagtgatggagaccagctggtggcccttaatcattacaaacgaggtgtttgaaattacaacaagccacagggatggagttttgacctgtaagcatctatgggaatgattttcttttctgtattttttgtggggggagcggttttttaacctcactgtgtgtcagacttatgttgggggcttgctaaaacccaggttgctgggccccacctccagaatttytaattcaataggtctgaagtggagtctaaaaatttttatttctaacaaattcctaggtaatgctgatgctgctggcctggacatgacacttcgagaaccattaatctaargcaatagctaactgatgatgtagttctaagaatgaaatacatgtgcagccttccaatgtactgtcttacatrtataggcagaaaaattctgccttatgtcaagtcttgtgggcagaaacaatttaacttagtgttttcagatgtatgccaatttatatattaggtcctttcaattgaggaaaaggtcaggtctctttgtaaaagggccttgcaatgtagcaatggctgtatattttgcattttttccaagccatctctaaacatatttctataataatagaggaggaaactgtgtggtcctgatttatggatgaatctttatggcatactgagaccagctgtaattggataggtgctgcactaaaaccccayatggggatgaccctgaaagccagtgggaaagagaaatcttcacaatataaagaatcctacagccttctaccagggtgactttacacgggagaaaaggaaataatactcagaacttctgagttattcgattctggctttaaattcattctgatccccagagactctaaatgccaccatagtatttaaaagtcagagtagagatttacgtagatcttgatcatattctaaatctaacagcatttcttagtctcagaatatataatgagaatagatataattagtaactggtggaatcaacacgttggtttcttgatccatgtaatgaaggctattatgataagaaagggccaagcagaagctcctggaatgacatttttcacctagctgaggtagtaaaccaaaagtaacatcacattcctgagggaatgtcagagattagtaccaccataaaagatataactaaggcgagtggatcatgaggtcaagagatcgagaccatcctggccaacatggtgaaactccatctctactaaaaatacaaaaattagctgggtgtggtggtgcgtgcttgtagtcccagctacttgggaggctgagacaggaaaatcacttgaacccaggagatcgcactactgcactccagcctggcaacagagcaagacttcgtctaaaaaaaaaaaatgcaacatatgaagagtgactattcctactacatatttgtttaatttgactgtttggctgatgcaaaacatgtgggtcatggagcatgagagtatatttttgcagacttaagtaggttgtgatgctatttgcacatatagttccagttgtgcaacatttatgggaactaactagcacagccctttagaagttgttttattttccattaacattgatatgaaaaaatcagaagtagtttgcatttacatggcagggacaacagtatatctttacaggtttaccataagtaacacctagctgatcactcataatctagagggactttggtttcttttatacccaatagaacatcaaatatactattaaattgttagcgttatgctaattcggcctaacaggcaggaagaagcaagtactatagtaactttagatatatgcatgttggagtgtgggagataaatcctgtaaaatttgaagggctaaccacatcagtgaagtttctaggattagagtgacactaaagcaggttattctaaagtgaaaaacagattattaaacctgaaccttgaaccccatccaccatcaagcacaatgcttggtgagacacttcggattttgaatgcaatacatattaccttcggatgggctactgctgaccatttactggataaatgctaaggctggcagtttgagtgaatccaggagaaaggaaggtctctgcattaggtccttaggtcctgtctgcattacagcctatctataagatggtctcagctgttatccttgaaaaactcctggagtaaaaatcatctttgacttaacttccgatatgattcagtttgggattcccatgtgactcagatgaagccaacttaaaaagtacttgtacatcttaccattccaatgactgttatgcctcattaattttatggcccagcaggctcaatgtactagaaatgtatgcgatagacagaattactatttggagtttctggaagaaacctcaaaggagaatcatggccagatttcttatctgccaacaactattttccatttaaaaagcagtttttctggcttgcttctggaccctacatgaccgcaggatgcaaagtatgtgacctgacctgtccataatgarcaaggtgttatcgaatccagtgaaccttaaaataggatgtgcctaagagcattccagtagtaatcagatgtggcatattaagagcagcctgagagacccagaatgcccaccaagtaaactgcacaagcaggtgatttacactcccatggtacttgattctactatttctctgcctcttcttcagtccatatctatggcttcgtggggaatttcctatgatatgttaacagagaaggaaaatatgtggtccatttatggatggattgcatagtatactgaaaccagctataggggataggtgtaacctatgcagggaggaccgtgaaagacagtgggaagggaaatccttccagtgggctgaactctgagcactacatctagttgttaatttcctatagaagtaaagatgtcctaaggtatcaatatgcagtaattcatggatggtscctagcaaactgattggctggtcagggagttggaaagaaaatatttgtgaagttggtgacaaagaggatctggaggacacctcttggaactgtcatggagtgtgaggatattcctgtctcacattaatgcctaccaaagagattcacagtaaatgggacactcagttttcaggtggtcaaatgactcattctgtgaatgtcagtcaactttttccagctaccctgttgcttggtcagagagtccacgtacaatgtggctgtggtgactgactagaggtcatacaaagctcaacaatatgggtttttcctctacaaagctgatctgacttcaacaagttgctgactatttaatttgctaggatcagggaccagcactgaactcttttttttttttttttttttttttttttgagacagcgtttcattcttgttgcccaggctggagtgcaatggtgcagtcttggctcactgcaacctctgcctcccgggttgaagcgattctcctgcctcagcctcccaagtagctgggattacaggcacctgccactatgcctggctactttttgtatttttagtaaagacggggtttcaccacattggccaggctggtcttgaactcctgacctcaggtgttcttcctgcctcggcctcccaaagtgctgggattacaggcgtgagctgccacgcccggcccagcactgaacccttgatacagcatcattggtcatccaactaccaagtgacaactggattgcattaaacccctttcaacctggaggatgccatgctttgtcctcacaaagaaagacgcaaagtccaaatattgatttgccttttcttacagtgcttctaaaatcgctgccatttttggacttataaaatattttatccatctccatggtatacccataaaatcaccttcaattaacagacctttttatggcattagtgatttcaagcccacagaatttactgggtttactgtatgtatataattcagaaacagctagctttgtagaatgatggtctgacctcttaaatgcttagccatagagctaggtaggcgataatgctctgttaggctatgatgctgtactgcattgtggtgtttgccttaaatgagcatctaataatattttagagagaaaagaaaaaaaatgctataatttcaactgtgtttgcttcctccagaaacctctttgctgagataatataaattttgggttaaaaataatatcttacagggtcattgcttactcacacttcacctttgtcagaaattcttgttagactgagacatttaactttgatcaccctgaaaaattcatgatatctacagtgtctactatggaccctcccttagatgtggcactgcaatgaactgcgcatcctgagcatccgtaggtagtggccctgcatgtgtatggtacattacagttttcaaagcctgttgcatagcattttgtatcagcatctgagataaatgtgataagtagtataataaacaagatttaacagaataaaatatttgcatcacaggtgtgtgtcttctaatttaagttgattttattcaactcttattcttcttactccagctaattaaaacccacattgacacttttaggcaatgaacagcaaccccagatgttggctttactgcctgattttattgatttcatttgtttgtggctttagctgtgagtggctgggtacattagaacttggtatggaatctgccactttaggaattgaagactttatttactttaaatagctgcattatggcctatatataagcaggtctcagctattatccttgaaaaactcctggagtaagaatgttctctgacctaacttcccatatgattcaatttggaattcccacgtgactcaaatgaagcaacttagaaagtacctgtatatcttaccatgcccgtgactgtatttccttagctgctaatcctcttctattccagtaaaaatggctttataattttacaatttatgatctatctgttgtcatgaattaacttttaaaaaatcctgctttctttctgagaccttwaagaaagaattttcttttgagtattttcatttttatttcaagagaacaatttaaaatatgttttctcacagatagtaggcatttaattagtgatcatgaaccacttactacgttatgccccaaaattacattaaagaaggggtaattagtgatagaagccaatgctaaataaatacagaaattccattctactgaagtccacttcatgggggcaggatgtgtttttagtattarcatctttggggtgaattatgatgttgttgaaggcatttaattcaaygagtactcatttttattgtgtcastttttaccaatactgctaaagtaacagaacattctattcctctaatttgcctgagcaatatatcgtagtcattagcaagaattagaactgtacctaccaattactgaacaaaaattagggctgtaaataatcacaacacctcrgtctaggcagatgacctcatctgcttattttcctgccacgtataacaaaataatggttggtaaaggatattaacagctgttttaatttgaaattaaacttttataaatcaaatcagtactttcccccagtaaaagagatcactgagattgatttaactgtcagtgtcttaaatctttttaactcctgtctcagtgggagaactggggagtcacttttttagaattcctttccttggtgcaagtttcaggtgcatgataaatttatttgatttgacaatatacatagctttgtagtcattattcttcttcttaaaaatcaaaacattttatttgtaaaaatgttacctgaattgatagtgtgatttttaaaaaaaatcaaattaagaataatttgtggaacagaagggaacatattattgagaaggttaacttggtgtagttgaatacattttaagtttgaaattcttgaatgattgtatgtatgtaattaccctgaaattgtagcaacacatagtctttttccccacctatatcttgtgtctattggtatatttactcgagtattagatttccttatatatatttgggtctctaaatactcattgatttatttttttcagcaaacagttattgagtgccactgagtgccaaacactgtgcgaacactcaaaaagcgaggtgttggggacaacgaataagacctcatcctctttgtaggatgaaaaagccttccaaatagaatctataactttgactggtattagataagcctttggagattctttagtgactgcagtttgtttaccatgctcagagccaattgaacctagagcacttaaaatgtgtaatttatcgtatgtttattgcagcactattcacaatagcaaagacttggaaccaagccaaatgtccaacagtgagagactggattaagaaaatgtagcaaatatacaccatggaatactataaagccataaaaaatgatgagttcatgtcctttgtagggacatggatgaagctggaaaccatcattctcagcaaactatcgcaaggacaaaaaaccaaacaccgcatgctctcactcataggtgggaattgaacaatgagaacacatggacacaggaagggggacatcacacactggggcctgttgtggggtggggggagggggagggatagcattaggagatatacctaatgttaaatgacgagttaatgggtgcagcacaccaacatggcacatgtatacatatgtagctaacctgcacgttgtgcacgtgtaccctaaaacttaaagtataataaaaaaaataaaatgtgtaatttagaaggaggagaaaatttaatatgtacattgataacatgttccagtcataagtaatccttaatactttgaactacttagaaatctgatatagtgtctagtaaggaattgtataccataggagaatatttattaaatgaaacaaaattaattaaattctgccctgtaatagaaattgacattcatggatggacacaatttaagctgatttttatctgtaagctttatagatttttcttttactagggctccttccaactaccttctaagaggacctttggagatgttttcctcaaaacattaggttgaaaagtctaatctacttataaaaaagaaagtctacttgatcaagcttagcaactttattttcaggaataatttttttatgtaacctgatattaacaaggaaataggtagtatttataacttctttccatttagagaacttctgatggttctgytttattgactcttcttaatctactaattctctttaggaatttatatgattcaatatcctaaactagartggtttatttatctagtattggacaaagaggaaaaagtttcaagtgctgatagttaccaaacttccaaatccctgtgagcccattagagttaccagaaaacattaattgtgatacatggtgagcacacaggactttctgcattaaacacatctcaaaccacaatgatttgttcctatttaatattgccaatcagaaatgttgctctttgaaagtcattactatttttacttgaatctaaaatgtattaacagctttatggctttttattaactgattattaagtaaaactaaagctttcaaagttttcattattacaaacgttgataaaattgttctatcccttagagtatggtttcattgtagcagttcaaagaaaatagccaagtaggagtttatagatataaaaatgggagggggactaattatggaatctgaaaaagtaaaatgatgtggtatcatttgacatttaaatttgagaagtagatcagtatattacaatcattgcgcttattgttttacatgaaattgtggagaattgtctggattcccactttactttgttgggactcggaaaaaaaaatacctcaaaatgaaggtctcagaagtgaaagcttctttgactttctcctgccctcctgtctctcagccccattcacctacatccagccatagaaatgagaatccctcttccccagggcatgtcgtagaaactagaacttcttttccctaaagccccccataacacctaaaaatattactcaaactttctctctgccctgctgtgtaaaaactggccataaagaaattatctaactgacattgttttactgtaggtcttaagacccccacccgccattcaagagagagtcctgccccatacccggaaggaagaaaggcatgctcagagaggccaagaagagtctagacagaccttccccactcaacctattagcattaggtagtaaactttttgtccaatcttatttgagtatggctgttcatactttgttgaactgaagcatataaatggacaatttcccctgcatctttgggttttcattctgaaggctctcatgtacacattaaatacatttgtatgccgtttctgtaattaatttgccttttgtgagttgatttttccatgaacctttagaggctgaaggagttttcccttggtctctacaacttttatytttcatttttcatagaaagctgtgttaacactagtaaatcatgtgaagaggttacagtaatatgcaaagctttctttttgtgtgtgagtggcggtgtggccttttaaacaatctaggtatttatggtagatggttacatagtaaaacgaaccccagtgaatcagctgactatgaagtattgtgtgaggagataacaaactatttgggtgctcacaatggtagatgtacatgagcttctgaacaggtcacaggaaatgagaaaagatgaacttaaaataaatcacttgttagagataacaatgagaaatgctagagagaggagaaatgctttgtaaagaggtgggtgagcaagtgctgtggagacctatagaaaatcagtggaccaggatagatcattcatctttcacaccaagctcacaattttagccactcaataggttaactatctcttctgtgtccatgtaccatagatcacactgttaacaccagctgtgtcactattagtggggttatttttatttaccatagctagcatagtttgggagctcaccacgtcccaagcattrtacatgtattattttcttttacatatgttatttcattttctccttacagctatttaatgaggcaggtgtcaatatctccatttatagaaggggagactgagacttggagggatcaatttattatatagccaaaaacagccagagagcaatgtgaatccttgtgcatctgactccggagtccatcctttcaaccttatgtttttctatcatctgtaacatcacctattatattacataagaaagggtgaacaaataagcaaactcaacatcacmcacacatcaattatgtgtgacagactgaacatggattagcagaatcttcttttaatttctgagacatgtaagaggcagaatattttaggatgtatagctgcgaggggttgcagaactagtcttggagatatatcagagtgcttaattgatattgttagccatttgctctacatatttgttaacaatttgctgtattttgaactctcttactgtatgtctgtcatagttcttggaggaagctctggagtcagacatctttgagtcaaagatctggttatcctgctagtgatgtaaccttggtcacatttcttacctcttgttgcctcagttttcctggttggaaatggggacacatatagcatctactttatgaggtgtttgtgaagattcaaagtgataatacacataaaatgcttagaacacatcctggcacatagaaaagttgcataaatattagccatgatttttatggttttgcatatcttattaaattcycaattgtctcaggctatgttgatgaaagacacagtatttctacacctttaagacatgaataacttttaggctataatacaagacagtcatgcaaataagcatatgtgctcatgaatgtttgtgattaatttgtttaaattctctttacataacagrctaggatttgtggtgctacatgccacacaagttgtgcaggtctccaataaaccaaaataaaataaaaaaagcaggtattactccatcccttaacactgtaagcagggaatcactggagctgctagcatttatacattgtatgaaggataccacagttctaaagactgctratagagattctaaagactttggtgaggcatggtagctcacatctgtaatcccagtactttgggaggccaaggcaggaggattacttgaggccaggaatttgaggccagtttgggcaacacagtgagaccctgtctctacaaatgtttttttttttttaaattagcctggcatgtggtatrtgcctgcagtcctaggtagttgggaggctgaggtgggargatcccttgaacccaggagtttgaggcttcagtgagccactccactccatcatgggagacagattgagacactgtctttaaaataaataaataaataaatccatccatcaaccatccatccatccgtccatccatccatccatccattcatccatccttcctttgttggatccatgttacctgcttaagaaatgacaggcaatcaaaagataattgattagtttctcaagcactaataataatttagtatgttttgccctttgtctctagagccttgaaatacatgtactgaacatgttttagatgattattcctagatttgccttctttgtggtaagagatctttagaattttgggatatgagagggccaaatgtttgattaacggcttcccttttattttcttcctgtcctctgacaatcatttgttttgacacttagaccttggatgtaattaccctgatcctagtttcctcatctgtacaagagcaaaaatgatacctcttttaatgccttttttgaggatttactaagataatttatgtgaagctctggcatataacgatgtttgatgtactttaaaacttaggctatttgcaactggtgctttctttctctcctctctcttctctttttacatctaaggtttttaattggttttctgtctaataatcctgactcatatagtacagtactctccaaagttgaatacccagaaggcatgcacaatgatccagtggaacatctgaaaaatattagaaattctacggataattactttttatctaagtaaaaaacaaagtttagtaattatttaacataaaggctgagattagaacttgtatataatgtataaatacatatattatgtgtgaatgctgaagtttttctaaagagtgcttgataaaaaatttgtaaatcatttatctgttatttatttatttagagacaggatctcgctctcttgccaggatggagtgcagtggtgcaatcatagctcactataaccttgaactcctgggttcatgcaatcctcctgccctggcctttcatgtagctaggactacactactaaacttacctatcatttagtacctgaatgaagctttatgggtgacagacagaggattttrgaaaaactttctgaaaactttctttgggtccagaatttgagcaggtcacaaggaggtaatcttattacaggtgccagagtacaatgtgactcagtgttagtgcttggatcttttgattttttgcagtttattgtagtgtagcttcagtgtagttttagcatagttttattgttgttattgttaaagaaagaactatgttgcggaagctggtttgttccacattttctgttaaggttgcaatcttatttgaagagaaaaaatgcacagataatatgcagtacaaattcattgtttatattatgattagcagttgacaagatatccatcttataaactgaataagttctgtttaaattggttgcattggtaataaatgaaaagtggtgctaggctacttgttgggatttgtatgctaagaagattttctttaattttgaagcaaactgatagaagttcacacagccatcatctgtgcttctgttgttgggactcaaagacgtgtagtagaaagatttttcatcaagcttaactttacttaatgattaaagcaatttttgcaaaactgtgtcctacaggagaaatctgtattcctgttggatttcaaagacattttacaatactacttccacttgcaccagggaaaaaattttacagaatagtaagctatttgttttgaggattggactaatcaatttcagtgattataaacctctgatcttcacattgatgggttatgtaatggtgttgaaactgtgcatattaacaatacatgaaatggttttaaatgtcttttatgaacagtgtcaattagagaaggggctaaattgactgcaaaagctcatatttgatggcaaagatgctcttctactctcagtaaaagttgttctttttactgactcaaagtctatttggtactcttttaagactaaaactacacccctaattatataatcagggagagtactagagtgattataactacatgtttttctgcaatctttgaacacaatatcaaatgctggtgttctaagtagtctgtttccaaatatccaagtttagactggaccaagaatatatgttagaaaacatgtctgatgagcgtttcaaggctggtcacatcatctgattgcatttggaggacgcacattggcttgggctgtgagctgggtatgaatggctacaagaagaaaaatccttctataaattcaagtcatttgtatgcagtcagtgtgagaaatatgtgcataaggagtaccttttatggtgaacatacacaatagttccagaggattgtctttataatacatcatactatatgcaaagatatttagaaaatatttgcacgaaagtgatggcaaaaccattgactagtctggaatgggtttggctatcacaaagacaatctgtaagaatgttttttcttttctttttttttacaagatggagtctcactctgttgcccaggctggagtgcagtggtgggatctgggctcactgcaacctccgtctcctgggttcaagtgattcttctgcctcagcttcccaagtagctgggactacaggcgtgtaccaccatgcccggctaatttttgtatttttagtagagatggggttttgccttattgtccaggctggtctcgaactcctgacctcatgatccacctgcctccgcctcccaaagtgctgggattataagcacgagccaccgcgctcgggcccagcatgttttttcatgttccagtcaccatggagtcgctcagcagaagctcttgcttctagggggatttcagaggaagcgccaagaaattgtgttcaagaatctgtccaggtttgcagctagggtaagggtttctttcagtagagctgcaaagtcaaagcagaaataattctcaggcttgtgaaatgccttaagttgagacagctagtatttttatatcaactctagattaatattctgttcttttaaaattttgtagttctgtgttgtagaattttaagtcaggagttaatgcagagttaattttacagacatgaaaacttgtatcatgaaggccttcccatttcttgaatgtttttcttttgctacttagtacaacaggagaaaaattaggtgatttttttgggtaccaattttaagtttggtaagaatggaaagatgcttaaataatagataactttaagtaagtaattgcagagggggcagataaaagrcaccattcatcaagtgtcaactctgtgccagctatttagctaagtgctttacatgagctatataatgtaatcttcacattaaccctgtgaggtaggtaatattgtctccattttacataggaggaaactgaccatccagagaaattaacagattttaaaaatgtcctacaactagtaaatgacagaactgggatttgaactaagagctccaggctctaaagcacatgttcactttatagttttacttcccacacatggtcatttaaaatggcattatttagtcatagattgaatatagctgtcatgagaaatcagcttgttctgtgtgagggtaagagtcactaagggttatttgctggtttctttaaattgacttggagagctaagtctctaggagaaggcagatgtcttcatttactacctggaaggataaatgttgccacacttgcacaaacatattgtatttctagaaaccagcatacacatttgatgtggaatgaaaatacactctttgtttggcccagcccattaattttaaaatgcctagagcccaaagcagccccaaacagctggaatactacctgctattccaaaataggcactaaaatcctctatttataaaaaataaaaatgctcttcttttcttaacaagctttgttagtgaaaaagcaaccaaaactgattgcctggtgttttttcttactttgcattgagtcctgcattatattgctgttgtgatgaaatctgaagtatacacaaaaatcaaacacatttcctgcctgtaggaacctttgtaaaaaacaaacattaattatataaaaacatattcytaggccacacaatattaattttaaataattgagtcagtacaaacatatttttctattttatatagaatggattttctcttttcctttctatgtactttcctgtttacaaaacaagtgttactttaaaaattcattgtaattctttagactgcctcctctggatatttcatttttgatggctatttgagaatttattcatttatgcagtgtgaagttgtgcaaagagcagtagactgaatgtcattggcccaacttatagttttattttgtgaagggtagtgtctagcccagtgcctgatgtattgtaggcacttcttagatgcccattgatgttttgtaaaatctctgctagctaagtgactttgggcagttctctagccgtctatttccttattttaaatatgtgaagtttacggatgatttctaggggcccatagctagctctgcaatgctgtaaaggaggaaaaacaattttctcctctacctttcattagttattagttgggacttctaaatgtctaatttctaatgtttaaaagacattaacatgagaacagtgtcttctaaaacttctaatgtctaaaagacattaacatgagaacagcaaacagaagtttaataacgtgtactttctatatacatgatagctcagagaaatgagtaaatatctatttggagtaagtcttgaagaagtcacaaattccaggaacatgaagataatgggtgaggcagctagtcaggagcaaaaacgcttttaaacaattacccctgggcataggtgccacccccagggggtgaggggatgactgaagtcttatgtctctccaggcttgataaattttgtattcctcacatagcttagacttctctgagctatttttcttttttcaatatttttaacactcactatagaacttgttaagccaaatatgtccactgggaatgctataagcttattccaatgttttctccattggttataacattttaaggaaagttactcttttggaatgaggkttttgtagttaggttatgatccaagtgcaaatattaccctgattactttatagccatcaattggcttagataaaaaaatgatgatacattcagcctgatcaaatacctttttaattagactttgttcaattaaatttctcccaaagggtacatttgccattattaaaacattaatttttttttacttactcgctgtaagtacagataaaaatattcaaaatatatttaagtatgtgaactaccatggaattagtgttacttctttctaagatgttgcttttgaacaaaataatactaatttggttgcatgaattcttttgtcttcattgaaaagtcaattactttaaagatgcttctttgttctccgttaaatcaattcactcctaaatgtaattcaaaagcatagccccaggggagtacttttgaaatggcagagtggggacatctgaaaattcactccttaaaagcaatgagaacactggcaaaaatggtcaaaataactttttcagaactctggaaattaaggcttgcaacaagaaaaatggcagaattgatacaagaacaatgatttttgtggtgttttaatttaccctatttccatctccctctctctaggatcacagtagccttgtttgggggcaaagggagagcttccccactttccccaccccagccctctgaaggtttgctgaaaaatcactaacgtgaggcagattgattaataggagaaaaggcatacacatttattcaatgtgtatacacagtggccttcagaatgaagacaaagatacattatccatttttaggctgagattcaatgaagtatggacatacctgtagaaatatgattgttcaaaaggatattgttagtggtggcgagtccaaacaggtccgcagcaaccttcaattcttgcctcctctgaagaaagaatttgacygaggggcataaggcagagtgagagacccagacaagttttggaggaggagtgaaagtttattaaaaagttttagagcaggaatgacaggaagtaaagtacatttagaagagggccaagtgggtgacttgagagatcaagtatgtgatttgacctttgacttaggattttatacatttcattagcatgcttctggggtctgcatctctgcatctcttatatcctgattcttccttgcggtgggccatccagatgcacagtgacctactaggactttggaggggttgaatgcacagtgtgtttactgaagttgtacacatagtcacttgagatgttttttccttaccaactgagtgttcctagaggaaggtcatctgccattttgcctcttagggtgcgtgcttgagcccactcacccaactcctgagatcttattgggaagctgctgattaccagtttcagatgttatctgtctattgggagactgccttttcctggcactggctgcgaccaattattattttagcaagactgtataacaaccaccttaccatcacctgatggttgcctgacattcctggtgaagaagcagtggaccctctcctaccatgcttgtgtctcactaactaccttctataacaatatgatctagtgttaaaaaactgagtggggaaacccagcaagtcctgtctgtctagattcttcttgtcctctctgtgcagcagtccttccttctgggtgtgggatggggccccctctggaatgtcaaacaaaatagattagataatttctttatggcctgtttttacatagactatttttaggtttctaaggctggcttttgggaaaaggggtcctgctttctatgacccaccttggggaagagagattctagttttcatggctagccttgcgggagaatgggactgagagacaggcatgcaggagaaggtcaaataaaaatgtttgcttttgagctactgctaaggccttcattttgaggcattgttttctgagccccaatcttgaaagtcagtagtcacacaaccatggtagctgtgaaacccacagctgagcagccactgaaaaaagaagaatggatttggagctgcctcaaaagctccatacccctgagacaatttcataaattgtaaaactgygtttattgctttataatgtttaaagatgtaatttgtatcaaataatgtaagagcaaaacataaaatgtgagaaaagaaaacataaaagtagacttaggttaccatgggttaagcaattgtttttagatatgaagatccgcttccttctccttttccttttcttatttatgcttggataaatattacttcccttgagaagccttttcctatgaattgcattctctgcatcctactcaaatttgtgttcccatgggagtatacctacaggaaaacattcatcatgatgttatattgtttatattagtgcctttgaatctctctccacagctaggcttaggaacatttttgtatgttcaagactagcagtgtctgacatatagtagggattcaatatagagttataaaattttaaaataaattttggaccaagttgcgtaaggaatagggtagaattacttctaatagaaagtataagttaaaaaataatatttattatgatagtcttattttctgtttaatttactttaaatgataatgtgaaatcattatttgtgtaataggacatactggtattatcattaaaatgaaacttcacagttttctattggccacaatgattggcaactctctctgcgttgtcatatggacctatcatgaggttttctatgtagagagtagtcaatatttatttgaagaatcagtgaatgaatgaatgcatcttatggaagcataatccaaggatcttttccttagaaatcattatcattcttgttacattgaaaatgtcctctaaaaagtaagataaattgaatttgattcatttggctggtgggatatttatattcagaactaaagtgaattgattacatatcaattattcatgattaataatataatacaagtgattgtcccattagacattttttcatgctatatgacataaaggacagtaacaatctatgaaattgaagtatcttggaaaattaatttttattccaaataaacttaactaataaggagtccctgctgaattataaatatttaaagatatctgcaaattataaaccatcatatatattagaaaaaaattagtctgagtagagaagcagtgctgtgcatttttttcctgacttattgggctccttttaagctttgcaatcaaataaatttctctagtcactcagaagtgtaaataaagagcactcagcgtgctgatatattttatatttagtgaaggtgctgcagaaggaaaacaaaaggacttgcaactgaatcaaagtgatgaaatgtagtggattacatagatcaggcaataaataaactattgaccagagtatgtttaagtgaacatttttgttagaaaataactttgaaaatgctaaacaggtctttattgctactattggtcttatttagttaaatcttgctatttgattaaatcatttttgaggtgaaaaatatttgactgtcctctcattttttttttcaaaagtgtaaagatcatgacctaaaatcagtaataggagaaaaaataaagacagaatggtggagggaggataatgatgaaaatgtcaaacgtaaaaatgtgtagaattgctgtgttttgtggggaagcctactttccctctgatgttttgatgattgacacattttgccaaaataaactgacaatagacagacagattaacaggagaaaaagacacaaaagtttattattgtgcacatacatgggtatgagagtcccacagatataagactcaaagaaacagacagacagttgaagcttatataccctcttcattgggggagggaaatggaggaaatataggcaattttgagggattgtaaatgatttttagggaaattaaatggtcccagtgataaatgcaggaggcagataagggaacctgcacagggtcttcttgcctgggcatgcctgcaatgcactgggggcctatgtgcacactgggagaatggggtggagtcaccaggaattgacaccttatgcaggggcaggagtcgggcgtcttcagcttgtgtgtggtgacctggtattcagtctgtgaagtgggagccggttggcaggactccctcacctgtttgctgagagttttctttttgcccaatgaactctgctctccttacctttcaatggatctgtgtgcctaatttttcctggttgtgagacaagaacctggattttacccgaactaaggaggaaaaaaatcctgcatcaccaggagacagaaattagcttgtaaatggttctctttggcatttgaatgagctttagagacagacactattttctgacaaagtccatccagttttggttacattccttagtcttctttcctgccatagataattaaatttcagggcgggggacaaaagacaattctgtgccttttggaaagctcagataaaggaatttgagagagagggttccactctgtgcttggagtgagaaacaggagatcaaaaagtccttggttctggggctgcttatgaggccttttgatatcctttaatttaaaagaactcagcatgccaaagcaccatactttggggtattgttctctggactcctacaatttctatggtaaggcctattatttaatatatttttctataattgtgtaatagatatgatttttggtatcttttatgaagtaatgatagatgtcatctgtttttatcaatgaatgaaattttctctgtccgtttctttcattttctcagttttttctcttccacctcccctagtaaaccttatcagtttggagtagttgaaagagcactgagtcaaaagccttgattttatatctggctgtgactggaactagctgggtggctttaggaggttagattttgtgaaaggaaagtagaaactcgggaccccaattcaccatgccaaaaggaaaaagttaagctgaaggctgagtcagccgcctttccttttgttcctaagcagatagctacagataaaaggttaaatatctccccgtagctacatagtgttcaccttaacttatgtaaagtgccaatttaccaagcacaagacaaatacctaattgactattaccctatctgcccctttcctcttgcagtgtgtgtatttccatactctccctccttcccctccagcccgctttccccctttacatattgaagccctcaagttcatcttcggagaaagacagaccacagactgtttcggtgattttatgtttatttcttaataagggtatgtccttaaccctggcaaaataaacttccaaattgattgagacctgtctcagatacactttggtttacaaatgaatgattttatggctctctccaggttcaaaatgttattgttaatgtatgtatactaatagactaatgatgggttaattgttatgtgtccttagtcttttgagggcttggtgttgcttagactctaggttttatgactgactcgatgtatttggggtgcagtaaatgtcacttatttagtatggatcccatatgtcagtttttctgattactgctccataggtaaacaactcaggactcaacaccacctttgcattctccagaaaaaatttacccacgcctaaagcatcagtaagtaatggtgattgtgctgaatgttattttggaggtgaggactgagatctgattttatcttgcccaaattcctttctaaggggtctggggaatcatgccctacaaaccataaattctcatcagatgggttttatttaaccctgtgtatcgtggcttactttccaatctgactataggataagaagggaaaaaatcaaaatgttttaccccaaaatatatttccttgccataccttgaaattgacctgcaaagactcttgtgggaaaaatccacattctacagagaatctccttcccccttcgttttccttcctttctttctagatccaggaggcagtcaactgaaaggcaggtaagtttttaggtctgataagaaacattgtacaatctgctctctctctgaagtctgctatctgagagagtcctctgcacaataaaacttggtctccacaatcctttatcttaacctgaacatttcccttccactgatccccagtcttcagataaactcaactaattttcaaccagaaaatgtttaaattcacctatggcctggaagcccctgctttgagttgtcccgcctttctgaaccaaaccaatgtgtttcttaaatgtatttgattgatgcctcatgcctccccaaaatatataaaaccaagctgtaccctgaccaccttgggcacatgttctctggacctcccaagggctgtgtcacaggccatggtcactcatatttggttcagaataaatctcttaaaatattttacagagtttgactcttttcatcatcaaaggaaagcttttaccttgcacattccataacaaattactgtaaaaatctttgttatacctgtacgttctccagaaatcatctttgttctcctgttcctggaaaggggtcccaatccagaccccaagagaggattcttggaccttgtgcaagaaagaattcagggcgagtccataaagtacagtgaaagcaagtttactgggaaagcaaaggaataaaagaatggcagtccataggcagggcagcatcttggactgctctattgataatacttatagttatttcttgattatatgccaaacaaggggtggattattcataagttttctgggaaaggggtgggcaattcccagaactgagggttccttctctttttaaaccagacagtgtaacttcctgacattactatggcatttgtaaactgtcatgacactggtgggagtgtcttttagcatgctaatgcattataattagcctttaatgaaaagtgaggacaaccagaggtcacttttgatgccatcttcattttggtaggttttggccggcttctttaccccaatctgttttatcagcaaagtctttgtgacctgtatcttgtgccgacttcccatctcatcctgtgactaggaatgcctaatctcctgggaatgcagcctagtaggtctcagccttattttacccagcccctatttaagatgaagttgctctggttcaaaggcctctgacactaccatgctgccaaggagattctttacactttagtcttctcaggactaagaagcattcaycttccccagcttctgactacctttcctctaggttatcattatccaactttaggtttcttttccctctattttacctaataatctcctatctttattcaaactgcatacaaccacccatcartgtgctcagccaataaaggacctttctggtgtactgggagccagttgcatcagaaggcagtgggcattgaacaaataaccacagggattgccatggtagaaatagtcatcttatgtaggattatgagtttaagagttcaagataatttgamacaataaagtagagtgatgatcagcatattcttcttaattatatgaattgccacttgaaagcatgaattagaaaaaaggtaacattttaaagtagtatcttggaagacctgggatgcctataaacttagaagtttgattagaaaagtattaatgaataaggaatgatcaaccactttgggccagccttaacattttggtgatgtcttcttcaagatgaacatatgttataaaacactagttatattataatatatatatgtgtatatatagatttataattagaaccacaatgtatatataggcttcttaaacctttattatagaatatttgtaacattatcaaaagtagaaaaaataatgtaatgaacctttgtgtccctaacacccaacttcagtaattatcaattcacgatccatcttgtttcatctctgtcacacccacttcattcccctcacatattattttgaagcaaatggcaatcattatgtcatttcatcggcaaatgtatcaaccatatataattttatatagtttactttctctttgtattttatatatcacacattgccccatagaattaattaaaaaatacaaatacaatggatgcataatattgtcttgtgtggatatactataatttatttaacaatagctgtacttttggatggtttgtttctgaattttaataataccaacaatactgcactgagaatctttgcccataaatacttatttcagtatctgattgctttctttgcatagaattttagaaaggcagcaataagtatattaaacttatttgaagcctactgcaacaacttctgactggtgactatatttcaattttcaatacctggtttgaaaagtaaacaggcaaactcaacaaggtaatttttatactctccaatcagacaaaaacattgtttcaggaatttgttataatggataggctgtcctaaattcttccataatccattaaaattaattgtaaaattttgaggatgatgtttgcagatttaatttgcaactagtgacaatgaatggccagtcttggtaagtctgtattttggtgatattcttatgaagccccgttagtattatctgaacatttttaaagtttcctgaaacatattgcagttcattttatatgatcattctaaatatttataatgtaaaacccagaagtgattttccaactatgctcagtgccattcggattcttattaaggttctgagctagttttctgatccataaattaagaagactaagaagaagtggaaaaaatcagaagataataaatggaaattagtgaagggctagaaagcaggatcagtaaagacggctaaagaaattgtgttgatttaacctgaaaaggagagagctcaggaatatatgtgaattacagaagatagttcttaggacagtttataatgtgatacatgcctcctaagcaatgtaaacaccaatgggaaaattccagtttggttccactttttttgaatttagaggtacccttttgaatttattaatcttgattttttccatttcattaatttctgattttatccttatcattttcttctttcttttagggtttactgttattcttttttcaatttcttcggttttttatacgcttagcacattcattgtcagtcattttttaaaaataatttctaacacaaatatttaaggctctttattttcctccaggtaatatgtagctgttgtagtttgatcaaagtttctcatctattatctaatttacataaagacattttctttgatcctaatgttattttggctaagagttctacctccaaagccatgctgccaaggaccacagctgagctccaccacttatgtgtgcacgtgtggttatttagcaccttatttattctctttctgcctcaatttgctcatctatgaaactgggatgataatagcagtacctaccttatatagttgttacaaggattaaaagtgctaacgtatttaaaatactcagaagagtgcccaccacttagcaaggaccatatgcgttgctactattatttctctggaacatttttactgacttctaatgtattatcatgatggtcagaaaatgtgggttgtataatcttgattcttcawattgagatttgctttgctttctggcttagtgggtggtcaatagtgtaaatgtctcatgaatgctttaatcagaatatattttctattgaatatatctaatgattctatatttgttcattaaattaaataataatcatgttgttcaaatctgattcttactgatattttgtcagtaaaatttttattttattgagacagagtctatctctgtccctcagcctggagtgccatgacatgatcatggctcactgtggctttgacctcctgggctcaaggaatcctcttatctcagcctctgagtagctggggacacaggcacacaccactgtgctcagctaatttttttgtatttttgtagaaatggagttttgctgtattgcccaggctggtcttgaattcctgggctcaagcaatccgctggcctcagcctcctaaagtgctatgattacaggtgtgagccactgcgccaggccatctccttaatttttaactaccaaaagagatgtggtataatctctcatggcgattgtaaatttgccaatgtcttcataattcagtcaattattgtttcaaatatttgtgattatgctattgaggtcgtggaaatcaagaattgtaattatttcctagtaaatattcctattgtctttatccaatgacccttgtatactagtaactcttattggcctaaacatcttttttggtctggtataaaaacagtatttcctttattcttaacttattcaacattcttttatttaatatctgctttgtaactcttcttccatttcttttgtttgaatctttctatagttttctcttgaaacagcatgaagctgaactaagaacagttgtgagaatctctttgttcagtttaattattttactctaatttatgcttatcaatagattgatttgttttctgcttttaatttatagttattttccaatgtttttgttttatagtaaatttatggcaaaactttcatttaaatgcctaaatcttaagcgtacatattctgcattttgatgaatacaaacatccttgtaacccatcacctcagatagtttcaagttcctttatccctcttgtgagccaggagtgcctcccacactagacaaccactattctcaccttttccacccttcattagttttgcctgttctcattactttacattaatggaatcacacagtgcattctgttttgtgtaagtcttctttcacttgttgtgacatttttaatatttatctatgtcattatatataccagtagtttgtttctttttatgggaaagtagtaatataccacaattgtttatacatttctctattttttgacacctgggcatttctaagttttggttattataaataaaggtgctatttacatccatgcacaaggctttctgtggaacatacttttatttctcttaaataaataagaatgaaattatttggtcataggatagacatattttcagttttataagaaatggtcacactctttcctgaaggagttttatcattttaccctctgactgactaatgtataagagttctggttgctggaacttcagcttttgccagatgtgtattggcatctaatggtggtttaatttgcattcccctaatgaatataattttgagtatcttctcatgtgattaatggccatttatatgtctttctttgtaagtgtctgttaacatagttttcccatttttaaattgggttgtttgtcttattattgagttgtatttttatttatttttatcttttcccgctttctattgagttgtaagcactttcatatatggttttagtcatttctcacaaaaaccttgggaaatagatataattatttccattttaggtatgaggaataggagttatgatggttatgtgacttctccatagtctcatgagtaataaatgatagaactctgatacaggatggctaggatgaaaactgtgtaattgtaactactacattatgctacaaataataagtagtatgggactttatgtgagagagggaacccatgtgagctgagatgattaaagaaaataagtggaaatgatagattttgatgagtgacagatgagtgataaataattatttatcaagtagtggtattgtgttgtgggatatagaggtttgtaaaaatacctccatgcaaaagatagtcatgcacctacatggagtaataatagagagatcaatcagaaaatgtcctcaaaattataagattatttgaggccaggaactttaacaagtaattatcaagatgctttagtgcattgcaaattatgagaactaaaactttcttccctattctttgaacattattttgtattctcttctgctaaaatggtttggtttccacaacaatgaattaataaagtattaactttgcttaagatttttatttaatgggcattttatttatttattattattttttgagacagggtcttaccctatcgctcaggctggagtgcagtggtacaatgatagctgactacagcctccaactattgggttcaagcgatcctcccatctcagcctcccaagtaaccgggactacaggcatgcaccaccactcccagctaatttttgtatttttttgtagagacaaggtttctcgatattgcccaggctggtcttgaactcctaggctcaagtgatccatctgcctcagcctcccaaagtgctaggattacaagcatgaacaaccgtgcccagccttaatggacatttaaaaaaattgggtgctaccagtcttgaaataagttgggttgagtttggaaccacagggtattttaacttgagaaattacggcaacttcagaattatagaatagttaagtatagtagtgcatttaaagttagctcagttcagtccatgaactcctaagagagaatccagaaaagatacaaagttgtgacagaggtatagggaagagaatcacataaatgtatacagtttagtgggccataaacaatgttacttgttttatttttgtatatttactagtagccctctattcctagtttaaggcaatgtaagaatgtctgctgtgcaattaagccatctggttggtggtttatgctgtgaactagtaagcagcataacttgagagaaatacagataagtagataagtcctccagttatctgcatgactcttacttcacataaactagtgtgtcatttttaaactcttcaaccttatggacactttagggcttggattctttgtcaatctttgcttacttctactactggatgcctattatttttttccctggcattttgctaaatgagtttatatcctatgtggttgtgagtgttctaaaactgagttcagattaaggacaattgacagagaggaggccttgtttgggctccaagctatctgattttaaaataaagtgattagaagagtgtagttgtattagtccgttctcacattgctatgaagaaatacctgggactgggtaatttgtaaaggaaagaggtttaattgactcacagttccacattgctggagaggcctcaggaaacttacaatcatggcagaacacaaaggggaggcaggcaacttcttcacagggcrgcaggacagagttgagtgctgcgaaagtggggaagagccccttataaaaccattagatctcctgagaacgaactcactatcacaagaacagcatgggggaaccacccccatgattcgattactccacctggtctctcccttgacacatgaggattattgggattacaattcaaaatgagatttgggtgggaacgcaaagcctaaccatattagtagtgtaggaaaagaaagattgacaggcatcaattaagaataacctcacctattccttttgtttccagtggatgtgaaattggcaggcagataaagccgcctgtttgttcactcatgcatattcctatcacagcatttttataatattggaattacagtccactagattgcatgatttggagagtaacaccaattggtttttgttaatcattgttttaggaacgcttagatttctgaaactgatataggttcatttgaaaataggttcaaattttgacatattgtcaaatttctacatatagatcacagtaattaccatgtggggacttaagaatttttctttgttgttattatcaaggtagtatggcttctttacgaattagcgtcacatataaaaactcaaaacaatggtagatttgtgagcaaaattagccattagccactctcttgtattgactttaatagaagttgcaaaagggtaattttgttgcttacacaaaagctaatattcctttagtgactgcagctttctatttctggagttcacttatacggagcacatttttactgcttgtattattctttaggaagcttaagacagcccttatattaaactttaaatactccctctccaaaagtttatccaagaactagaatggtgaacttaatctctgcaactttgcaattagtgtattaacttaagtactatttttggtatcactgtgctctgcaagtcatctggttaacgtgtttccttttgtagaattttaccagagcatagcaattggaacacaaaataaacattaacagacttttctttgtgcttgcgtttggttataaggaaaagtttttttctttgctgcttttatccttttaaaaagtgcttttaaaataagaggaattatgtttattttaaaagagcaacatgtcaagatgcgaatagatgtgcctatcctaatagattctctagaaagataatgtttaatttttgtagacgtgtatactcgaaaaagggacaaatcaggttctgtattttcagcttttttttttttttttgacaaatactggtggtgtaaattatccagctgttcttcctttgtatggattttgtagtactcagagcgatttataggtctagagtgcagctgctgaaagtaatttattctcagttctgtattaaacccatcatatacaaatgcattagcattcagtacagacctcaaaggcataagatatttttttcccttctgagttgttgtcctacaaatgtttgtaggatataccaaaacagcatcagaaaattattggtttgatatgcacttttagcagtgctgcttttagcattcctatttagagtagttgaaatccactcatttattgatataaaaggaacagtcaaaatgagtcttcctgtcaacattaacagattggtaatactaggacttcaacttgatctgctcatttgctgctcctgccatatgtctactaatctgatatgttcaccatttcagaaacttaattatttgcatttttttggaggagcacttgtttggaaataagtaagggaaattttcacatttactttattttttcatttcttcttaaagacatctattcctcctttagatggacaggagctattctgattaataacataaacagagtttacagagctcaatgcatgtgttgcttgcttatgacttctctaaaacaccttcacaaaatattgaatgttcacaaaatattgaagcacatttgaaatgtacacagtgcttgagaataataatcctcaaaatgtatgtctagctatttattcagagaataagattttctcattattatctattaatataaaataaaacatagctttcatcctttcccttttaatccttctcatatacatttctggactaattttttaaacaataaatctagataagccacttgttcataaaaaatctttaatgactccaacctttctgttatatgaattataaaaaggttaacttgactctcaaggagccccatgatcttctcccagactatttactttatttattttttactactcccctgaatccaccttatgttccagccaaaatgaatgattttctgcactcacatgtgccatactgtccttctctcatgctttatgatactattttactcttagataattctctgtctggattcagatgttcaaatcctatttccaatgaccacggttctctgaatgataaggattttcctttaaccatctcttttggacattttttttatttttagtagttattattgcatggcttatattccttggaagattataaactcaattaaagattgagatattttaacttttatccccaacaaagcctagggcaatgtcatttgcatatacaatagctgtttaatatttgttgtatttaactggaatctgttgttaataaaatactggtttaactgaaaattgaattcaaaatgtttaatggttgttgagaatgcctctgagatgtgcattgtgcagtctaagtatggaactgcatattaaaagtaatttacgctttataataattgaagttcttaaagcacccaatgtgaccttattaaaaagtctcattttgaaaaacaaaaaaggccgtagagggacccaaagcttttttgtttgtttgttcagaggctgggtctccctttgttgcccagtgaagtggtgtgatcatagctccctgcagccttgaactcctgggctcatgcaatcctcctgccttagtggccaagtagctggcacwacaggcatgagccgccgctaacggctgattttttatttatttatttaatttaatttaatttaatttaatttaatttaatttaatttaatttwtttttgtagagatgggagtctttctatgttacctagtctggtatcaaactcctggcgtcaatcaatcctcctgccttcgcctcccaaaatactgactttacaagcatgagccaccatgcttggccactgttaaatgattgattctaccaggagataaaccagtattgagtagtttatttctcatatgagtttgttttctgatgatttgacccactatgccaaaaccaaattccacttattcacaaatttcagttatttcagattactcattttctcttagaaaattttaattttttaaattttatcaaattattatgtgcttaacccctcttcacttcccaattattttccagagacaactatttttaaattcttggctctttcttctgatatttaactcagtatttgtaaaagataagagtaaactactgttttcatttaattttcacttttaccaaaatagtacatataataaatcaaataatgctataataaaaaatagctgtcccatgttccagcctgtctcccagttctcatgcctcagaggcaactattttaaatcttttaattgtttcttctagtatttatattcatatttctaaatatcacacagtatactgtttttcttgatgtttcaaggttagatctttatagatttccttttgaagaagattataatttttgggaggccgaggtgggtggatcacgaggtcagaagatcgagacaatcctggctaacacggtgaaaccccatctctactaaaaaatacaaaaaaattagccaggcatggtggcaggcacctgtagtctcagctacttgggaggctgaggcaggaggatggcatgaacctgggaggcagagcttgcagtgagccaagatcgtgccactgcactccagcctgggcaacagagcgagactccatctcaaaaacaaaaaaagaagattataatttaattttcatatcgcttttacatgcacacacacacacagaacttcttcctatcctttcagtaatttcgtgtttttatttcagccagtatgaagtgattatgctattattactatgtaaatattttttactctgaatcacatagtgtaaaatggctacagtttgttcttatatttcttttcgttttatccagagttaagaattgtttgtgttttaatttcttcgttttctatgtgcctactaatttgggtcagtcttttaaaataaaatccaaagccctgtcaatgtgatcaaacctattgtaattgtcaggatagaccagattatctgaagtaaaaaagcatgcccagaatttcaaaagctttcaacaacaaaagtttaattctattaaagttaatattatttttaattgataaatcataattgtattacatttatagcatagaatttgatgttttggatgtatgtatacagtgtggaatgattaaatcaaattaattaacatatccattacytcactatttaacttttttcttgtggtgatacatttgaagtttactctcttagttattttgaactatgcaatatgttgtttttgactgtagtcaccctgctgtgacatagatcttaaagtgtattcttcctatctagctgaaactttgtaccctttgaaaagcaactcctcatttctgagttactcatctccacaaagttaattccttatcatgatagttactcactgtgggtcagctacagatgtgtccacatcatcttcctttgaggattcaaaatgctggaatctaatattcaatattagatgatatcaatagtctagattatatcatattctagattatatcaatattctaactgctatctagaatattgccagtcttgtgccagagggggaaaaatgccaaccgcatgctcgctctaaggtttcggtgaaacatcacattcaaacacatttcattgcccaaaggaaatcaatagcaaatagccagccatggaggggacaggggaggatagcctcccctctgagaggggtagaacatatatattttttttgaacaaaaatacagttcactgcatgcataagatgaagtgtaagttgaattgtttagtgttctttcttgtcttttgctttttcattttctgtagtatcctgtccttattttaagattgtaatcttaatcatttacctttctgaggatactgataaaattttttgatgacttttttctctttctagcgtatatcagcttcttccagttttaatttttttctctgtttattttggtctctctttttattgaaatctttcatgaaatgtttggtgtttcttgggtgtcagtctaggtttgaatgaagcattaaaaggctgatttgcagatctgtttctaggccttgtcgattgayctgtttcattttggaatctccggggtgttaggacctagcactttgctggagaacctcaagctgagaataaagatatttttctctgcggcaggtcagtttttccaaggaagtaatctttgattccttatgtgtgtggaagatgcctggtttccaggtttttgcacatgaagagatagaggctgaggaggaggcatctcttaactcaacacatggatgtttaattaatccactttttttccttgctcttcacagtacctgatgtctctgagtgttgagctactccagttaaatttatcccatggaaaatgcggtattctcttggtgcttgtatctagtgcagggagtaggagggaggtgtgtgtgggcattttgtaccccatagaaacagactttaaaccccaaacctccttaagggttctgtgaagtgaatcaactctcttatctttattccccttttaaagttatagcttcccctccctgctaagtaagttatccatcttttgttagcaccctccttgcaaatatgctgaaaatctcattcagttaggccttttatttgttttgtatgtgtctattgctctttcaccattttagggaagtcttggggaaagagaagatataaaaaaagtataatcaagtcatcataaatctgttgatagaatttcaaagtaacggaatatgagccttcaactgatcatggctgggactttgtgatagaagctataaggatgaatggttgagtttgattattttaaaagatggaaatgtggagaaagttgtcacagttccagaaataggacagacaaggacttatactaggtatggcaagtagaacagatgagctggtgtacagggtttgccaggttgggaacacaacttagagagctttcaaagctaggttgcatattttgatgtttttatagcataagaaaatcctattaaagtagtgactgatttcaaaaatttacccttgatacgaagtcattatatctaattgttaccttcaaaacactagaattggatttttcatagtcttttctcgatgccttcatatttacttattttggaaatggtgaattacggcatcatgcagtggaaagtttatccaactgttgagcaatttgggatgtatattgtactttgttattaagttacttttagtcctcagtaggtcaatttttcggagggtgaacctctatctctaacatttcatgaatctaggaagttatggtatctataatgagaagaagagaggagaaaacaaacacataaaagatgaagctagacaggtgggaatctaaatctaaaatttgcagaatagaggaattccccaaagaccaggcatttaatgtctgttccaattttgtagctcttatgaattttggaaatgtgctgaggctttggaggcagtgatttgaatgtgaatcatgtttatcctactttctaactgggcatgttacttacctcctttgagtcttagtttcctaactgtaaataggtgaaatagtacctcatatagctgtttggagatatagtgagacagtatacctggaacatagtaagcccttaatagttattattataactttgaaaaaatttaatagtgaattttgcaaagggaatctgaggcacaaacaacaatgacttaggagtctggcaggctttagtttgaatcccacttctggtccttcctaccgccagggctttggactagttactcaccctttctgagctgctgctgcttaaaaatgggtctatctggatcaagtatactaaatgagataaaacatgtcaagtccctaacccatcatgtgtccttaataaactatagtatattattcatttttgatatttccttaatataaaatattgtaaaataatataacttcaatgctagttcaaatgttacccttttttttttaaagaaactttctttcagatacacacacaacagtaaaaaagctgacgttatcaaactgctttattgtctgacacttttttttattacaattcagttccagtagctttgtgacttaaatgtaaattttatctcatcagcattgcctcatttattggaattgaagttctcgttcccaggggtaggtgtcctttttggctgtgatttgctacttcttcaccagcgacagcagaattctcattacccttggtcctgccagaagtggaagtgtgtgtaaatcctcagagtgtagggtgtgaatcagttggcattttatagaatttcacatctggtacttcttcttttttagtttgcatatcctttccctggcatagaaggaagggttaggaacaacatccttaccaagatgaagcagggaggctggagagtggaagatcgaggtcttctggtatcactttaaatcctttcttgarggatgagttgtttttccttttttataatgaataggtgcttgtaacaaatgatggcaaccatctgcccttgttaatataccccttggactgtcatatcaaaggaaaagattctgcacaattcttcatgccacaaatcaacgcatttgtagccttttctccacctctgacttatatctctcagaacggggcmaagacatacaggaaagttgttgaaagtgatgtttatgatgccgtaataaaaagatcccagatcacaatagtactaggtctgaaatcactgcaattcaatcaggttataaactggagtgttgttttgggcttctggggatgatgaagttgatggctgaaacaagaactcatttgtaaaagaaaggtaccagggccttgcagtgatgattgactagtttgaataaatactccaccactgcttgttatattaccttgggtttcttgccatctggacctgctaacctgtagagacttagttttctccaagtgctgtgttatggcatcaagttttatccccttctccctactaactagttcctatacaagtaagatgttaattacttgaacttatacagttcttcctttttaaatattttctcactgaagactgattgaaaacaccctggagtctgtcatttcagaatgagccgtaatttattggaactcttgcctttgctgattagcggtgctatttttcacttcccctttgtgttattttgcattctcatttttaacattatttctttgcttttgtgaaataatttttttcctgacaagttttaaatcaatttgggttttatattgttgtttaatttgttcccctttttgtctctagcagggatttttccccgccaaagatccacggacagccttttgtgaaatcacagagggagtatgagctgttttttaaaaaaactgtttaaagcggtttcggtttttatgatttgtgaaaatacagacttctctgacatccacagatcctagacctctcacattctagactgcctttgtaggatacccttatgatttagtattccatcctggggtgctatttctgactaatataagttggggaatctcatggtcactagtaataagctttcctcccctttcaaacwctgcattagtacctccaggggtcagctgcagagccagtttatcctcttgcgtggatgttctgcttcatgacttttgaaaatagtcacagaaaagtcaagaaaatcaccccttttgatcctgcatataaaattatttttatgatatagcagataataggttggatgatgtatcttattatttattgtgggaactaaattacttgaatgccaatatagtattcatcctattatacgtgaaaacttgtggcttataataataattatgccttttctcttctctctttctcttttcccatttatttttagtctaaaaagtatcagatcattgaaatattgaatgagattgagcaatttatatttaatattattgtacaatattataccatgcatcattaaagtgtattgagtattatatttaaatgagatagtatacatagaacagttctcaacacatagtcagtgctacatttgtgttagtattagttgattttaaaaaacatatccaacttatttgtatagcagaaccctgtgtagctacatacataaagaaaaaaatccccaacatgaactagaggcagcatcactraaaatgagccatttttctctgatttctcttttctgaattgtttttctggaccaattaccccttgctgaccatcctgactactatagttttgagattttatagtaaatagagacaataaaaatattttgaataaatgtgtgtatttgaaatgacagcctctttgagctataaaaatgatttgattcagggaacatccgtggatttttaaagttgctctatattcataaatctggtgatgttacgcaatgtagttctaagccagaattaatgagaaagcatacctctgtttcctccttactctgcttgmttatgcattatataatcagttttcacattaagatgccttaatttgttagtcatcgcaaaatgcctcactcttggcaaccacagtgttggtatttctgacatamagtttcccaaatgttgtttttgaagaccattcatatatttttcacrtttcatggttaattttaagaccttttaactccttgaactcagttaaattgcaggtggtttgctgagcacttctgtccctcttgattttaaggcttggctttgaattgggtttgggaagattcaggataccttttgtgttcatttggtaatctcattattttaactcatctgtttgctaatttaaactgtgtttgtatgcataaataaataaatagagttgtcagggtcagccctaagcaaattttggagcacaggaaaccctctgcttattaaaaaccagtccccaagatgacttatagacaggctgaccacatgaatgaccactgaggctttctatcagagcacttgataacttcactttcttttgtcaaagaaatggatttagcagtgaaagtcgctgggcgtggtggctcacgcctgtaatcctagcactttgggaggccaaggtgkgtggatcacctgaggtcaggagttcgaggccagcctgaccaacatggagaaaccccatctctactaaaaataaaaaaattagccgggtgtggtggcacatgcctgtaatcccagctactcaggaggctgaggcgagagaatcgcttgaacccaggaggcagaggttgcagtgagccgagattgagccactgcactccaggctgggcaacaagagtgaaactccacctcaaaaaaacaaaaaaaaaacaaaaaaacaaaacaaaacagtgaaagtcacgtagcatgttatgattcaatgttatttatacctgcaatgcttgcatttcaaggacggcattattggtaggacacttcttgcctaatggtttggatctatagaagaatgaatttctaggtgttgaatgtgagagatattttggagtgaggagacttcctgggcacttaaataacagctactacatttttttctgtgtttaagggagtccctaaaattattttgtggagaaactattttatatttgttgccaaatttcttcattaggactacttacaaagagaaggctaattataaaggaacagcaaatgtcatagtgttttgaatccttttcatacataagacttccattctgcactgtggctacttkgggtcctcttccgagtgtagcatcttctgagtttctgttcctcagaagctaggttcttgcccactctttccttctccattatcatgctgaatgagaaacacctaacctctgtggtcccactccctccagatgatggctcttatttaggaaacgatgccgttattgggttcatttgttatttagcgcagcgctaatgtatataaaataagctgagcaaatacatgttacttgattagtttattctttagggtactggcatctagtaaaggactgctgaagaaattgtgctttaatccaaggtaatggattatactaacatatagtatatatggtatgataattatattttgatgatgaaactacatgccctaggcagaacagtagaggaggtgtgtttgggaaaggggcccttccaacactatcccaattacactttacaggaaactgcctgtgctacttatgaagctacttcatttgactaatagtagaaaagaggcagaatcagagagcaaggtcacctggtatcctgcagctgagaaactgagaatatgtttgccaattaggcaaaaacatagagggtcatgggagttagaagcaaggaagcgggaacataaagtggcgcaaaaatagtcatgaagtaggcagcaggcagcaacctcagggacgtatattttacagtgtaagtgctctcacatgcatattatcttattatsatctttccaaactctccttgtgataagtattattcactctgtaamgtgatccaagcttctgcgtaaatgattagctcaggtcttgttaacttactggggagtaggtgagccaagattgtattcagctcttttaatgctaaatgcttttttttttattgtttgtttttgcattatataacttcagggtcagtgttgagatttgatgttttagatttatgttcagagctttaaggctgataaaaaagatgttgtaaagatatgtctccaatctataaaaatatggagagacaactaagagatacacttaaagagtgattatcttgggtttcactccgcagaatgggtttaggttctgcagactgggaacttgtgttgtagtagtaagtagttaaaagctaaaatgtgagcatttaagattatgttttggagaatatagttgtccctctgaatccactggtttcctatctgcagattcaatcaactgtgggttgaaaatatgtggggaaaaagagcacaacgcaacaataaaaataataaaaagaaaaaatatagtacaacaattatttacatagtagttacattatattaggtattatgtgtaatctagagatgatttaaaggatatgagaggaggtgtgtaggtttgctacaaatactatgctattttatataagagacttgagcatctgagaattctggtatcagtggggatcctagaaccaatgccctctggtacgaaggacaaacatattcttgagggaatatttgaacacctttaattctgaaacaatacttggcttgaaaaatagcatatttaaattacatattgatacaatgaatgtttttacactgagaaagtgactaatttttaagattcattcaacctttggggcttcagttttcatggaaagggatagaataaagcagacatcacttaagggtaaaaaaaatcacagttgaaagatagatcttattttgtgttcttactacaataaaataaaattttcaaagttgtcggctaaacaaagtgccatgaaagttctctaggtgttcgcttttggaaaactataaattgttactttaagaaaatttgggtattatgamaagtacttttaagaaaaatcattgtggccgggcactgtggctcacacctgtaatcgcagcactttgggaggtcatggcgagtggattacctgaggtcaggaattcaagaccagcctgaccaatatggtgaaactccatctctactaaaattacaaaaattagccaggtgtggtggtgtgcacctgtagtcccagctactcgggaggctgaggcaggagaattgctggaacctgggaggcggaggttgcaatgaaccaaaatcaagccactgctctccagcctgggcaacagagtgagactccatctcaaacaaacaaacaaacaaacaaaggataaccattgttgaaatgagcaaggaaatgcagatttttgaagagggattgcatatgtagaaggaacaaggaaaggacttatccttgttaatctgaaacccaggtgactggcagattgtctgacacacacattaggcccttaataaatgttgggagtataaatgatttcatgaactcttgggcaagaagtcagttttgttaaactttgtgatgatgtaaggagagtctaaacagctattgcttttcagcttctggaagtcacacctgaacacttcatgtttttcagaaaacctttcagatatattcacaaaaatttacacaaaacctcaattctttattctattttatattatctgtaatattattttccattattgkttttaattaaagaaaaaatttggtttttcttatccaacttgtcaaaaaaaccaaaacaaaaatgacgcaagacaaaacaagaccaaaaaaacatgcacgaaacactagtccacccgctgtttaagagaactttgtacttgcgttttgtggagcagagtcagtgtactggagcataattattatatacaaaatctcactaagtagaacattaaagttataaatataaaagaagcacaagccaagaaacacaagatatcacactgtaatatttcccacattatatgtaataaggcattcatgtaggaatataattagaaacaagaacactgctcaggtataatgtgagaaaattaatgtggcaatgaaaacattagcttttgcctttcctagtttaaactgaaatttgtgctttcagcattgcactctaggagtctttacatactttattctccagattactttttgagttagaaaatcacaaaccctgtctttatctccccaagagcctgcttgttcttaaaacaacaggctcggaattatagctatgcaattatctctcacacattggtcttaaatgcccagctgtgtaaacatcacatgatgattcaagaaactatttagataactattgtttgatattgttttatagttataaaatgattatctgctatcagaattctaaaattataaacatgtttatagctggaaactcgtgaaatgtttgaattatgagtaagcaagtgtttctataagcataaaatcttagcaaagatgcatttttttatttaaaggaagacattcataaacagagtttgcattttgcaattttaattttttttatttaactaaactttttcttaactatttaaattgattttgttctaaaaatttcactaaaaaaagtaccactgggtatttttaatgtccatgatactgaagtttttgcagttttcctccctgtattgctgtgctacctccctttttgatcttaaatgattttaattaaagcttagggtgaatattttatgttgtgttctgtttatccttcctggtgggaaataaatgtctaacatcactcagagacttttcaaagcaatgttaaattcccagataattcactctaagaaaatctagatcatcccatcttatgtcatttaatcgaatgtaaggataaagagactttagggaaaaagcagtcatttttattgggtaatctttcagataaaccatctggtaatgatcaaattcatgtgtcccatcatattatgcaaaaaggagctgaagcgatgtggtttttatagtctatattgttcttttaataatgaaaataaatttaatgccctaatatttttggacatcaagacagatcaaaagaaggcattyggtaaggcagtgaaattattaagtaaacaattcagactgaagcataatcttggtatacaatcaagataataagacattgcttcactagcatcaagagcaagcttcctagtttggtgaacaatcaatgcagttagaaaaaatgcatttatgccaaattaaagaaagagcaaggcaagagaaaggtgtggcaaataatattttcctaatggtttagctaattgtcttaaatctctaagcttcaaaggtcttagtgtaatctagtccagtttggtgatagagaaaataatataatttaagggtctaagaattttaaaggagagaaatccktttttttttgctgctgttcttattgtctcttttatctgttatatatactctatatctattatatttaagtgattatttctctggtggtgctggttttcagtggtaagaattcactaagaaaaaaatctcatggtgtattgcaagaattagaagagtgttttctgctggttgatagctgaatgacattaaataagccattgttttcttagattattaatttatgtaatgagcacaatataatgggatcaaatgagaaaatgtatacaaaactaaaacactgtgaacctctaggagaaggttttcagttcttactggaaagtccgacagcctagcagttacacacatgggctctggagctaaaatactttggattaaatctcaccttcactgcttatcagtgttttaacttgaacagttaatatgtttgcatgtcagtttctttataaaatgaagacaataatttgcttcatagggttattagaaggattaaagtatttaatagctataaagcgggtatagcagtaagcaccagtaataagcactatacacagagccaattagcgtctgtgcttatgtaatacatagaagaaacataggtctcaggattgttggaatcttaagttgtgtaattttccttctgcatattatttgactaagatacaattagagaattttggagttgtaatagattttagaaattattgtagttttttaaattaattaattaattwattwatttatttatttatttttgagatggagttttgctcttgttgcccaggctggagtgcaatggcattatctcagctcactgcaacctctgcctccctggttcaagtgattctcctgcctcagccccctgagtagctgggattacaggtgcacaccgccatgcctggctaattttgtatttttagtagagacatggtttctccctgttggtcaggctggtcttgaactcctgatctcaggtgatccacctgcctcagcctcccaaagtgctgggattacagtcgtgagccaccatgcccggccagaaattattgtggttttatagcatagaaacaatcacacaaaaattttagagtgacacttcaaaatttaggcctttcatttgataaacagtcatgcatcatttaccaatgtagatacttgtgagaaatgcatcattaggcgatttcattgtaaaacagcatagagtgtacttatacaaacctagaaggtatagcctactacccacctacgttacatgatacagcctgttgctactaggctacaaacctgtacagcatgttacttactaaatactacaggggattgtaacacaatggtgtttatttacttaagcatatctaaacatagaaaaggtaaaaatatacgacattacgatcttacaggaccaccattgtatatgtggtttgtcgttgactaaaatgttattttgttgtacatgatgatattagaatagtgagcttgagagacctgttaatagaagtagcattacattgggctcagagtatagatttagatcagaaagacctaggttccagtgccatctgtagtagcaatcctattaccttggatgagttatgatccttctgtgtttctgttattgtcaataagaatggtgataatgattcccacttcacagggaagggaaaataccttgaaccttaccatctatatagcagacacttgatacatgttagtttttatttatccctctctcttacttcttcctcttttctttttttagggggcttttcttagctgcaatttgttcatgtttctaattaatttataagtcactgcatagtttgaactaaagtgagtctcgggggccactttggggcatttcttttatgagcccaactttgaatgtcttcttttttctgccagtattttccatatgaaaggtagcaagatggtaaatcctgaaaaggacaacagaggaacttgtaaatatttagagcatatagttgaaaataaattggtaagaaaggaaaactgtattgcagtttaaataatctctctctctatgcatgaatcatagaaggaagggaaagcacctagaatactgccgtttatatagtggacacacagtacatatttttcgtagttcattcctggtatactggatcctgagtctgaatagccagtcaggaaggaactatgggtatttgagtggccctcatattgcattaccttctgggcctcctgggcccataaaacccagaatttggccttggtattgtgctttgttctgccagtcatggttcatcatcaccatcgtttttcatttatgatttcctttggtgttgctgcattggaggaaactgcrgggaacagctacaatctcccatggtattggcattgccggttacctcctgactctgcattctctactcccaacagttgaatcccctgatggcctccattatatacttatgccattcccaggacttgacttaagtgtaggagagggaaagagagagagagaacatttaaatcatctcgctcatctcccacatcctagtctttgaactatagattaaccccttgtagccctatttaactctccacattttccttgtatctttctacttgcatggtctaaaaatatagtaatttccctttatctgaggtttcagttacccacagtcaactgtgatctgaaaatattaaatgaaaaatctagaaataaataatttgtgagttttgaattaaacattgttctgcataacattttgaaatcttgtgctctcttgctcagtcctgctgagatgtgaatgatcttttcctctagcacatctatgctgtatactayttgcccgttagtcacttagtagccctctcggttatcaggttgactatcacagtattgcagcatttgtgtgtaagtaatccttattttgcttaacatggccccaaagcacaagagtagtgatgctggtggttgggatatgccaaagagaacccataaagttattcctttaagtgcaaaattgaaatttcttgaattagtaaggaaaaaaataattgtatgctgaggttgctctatggtaagaatgaatcttctatccattaaattgtgaagaaggagaaagaaattctagtttggttgtcatacctcaaactgcaaactttacagatacagtgcataataagtgattaattagatggaaaatgcattaaatttgttggtgaaagacataaacagaaaatgtgttctgattgacagcatgttgcaccagaaaacattgagtttatttgagaatttcagcaaggagtctcctgaaacaagtgacaccaagccatttatttcaagtaagggatggttacacatgattcaggaatacacrgcaatagtagcctaacggtatgtcacaatgcctatgtaattcacctcacttcatgtcatcctgtgggcatcgtataaactcaaatcattacaagaagaagggtgagtacagtatgataaggtattttgagacagaaagagttagagaacacattcacataagttttattacagtgcattgttatacttgttctattttgttattagttattgttgctgatttctactgtgcctaatttataaattaaaatttatcataggtatgtatgtataggaaaaaacagtacatatagggtttgttattatccagggttttaggcatccactgagggtcttggagcatatcttttgcagataagggggatgactgtactgcctccttcaacctcagacagtagatgagcttctaattctccacgtaatagctaccttactccttagtccttaggtcttttttttttttttttttgagacagtgtttcactctgttgctctgttgcccaagttagagggcagtggcacaatctctgctcactgcaacctccacctcctgggttcaaacgattctcccacctcagcctcccaagtagctgggacttcgggcacacaccaccatgcccggttaatttttgtgtttcttggtagagacagagtttcaccgtgttggccaggctggtctcaaacmcctgacctcaagtgattcacctgccttggcctcccaaagtgctgggattacaggtgtgagccaccacctcctcaggtcttgattctctttctaaacatctgaggccactagtgatgatcttgtggaaaatagtttcctgatgctggataccatgtctctctgtgtttacgttaatactgcccctccctctcttcctcaaatcttgaattccttactgttgtgacctgaccatacgatggcaaattctagaaggggctctatmtgtaatttatattgagattattttctgttgacaaacgtgacctggcctctttaagtgctttaaaccagcagttttccaacccccgtcccttgatcttgacttcctcttcttcctcattggttctgagctgccaaagtattagcatccttcaagtctgagttttactattaggacaggctgcctcntcactcctctttctgatgacatatgtatgggtatgtctttgtctttatttctaaccactctattaaggcataattcacatatcataacattccctatttaaattatacaattcaatagtttttagtatagttacagagatgtatgacaatcaatatataacctaattttagagcattttccttacctccaaaagcaaccctgtacccattagcagtcactcctgcccccaacccccagataaccactaatctgctttttgtctctatagatttgcctattctagagacatttcatagaaactaactcataccatgtggccttttgtgattggcttcttttacttagcataatgttttcaagattcatccacgttgttgcatgtatcagtactatatcccctttcattgacaaataatattttgttttgtggatatactctattttgcttacctgttcatcagttgatggacattgaggttgtttctactttttggttattatgaagaatgctgccataaacattcatgtacaagtttttatgtggacatatgttttcatttctcttgatttcatactgaagagaggaattactgggtggtatgataattctatgtatgactaacattttgaggaactgccaggctattttccaaagtggctgtaccattttacagtcagcctagaaatgagtgaaagttttatttcctccacatccttgccaacaagtgttattgattatgggcatttttatcatagccatcttagtgggcgtgaagtgatawctcactgtggttttatttgcatttctctgatggctactatgttgaatatctttcatgcatatgtgatctatttgtatagagatggccctccatatgcgctggttccacattcacagattcaaccaacagtggctgaaatatacaggcatccctctgtatacatgagggatgagttccaggaccctcaggtatacccaggtactcgagtcttgaaatctgccctgcggaacccatgtgtataaaaagttggccctctgtggccgggcgcggtggctcatgcctgtaatcccagcactttgggaggccgaggtgagcagatcatgaggtcaagagattgagaccatcctggctaacacagtgaaaccccatttctactaaaaatacaaaaaattagccagacgtggtggcaggcacctgtagtcccagctactcaggaggctgaggcaggagaatgacgtgaacctgggaggtggaggtggcagtgagctgagaccgtgccactgccctccagcctgggtgacagagtgagactccatctcaaaaaaaaaaaagttggccctctgtatacttagatttcatatcccacaaatcctgtcttttggatccatgtttggttgaaaaaaatctgtgtaagtggacctgtgcagctcaaacccatgctgttcaagggtcaactgaatctgaataaaaaataaaaatgcaacaatagagataatacaaattaaaaatacagtataacaactatttacatggcatttacactgtattaagtattgtaagtacagcaggtcctccaataatgttgtttcatccaatgttggtacctagctgggaccactaactgtgtgaagtatgcgtgttctacccatgtctgtgtgggttttttctgggtctccagttttctcccacatcctaaagatgtgcatgttaggtaaactggtgaatctaaattgtcacagtatgaatgagtgtgggtatgtgtgtgactgagccctgtgtacaatggaatggtatcctgtccagggttggttcctgccttgcacctggagctgccatgataggctctgtcacctgccacctttaatgataataattgggtaaatacttaccttagtctttcttaaatgtatgtgtggctcacatttatttcaatgtttaatattagaaatgttttggtctttatttacaagctcggtaatacatacggtagaaagttaacccttgtttatatcaattagcctatagtaaattgattttgttacattgttttgcttaaagtcacagttcccaagaaccaatcaaaaatgttaartgaggatttactataatctagagatgatttaaagcgtatgataggatgtgatgtatgtaaatattatgccattttatgttaagaacttgaagatcatagattttggtttccatgagggtcctggaaccaacaccctgtggtactgtgggatgactgtattgtctttggagtaatgtctatgcagactctttgcccattttttaatgagtaattgttttattattgagtttttatagctctttatatattccagatatatgacacatcatatatataatttgcaaaaatttyctattattctgtatattgkctttttactttatagtactctttgataagcaaaattttttagttttcatgaaatgtgatttatctatcttttcttttgctgtttgtgcttttgttgtcatatctaataarttgccatctaaaccaaaatcacaaagatttactcctatgttttcttctaagtgttttatagttttagctcttatattaaaacccatttatgcctgaggttgcaattttttgaatttttgcaatcagaccttggcaatgaccttgagcagtaggatataaataactcccacatccttagcattccaataatggaacactaggcataaataggttgagacaggcataaatggtctgtgatccattttgttaattttctgtatggtgtgaggtaggagtccagcttttttcttttgcatgtatatatccaattgttgctcaggtgtggtggctcatgcctgtaattccagcactttcaggaggctgaggctggcagatcgcttgagcccaggagtttgcgaccagcctaggaagcatggtgaaaccccgtctctctaccaaaataaaaacaaaagcaaaaaccagccaagtgtggtggtgtatgcctgtagtcccagctctttggggggctgaggtgggagaatcacctgagcccaggaggtccaggctacagtgagccaagattgtgccactgcactccagcctaggtgactaagcgagatcctgtctcaaaacaaacaaacaaaacaaaaacaaaaacaaaaaacacgaaaaaagaatccagttgccctagcaccatttgttgaaaagattgttctttttttctttgacacagggtctcactcttgcctatgctggagtgcagtgacacaatcagggctcactgcagtttcaacacccagaagcttaggtggtcctcctgccgcataccacacccaccttcatccccaagtagttaggactacaggcacgtgccaccacacccagctaatctttgtatttttaattaagatacggttttgccatgttgcccaggctggttttgaactcctggactcaagtgatccacctgccgtgagcttcccaaagtgttgggattacaggcgtgagccactgcacgaggcctgaaaagagtatcctttctgtattgaattgtcatgatacccttgttgaaaatcaattgacaataaatagaaatatttaattttggactctgatgtctattacattgatctatatgtctgtctttatgattgtaacacactgtcttatagttttgtagtaggttttgaaactgggaattctttttaaaagaattattaatgtttaattgatatgtttgtataatagttgtacatatttttggggttcaggtggtattttgatacaagcatataatgtgtaatgatcaaatgaggggaattcttccaacattgctctttgtttcaagataattttggctattctgagtcccttacattttcatatgaattttaggattacaaaattcatttttgcatttaggatctgcaaaaacacagttggaattttgatagaaattacattaaatttatagttcaaattggggaataatgtcatcataaaaatactgttttctaatccatgacatggaacgtctttaaatttatttatgtcttgcctaattcatttcaatgatgttttgtagttttcaatatactcatcttgtatttctcttgttaaatttttttactaagttttttatgttttgatgctattttaagtggaattgttttcttaatttcagtttgagatttttcacagcaagtgtctataagtacaactgatttttgcctattgatcttgccttttgcgaactgtatcaatcttatttattagctctactgttttcagcggggagtgtactccttaggatttttaacacataagattatggcatctgcaaagagaggtagttttatttctccttttctaatctgtatgccttttatttctttggctttcttaaattatttgactagaactagtgcaatgttggatagaactagtgaaaggggacatccttgtttagttttttattttaaggaggaaggcattcagtttttcactattaattatgattttagctgtggttgaagatttatttatgtattttttactgaaattgactgtctctgagtatgcattccttacacatcaaatagtgaataaaaatgagaatgaaagtaccactcacattgagatagcaaaagctagagaaccttgaggaacataagccggacaattagacaactgttgaggtcctgccattttccttgcgcattctgcttgtaaaagaggtgtgattgaagagagctgagtcttcctagaaaggaatttttccctatttaatataggaacagttgtactccagtaacttatcatttaaagatccatgtctcatacctttaagtgtcccatgaatttgggtaatgctcaaaatttactgttgaactgtagtaactctgaatcagttatcattgctgtaaatttataagatattccgtgatgtttagtagcaaaggtagccttatgcttcatttgtactatgggggtcgctgtgatatgtttagtcataaagtcaacttgatggcaataaaggaacccaagggctcttgctaactctggtatgctatatggaatgaatttttgaatggtttatttctgcattagaggcaaacaccaaccttctggggttgtccacattccagcatcttgcatctgttgtatttatgatagaaacaagagaggaaaaaaagagtatttagtcatctgctgattccatttggtgctaaacacatacttctctctagagtgcaagaatgctaatttattttatgcaccagggtggattgaagccattcctagagacatgaatatttaaattggcaacaactaaacagtgaatactctgcatatagatgattcatgctctgcgtacagttcttgagtaaggcaaaatcgttattaattagggatctggattttaaatacaacttgccatctaattggcagtcatacgcagttgacctttcaacagcagccattgtgttttgggttcagaagctttctatatgaattctcgcaaacatgaaagatgacctaagtagaatacaaaaccaaatcctaagatatgcaggtgaatgttctaatatttgcctctagaatgagagccaaaagggagcaggaagtttatgctatttgtatgccctttatctgtcttccctgttgtaactagataattctctggtttttttttttttttttttggagacagagtctcgcactgtcacccaggctggagtgcagtggtgcaatctcggctcactgcaacctccacttcccaggttcaagaaattctgcctcagcctcttgagtagctgggactacaggtacatgccaccatgcccagctaatttttgtatttttagtagagacggggtttcacaatgttggccaggatggtctcaatctcttgacttcgtgatccgcccgcctcggcctcccaaagcactgggattacaggcgtgagccactagcacctggccaattctctggtattttattgccatatgataggataactttttgcatgtgtgatcagtaaaatatgtcaaattaattgaaaattcttgatttgggttgctgttcattcattcatgaagtaaatatttatcacctcttatgtaccttcatggagcttacgttccactggagaagacagaaaacaaacatgataaataaatgtagtatatattagtgacaaatagtacagagaaaataaagcaaggaagggaaatatggcatattgaggttggaattgttgattgaacttttagacagggtgaccaggggaggtctcactgaaaagtttatttttgaggaaagacttgaaagaagttagggagtcatggatctagaagagcatgccggccgtgggaaggcctaatgtagggatgtgcctggcttcttggataagcagcaaggaggtccatggagctggtcagggtaagcaaggagagtactgggagtggggtcacagagatacataggatggtctgagccaagcagtgacatggtaagttgtagaggtaataagaggtcacatttttcataaatgaaggtaaaactgatgggattttctgacagactggatgtgggatatgagagaaggggagaagcttaaagatgacaacaaagtgtttggcactggcaattagaagaattgctgttaactgaactgttaaataccgtaagaatagtgggctgaggggcactatcaggagctcaaattttgatacagaatgtctgagatgcctactagcaagccaactgactttcataccrgttttctggactagcttttacgtggtacatttagaaatgtgcatcttcctctctctgaagcatttcttaagcttttcatgctttccttataattcctatggtaattattatctatttcactaattttagccaaatttattattttagcatatcattatctaacaatttctgaagaacagaggactgcagagctgggtacttgattttacttggtatttctattttctcacagctctaagcacaattccactatataaatacttgttgaaatmagtttttcagaataccygaaatttagcaagattatcaacctaagttacctctgttttcctcgatcagatgaatctagttattggttaacatagggagcactaatttaactttctgaaaagcatgtcaagtgtgagacatctttatctgcattcttctcagtcttgtttctgttggggaatgtgttagaaattaggtatattttagaacatcctgagagtcaaagcaataggttctgaaagacacaccttcttataagtgattaaaaaccatcatcactggttttttaaaagaggcttagaccagaaaactttgaagactagttcataaacaaatctacttagcctagtcagggaagattaaaaaacatttccattctagactgagcatatctgagcttttttgcagttgtgatttccttttacaaaagtgcaatttttatttcatggaaaagtaaattattttatggcagtgaccctcaaggttttctcattactttaaagtggtgagaggtgttatcaattcattggttactctcagctagttcctatgcaaggcctagtggatggaggaatgaagacatcattttggcctcaggaggaactcatgatttggtgagagacacagacgtgtcaacaaatagttacagcaaagagtaatagtttaaaatatctgctagactagtgccatataaagggggcacatgagtgaagtctgtgtgtgatagaatgtaagaatccacgatgacttaaaagatgaatagtcatttcctaggaggtgcaggggagactggaacatagctcatgcaaaggcaccagtggaacctcatggattctatgtatctggagaaaagagtgaccgtgacaggagtagtaggaagtaagactagagagagaagccagagaagcatgcttgtctataacaaaaaatatgagttttcttatttgtggattaaccatcattagaaaattttacattggaggagtgatgaccagatttaagttttaaagagtttcctctgatggtatgacagagaaaagattggtcaaaaagttctgtcttactaaatatttctgtagtctctcatctcccttgtgttcacgtgcacttccttaattttatccctaattatttctcctctagactagtgctactagtgaggaacagagcaagggtgtatattggagaaatagttaatgagtgtaataatagaccttacctaatggtgggggttgggggggttggaaaagtcacggatattcctcacgtttctttttgatcagctgaatattagggccatgcagatggaatgctggagagaaacatggggagtgggagtgtaggaaacacaatgggctcaacttcggacatgtttgagactcaacttgagatatgcagctggaacttagaggagaggtaaacacctctcagtttaaatttaggttgctgtcatctaagaaaacaggggagaaatattgtaaagagggaatatggctaatagtttgttgcatggagagacatcaaataagaaaatgctggaaaagtctttgacattaaatcatttaacttcattaataccctaaaaggtaggaattgttcacattttgtagctgaagtgaggttaattattctgcctgaaatctcctgctattggagtgtttttgcactgggattctaacctcaaagcttatgctatttccattaaaatgaggcagacttcctgccttggagttgctcctcattcagtccttttggcttattgtaggctcatcaggcccggagacatgcatttcctatctttccgaggtcttccaaggtcaggcacatatattgcatgaatgcacagcatggtgactgaattaataaggctcacagaaacatctgtgctagtatattagattcagggattcttttggtttggtcaattggatctgaatgtgtttaaatcggggcagatacagtatagtgtgccaaggcctcaccactccctatttactttcatctgccctattcacgcttcctgcttaaacatttgagtttgtagtcttagctttaaagtcacaccttatagcaggcatttcaagctatttgaattaaactaaaaagcaaaacacttttttcctgtgggaaaatcaaccattagtctacaaatatgccatatttagaatgtttcctttatcaaagttagattgaaatattcaagattatacttattagtttcattctttctccacatatctgacttatatttttgagcattctaaatgaccttatggaccacactttaatttttaatcttgtagttttgacctgaggtttttgtatcagccttgttctaaaactgaattcaggaaaatgtttctaacttagttgtattagttacaacarttctttgtcaggaagatatgcctgaaatatatattctctattgggtcaccgcagatgggcagagttaaaggagagttttttgacaggctttaagagcagatgtgggagctactgacaacaaatagaaatagtgtcgagtagaaagagtgttgagacaggagccagtcttggatcctattcctagtggggccattaaatgagaaagtgattagagagtacttgaatataggaagcatcatagctgcttggtaaatgttggctttctgaaaaaaatcaccatcaccactttttattaatatgtgtgtgccttttgacaaatgtccatttcttcttttgacaacaagggataccgctttttatgatttctcatagaactccttgtggaagaatggctggaaatatgttgaacagaataaatcactacacaaatgtaatgaattattaactaggaagttgggtcaacatccctgggctttggaccctatttgatctaagtgattctgtttgctctttgagatgcaccataatgttcaggaaacaagtggtctgtttctcacaagaaaacttaaataggaaggaattgcaaggataaaaatatttattgatttttgactaaattaaaaaattcaactttacttttataattgttaattatgctttagaggaaaaattttctgacctatggatttttttttttttgaaacagtctcactctgtcacctaggctagagggcagtggcrtgatcttggctcactgcaacctctgtctccaaggttcaagtgattcttatgcctcagcctcccgagtagctgggattactggtgcacaccaccatgcccaactaatttttgtatttttttagtagagatggggtttcaccatgttggccaggctggtcttgaactcctgacctcaggtgatccacctgcctcggccttccaaagtgctgggattgtaggcatgagccatcacccctggccctgacctatggatatttgactcttcttgatagattaaatgatgaaacatatgcaccaatggaaaggatgcattaagtacagccactgaattttgctaaaatagcccataacttttttgtttttctgtgtattccttttactttttaatcatgcggcagatggcttcagataccatttattttgagatataaattctaagcaaacaatagacaaatgtaatacatattgtatttgcttcagatgaacaggaaatgaacatagtgcatttttgaactttacacacacacacatgtgcacacacacccccctacattttcttgactgacacagtagtccgcattagaattaagtgataatgttttcctcataggtttctttggagttaatattcaccttggtgtatttcagttacccaaggtatgcattaatggcccagaatgcacaccttgggagatatcttaatactattatgatatggtttctcagtttcctatttgaatttgaagaattcttttattttctcttttattgaatctgtcctatttctatgaaatgacaaatgggaaataaggatagaaaagtagtaaaggcctctctctgctccttaatgatgcttttattgtaaaatcttgcatttttttaattttaatttttcttctcaaaactttcttttacctgaagcytactgttgtttcaccatcttatatccttcagctcagttaagactaagtttccatttcytaatttaagttggccaaraacattaaattagcaggtgtttgtgttattttgtttcctaatagaacatgaagctgcccaatgaccagtgaagcaattggtatgcagcatcttggcagagagaagactggagacagaagccaacccataatggaatccaaatagcaaagtatacatgggcttttctgctgcacatcttaatctcaaacaaacaaaacctctttttataagctccctttccttcccttaccagagtggttttgtcagcttcagaaacctcatttaaacacctggaagagaaactcagtaatttgtatgtagctctgctttgttgagcagagtatatgctgagctattccatgtgggcaggaatgtagcttcgtaaggaagttttctttgattctcagaaatgcaggtttgtccaacggttcatggaatcagttgctgtgaaaacctcttaggtttgctttttctgatggtcaggctacaggagctttctcttcttatttttatatttcagacttttttttcttttttaaaaatatgagccctcaaagtggatacaggattcttacagatggacagaatatctaattttctcattcttcccttaatgacatgggtaatatgacaacatagccagtccatagctagtttataccagtgtcctttgccaaaagaaggctcacactgtagatattggctttactttttgtttttcatttccttgattttatgtgaagcttttttaattaaagtataacatacattcagaaaaatgcatagtgtgaaataaacagttcaatgaatttttccaaactaaacacattggtgtaactagcacccaggacaagaaatagaaaattaccagaaactgaaagattcctcctccctgtttagtctctaatcaccccccaaagaataaccactattttgatttttaaaatgataggttacttttgcctgagtatgaacttcacatagatggaattaaaccatacatactcttttatgtcttgcttttttttttttttatcacgtgtagctgtctttttttctttttcattactctgggttgtgtccaggtcgggactattacagacagtgctggtatggaacatttttgcctgtgtctttagatggacataggaacatatttccatatgtgtgtatcctctcctaggaatgaaatagctgggtaacagggcatgcatatactcagcttcagtaaatactatcaaatcattttccaaagtagtcgtaccaacggcctcactaccatttaatgtgaagatagttatagtttaattttgctcttcagctttctgtggcattgccatgcataaatttattcaaactctctggattaaggtatattttccccatgttttatttcttggagtaatcatatctggagtttctatctccttttgagcatattgacttcctctggcttaattcttattcatttgtctgtttccttaacaaaaatgtattaaactcctaatatgtgctgtatactactagataatgaggtataaaataagtaagccatagtacttgcattcaagagaattataatgaagtagtgaagacagaagtatgaacagatataatttattttactcaaatctaaaaagctacttctatgacctagtatctccagatttaagtaaagaagcccattaacaagttatcaagttcgttcatgatttacagatgtttttatcatgcgttttccaataaaaatttcccctttccaaggtgaacagacctcatatttttaagctttccagaaacagaagtcattctgttcaaaattgcttttaaagaaaaatcatttgttatcttaaggtatgatgaccatgattacccacagtagtttagattctaactctgtagcctgcatgcgttttctggcctatttaaaaatatttttaattgaatttttttttttttagtttagtatttgctgatacccttcttgctaatataaatatatatttggccttttgggctagcacataaaattactgggttgatatactcaaggaacaatttacgatgactcctagattcttctccttattgtaatattcaccctggatgcaggtcctgtagccttcacacacatggctttagctcccaactgtgagctggtgtttcacatatcyctatttctggcccagactctcctctgaagtctagattcatgtgtattgtattttcatttggatcttgtgctgatatattacatttggcagattacaaaatgtgttcacctttttcttccaagtacattcttctctctgtattctcattgtggtgaatgcatcaccacttccacgattgctgaaacaattctctagatgctttcaaatatcttctcttccctactcccatctagatataccaaaatcctaccatttgtacctcctaaaaatttcctggatctctcccactatagcctagcaatagtgttcaggcacttattgtctctttcccagacctgggttattgcctggtctctctgactgcaatttcattctctccaatccactcaaaaacccattgccagagcaatctttgtaaatacacatctgagcttgttgctttcagagttctttagcagagcacgtgaaatgtctcttgcctacctttttctgctggattcatcaccattcatgcttaggtttcctgtatttgtcatatcacctgcagtgacctgcaccttcctcgccttttcatgcttcagacctttccacatgctcttttgttctgcattgctcatagggatagcttctttttttttctattatacttaggcaatgtttgaattttttaattttaattttttaaaaaaatttccataagttattggggaataggtggtatttggttactagagtaagttctttggtggtgacttgtaaaattttggtgcacccatcatctgagcggtatacactgcgccatatttatagtcttttatcccttcccccaattccacacctccccaccccaagtccccaaagtccattatatcattcttatgcctttgtgtcctcatagcttagctcccacatatcagtgagaacacatgatgtttggttttccattcctgagttacttcacttagaataatagtatccaatctcatccaggtcgctgcaaatgctattaattcatttctttttatgactgagtagtattccattgtgtgtgtatatatatatatatatatatatatatatatatatatatatatatatatacaccatagtttctttatccactcattgattgatgggcatttgggttggttccacaattttccaattgtgaattgtcctgctgtaaacatatgtgtgtaagtatctttttcatgtaatgacttcttttcctctggggtagatacctagtagtgggattgctggatcaaatggtagttctacctttagctctttaagtaagatccaccctgttttccatagtggctgtactagtttacattcccatcagcagtgtagaaatgttccctgatcactgcatccatgccaacatctactgttttttatttattttttgattatggctattcttgcaggagtaaggtggtattgccttgtagttttgatttgcatttccctgatcattagtgatgtgcattttttcatatgtttgttggccatttgtatatcttctttttttatttttttattttttatttattattattatactttaaggtttagggtacatgtgcacaatgtgcaggttagttacatatgtatacatgtgccatgytggcgcgccacacccactaacttgtcatctagcattaggtatatctcccaatgctatccctccccaccccccccaccccacaacagtccccagagtgtgatgttccccttcctgtgtccatgtgttctcattgttcaattcccacctatgagtgagaatatgcggtgttttgttttttcttcttgcgatagtttgctgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacctgtgcatgtgtctttatagcagcatgatttatagtcctttgggtatatacccagtaatgggatggctgggtcaaatggtatttctagttctagatccctgaggaatcgccacagtgacttccacaatggttgaactagtttacagtcccaccaacagtgtaaaagtgttcctatttctccacatcctctccagcacctgttgtttcctgactttttaatgactgccattctaactggtgtgagatgatatctcattgtggttttgatttgcatttctctgatggccagtgatggtgagcattttttcatgtgttttttggctgcataaatgtcttcttttgagaagagtctgttcatgtccttcgcccactttttgatggggttgtttttttcttgtaaatgtgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttaaacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcagcatttattaaatagggaatactttccccattgtttgtttttctcaggtttgtcaaagatcagatagttgtagatatgtggcattatttctgagggttctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatttgaactttaaaatagttttttccaattctgtgaagaaagtcattagtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagattttgctgaagttgcttatcagcttaaggagattctgggctgagacaatggggttttctagatatacaatcatgtcatctgcaaacagggacaatttgacttcctcttttcttaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagtgcttattattttgaaatacgccccatcaatacctaatttattgagagtttttagcatgaagrttgttgaattttgtcaaaggccttttctgcatctgttgagataatcatgtggtttttgtctttgcttctgtttawatgctggattacatttattgatttgcgtatattgaaccagctttgcatcccagggatgaagcccacttgatcatggtggataagctttttgatgtgctgctggatttggtttcccagtattttattcaggatttttgcatcaatgttcatcaaggatattggtctaaaattctctcttttggttgtgtctctgcccggctttggtatcaggatgatgctggcctcataaaatgagttagggaggattccctctttttctattgattggaatagtttcagaaggaatggtaccagttcctccttgtacctcttgtagaattcggctgtgaatccagctggtcctggactctttttggttggtaagctattgattattgccacaatttcagctcctgttattggtcctattcagagattcaacttcttcctggtttagtcttgggagggtgtatgtgtcgaggaatttatccgtttcttctagattttctagtttattagcgtagaggtgtttgtagtattctctgatggtagtttctatttctgtgggatcagtgatgatatcccctttatcattttttattgcatctatttgattcttctctctttttttctttattagtcttgctagcggtctatcaattttgttgatcctttcaaaaaaccagctcctggattcattaattttttgaagggttttttgtgtgtctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagattcttaatcctgagttctagtttgcttgcactgtggtctgagagatagtttgttataatttctgttcttttacatttgctgaggagagctttacttccamgtatgtggtcaattttggaataggtgtggtgtggtgctgaaaaaaatgtatattctgtcgatttggggtggagagttctgtagatgtctattaggtccgcttggtgcggagctgagttcaattcctggatatctttgttgactttctgtctcattgatctgtctaatgttgacagtggggtgttaaagtctcgcattattattgtgtgggagtctaagtctctttgtaggtcactcaggacttgctttacgaatctgggtgctcctgtattgggtgcatatatatttaggatagttagctcttcttgttgaattgatccctttaccgttatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgattctttatccaatttgccagtctgtgtcttttaattggagcatttagtccatttacatttaaagttaatattgttatgtgtgaatttgatcctgtcattatgatgttagctggttattttgctcgttagttgatgcagttttttcctagtctcgatggtctttacattttggcatgattttgcagtggctggtaccagttgttccttccatgtttagtgcttccttcaggagctcttttagggcaggtctggtggtgacaaaatctctcaggatttgcttctctgtaaagtattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgagggtaacccaagctttgtctctggctgcccttaacattttttccttcattttaactttggtgaatctgacaattatgtgtcttggagttgctcttctcgaggagtgtctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcgtttctttttattcttttttgtctaaacttcccttctcacttcatttcattcatttcatcttccattgctgataccctttcttccagttgatcgcatcggctcctgaggcttctgcattcttcacgtagttcttgagccttggttttcagctccatcaactcctttaagcacttctctgtattggttcttgtggttatacattcttctaaatttttttcaaagttttcaacttctttgcctttggtttgaatgtcctcctgtagctcggagtaagttgatcgtctgaagccttcttctctcattctccgtccagctttgttctgttgctggtgaggaactgtgttcctttggaggaggagaggtgctctgctttttagagtttccaatttttctgctctgttttttccacatctttgtggttttatctacttctggtctttgatgatggtcatgtacagatgggtttttggtgtggatgtcctttctgtttgttagttttccttctaacagacaggaccctcagctgcaggtctgttggagtacccggccctgtgaggtgtcagtctgcccctgctaggggttgcctcccagttaggctgctctggggtcaagggtgagggacccacttgaggaggcagtctgctggttctcagatctccagctgcgtgctgggagaaccactgctctcttcaaagctgtcagacagggacatttaagtctgcagaggttactgctgtctttctgtttgtctgtgcgctgcccccagaggtggagcctacagaggcaggcaggcctccttgagctgtggtgggctccacccagtttgagcttcccagctgctttgtttacctaagcaggcctgggcaatggcgggcgcccctcccccagcctcgctgccgccttgcagtttgatctcagactgctgtgctagcaatcagcgagactcggtgggcgtaggaccctcccagccaggtgcgggacacagtctcctggtgcgccgttttttaagcccgtcggaaaagcgcagtattcgggtgggagtgacccgatcttccaggtgcggtctgtcacccctctctttgactaggaaagggaactccctgaccccctgcgcttcccgagtgaggcaatgcctcaccctgcttcggctcgcgcacggtgtgtgcacacactgacctgcgcccagtgtctggtattccctagtgagatgaaccctgtacctcagatggaaatgcagaaatcacctgtcttctgcgtcgctcaagctgggagctgtagaccgagctgttcctattcagctatcttggcttctctgtatatcttcttttgagcattgtctattcatgtccttagcccactttttgatgggatttttgtttttttcttattgatttgtttgagttcattgtagattctggatattagtcctttgtcagattacggattgtgaagattttctcccattctgtggattgtctgtttattctgctcactgttccttttgccatgcaaaagctctttagtttaattaagtcccaactgtttatctttgtatttgcttttgggttcttggtgatgaaatctttgcctaagccaatgttatcgtatagagtttttataatttcaggtcttagatttaagtccttaatccatcttgagwtgatttttgtataaggtgagagatgaggattcagtttcattctcctgcatgtggctagtcagttatcccagcaccatttgttgaaaagggtgtcctttcctcactttgtgtttttgtttgctttgtgaaagatgagttggctttaagtatttgggtttatttctgggttctctattctgttccattggtctatgtgcctatttttataccagtaccactctgttttcatgtctatggccttatagtatagtttgaaatcaggtggtgtgatacctccagatttgttctttttgcttagtcttgctttggctatgcaggttcttttttggttccatatgaattttagaattgctttttctaatcctgtgaagaatgatggtagtattttgatggggattgcattaaatttgtagattgcttttggcagcatggttattttcacaatattgattctacccatccatgagcatgggatgtgtttccatttgttttgtctgtgatttctttcagcagtgttttgtagttttccttgtagaggtctttcgactcctttgttaggtatattcctaggtattttattttattttattttttgcagcaattgtaaaaggtgttgagttcttgatttgattctccacttggtcactgttggtgtatagaagagctactgatttgtgtatattaatcttttatctggaaaatttgctgaattcttgtatcgttctaggacctttctggaggagtatttagggttttcaaggtaaacgatcatatcatcagtaaatagtgacagcttgacttcctctttaccaatttggatgccctttatttctttctcttgtctgattgctctggctaggacttccagtactatgttgcagaggagtggtgagaatggccatccttgtcttgttccagttctcagagggaatgctttcaacttttccccattcagtataatgttgactgtgggtttatcatagatggcttttattccattgaggtatgtcccttgtatgccgattttcctgatattttaattataaatggatcctggattttgtcaaatgctttttctgcatctattgagatgatcatgtgatttttgtttttaattctgtttatgtggtgtatcacatttattgacttgcatatgttaaaccatccctgcatccctggtatgaaacccacttgagcatggtggattatctttttgatatgtttttggtttcagttagccagtattttgttaaggattttagcatctatattcatcagggatctcggtccataattttcttttttgtttatgtcctttcctggttctggtgctagggtgatgctggcttcatagagtgaattagggagggttccttctttctctatcttgtggaatagtgtcaaaagggttggtactaattctttgaatgtctggaagaattctgctgtgagtccatctggtcctggatttttttgttggtaatttattaattactatttcaatctcgctgcttgttattggtctgttcagggtatctaattcttaccgatttaagctaggagggttgtatttttccaggaatttatccatcttttctaggtttctagtttatctgcataaaggtgttcacagtagccttgaatgatcttttgtatttcagtggtatcagttgtaatatctcctgtttctttctattttttttttgagatggagtttcactcttgttgcccaggctggagtgcagtggcacgatctcagcccactgcaacttccaccttccggtttcaagcgattctcctgcctcagcctcccaagtagctgggattacaggtgcctgccaccacgccctgctaatttttgtatttttggtagagatggggttttaccatgttggccaaactggtctcaaactcctgaccttgtaatctgcccgcctcagtctcccaaagtgctgggattaccggcgtgagccactgtgcttggcctatctcctgtttcttaatgaggttatttggattttcgcttgtcttttcttggttagtcttgctaaccaattttatttatcttttcaaaaaaactaactttttgtttcatttatcatctgttttcattttgtttcgatttcatttagttctgctctgatcttggttatttcctttcttctgctgggtttgggtttggtttgttcttgtttctctagttccttgaggtatagccgtagagtgtcagtttgtgctttttcagtctttttggtgtaggtgtttagggctgtgaactttcctcttagcaccgcctttgctgtatcccagaggtttttgttcagttcgaagaatttttaaatttccatcttgatttcatttttgacccaatgctaattcaggagcacgttatttaatttccatgtgtttgcatggttttgaaggttccttttggagttgatttccagtttttttcccactgtggtctgagagagtgcttgatataatttcaattttcttaaatttattgaggctcattttatggcctatcatatagtctgtcttggagaaagttccatgtgctgttgaataaaatgtgtattttgtggttgttggatgaaatgttctgtatatatctgttaagttcatttgttccaaggtataatttaaatcaattgttcctttgttgactttttgtcttgatgacttgtctagtgctgtcagtagagtattgaagtcccccactattattgtgttgctatctcattgcgtagatctattagtaattgttttataaatttgggagctccagtgttgcatatatgtttaggattgtgatattgtcctgttggacaaggccttttatcattatataatgtccctctttgtctcttttggctgctgttgctttaagtttgttttgtctgatataagaatagctacccctttggccaggcatggtggctcaggcctttaatcccagcactttgggaggccaaggcgggcagatcacctgaggttgggagttcaagaccaacctgaccaacatggagaaaccctggctctactaaaaatacaaaattagccgggcatggtggtgcaggcatgtaatcctagctacttgggaggctgaggcaggagaatcgcttgaaactgggaggcagaggttgtggtgagctgagattgcgccattgcactccatcctgggcaacaagagcaaaactccatctcaaaaaaaaaaaaaagaaaaaaaaagctacctttgcttgcttttggtgtccatttgcatgaaatacctttttccacccctttaagtttatgtgagtctttacatgttaggtgagtcttctgaaggcagcagatggttggttggtgagttcttctgcattctgtggttctgtatcttttaagtcgagcatttaagccatttacattctgtgttagtattgagatgtgaggtaccattgcattcatcatgctctttgttgtctatgtactttggttttttgtttttgctttttaacttgtagttttgttttataggtcctgtatgatttctgctttaaagaggttctgttttgatgtgtttctaggatttgtttcaaggtttagagcttcttattagcagttgttgtagtggtggcttggtaatggtaaattctcttagcatttgtttgtctgaaaaagactgtatctttccttcatatatgatgcttagtttcactggatacaaaattcttggctgataattgttttgtttgacaaggctgaagatagggtcccaattgcttcttacttgtagggtttctggtgagaaatctgctgttaatatgacaggttttcctttgtaggttacctggtgcttctgtctcacagctcttaagattctttccttcatcttaacttcggataacctgatgacaatgtgtctaggagacgatctgttcaggctgaattttccaggtgttctttgtgtttcttgtaattggatgtctaggtctctagcaaggctggggaagttttccttgattattcccctaaatatgttttccaaggttttaggattctccccttcctccagaacatcaattattcttaggtttggtcgtttaacataatcctagacttcttggaggctttgttcatattttcttattcttttttctttgtctttgttggattgggttaatttgaagacctgtctttgagctctggatttctttcttctacttgttcagttctattcctgagactttccagagcttcttgcattactaaagtgtgtccaatgtttcctgaatttgtggttgttttttctttaagctatctatctccttgaatatttctcccttcacttcttgtattgttttttggatttccttgcattaggtttcacctttctctggtccctccctgattagcttaataactaacctcctgaattctttttcaggtaaaacagggatttcttcttggtttggatccattgctggtgaggtagtgtgctttttgggggtgctaaagagccttgttttgtcatattaccagattttttyttctggttccttcttatttgtgtaggctctgttagagggaaggtctagggctgaaggctgtttttcagattcttttgtcccaaggggtgttcccttgatgtagtactctcccgcttttcctatgggtgtggcttcctgtgagccgaactgcaatgactgttgtctctcttctgggtctagccacccagcaagtctaccctgctctgggttggtactgtgggttatctgcacagagtcctgtgatgtgaaccatatatggctctctcagctgtggataccagttcctgttctggtggaggtggcagcggggtgcagtggactccgtgagggttcttagctttggtggtttaatgctctatttttgtgctggttggcctcctgccaggagatggggttttgtagagagcatcagctgtggtagtatggagaggaactggcagcgtgcaggtcctagaactaccaagattatatgccctttgtcttcagctaccagggtggatagggaaggaccatcaaatagggacagagctaggcgtgtctgagctgagactgtccttgggtgggtcttgctgtggctgctgtagggggtgggagtgagattcccaggtcaatggagttgtgcacctaagaagattatggctgcctctcctgagtcatccaggttgtcagggaagtgggggaaagctggccatcacaggcctcacccagctcccaggcaaaccaaagggctggtctcactcccaccgtgcccccaaacagccccaagtctgtttccaggtggtgggcaagctgggcttgagaacttgccccaggctacctgcctgccaccttcaaatgaaaacggcctggttcttcccccacgctgtggagtctgcatgctggattcacaccctccctcaagttctggccatgaggcttctcaccctgttcaaattgttacgaagttcagctggaattttccttctccctgtggtgcttccccctcccccaacccctgcttctctggctgccctcccagtggatccctgtgatgccaggcaggaatggcctgactggggacccagcgagctcctagggactttctgctgcttcctctctatatttttttttgcttggctctttaaattgactcagctccaggtaaggtcagaaacttctcccgcaaacagaccttcatttgccccagtggggttgtgtattcaggagaggaggctctccctttcccacttccgcagttggggcactcacagtatttgtggtgtctcccagattttgcaggagcagtccgcttccttcaaagggtctgtgggtcctccctcatagggataacttctactcactgtttaagattcaccttctctgaaatcccaccacttatgacaacttggatgaacctgaaggacattatgctaagtcaaataagcccggcacagaaagataaatattgtatgattgtatttatatgtggaatctaaacaagtcaaactcatagaagcagttttaccatagttgccaggggttggcatgtgggggaaacggggacatattggtcaaagggtatacactttcaattataagatgagtaagttctagggacctaactcacagcatggtgaagacagttaataataatgtattgcttacttgaaatttgctaagagaatagatcttacatgttctcacagcacatacacacaaacgcaaagggtaactgtgtggtgatggatatattgattaatatgattgtagtaatcattacacaatgtatatgtatatgaaagcatcatatagtacaccttgaatctacacaatttttatttgttaattgtacctcaataaagctggaaaaaagattcacattctctgagaaattttatttaatcccttcaaactgagagactgtcctctatgctgtgggtaactctattttagttcccatgtaaatgtgtttatttgtctcccctcctgatctttatctttgcatttccaacatttagcacactgccttgatgcaaagtcgaggctcagcataggagaggctcaacatagtacaggttgaaggaatggttgaattaattaactgatagcttaaagccctccacttgtattttttaaaataatattcctaaatatattttgttctcttgccagggttaaaactcatatgttacttctctacccacttgcacagactttaaggtctttttaaatcccatctgtgtgtttcttcgtcagctggaaacatttaatgtcttcttaacttggaaatctcctgtgagctttcttctggagcatttaaaaaaagattataaataagtatcaatccttgaggagctgaattctttatacttctccatccaaagaaatccctgattaactttactgtttaatgcctattttgactttatgtaaaattttagggtaaatggacaaacaagaacctttgaacctatggtatcatcagttaaaataaaacaactacaaacaccactaccacaacatacatttaggaggtgacagtcattaatttctcttttatctgtgtgcctatttactacattaagtttatcatgcttgatgtcctttgggagaaatggtcatgccttgtcagttttccttacataaactctgccacctgcccctttgcccctgtccactgctgtaacgttatatttgttatgttcactgatctagtcctttttcgcaggcgtcaaggacttgctatttgggctcatggattctgtaattgccttgggcagagatgacaaagcataggctccaaattcaaaatacatttgtatttttaacatttcaaagtccccatggcattaaagttactacaatttaccatcagattacacattgctaccattagagcaaaagaaataattttaactttagcttcttgattataatctatgttcaagtttttcacctttcagaaacaaactaaaccttgacactgtccttctaaataaagaagcataatgtataggtcacttcagagagaattatgtattaagttgtgattgtacagtaatatcagagaatttgccttacctttttctaaatatttatacttttaattattactcatctgaggagctgtgcatcctttctaaacattaaactatttatcctctaagttacactgatgactgtaggtagagcttgtacaacgttgtgggaaatacaaaaatcactaagattatcagtacagaaacagtacaccaagtttgacagatgtaaggaataaaacaattccgtattctttctacaccttttctctattttccacttatattccatttctgatgtgctatgtactcaatcttgtgagagggtcggcagaagtatcattatcccatttttacagatagaaagacagacaccgaaagagatgagttacctagctcacagtgctaatgacagaactaaaactaaaacccagaccacatatacaagggggaaatcgtagcaagccaagaaaaccatagtgtcttttcttgggtgattagtgactatgaacagtgggttgatagctacttctaactgtcctccctacattttgtaacgaagttaatctctccaaagcctgagtgaagtagcagacagtgtttattttcagaagggaaggaactaaaaatatagtagcacaagccatttattaacctcatgcaacattattcccagagtagcagagtcttgtgaaaaggcataaggttagcaatcagtagacttaggtttagatctctgttcctttactagtttctatctccttgcaccaaacacctgtttagttaaaataggactaataatagcagcctcattccctcaaagactattgtcatgatcagtaagatactgtatagaagcactttataagctacatgatattatacaaatacaagtcctcattctgtgtagcaaataagaaatttttccactttgggaggccgaggcgggcggatcacaaggtcagaagatcgagaccatcctggctagcatgatgaaaccccgtccctattaaaaatacaaaaaattagctgggtgtggtggtgggtgcctgtagtctcagctactcaggaggccgaggcaggagaactgcataaacccaggaggcggagcttgcagtgagcctagatcgcgccactgtactccagcctcggcgacagagcgcgactctgtcataaaaaaagaaaaaagaaaaaaatttttcctatgtaggaaataatgtcacatagtttttaggataagggcttggaagttatactgacgtgggttacaatacaagaaataccaccatctagctctgccacttggctaagaaacttagtctcttgaaaccttagtgttttgagttttaaaatgggaataatcacatctctcatgagtttttataaagattatatgaaatgttgtatatgaagtgaatgaactattgtaaatgtcccttgaattagttttttttaacttaagcttttatttgggagtaattttagatttacagaaaagttgcaaaggtggtacagagagttcccatttaccttttttccagttttctccattgttaatgctgtatcttacatttgccactacaaagaaatggatactgatgcattgctattaactattaataatggttatttggatttcagcagtttttcatgaatgttttttctgttccaggatctaatcctcagtaccacactgcatttagttatgtctccccaatcttctctgttctgtgacagcttgtcagtccatctcctgttttccatgatgttaatggtcttgaggaatactgcccaggtgtcatttaggatgttcaccaatctcattttgtttgttgcttttctcatgattagactggaattatgggttcctggagggaataccacagaaatggcatacttttcctgtcacagtatatcaaggggtacatgatatccatgtgatatcactgattatgttaaatttcatcacttggttaaggtagggcttgccagatttttttcttgtatattgagctagttctgatcgcctatcacttagacagggcattctctttcctctcttctctctgatgtaatgctattcatttacatttactgcaaattgtcatctctgaagaaataccttctcggaccattcagcctaaagcagcttttcctttcaagtcaatctctatgacacttcacttttgtgttttcttcatagcatttattgtcacctgaaatcatctcgtatatttgttcatctagttcattgtttgtctgtaggccctttccccccaaaagaaagaagaacaaggtccttgtaggattttttcatatctgtacactggagtccagcacaaggrctagaatatgctaagtgctcagtaactaattgttgaataaatatcaaagaaagaatgatataggattaatttattagtatttctgaaaaagaaaaatagctgaatggtgggaggtttcattagtgttcttaactcaattggtctaattttaacggagaggttaaatgcaattatcaacatctatggaatgaggtaatcagcatccttgtaattcaagctcccatgtaatgcacttaataatgtgaatgccagagtattttagctacttataaggatttgactgacaaggacttgactgaatagtaatggatctttacacatctgctytacggggacctttacttattaactgtgtcattgtttatactgcagaatttttaacagaaactgaaagaatgtagaaataatagatgcccttgattataacttatagctgacttcttcatgtctattatcttttcatttatacttacaaaaaaagaagctttttaatttaagtctttctcccataacccattgtaagataccactctttttatttacyttctcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggaggtaagtcgggagaaagrtaaastgtgatctgatgtcctaatacagtaataataataataaaacagaagaagatccacatgttggcgtttagagcatgagaaaataaaaaatccagattagtctctatcaccttcttgagtcttccaaagaattgattaacaggaaagtactctgttagtaaacttctgactcctgtacatctctgccaaggaatccaatgaatttgaagtgggattgttaattagatcgaaatgatgactttgttttatgtagatctacttatgaagcataagatttattcactccacaaatacttattggcattactgttctatgtgcttgggacatatctgatcacttcccttgacaaatttttacattttagcaggtgattataggcaaaaaataaaaccaataaacactgtagagaacaaaattgtatagatgttacactgagaaggtgagataatgccaaagccttgaaagagttcaggaatcgggcagatgaagatctagagcaaaggcttgaaggtatgtgccctgtgtttaagtgacaacataaaaaccagggtgtctaggtgaagacagcaaagtgatgagtagcaggagctaaggttggagaaccaaccatttaggagtgtgtatgcctttaaggactttggcttttactccaagttaaatgggaatacactgaaaggttttaagcaaaggtgtgacatgctgcgactcgtgtcttaaaaggactatgatagttgcataaggaacatagactgaaggagaacaatgagaggaactgaaaaaccaggctggaggctattgtagtaacccaggttccatttatacactttacatgaaccacctcatgttttagtttagactagagtggtgttggtggacatcagtgctaaattttgtaaatagagtcaactgaattttgatagaatggatgtgggacatgaatgaaaggaaggagtcatggctagtgttgtaggctgggtcctccagaatcacacacagaatggagtttggaaaacaaggtgttacatttgggaaggaaagagggaaggagcgggactggatagaggaagaagtctacctgacagctagacccgcaaagcctaggccaatcagcagggagctctggtgagagcattgccctccagagtgtaccttgtcaggcagaaatggccaggcctgtatgtctctttcagtcactggatgcaggttactctaccctgggaagggtatgacctttaggggcctgaaacactctatatacacactgaatatgtattacttttgcaccatgataaagctggaaaaaattataagttgaaccattgttaaatcaagtcagggaccatctgtagtctgtatctggggagtgccgagtgtgatacattgaaatttgttagagtagatagataggatcatacrggttgagcatcccttatctgaaatgcttgggaccagaagtggtttggattttggaattttttggattttggaatatttgcatatacctaatgaattatcttgggaatgggattgatgtgtaaacatgaaattcatttatatttcatatataccctatacacatagcctgaaggtaattttatacaacattttaaaaattttgtgcatgaaatgatgttttgactgcattttaactgcgacctgtcacatgaagttagatgctgaatttttccctagtgccatcacattggcattcagaaagttttagattttggagcattttggatttcagatttttagattagcaacgctcaacctgtatagcacatttttcacagtactaaaacacaattgtgtcagagaatgctcscataagagctccagtttatctcagacaatgcattctgtattttaggattaaagaagaagacatttccaaattgttcctccttctgagacctcttctcttttctctttttagttgaaagtgactgccacaggcacaaaatggcagtggttggagaggaggagaaagtgtgcgtgttatgtgtgtaacttcagtgggagtgggcataggcagggcaacagtgttctcttaagaaaggcagactcagttgttcttcatgaggcgggaaggggtccaaaagatatttctctgagatcctaatgaggattctaaactgtctgaacaacctttgaaatttagttctagtcaaaggtacagatgcacaaactagtaaaaaatgcctaagttttctatattttttatatccaagttacaaatagctgctgtggctgactgaactagataaagcagaatttattgagcatttaaccttttttaatgatttggtaaattaaatggttgcacttttcattatttacaggaagctgtattggtaaaggatccaaaataacctttgctctattttgctcctgcaaatayaatactatgaagtaaattgatgtagtaaatactctgttgggagtaagtctcattaaatgtttatagtgtggaatgtatcagagtgcttactcaacaaccatgctgaagcttttgttaaatttttcrttctggcccttggctgggtgtgagtatgaaacctgaaatttatgagtggagaaaatagaagttgaattggaacactatactggctaaatcaattgayttattggaaaggccagtgtgaattataggggttttcttctgtatttgtggctgaatgagagctgagaagtgctgaattgtagattaagagaattttgaaaatgttatgaagcaagaaacttcaccaataaaaattgctttgaaaattccaagtccattaagacatattgtctcctgtgaggagggaaaaagcagctgttgtcattgtggtacacaagaactaatctgaattcccatgcaataaagatgataacaaatgatatgtatgtatattttcttatttttagagagctgtcatattcactttttttaacttttttacatattcatgtatcatcattcatacagtcattgtttactgttatatctccagcacctagaataatgccctaaatgtagtaagtgctaggtaaatatcaatgaatgcatgaatgaatgaatgcaataatayggcatgccattttgtgattttgcagtgaaaagcattttttccttacccttatttttttctccttcctccgactgaaagtggatgtatttgggggtatatggctctactttaacttttaaccaggccatgaatttatagtgatggaaactaccagaagcacatgtaagtgatacactgctcagaatcctttctgtggtaaggcagcacaaagagaaaaaactttatatatattctcttctctcagcagctgtccagccttagtcagagttccctgttacttccaagatactctgtcttttactaagggtaataattttggggaagatactcctcatgttcttacattttcacctgttaggagaaaacaggatctctgttagtcagattagcatttagaagctaaagaagaaatagatatcactgttatctagaagcacattaatatgattttaaaaaatggtttggtttctagatatatagtgaactataagaactaaaagagatgaagaaaatatttttatatacataaataatctgataactgaattatggaaattatttgaggctgatacaaaaagcacaaaatccaaactagtgagccaacaccagcattatgctgggggatggggtagctgcttttcaattatggcctggagcttgaatcttgaaagactgtgaactgaagacaaaagataaattctgtatcctgccaactggaaagtcccgtaagatacatttgcatgttactgggaatctttaaaatttgaccaccttgttggagaaatgaaaataacactaacccgaatagcaggagatgttgggagaacttttgactagcatagccttggctctgggaagctcagaaaaaaggaacagaatccatgttggaattttctagccataggcctgtccttatctggactttgggtcagcattcatattatctgtgtagcctctaaaaccccgtccaaaaatctagtttaaaattgccttatcctggcaatacctccagagatctgccagaaggaaactcagattctttctgcactttatacacagctttcaaaaaattctcatacggttccaaggaagatggttttcacaagacacacaaataagccatcttgagtaacttcatagaatgaacaaactacagaatcaggtctgcaaacactgtagatattgaaattataaggtactgaaaaaagtattttaatatacattattccctaatgaatatgttgaagaaacaaaagactgtcaaaattgaccaggcagagctatctaaaatgaaaaatataatgatgaaaaattcaatggttaggcaaaacaggtgattaggttagagaattggtgatctgaaagatatttgaagaggttactttgagtttcccacagaaagacacagaagtaaaaagtattttttgaaaagcagttaagatacatgccatgacaagttctaaaatattataatatacaattcagaagagagagaagtataaaacagataatgagaatttcctagaactgatggaagtcaccattctctatagctaagaagcccagtaaatcccaagcaaggtgtctttaaagaaacctatatttacacgtatcatagtgaaactgaagaacgccaaagaccaaaagaatatttttaaaagaaaataggaaaaaaaagagttacctatgaatgatgactgattatctgtgaatgatagccgagttcttaaacatgaatgttacaagatagtaaatcattctcagagaaaataactgttaaccttgagttcaatacatgatacagctgtttttcaagaaaaaagataaatatatttttacccagtcccaaacatgaatagtttattgtcaacaacttttcactgaagaaattgttaaagaaaaataaaaaaattatcctatcttaagggtgcaaatgcaagaatttgtaagcagaggaaatggtaaacataaggatttattactgcttacatattactttttataaatgattaataactatgtatactttgtataattaaaattgtagaatgattgtgtctggaaacacagtgtataattaggatggatagaatcatagttaaatgttctagggtctttatatattttttggggaaggataaaaatattgacttatattaggcatttatcttaataagcatgttaaaatgtctatagtaactactaaaaatgtgtagtcatagactgtataattgccaaatatggaaaaggagaaatgcaatgagaaaataagaaactcagtttgtccaaaagaagaaaaaaatggaggaaaaaacactgtggaaaaagaaggatgtacacacagtagaaaacataataaaataaatccaaataatcttggaatcataataaatgtaaaaaggaaacctaaactctccaaagacaaaagactgacagcttagaatataaaacgaaatctagctatatgctgtttataaaaacacatctaacacttaagaatcaagatagtttgaaagtcaaaggataaaacgatatccaacaaattctaactgaagaaagctggtatagctatatcaatactagtaaaaatgctaatgacagttactatctactgataggataaattcaccaggaggttgtaacacattcttttcgaggacacatggaaaattaacaaaaattgacagcatactgagtcatgattttcaaagcactagtattatacaggccacctagaaatgtatttaggtaaataagtgaaattaccctactatttggaatcttttttgaaaaccatatctgtataactactgggtcatgaataaattataattgaaagtaaaaaatacttataactgagaaataatgataatgtataataacaacaaaacttgagcgatatagctaaagggagtacatagaaggaaatttctcacctatacatgcttatattaggaaagaagaaagctggatgttaaggagctaagtttccacttggagtttgaaacagacaatataaaaaacccagaaggaaaaaattaataaagataagaatagaaattaattaaatcacaaacaaagatacagtagagaagttcaacaaagccaaaagtgtattatttgtaaagaccaataaaattgacaaactgctggtgagataaattaagaatactgaaagcagacaaaaaacagcatgtaagagtgaaagtcagaagaggagtcataactacagggttatgactaaatactaaatattataaatactaaaacactaaaagaatattataaacaaatttatactgataaaaatgaaaatttggatgaaatggaaaaattcctaagaaaatataaattaacaaaattgactcaagtatagacaatctgaatgaaataattaaatagaattagtagttaacagtttttactgaaagcaaataggaggctcagatagtttgatagaatactataaacccttccaggaatatgtaaatgtatttctacagcagtgtcctgagaatagcaaacaaacaaacaaacaaagtagctctcaatccattatatgaaattggtgaagcaagtgtgaaacgatgctacacaggtcagataagtaaggaaattcacatgccaatctaatttatgaaattagatgcaaaaattscaaacaaaatgtgaataaactgtttagcactagataaaaaagtcattatgacaaagttgaatttattccaggaatgtaatgttagttcaacattagaacatttactgatggtattcacctcattaacaagttagaagagaaaaactatataataatctcagtagatacagaaaacatttgaaaaattcaatataatttatttaaaacttctagaaagctaggaacagaagtgagttttcttgataaagggtttctgtaaaattctacagtaaacttcatagttaaatttgagtaattaaaaacactccctttaaacttagacatgaggccataatgaataaaaatgagtaaattatagtaatacatgtcaatatgaatgataccaaaacaaaaagctttaccataaaagagcaagccgtataagaattcatacagcatttttacttttatataaaggctcacacaagcaaaactaaacaacacatttctagtgttacagacatgtctggtaagatataaagagaaggaagagaatgatttatgcaatattgaggagtggaggagtggggagaaagaggttgcatacacacatcaggagctttaaagctactgagcatattgtttttcagaagctgggttggtagatgaatgtgtgttatattattattctttattcatacattctcttatgtttgaggtagttaataatgaaattgaataaagtgtgttaaaatgggtggtaaatctgagaataagtgctacaacaatgtactgtttatatttaacaaatatttattaaatctattttctgtgtaattaatgtctgtgtgaacccttgtgctaggtactggcttaatacaaatttaaggtactagcatcttacatttgtactatttagggtgtttatctgcacattttattaatagtatcaaattgcttcatagagcacataggtcaggagttattgtgtactttatagaggagcaaactactcttctgtgaggttgtgtaacttgtacaaagtcaaataaacaggaattagaagagttataacttgaacacatatttcgtgagccctcccaacaattactctttccaaataatgctcttgtgacaaatgatggagactgttggaatacaattaggtcttgagtttaatacatttatttgtttatgcatctgtctttgctattggatgaattatatgagtagaggaataatgccttattcatatttatattgtcaccgcctagcaagktgccaggtacatagtaattgctttaaacatatttattgaaaaagcaatgaattgttgatatttcagaacctagtgtgaggttttaatgcatctaataaatatttacccaataaaagaaggacaacatctcctttatcttgatgattaaataaaacacatggatagtaatgagtattagaccttgtttgctcttggcttcttgggactcttagaccccatgatgtacatggcattatagatcgtgttcaaggtttgctgttatatggacccgatgtcaagcttggagaaaactctggcagccagttatagtaatgtttttttttttttctccaaaacttgaaaaaaccaaaatgaatccacagcaagtttttaaaaacaaattcttataaaatgtttgtatcatgagtctcatgaccatcagttaatcatcagtatttattaggtacttgttctctatttccacattgtcatgtgcttaatgggagctagaaaataagtaaaaataaaaagcctccaatcctaaaaattgcatattcaggagataagaataccataaatcaagcaataaaagctagcacaactcttcctttagatcctcactcacatgacacaggtcgggctttcttggatgccgattccttgatgatgtttagttttagggttagtttagcgttaactagggaccatacttgtgagcactgcaaaatgagaaaaggcatgaaggaaaaataaatatgagagctgatgaagggattgtgtaataggagtggataattcacactgactactgattgaaatttatagaggacctcaaaatagaacagtttttatttttatttattattttttattgagcccccccccatatgcagtatggaaagttgatttcatgtatagaacttcacatgcaacagaggacgcatatctttcaaatagctatggaaaaatggatccaaaatggatccacaaaaatggagcaaaggctgcaaagaaaacctcaataaaagagtcaccacaaaaaagtatgtgggatgatggacatgttaattagcttgattcagtcattcctcagtgcatacatatatcaaagcatcaggttgtattccacagatgtgtacaaaaaagaggcaatagatgaatgacattaggaacatgtgtcttcttttttttagtttgaattttaaaaatctgaatttttattttcttctctgtaaagaattttctttttagcaattaagactactatttaattatttactagattctgcttttatttttatttttattttgagatggagtctcagtctgtcacctggcctggagtgcagtgacacaatctcagctcactgcaatctctgcctcccaggttcaagcaattctcctgcctcagcctccagagtagctgggactacaggtgcatgccatcatgcctggctaattttttgtatttttagtagagacagggttttaccatgttagccaggatggtgtcgatctcccgaccttgtgatctgcctgctttgctctcccaaagtgctgggattacaggcttgagccaccgtgcctggcctgcttttatttttattaacttatattttctaatttcttaggttaatttgctgatcttttataatatcttgaatatatttattgagttaatttttagtctctctttttctgtttttcttacttggtttttttcttttgtaaactcattcatggtgtcagttttcctctgaacacctatgtttaataagcagtacttttatctgtattttaaaaaataggtgttagttttaacttagtttttttttctttgccttatactactagaagtgtgttttaaaaatgttaaaattggtttttggtgttttaaaattgttttttgtttatttttgtcatcctttaaaattaatttctagttttactgaattttggtcagaaaatataggttttattttggaaaatgtttggaatttttttgggggaacactgaaattttttgtggcttaattcatgttttgaaagttgtatttatacatatttgaaaaaattgtgtattctctctttgggaggaagttttaaaagttcgtaattgtaataaataaagtgtcttcattcttacttctgttttctgtttcacctgtttgagagaggttagttgaagtctttcacattacagcaaaataccattttctccttgtatttctagtggtattttgttccatacatttaaaaacttatattaggcccgtgcggtggctcatgcttataatcccagcactttgtgaggccaaggcgggtggatcacctgaggttaggaggtcgagaccagcctggccaacatagtgaaaccccgtctctactaaaaatacaaaaattagctggacacggtggcgtgtgcctgtaaaaccagctacttgggaagctgaggcaagataatctctggaactcaggaggcagaggttgcagtgagccaaaatcgtgccactggactccagcctggtgacagagtgagactctgtcttaacaacaacaacaacaacaacaaaaaataacaatacccttatattattagatttagaagttttcttgactcctatgacttcctggtggaaggtaccttttattattataaaatgttcctctttattttaatagtgtctactctgattcaatttgtctggtattaatattgatattcttggcttcctttttattagcattttcctggtgtatctttgacaataattttattcatgtctagattaattaatttcataaggaatacatgaatttattcttgtaaaataattatacaattatggaaattaagaaaaaagttaatgtctcttttcacttcacctcaattcaattcttattgccagtgataactgcaattaaggacttggtatatattttccagacgcttttctaggcagagacacattttcttttctcttctaaaactcttattaagatgaatgttggtctgtctggatgagtcttgtggcttttaatttttgtctcatactttgcatatcctttycattctgtgagaatttttggctttcttttctggtcactgattntgatgttagctattttcattccgctctttaagtcttcaactgtctagtttttatttttgcaataccattttaaatttccaagaataccagtggtgttttctgtggctwtttttttttttttttttgagacagagtcttgctctgtcacccaggctggagtgcagtggcaygatctcggctcactgcaacctctgcctcctgggttcaagcaagtctctgcctcagcttcccgagtagctgagattacaggcgcctgccaccaggcccagctaattttttttgtgtgtgtgtttttagtagagacgtggtttcaccatcttggccaggctggtcttggactcctgacctcgtgatccacccacctcagcctccaaaagtgctaggattacaggcatgagccaccgcgcctggcctggctgttcttatagctatgataaacatttgaatctcttttagaatattaattatactaattatgtttccttaagttcttctgtttgttgagtttggggactctaattctgttgatgtttctcaaatgtttggtgattaaccacttgcacaagaatcactttgggtgctagttaaaagtgaagatttctgttcccaaatttagacatactctgatgatgaggtcatgaatcattttcaaagacgagccttcccaggtgatccttaagcacactaaatgttccaaaccattaatctagattatacagtattattagctgctgtatatttttcagttagactgagtattcgggtaatcttgcaggtttgtaagattgtaaggttctgattctaggaatgctaggtcaagtcgctatactggagggagggcaacatggagatgtaggtggccctttagaacatggaaagcaaatagtttatcttcttggagaagaagcttcttgtctcttgtggtagacttgcctagtttttctggtagcagaactcatcctgagttctgttacaattcccacagaggttcttaagctacagttcatggggattcatatgtagaattcagggtgtctgtggacttggatgagaaaaatamatagttctttattttataaagttctatctgaaatttatcactttagttattaatattattaaatacaaaccacagtgcataagatacctaagactttgtcacctatagaaattacagatattttcataccacattatgtcatgtatgcttatcactatgtctgaattatgagagttattaggctgactgctagatcttattatttcatgttaatataatgactaaaaaattatatctgtcaatggaattgatttccatttaaaattgtatctgttatttttatgcattacaatttttgttttgttttgttatgagatgaactctcactcttgtcacccaggctggagtgcaatggtgcgatctcggctcactgcaacctccgcctcccgagttccagtgattctcctgcctcatcctcctgagtagctggtattacaggcgcctgccaccacgcccagctaattttcgtatttttagtagagacggggtttcaccatgttggcttagctggtctcgaacgcctgacctcaagtaatccatctgcctcagcctcccaaagtgctgggattacaggcgtgagttgttttgagaaggggttttagtttttatgggatattggcttgattgttctcccctttaattacttcgcagacaatatgttcagtagagactgaattctagagtcctgattctagattctagaatctagattctagaatcaggtgcaggctctagaagcctgattctagagtcctgttggaaactcttaatttttttttttttgaaggtcttttcttccctaagtggaagtgctttttgttgagtttttgctaatagcctgttctttgtttttcttcctccctccctcttttcttcctttcccttcttcttccacaatttccctccttattctttagtttcttaattggttcctttcattttattgagaagttaaaacatttgcacatttacatatttaaatgatacagtaatctccagtgagttttggggaaatataatttaaaacaatatatcctgccaacccaggatacccttcacaaaggaaaacaattttataattgataagcattaaaccagaatgtgatatataccacaggcaatcagctaaagaaatgcagagacataaagaaatctcaatgttttatatagcttaggagacacaacccattagatacatgttctcaagataaatgataactattcctcaagtaagaggacttgacagtaccatttacatacatagttcatcctaaactcacctggtaatttgaataactgtctctgttcactaattgcctttatccaaaggaactttttatatctttttgacagaagacaartttgtaacttggagccaggcacccaccaaagttaggctcctgccttcccacagaaactgggagatagggacactacgttctttgatgattatatttaaaagagatggtttccaggttcttgagaaagacattctcccaagattcttttcatccttgggttgaaaagctggcgagaagcttatttcacttttaagaagatttacatacgtttcaaagggcagagaaagactcaccatgacaagttttctaaagtaaatggtaacgtgtctctcccttttttccctaggaaaattatattttgcttcttttaagatctgtatttatccttaccttttcctcagaaacaagtattttaaaccattttttggtgttttagtccagagattgttctgtatatacaagtgtgagtataactgaggggtaaattgttagcacagtacctgttctataaatgtttgttgaatccacacttcactctgttctcaagcctcctgtaacctagcaagaagcaaacagggaagtctttatggaaaggaaattgagctaggccttgaaggatgggagattttgatagaatgtttaatgacttttcacagttatctaaaagggggtttacaaaactctgatgcctataaatatatgagagtttgcaattttggtgggtaaataagaactaaataaaattatttactagtaagaggccccttatctgccagaaaaccttcatacaggaacacaccattaaggatgaatagcagaacagaattaaagttggtcttacttgggactgaaaccgactttgcaaaaaataaaacatgagaaaattatgacataaaagagatctgatataaccaacccccatcttgcctttaacctccaaactgcccttaattattctgggccagggccaagctaactttgggagaaatttagtttatartttaaatgttaataacccttcccccaaactaaactgcctttgtaaagctaataaaagaccaccaggttacgaagagatgaggatcctgaattmtgctaaggtgtagacataaacaattaccagccattattctggaggtyacaagatttgcaactcccgcaattactcctgcagataacatcactattacagagmgagcctaagatyggccttttgagatatcttttcaggtttttacatttctgaggacagtctacccctgcccatctgtcatgtggccccacccaaactgactccttgtcccaccaaactatccttgaaaaaccctagcctctgaattttcaaggagattaatttggtaataactccayctcycacatggcatagctgaccttgtgtctattaaaatctttattgcaatgctgtggtcttagtgaattggctttgtgcagtgggcaggaagaacccattgggtcgtttccggactgtcatgtcagtttgattaatcagtagatcaacatactttgttttagatcycataaattcagctttcttattagtagctgtattagtctgttcttgcactgctatgaatacctgcgactgggaaatttataaagaaaacaggtttaattggcttacagttctgcaggctgtacaggaagcacgagagcttctgggcagcctcaggaaactttcaatcgtggtggaaggtgaaggggaaataggtatgtcttacatggctggagcaggaggaagagagagggggggaggtgccatacactttcaaacaagcagatctcatgaaaactcactcactctacagtaccaaggggagatggtgctaaaccattcatgagaactctgcctccatgatctaatcacctcccgccaagcccctcctccaacattagtggttacattttgacatgagatttggggtggggacgtgcgtatccaaaccatatcagcaggaatcaagacatttcatagtacatatctgggaaaaaaatacttttaggtctaagagatttgctttatcacttccttctaataaaagcccatttccttcttaggaagttgaattcctaagttcatattttcttcttttaaagagagggctaatatcactccttttctgtattaccagccatattccagcagtcacaagacttggaactccctcaattactcctgcaggtaacatcactacaccttttctgtagtaatgaaatgggaatttccagcccaagctcattaataccgtattacagtatctgcaacaggtgagaagataatctggcttggaaaccagattttgaggaaccatattgaatgccaagctaagaaatttggactttgttaatgaggaatattttgtcatggaagggacaatcaaacaggtattgtggaagattaatcagtaatgatgtgtagattattttgcatggtttaatggaagcaagaaaaatcaagatatttttataatatttcaggtaaagtgtaataaaaacccaatgtaaaggagttggaatggaaaggagagggataggtatgaaaaaagaactgacagttgtagtgactggaagtggcccaagatagcttagatatccaatggatctatgcttggaagaatggtgacatcatatcttcagtaggagggygtattagtctgttctcacactgttaataaagacatacctgagactggataatttatagaggaaagaggtttaattgattcacagttccacatggctagggaggcctcacaatcatggtggaaggcgaatgaggagcaaagttacttcttacatggtgccaggcaagagagcgtgttcacgggaactcccttttataaaaccatcagatctcgtgagacttattcactaccaggagaacagtatgggggaaaytgcccccatgattcatttatcttcacttggccctgtccttgacacatggggattattacaattcaaggtgagatttgggtggggacacagtcaaaccatatcagaggataaactgaattgggagaagtaagataggaaatggaacaagggagacagccaaaaagaaagagatacaagcttctgagtattcaaatacctttttttggagttagttttaggaggtaaatcattttaacacaagtatacatggtatgtaaactaaaataagcaattaattatttccataagtattccttaaagaatgttggttaaaattattccaagttcagaagattatctagcttttttttaaagcagatatgtccagagttccctttttatatggctgtaggtaccatcataataatataataaaaatttgttttggaaggttacatttactatgtaaagtgatattacagttttcttttttttctaccacctggtgcaaactttctgtctagcatgatcggtctgttggataaagcacttcgttcaaaatggaatgatgtttattttagacatgttctcagagtaaggtgaaatcaagaaaagagaagtagcctatgagaattattaattcttacattaaaaattagtaaaacataatttttattagtttttattagtttggtcttgcgaattccagctttaatttagaggaatctgtttttacttttatcaagagatggagggtagtaagttgtagagttccttgttttaagatacagtttgataaaatatggttagtagtgtggatcatagtatagtattttgctttgtagggtgttgattatggctttattatggagaacattgttcagtggccatgctgttcctagagtgagcgcttatggcttttgttactgtcaggtgttcactgctaagtttaagatttagggttttccaaatctagccatggatctataatttacaggctttattttcatacttttgtatttacagtaagatttggaaaggcaagaagggtatcgggcaattattttttgaaactgaattgaactttatgttatgaatagaacctcaaagcttgttttctgagaccaatcgaaaaggaaaaagaagtctttgtaaattctaaaaagaaatttttgatgaagatactattgactttgaagaaaatattgccaacatattagtttttatcataagcgtgattaacatttaaaagaaatggcaaaaatgtcttatgttttctttgacaaatccagggctctcttcatgggtgtgtctcacagatggaaggatctcatatttggtttaattacctgaggttgctatattaaaattctgaatatattttgaacaaggtaccttatacttccacattgcactgagccttccaaatcacgtagctgatcgtggatgaatcttttggtttctttcaggttgacttggactctgcttagttcccatcacctgataagaactcncctttaaacatgtgaaatggaggatataattgcaattaaagtaaagcctgataatttaggttgattattgacatctaatcagtttggactaaatgcaagttatatgttaacaaaaatctcagcttcgttagccacaaatgaacacttgaagttaaatgaataatttggtaggcaggatccaaaagagcaatgtctaaaagcttcagagtaaaaggaaaaaatggaaagcacatgtaccctaaaacttaaagtataataataaaaaaataataawaaaaaaagaatagacataaggtgcctgccaatactctgactcctctccaagcctactataagccaatcaattggcatatgtcatgtcctgcagatggaaaagsagtatgtgcaaacatgtactgtacagatgcatggatctgctctgcagctgctggaggttatatttgttaagcagcctgacaatatccatgagttttgaaaaaggtagttgcattataggaggtagactaatcctatttgtttcacgtggaaaccatgctgtctctaacaggcatagtggcttgcttcttcaatgcctagaatgagtctgacaatatttttttcctcacattactatcttagtcatgtgagtgttgagtcagtcttatggacagggagggaggcccaatgcagagtaggaactccggtgatggatgaagcaatgtaataaatagatacagccaaacagatgagtgacccagagacagagagagcatccgttggggtcaattgaccctttgatgaaaaaacaggaggaaacacatactgagacacatcaaactgaagatagtgagaatagtctgttttagttgatattttctaatacttaggaatttctaagtcttaatatttctaacttaaatatagggcttaaaatatttgtaacaaggtataatgtgtatggtgttcacattacagttgtttttgtgaaacggaaagaaaagtgcatgcgtgactgtcttttgggctttagggagttaatgaggaaagggcagtaggctgagcagtattgtctacctggtatatgacttgtgggcatctttgcaggtcatggcttgagcatgggaaggcattaaagaattttgacttgatacagactcctattcctggccttcctggtatgggttgatttggagatgggatcactttacctcattcaggcaggctacaatttaccaaggagcctccttggaaccaccgatgtttagagggataatttttggtgctgatgcagaggcagtatcaaccaagaatcttggttctataggaattttatgccttctttagggagtattaaactgcctttctttattttaaaagtccccttaaattgagaagttggattctcttctctttttatcaatagtaagaatttctatttttttattcatgcattcctgagcatattttgaagtttctacatactttccccccaccagatcttcaaatatggaatagcaggcaaggtcacaagtaagttaatttaaaaaccctttaaatttaatcatttctcatacagggtacagaaaaaattcagccaatttcttcctatattagttttcatcaggacccaatatatctctcctgttcgctattgtgatatgtgcccctgcttgtctctctagataaagcactccttctcagagattttggccttcatattcaattgctttttcctgtctgcaaagaaaaggggcaaagtattcttaccatacttttgcttggtattcgtagtagttaactagtgttttataatatcctgataagaaaagtctggagcggtgttcagtgatgggatttttcttgatggmattatgtattgttaaatttaaaggatatagtttatgctctttaatagcacatcccactgcataacgtcaatatctacttgaaaaatagtctagttatgtagatgatactactctttcaacattaatttcattctgaatgttgttttgcatcccatttgccaaagctatgtgaatattgtaaagttcaggaagggacatgctgaacacctgcactttataaaaatacaaaaaccttcacgtctgtaatcccagcactttgggaggccgaggtgggtggaatatgaggtcaggagattgagaccatcctggctaacacggtgaaaccctgtctctactaaaaatacaaaaaattagccaggcgtggtggcatgcgcctgtagtcccagctacttgggaggctcaggaagaagaatcgcttgaactcgggaggcggaggttgcagagagccaagaatgcgccactgcattccagcctgggcaacagagcgaaactccatctggaaaaacaacaacaacaacaacaaaaaggaaaaacaaaaaaaacttgtagccatttaaaattttctatagtgatgaaagctggatttttatttggcaaagttgtcaggtacctccacagttatccctttatcacttaaatgttctcttgaatcatgaaacacagaagcgtattggttttattacttgcagtgtgaatgacacaagagtgtttagcaaactgtttctttactttcactttctttttttgtcactttctctcttttcccagttcctcctcttctatcctgtcagtccccttctcaactctccttccatccccttttctctttcccttccccctttaccttattttttttacatctccctcctctttctctccttcctttctcctcctccatctccccctcctccttatattgcacatgttcttgttccttaataggatgaaaaatgtaaatcatattgataaagcaccaagggaaaaaataaggctctttggtaaaaactttaaagactataaatatcaaagcatagcagaaggaatgatgttggtttaacatttttctgaccaacttttgtgtatgtcattacataactagcaaagcaaaaagatccaaacagtgtaaaatgcacgaacagttgattttttctacaggtcttctcaatttggaaaggatattaagccagggactgacattttcagtcttgcatcgacaccctatgagaacagcaccagcaacatccttcattaataaaaagagaaggatataaaacagagcagaatgaattaaactgtgaaatagatgaatgttgcctttgattgtcctttccattttccttctcagaattcttttttctcagagtatcttttccctgtcttcccactgatgctcagtatctctatatcctagccacataagacttgcttcttgtccttccacactgtgactcatattctctggagctgcctcttttttagtctaactcattctcaactagttgttagggaaaaggacctgataaagtaagaccttcgtgactggcaacagcttaaacttttatcctccaccagtgctttctccaaagatacccacttgcttagggaaatagtgcttttaatcacaatcaatcaaccatcaaccacctagatacctaaaggatatcacaacatatcatgacataatctcatatggaaaatacagtgaaaatcaactttaagagctgtgctgttcaatatagtagccactactcacatgtggcttttcaatttaaaattaaattaatcataattaaataaactaaaaattcagtttcttacttgtactatccaaatttcagatgttgagtagctactgtgttgaccattgtagatacagaaaattttcatcaacatagattgctcttttgggcagtactccagagtgtactttagagtcaatacagtttctttgcaatttcttaccaagacaatgtagctttatgtagactccaaaatgatgattttgtggcacttataggctaatacgtcctaaagtaaaattttaaacacagtgactacagcaatttttttttcttaagccctagttaactggaaaatgacttagaaacatttgagttaatttctatttaactggatattaaactccaggaaaagagcagatttttaactcttttcataccaagaacatctttagttggttgtaatttcaaaatgttcagaatacccacaatccttaaacagcagtgctctagagaatatggggaagacctcagggaccacatcaagaacatctgaaggatgctgttattgagaaactgtcaccacccagcagtcattttcacactcatcattgttaaggaattctacagcagatatgactttgagaattttacagttgcaaggtaagactgcaccatatcagctacttttttttaatgctctactatgcacaattcacccatgaatccagggcttgtacttaacctgctatttctcccaaaggacatcattatagacagaagtgaaaggtagaatcaaacagaaatagagcacaattgggattacttattttttccacttgccccctgtgtaccttttcttttcttctttgtcgatgaattgttttctgggagaactccacaggaataacaattgacataaacctcggaaatgacaggaactattcaaangtttgtttaaattttgcagatttgttgtcatttaggcttggaatcataagcctcatggacatagaaggtgggacacacatgatgttactgagaaattaagatttaatatacttaaaaatattggggcatntactttagttttaatgacaatcttattgtgtataaaaatcatctgtattttctctaagttcaatgtagacagaataagttaatcaccattgcgtctatatttttaggattttttacacattttaaatacagaccatgtaaaacacaaacatgtaaacacatatttccaaacagataatcacacaaggactctttcattaatatatattgcctcagtctataatattatggtaagattaattcaatataatattcaatatcacaacaaaatcaacagattcctggaggtgcttatgttactattcttttatacagagattgtgaaartaggagaatccttcaaagtttatcatattattgatataaaaagataaaaaactgaaagaattcatgatgtgtggtgctgtgcataggctggtttgcttaactgacagaaatatgcctaggagaagacgttactaccttaggtgaaatgagtgaaatcagatgagtgaaatttttatcactgttctggtttaaccatcattacagtattagggccatttaaatgtwmtatgttcattacttacaagatttttaaaggagtctgtatgtattatatttaattgataagtatattgagtatctctaaaatattttctttttttctgttgtgctaattgatacacaacaaaatgcaagttatgtactctttgacttactatagctaagtatgtatttagatttgtatgtgtagattacactaatgtaccaaagtactataaataatttgtattgatcatcttgctaatttagtttattgttcacattttgccttcttaaaattttttttatatctaaagcttctattctttagattaagtagaaatgcattaaaacargaaatatactagacaaaagggagtctatgagctctctcaatagcattttctattggtaatcataaggaaaaatttcattccatttttatcactcattctgaagattgataatrtagttgcttgagaaacattacttatgctgtgtgcttattatttctgctgctctcaacgtgaagcatagcatgtgtttttgtgaagaatgttggtacttgattataattgtagctgcatctcatttgataggcaatttcactttggagaataggtgtaagatttttagtattttcagtgtaaatcaggtcaatcccatcagagaatatagagtatgtgaatgatgaatagcatttattccatcatgttattaaaatacagaaaactttttccaaccaaaatattgattttgtgcttcagcttgtttaagactgtgtataagttctacatgtcctggtaaggcatggtcacagccttgttcagaatctgaaatatattggatgattaataaatattggtggaacgatacacatctgtatggtatattggagtgttctgtttaggaaaagctgcttccttcatatgggtctatggctttattcatcaggtatagatggtagtgcatttaaatgcaaaaaataacattagcaaggagaccactgaggtggagcctacccgccccccgcccccgatattaaaacatgttataaagctacattaagtaaagtcctgtatggtaggtgtagattttattttcctcattctaccagggatggaataaaggcttcagcagcttaaaccactttcccaatgtgagtagggggccaaaattcatgttcagtttttctgactccagagctccactgaataagagagccctgctattttagatcatatgtctttattttcttctaattttcttaaagataagtatccatatttatttcattagtaaaaacattttcataatttaccttttgagtagcattatgaattaatggctccccagactcaatatgtctaaataatactcaatttatcaggaattaaatagtaggagcccctttaaatggactggactcctttgttcttttgctatcatccctgctaattttaagtgattttggttagtggccaccagatattccagacacattttgattcttcccatcctaagatataaaatcagcaacctttcatggagtacagattccttatagggaatattagtattaaataaaaggctttcagccttttagtattaaagactagaagacttttctgtaatactaatttttttcttatttttaagactttattttagagcagttttagattcacagcaaaattgagagaaacttacagagattcccctcattgtgttctgatcccctgctcctacacatggatggcctccccattatcaatatcccccaaatgttacaattgatgaactaaactgacacgttgttatcacccacaatccctagtttatattagagttcactcttggtgttgtacgttctgtgggcttggaaaaatgtataataaaattcatccaccattagtatcatgtagagtatttttactgctttaaaaatcctctgttctctgcctgttcctccatccctccttgctaactactggcaaccactgacttcttactgtctccatagtttttcccttttcagaatgtcatatactgtagttggaattacataggatgcagcattttcatattggattctttcatgtagtaatatgcatttaagtttcctctatgtctttttgtggtttggtatctcatttctttttagtgctgagtaatattccattgtctggatgtaccacagtttatccatttacctactaaaggacctcttggttgcgtccaagttttggcaattatgaataaagctgctataaacatccatgtgaaggtttttgtgtggacatgtttttgactactttgggcaaataccaagaagtgcaattgctgggttatattgtaaagtatgtttagtttgtttttcaaacaaccccattaaaaagtgggcaaaggacatgaacagacacatttcaaaagaaggcatacatgtagccaacaaacatagttttaaaaaagctcagcatcactgatcttagagaaatgcaaatcaaaaccacaatgagatatctcacaccagtcagaaaggctagtattaaaaagtaaaaaaataacagatgttggcgaggttgtggagcaaagggaacacttatacacagctagtgggagcctaaattagttcaaccattgtggaaagtagtgtgtcaattcctcaatacctaaaaaacagaaattcattttgacccaaaggaatataaattgttctgtcataaagacacatgcacacatatgttcattgcggcactattcacaatagcaaagacatagaatcaaactaaatgcccaccaatgataggctggataaagaaaatctcatacatatatatcatggaatactatgcagccataaaaagagtgagattatgtcctttgcaggaacatggatggagctggaggccattattctaagcaaactggagcagtaacagaaaaccaaatactgcattctctcatttataagtgggagctaaatgatgagaacacataaagggaaacaacaggcactggtgcctaatagagggtggagggtgggaggagggagaggttcaggaaaataatgaatgagtattaggcttaatacctggtgasaaaataatctgtaaaacaaaccctcatgacacaagtttacctatataacaaacctgcacaggtactccgacttaaaaggtttaggaaaattatgtttagtttttaaaatttgaattaaaacaattttaaatattcarttgacaaagaakgtatatattaaaggtayacaatgtgatgatttgatatacatgtgcattgtgtaatgattaccccaatcatattaattaacataccaattaccatctatgttgtacattagatccccagaacttatttatcttataactgaaagtttgcccccactggtcaacatctccccatttcccacaccctctcatctktggcaactgctgcttcactctgtttttatgatttatgtaaaatcaaaacagtttgattttacatataagtggtatcatattgtatttgtctttctgtgtttggcttatttcacttagcaaaatgccctccaggttcatccacaaatggcaagattttcttcatttcttatagctgaatactattctattgtaagtggttgtatatatacatatatatgaccatttctttattcattcattcatctgcagatgcttaggtagttgccatgttttggctattgtgataatgatggaatgaatgtgggagtgcagatgtcttttcaagctacttaattccttcagatataaattcagaagtggaattgctagatcttttggtagttgtatttttaatttttgaggaatctccccactttttttcattatgactgtatcaatttacattcccaccagcagtgtgcaaaagttcccttttctccacatcgtctcaaatattatctcttgtctttttaataatatccatcctaacaggtgtgaggtaatatctcactgtggttttgagttgcatttcccttgatgatcagtgctattgaagatcttttaatgcactattggccttttgtatgttttctttttcagaaatgtatattcagcgcctttacttatttttaattggattattattattatattgttattgagtggtatgacttcctactatattttagatattaactccttattgaatacatggtctacaaatattttctcccattctttctgtgtgttgccttttcatgtttttggttgtttgctttgctttgcagaagattttttgcagaagaagaagatttttataagtagtcccacttaaatctttttgcttttgttgcatgtgcttttggtgtcatctaaaaagacattgttgagaccaatgtcaagaatcttttaccctatgttttcttctaggagttttacagtttcaggcattacagttatgtcttttatccatttcaagttaatttttgtgagtggtgtagataagggtcgaattttattttatttttgtctgtaaatattcagttttcccagcaccatttattgaagagactattctttccccattgtgcttttacagaatattagttgactgtatatgtgtgggtttattcctgggytcttaattctattcaaatggtgtttgtgtatgtttttatgctagtactatactgttttgattgctatagctttgtaatgtactttgaaatcaggaagtgtgatccctccagttttgttcttaagattgctttggctatttgtggtcttttgtggttttatatgaatgttaggattgttttttctatttctttgaagaatactgttagaattttgacatagattgttttgactctatagatcactttgggtaatatagacatttaacagtactaattattttaatccatgaacatcagggtactttttcatttgtttgtgtcttcaatttttttcatcaatgccttgtaatttttaatgtaaccacagatctttcaaatctgtggttaaatttgtttctaagtggtttatatttttgatgctaatatacattgcattgttttctttctttttcagatagtttgttgttagcatacagaaatgcaactgatttttgtactttggttttgtatcctgcaactttattggatttgtttactagttataataggtttttggttgagtctttgggttttctatacataatattatataatctgcaaacagagaaaattttacttctttttttcctgatttgtatgccttttatttcttyttcttgcttaattgctctggctaggacttccaggaatatattaagtggaaatggtgagagtgggacaatatgtttaattttgtaagaaaccgccaaactgtttttcaaagtggctttatcactttgcattcctatcagcagtgaattagagtttttattactccacattcttgccagcatttggtgttgtcagtgtcctggaatttggccattctaatagatgtgtagtggtatctcattactgttttactttgcatctcccttatgacttatgcttattttcatatgcttattttctatctgtatatatgtttaagtgaattatctgttaaggtcattggcctatttttaaaaatgaggctatttatttatagttgagttttaagaatccttcatatgttttggataatatcgtttatcggatatgccttttacaaatattgtctcccagtctgtgtcttgttttttcactctcttgatgtctttattttttaaaagacatatattagccaaacatatttgtaatagtttaaacagtgtaaacctaacataataaaattgaaattcttgcaactgattaatttaaaaataatattatattcattctggtaaacaaagaaagcattttgtctatttgattccaaaataattagttgattaatacttgaatctaaaagagtaataaacrtttggtccataattatcttttttaaaatttaagaatttgaatttttaattactttgtatttttataagtaatatgaaatgaagcctagttattaaaaaattaaaactttactaccccagtttgggttcttgtctcatcctccccccaaaataataattgctatggtattggtatgtttcctttagaccttttcctaggctctcatatacacatatgcactcagagaaaatacaaagtgttgttgtgtgctcgttttaaaaatatatatgatatcattatatatatcatcctgccacttctgttttttattttatcatatattctggcaatttttcaagctattatatatagattcatcccacattgttcactcaaatacatgtagagccatgatctcagtcttctcaaaatgtagcaattatttctgtttctagaggccatagagttttctttcactgtaagtcatattgattaaaataatccttataagttattttctggaagatagcctttaggctacaaccaaaaagaaaaatgatcagcaatgcctacgtaaactacatattctccattaaatgatttaatataagacattccccacatcactatttgaattggttctcatacttccattctgtgggtggtatacatcttttgtattttaaaatattgatatttgcaatttattttaattttaatcattccgtcatagtgtcagattttttaaaactcctatagatgaatgaaatatgtattctcctggtttcacagatcccttccctacctttgatgcagtttttttgtttactcagatgtaaagtacctgtcttctctttgacttgttttcaagtttcagtctttctgcttctagctgtataattataatgctgatgcctgttcaggaagacttgataacataaaatctggataagatcacatccagactgttttttagcagttcatttaaaattttttaaattagtgaataaaaattatgtatatttgtggtgtataacatgatgttttgaaatacatacacattatgcagtggctaaatgaaactaacatatgcactacctcacatacttatttttttgtggtaagaacacttaatatctactctcagcaattttcaagtacacagtacattattattaactatagttaccaagttatgcaatagatttcttgtatttattcctcctgtcaaagtaaaattttgaatcttttgaccagcatctcctgaatcctgtccctgccccctagcccctggtaaccaccactccactctgtgtccgagttagattcttttggattttacatacaagtgagatcatgtggtatttgtatttctgtgcatggcttatttcacataacataatgtcttctaggcttatccatcttgctgcaaatgacagaattttctgtttttttttttgttgttgttgttgtttgtttgtttgtttgacagggtctcgctctgtcacccaggctggagtgtagcagcatgctcacagctcaccacaacctcgacttcttgggctcaagcaattctcccacctcagtctcccgagtagctggaactacaggcatgcgccaccacgcctggctaatttttgtatgttttgtagagatgagattttgccatgttgcccaggctggtcttgaactcctggactcaaaccagccaccagccacccacctcagcctcccaaaatgttgcaattataggcatgactcgttgcaccctgcagattgttttctttttaaaggctgaatagtattccattgcatatatactacattttctttatccatttggccattggtagacatttagggtgattccatatcttggctattatgaataatggtgcagtgaacatgagagtacatatatctctttgatatactgatttcatttcccttggatatatacacagtagtgggattgctgattatatgatagttctattttcaattttttaaggaacctccagctgtttttcatgatagctgtatcaatttatatttctaccagcagcatacaaggattccccttttctctacatctttgtcatcaagattacctgtagctttcaattccatgttctatggatctaaatccctccctaagaattctgtgaatgactggtttgccaggctcaaatgatcctcctacctcagcctcccaagtagctgggaatacagggatgtgccaccttgcccagctaacttttatattttttgtagaaacgggtttcactatgttgcccaggctgatgttgaactcctgggctcaagcaattggctcatctgtgcctcccaaagtgctgggattacaggcgtgagccactgtgcttagccctactttgcctttaaccattttgattctgcatttaattgtccagacttacgtctggtcaatctgtgcttaactaactactctttttatttatacaacacatccacattgtagttacgtatttttgtgattttcttggttaatagtgttaagttctgagatgtgagccctgtgaggagggcagggatgctcaccattctattaccaattcctagcacagtacctggcacagagtaggctctttaagagactcagaatgtaaggaaggaaaagttgaagagtacttggggtttgtgatgaggagaagatagccttgaaaataaaggggaacactgggcacagtggcttacacctataattccagcactgtgggaggtcaaggcaggtggattgcctgaactcaggagtttgagaccagcctgggcaacatggtgaaaccccatctctacaaaaattacaaaaactagctgggtggggtggcacacacctgtgattccagttactgcggaggctgagttgggaagatcacctgagttggggaggtcaaggctgcagtgagccatcattgcacaactgcactcagcctgggtgacagagtgagacattcctcaaatttttttcaaaaaagaaagaaacaaaggggagataagagagagagaaagaaagagagagagataaagagagagaaagaaaatgatgagagagaaagactatgtcttccttgaagacaaggaggagaagaaatgagtggaaaaacataatgagactcaggtgaatgaagaagtttgccaggtggtctcatctcagtttccccagagtggtagaaagtgtatggatttggtacttacataaaattggatttgaatcctatatcttctcttttaaggggattattagacaacttacttaatcttgctcactctcggttttcacatgtataaattaatgatgataataccccacaaaatggttggtaatggttaaataagataacaaaagcagcattgcatggtagttatagcatggaactggaagtagacagatttggacagactcttccctctgctacttactagctgagtgatcttgggtaagttacttaaagtctttaattttgaaaagaagtggtaggaagaaaaataaggaataaatttattaatcaaataaattataagctctccagagagagataaaaatatagaggatgatatcaatacaaatatatttgtttatagctatgcgccaggattcaaacccaggctatctgcttctaagacctgggttctaaatttctagctatacttactcttttaaacaaaataatataatagaagaatatggagttgggactcttaattatatttaaaaaataatgttctgtcagcaatcaaattattaaggaggtaagtatacattgagtggaaccttaaaaaaggaaaaatattttctatttcaatggagtggcatcctgaaaaaacaatatcctattgattgtctttcatgggattaatgccatgaaacacactgaaatgctgttttaacatagctattgtgcatcggaagaggtaaaaacttatttcagttggtcttaaacaaatccagtgccatttcacaggacatttgatttactttaaaaaattcttgcctttttattgattcagtgacaaggttagtgaaaactttagtaggttggaatagtaggacagttgtttcaggcaaaatcaagagacctgcctataggtgtcagatgtcagaacagacaacggtttgagttcagatgagcttgaagaatcggaagtcttaaaagtcaagcatgtaaaattccaaatgctgagatagtttgaggaatgaacctgtagagcagaagctagagtgaacttaattctacaatataggctatttactaacatgaaatcacagctagaacatggcaaaaaagccagaactgccaaaaatcacggcagttttttcttgcagtacttacagcaaacagatttgaaatgtaatcagttttttcctattgtcacaatgctggagacatattcactgtttctatcacatcttctaattacattagagcaattaaagagcaattctattgcctgcatagtcttttcttaatgatgccacactggaagtacatttccaaaaaggttttaaatggtttaatttttttttttttttttttgtgagacggagtcttgctctgtagtctaggctggagtacactggtgtgatctcggctcactgcaacttctgcctcctgggtcccggttcaagcaattctcctgcctcaatctcccaagtagctgggattacagacacatgccaccatgcctagctaatttttgtatttttagtagagacagtgtttcaccatgttggccaggctggtcttgaactcctaaccttgtgatccgcccacctcaacctcccaaaatgctgggattacaggtgtgagccactgcacctggcctaaatggtttaatttttgttatgaaacattgtagtggaaagtttgtactaaatgagtgggccaaagaaagatgtggtaaaagtggcaaatgaaataaggaggaagacttagatgaatgaagccttaactgatggccagccccattgtagggattatggtttcatcaaaaataatatctactgggtaaagaaaaagaaatgttaaatttgctttttgtaaagttaatttcctttcatgtttttaaaaatttttttgcccatgtaagacagaaaaatggagagactcaatagaggcatagaaaaaaaggaaaaaaaggccggccgtgatggctcacacctgtaatcccagcactttgggaggccgaggcaggcggatcatgtggtcaagagatcgagaccatcctggccaacatggtgaaaccctctctctactaaaaatataaaaattagctggatgtggtgacgtgtacctgtagtcccagctacttgggaggctgaggcaagagagtcgcttgaatttgggggtagaggttgcagtgagccgagatcgcgccactgcactcaagcctggcaacagagtgagactccatctaaaaaacaaaaaaagaaaagaaaaaaagaaaaataggaagaaaacagtcaggaaaggaagaattctcctgcatgcttttaagatatttaaccaattttatatcagatctatattctagtttacattttacattatataaggggccttcaaaaagttcatgaagaatgtgtattataaaaaactatgcatggatttcaacattttttccaccaaaataaactcatactaacttgttgtaacatgtcagaatgggatttattttgaggcactgagaaagataaaacatcagtttgaagaacctctatcagcaatgtgaattctgataaaaatgaagcaagaacaaacatcaaatatgtggtgaagactgggcaaaagaatggtaaaatcattgatgctttataaaaggtttatagggacaatgcctcaaagaaatcagcagtttacaagtgggtaactcattttagtaagggatgagatgatgtcaaagatgaagctcaaggtggcagaacatccacatcaatttgtgggaaaaaaattaatcttgttcatgtcttaattgaaaaggactgacaattaacagcacaaacaatagccaacaccatagacatctcaattgcttcagcttatacagttctgactaaaatattaaagttgagccaactttctacttgatgagtgtcaaaaatgttgctccgggagaagctgcagataagagcagagctttcaatagaaattttttaaacaattgatatcaagatcctgaagcatctctccaaagaaatgtaaaaggagatggaacatggctttaccactacgatccctaaggcacagcacagtcaaagcaatggctaccaagagttggaagtaatcgagtcgaagcaaaattggaccagtcaagagcaaaggtcatggtaatagtgtttgggattctcaagacattttgtctgttaacttgctgggaggccaaagaatgataactacttattataagagtgttttaagaaagttggccaaagcgttagcagaaaaatgcttaggaaagcttcaccagagagtccttctccatcacaataatacttgtgctcattcctcttattaaacaagggcaattttgcaagatttgcataggaaattattaggcttccatgttacagtcccgatttggctccttctgactcctttttgtttcctaatcttaaaaaaattgtaaagggcacctatttttcttcagttaataatgtaaaaaagactgcattgacatagttgaattcccagaaccttcagttctttagaggtagactaaatagctggtatcatcacttgcataaatttcttgaacttgatggagcttacgttgagaaataaagtttacattttttatttttatattttaactccactttttacgtgaactttttggagtaccctcacattttattttttatttatttattttttaattatactttaagttttagggtatatgtgtacaacatgcaggttagttacatatgtatacatgtgccatgttggtgtgctgcacccattaactcgtcatttaacattaggtatatctcctaatgctatccctcccccctcctcccaccccacaacaggccccagtgtgtgatgttccccttcctgtgtccatgtgttctcattgttcaattcccacctatgagtgagagcatgcggtgtttggttttttgtccttgcgatagtttgctgacaatgatggtttccagcttcatccatgtccctacaaaggacatgaactcatcattttttatggctgcatagtattccatggtgtatatgtgccacattttcttaatccagtctacaattgttggacatttgggttggttccacgtctttgctattgtgaatagtgccgcaataaacatacatgtgcatgtgtttttatagcagcatgttttataatcctttgggtatatacccagtaatgggatggctgggtcaaatggtatttgtagttctagatccctgaggaatcaccacactgacttccatgatggttgaactagtttacagttccaccaacagtgtaaaagtgttcctgtttctccatatcctctccagcacctgttgtttcttgaatttttaatgatcgccattctaactggtgtgagatggcatctcattgtggttttgatttgcatttctctgatggccagtgatgatgagcattttttcatgtgtcttttggctgcataaatgtcttcttttgagaagtgtctgttcatatcctttgcccagttgttgatggggttgtttgtttttttcttgtaaatgtgttggagttcattgtagattctggatattagccctttgttacatgagtagattgcaaaaattttctcccattctgtaggttgcctgttcactctgatggtagtttcttttgctgtgcagaagctctttagtttaattagatcccatttgtcaattttgacttttgttgccattgcttttggtgttttagacatgaagtccttgcccatgcctatgtcctgaatggtattgcctaggttttcttctagggtttttatggttttaggtctaacatgtaagtctttaatccttcttgaattaatttttgtataaggtgtaaggaagggatccagtttcagctttctacatatggctagcccgttttcccagcaccatttattaaatagggaatcctttccccattgcttgtttttctcaggtttgtcaaagatcagatggttgtagattggctttatttctgaggcctctgttctgttccattggtctatatctctgttttggtaccagtaccatgctgttttggttactgtagccttgtggtgtagtttaaagtcaggtagcgtgatgcctccagctttattcttttggcttaggattgacttgctgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaaagttcttccatttgtttgtatcctcttttatttcattgagcagtggtttgtagttctccttgaagaggtccttcacatcccttgtaagttggattcctaggtattttattctctttgtagcaattgtgaatgggagttcactcatgactcaggattaagaaactcactcaaaacccctcacattttatagtaagggaacattacacagtgctgtttttttaaaaaaaatgttttaaaactatatctttttctataataattttttcttcctagcttgactctgcagttgtggcttttaaaattgtatcctggctactttcaatccccaaatatttatcagaatgtaatgtaacacaatgataagtataagattttatatataaacacacacacatatacttatttacatacttamacacctctacctatataaaatacatatacatatctataatcttatacataagattatatactaggaagatcttataatatcttcacagtgtgtttgtgtgtagattcacactcagaatttcacactctgaagatcattatgtgattgcatttcatgttaagggttcttcagagagcttttattctacactatctctttcttcaattctcacattatgcctaatcttggaaagacttcctctcttggagtattttaataaaagacccttagagcagcatataccttccatcttttcttaagaggctgtagattatctcgacttctattacctgaagatatgtctaatggaaaccttaaaaataccgtgtcagkttctaatagctggaaatagctggaagttataatagatcaacaggaagaagcagttttgttttaaattaaataattaaaattcagaatttactttgatatgttagtgttaaagttaactaaagtttatgatttaaagtgaggcataatgaaaataatattaaatctggtattgaaagacatggatacttgtctgaacgtcactgtttatttgctctatgaccttgggtaagacagcctttcagcctcactcatcatcagctgaaatgtgtagttattaatactttgctgcctacttcctcatggtgctgtcaggatgagatacatgaaaatattgtataaacagtgcagtctataaaagttactattgtaaataacagttaatatgctccagtcagtgtattaagcatttatatcattcttacaacagttttacaacacacgcaacattaatattctgcttttatagatcaagaggttgaggctcagcaagtgtatgacacctgcatgagggagaaatgtaagatttgaatccaggtctgtctgaggctagaacaaaagctcataattgcatcactttcattatttatcagaataataatcactacatagcattatgtgtgaaccagccgaggcagtaaaacacagttctctttattatcacatctgaattctaaatgcaaaaacaaaataacatttgtttttcrtaaaagtgaaatgccatggagctctaaccatacaaatgtgttcttctcttagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgtaggtgactggtttgccttcccatccctagcccctcttcccttgtactttgaatataggctgagatactttccgtatacaaaatagrgtaaattacaaatgagtatgtgattttacataggttgattttctaagtgagttctgcttggttatttacagggaacaacaaccctgggaatttctagggatgagatcagaaccagaagggtatttacaggtgattgttttgtttgtggaagtatctcactattagttgaagaagggaatcaggattggagaaaggaaactagagttgcacatcaatttaagaaatataaagaagataaagagaggggcagattgctcaggatcaagttagtgaataatgaaaggccattagaagttagtatccaataacagtgatattacagggatcatgagctatgtttgaaggygtgtaaagagcccatgcaggttgttatgtttttttgttgttgttgttttatggagatagacagggtcttgatctgttgcccaggctcaagtgcagttgggcaatcacagctaatggcagcctcgaactcctgggctcatatgatccttctacctcagcctcccaagtagcttggactacaggtgtgttaccatgcccagctaatttttgtagtttttgtagagatggggttttgccataatgcccagactggtgtcaaactactgggctcaagtgaccctcccaccttggcctcccaaagtgctgggattacaggcacccacgtagttttggcagctcttaatctttttcaaatgtgacagtgtctagttttttttttttttttttttgaagttttagctatcagaaatattgtaaatgtctaaatttagggcaaaaatatttgtttcaaagtccattttgtttcactgtatttatacatatatatgaaatacatatctcttcatctatggaatgtctgtaactattgttcccctcaaatcttggtaatatttataaagtgaagagaaaaatcttgaatatattttcaattatatattgattatgaagattccttaaataatagagctaaacaaaatgaaagttataatagcaatattttgttcatctgcattattataaatagaagaattcaagattcatgtaggtgtgttttgagaatgattagttacaaagggtatgacttttcaggtatgaatttaagatatttgagattgttcaattatgtgaataattgaaatgcactaaaattatttggtgcattttgaagacccttcaacacatttgatgtatcttcatactcttaatatttgatgactttggttcctgaccagaaatctctcacctgtcgataaatcaaagttgtaaggtagatttctttaataagaaaattttagtattgtcatgtcctagacatgacatgtcctagaatgcctgaagctagaatatccccatttttagcatataatatattcttaaagatttttcaaggtaattcatcagtcataaaaaacttagaagataatattttattgaaatgccttctttcatgatatgcaaactgttacaattattattttcctctttacagataaaatatagtaaagttatatatacatttatttttcctagaaattataaaattgtaagttcaatttatctaaaatagaaagttattttattctttataggtacaaattcagatatatatacatgtgcacacttacccacatacataggtaaggttggccacgtaatttgtggggcctaatacaaaatgaaaatgtgaggcttcttgttcaaaaagcaggagaaaggaactgtagctttcttacacagtctctcgtgacctatgaaaggttatttttgtttgctatttaatgttagatttctagagtatagaggtacttataaagtgactatataaagaggtacttataaagtgactatataaagaggtacttataaagtgactatatgtctcgtgacatataggtcacgagagactatgacctatgaaaggttatttttatttgctatttaatgttagatttctagagtatagaggtacttataaagtgactgcagaccctcacaggcatctgtggccccaccaaatgaccctgacccaccccagggtgtgccaaggcccccacaaggaataaagggtggcagtaatcactgggtgggagaacaggtggctgaggacctatcccaggaagtcactcggaggcaggactgcatatgagccaagacatgtgcttcattgctgcattggactacacagattcacaggtaaaattgttaaaaaattcaagactgtggtagcagagcatgaaaacccaagcctgggacccctgtctaaaattgggatcctatgtgcagtagcaggtccctgaagctgsccctgtgtataataaacacatatcacatcaaaataatggtgattttatggttttcttaaactgagcaaattggactgaactaatgaatattgtaattaagtgtaattaagtagcaggaaccaacctggaaaactgtggagtgtattattgtatctcatccccaggtttactgtcactccaggtttctatcacaaataatgcttctttatagctgttgcatcagttttaatgaaagggaatgcatttttctggaactagctgaactcaaaccttgctcaccgtttgctcaaagacttgggatggctctaatacttaagtcctcatctttctattttaaggaatactgtgtctcctttggtggacccagttgtttttcagatcagtcagtagcttttgtaattgagctgtgctgatggagcaaatgcttgatgataagcatgaaaactgaaagtgattaattcatcaaaacctgtgagtcttttaggtgaaggggacttcagagattggcttaaattttgcaaatctgttgcrtccagccagagcagttccgcaatgagaaatgaatgcagcttatgtttgtctcaggctcagtccacacaaccatatgactcctctgagtctaaataaattcagttccttaaacagatcagcaagtcttgatcattttttaaaatggaatctcaacgttcaataagttcaatgtcttgtcacattaagaagaaattagcaagaaatgagatgagatgggtctataacggacaaaacagacaaccacttaacactattgattatgtatgtttgccctaatatatactgtcctgttaaatttatatgagtggatacatatgtatatatgtttggttagttttctattgctgctgtaacaaattaccacacacttagtgtcttaaaccacacaaatttctgtctttcagctctgtaatcaaaagtctgacctgggcctcactggagtaaaaatcaaattgttggaggaatgcattattttctggagtctctagggaagagtccattatttttgccttttccagtttctagaggtcacyctcattccttggctcatggccctctgcctccatcttctaagccagcaacgtcatgtttctctgaccctgcttccaacctcacatctctttctctgaccacaccttggaaagattctcttctttttaggactcatgtgattagtgggagccacccagattatccaggataatcctcccatctgaaggcccttaaccttaattacatctgcaaaatccctcttgccatgtcaggtaacatattcataggttctgggaatttgaatgtggacatctctgggagactcacaacattatatcaatactagtcttccctagtctctttggtggaatcattatcaatcctttcatttcgaatccattatagacagcatccctcatacactttaagytctgtgcaggcagatcacatgtctgttttgtttagttttatcccaagcctcaggcacaatgcatagaatttagaaaaagctgaattgtatttttggatgaaagagtgaatgaaatgattgcatgttgtatatgccatgtaatggagaaacagcctctctgacattaactgaaatgagtttcaagcatctactacatttatacaatggactgcctgttataaaaggtcttattttgcaaagcattaaatctcttctggaaatcaatgtaaatatccagaaataaattcttttttatcttaatctctgcatttggatccacatccagccctattctagaacaggatttttattcattaaaaatacactccaggaaacatttaggatcagaaaaaatatagcttttgtcttttaaaacttagggatatatatatttctaagatatttctgctgattttgttatatctctatgactggttagacctagttcatcttctctgatgtataacataattaaggaattttttyataaatggggcagagcaacgaggccctgtgaaaaaggaatgatcttcaggaaatcaattatttttacatggtgatctttctgtaattggtgaaaatagaattgtaggtaggcagccatcatgtttgagttctaagataacaccaagcatggatatttttctgggactgggttgaaatcatattgttgtagttgggttggatgtgttagataggtgacatataattattagtaaagttaatattcaggtgatacatgactataggggattattagaactgagtgagagataatgctgctagagtaaacaagtcagatctgagctccatgcaggaactaatttgcatttctggacctctcatccacccacttgtttcttctcttggtgttttatgtggaagcacattgttggttctcattacgtatttgctgagtgaataaagaatcaaatggactggctttgttattcagaaacctgttttattgtgtgtcttgagtttaatgcattccatgtcttgggaaattctgaaaattcatataaagcctacacgaaaagagatgttatgggatttttccttttgtatagacctccatctcactcctgaaaatgcattttggaaataattccagccttaattaattaatttatttttatttcctatgatgatatggtaaaacagttgggaggaacaatatgcaatggctttttgaatacaagagacaggttagaattaaaattctaaaaatgtaaaggcagttttcagcctatgtttttccttctttccctccctccctccctcccttcctccctttccctccatcccttccttcttcccttcctccctcccttcctttctttttttttttttttggcatggactgcatatgagaattgtcattatcacctcaagtgtactgtactagatgctttacatttttatattcttaaccgttttcattattatgtagtggtaactgatttttgagtggttgatttggttagagataatgtttttcagtttacagatatctggataacttaaaagaaataaatagtatcctatataggtctgtgcaagagtggatatgccaaaaacagagatatcaaccaaggtcagattgattagagcataaagtcaaagtccaagaagatataaaggaatcatcccaatgaaagaggctggatttagatattgaagctggaatataggagctgatgattcaacaagctgggagttgagagaaataataaatagtggggatctggttaagttggcaaaatgctttttttttctctgatttcttttctgtgcctaaattaaggactaagtattacacaggtatttgcatatgtgaattgttttggaaataactttattgtttcagctattatttttctgagctgctctgggttcctagtcttattcctctactaaatgttccttaattccatagatgactgttaaataatgattccaaatccttcttgacaagttaagtttggtgtcacgtagatctggcatagaatatccactttggggtttaagaggagcttgtgcagtgctcattggggaaaaggaggcatctgggttcctctattgaggaaacagactattctcatatatctcttctttgtgctctaatgtactaatctctcttaataataaaaattaattgtgagaatcctacagaaatgcaagctatgtgattgcggaactagtaagaaaagctgaaataataaaaagtaggcagccatttttatcttttttaataaaagggaaactaatcagatagagccagagcacaggaggagaatgaaataatttttgtaaaataaaagtaactataaagtaatggagaatattccaaagtgtcaaaacttaagtcttgcagagagcaatcaatacagaggtgaaaagcagagagcaatacagaggtgaaagtccctaaaggttacatcctcttggccagagagcttaaagcctgagagccctttgtcatttgccttccagcagaggcagccatgatttctaatacctgtggggcaggtcagtcattcactttgtggattgttccaactgatcctttcccaagaagtgggttcctttactccctagtgtttaggcattcctcatatgttagaagttcctgctatggttttttaacattaaactttactcagagttgtttgttacataaaataaaactaggtcaaatggtagaaatgacaggaatatagtaagaatcaagaatcctggcatgaagtattagttctaacttggacraaatataagggtcctgagcctagtagagttcctaggtgggagctgatggtagaatgaagagtgattgttgtcttagatcatatacactagaacagacttgaaagtaaatttgagtacaaaaaagttttgttgggacagtctttcagaaaataaacatataaggaaacatataaagaaaggcagattggcagagaagccaacttacaatggaaatcttagctgtcctrtggggagtgttggagctgggatggcctttcagaattgtctcatattgaaacgggggaatggacccttagaattcctgcaactgtcaatcattgatggcatatcatcccaggagctctgtaactttggatgaggcaggttcctgcaactgaggactgttcccagtgaggaaaagagatgtgagccatcacagctggtatttccagctgaaaagggaatcccttataaaggaaatctgggtgaagcaccacattattcactacaacagttaatagcaaaaatcaaaaggttgtttttatagcccttgaacaatgaaatattatcctgtgttagcaactatagtcagaatatttggcttcacagagaatttaatttactattggtaatgtttagaaaattattaggagaaacatgtaatttgttatccaaaccgggatacatttttttttttttttcctgagatggggtctggctctgtcacctaggctggagtgcagtaacataatcttggctcgctgcaacctctgcctcctgggttcaagtggttctcctgcctcagcctttcgagcagctgggattacatgtgtacaccaccatagctggctaatttttgtattttttagtagagacagggtttcatcacattggccaagctggtcttgaactcctgacctcagatgatctgcctgcctcggcctcccaaagtgctgggattacaggcgtaagccaccgtgcccggccaaaactgcgttacttctgagagacaaagattcataaaatggtcaacagaccttaattgatctacaaaaggcatctcaagcaaactgagaggtatggccacctagaaactatatgactatatgactatagtgtgtgtgtgtatatatatgtatgtattatacatatgtatatatataataaacacaagaatacatatgatggattttgagagagatttaacacatttttctgacagattttgtatgggctataacagatagctaaactgtaaaatttaaattaaaatgctattggtgttactgcatttctagttacataattcttctataaacactgtgctaagaagtggtggtttcaaagtactaacaactgcagtcttagttgtcaaggagaatcaaacagacaagtacgtgaaatggaacatgataaaaactgtaatactgatgaatgctaagtactataagagcaccaagtagtaagtggttaactcccctggggtggatcaggcttcagaggagagaaagctcttaagctggcttttgaaggagaagtaggtactcattagacagttgagggagttgggaattccagaaaggggtaagagcctgtgcaaaggcacagagcaggaatcacataggttgtttgttgtaggaaatatatgaagttcagtttggaggaaaagtagagggaagaaagaaaggaaggatatgagactaagtactggccattagtttgcaaatgtgtttcttttaaatatttgataaactcccaatatttttttccttctaaaacaagctgaattttaatttttgcctatttttcttcaatgttaatcagttatgagtccctcatatcatcttggctgtcttatattcataaatcaatttccattgaaatatattaatttatctttttattttgtttttatttttattttttggcagggtcttgctctcttacccaggctgctagagggtagtgatgtgatcacagctcactgcagctttgaccttccaggctcaagtcatcctcccactacagcctcctgaatagctgggactacgggtgtgcactaccaggcctggtcaatatattttgtttttctttttttttttttgagacagagtttcactgttgttgcccaggctggagtgcaatggtgtgatctcggctcactgcaacctctgactcccaggttcaagcaattctcctgcctcagcctcctgagtagctgggattacaggcatatgccaccacacccgtctgattttatatttttagtagaaacggggtttctccatgttggtcaggctggtctcgaactcccaacctcaggtgaaccgcctgtctcagcctcccaaagtgctgggattatgggcgtgagccactgcgcctggcctagaartaccaaaatatttactttgaatatgcttatatgtctcacataagatttagcaagaagcaattaaaatgcctgaaaaccatttaatggtacaaaaaccatgaccttttgtggtactatatactggaaaatatgattcagtttattttattagccagcactatcttatggaaatattatgcaaactacaataatatgtgagccaaatagataattttaaattttctagtagctacatacagtaaaaggaacaggtgaaattaattttagttaagtcagtgtatgcaaaatatcatcatttcaatatgcaatcaatataaacatcataatgagatatcttacattctgttttagttataagtccttgaaatttgatgtgtattttacatttatagtgtagctggactaaccatatttcgtgttcaatagcgacatgtggccagtggctgccatggtagacagcatagcactatgcagaattgccttctccatcatagtgtttgtggtttttttaacctttttttagatacaggggtacatgtgaaggtttattacataggtaaacttgtggcatgggagtttgttgtacagattatttaatcacccaagtattaagcctggtacccagtagttatcttttctgctcctctcccttttcccaccctccaccctcaagaagagtccagtgtttactgttttcttctttgtgtttataagttcttgtcatttagctcccacttataagtgagaatatgtggtatttggttttctgtttctgtgttagtatactaaggataatagcctccagctccatccacgttcccacaaaagacacgatctcattattttttatagctgcataatattccatggtgaatatgtgccttgttttcttcatcaaatctgtcattgatggacatttaggttgattccatgtttttgctgtgaatcatgctgcaatgaacattcgtgtacatgtgtctttatgatagaatgatttatattcctttgggtatgtacccagtaatgggattactgggtcgaatggcagttctgcttttagttctttgaggaattaccatactgctttccacaatggctgaattaacttacactcctaccaacagtatataagtgcttccttttctctgcaaccttgccagcatctgttattttttgactttttagtaatagccattttgactggtgtgagatggtatctcactgtggttttgatttgcgtttctctaatgatcagtgttattgagcttttctttatgtgctagttggccacatctatgtcttcttttgaaaagtgtgttcatatcctttacctgctttttaatggggttgtttttcttttgtcaatttgtttaagtctcttatagatgcttataagtttcttatatcagacctttgtcagatgcatagtttgcaaatattttctcccatctgtaggttgtctgtttactgtgttgatagtttcctttgctgtgtggaagctcttaggtttaatcaaattttgcttttgttgtgattgcttttggtgtctttgtcctgacatctttgcccattcctatgtccaggatggtatttcctaggttttcttccagtgtttttatagttttggtttttacatttaagtctttaattcatcttgacttgatttttgtatatggtgtaaggaaggggtccagagtcaatcgtctgtgcatggctggccagttatcccagcatcatttattgaatagggagtcttttcccaattgttattttttgtcagctttgtcaaaagatcagatggtcgcagatgtgtggccttatttctgggcctctcttctgttccactggtctacgtgtctttttttgtaccatgctgttttggtaactgtgttctgtagtatagtttgaagttgggtaacgtgatgcttccagctttgtttttttttgcttaggattgccttggctattcaggctcattttggttccaaatgaattttaaaatcattttctctagttctgtaaagaatgtcattggtagtttgataggatagcaatgaatctgtaaattgctttgggcagtatggccattttaatgatactgattcttcctatctatgagcattggatgtttttccatttgtttgcgtcttcactgatttctttgagcagcattttgtaattcttgttatagagatctttctcctttctggtaagctgtgttcataagcattttagtctttttgtggcaattgtgaatcagattgcctttatgatttttctctcagtttggctgttattggtgtgtaggaatactagtgatttttgtaagtcaattttgtttactaaaattttgttaaagttgtttattagctgaaggagcttttgagctaagactatgggtatggggttttctacatatagaatcatgtcatctgctaacagagatagtttgacttcctctcttcctatttggatgccctttatttctttctcttgcgtgattgctttggcttagacttctaatatgatgttgaatagaagtggcaagagagcattcttatcttgtgccagttttcaagggggaatgcttgcagcttttgccctttcagtataatgttggctgtaggtttgtcatagatggctcttattattttgatgtatgttccttcaatacttagcttattagaagtttttaacatgaacgggtgttgaattttatcaaaagccttttctgtggctattgagataatagtggtttttgtcttttgttctttttatgtgatgagtgatatttattgctttgtgtatgttgaaccaaccttgcattctggggatgaagtctacttgatcatggtggattatctttttgatgtgctgctggattcggtttgccagtattttgttgagggcttttgtcttgatattcatcaaggatatagctctgaagttttctttttttgttgtgtctctgctaggttttggtatccagatgatgctggccttgtagaatgagttggggaaaagttcctcctcctgaattttaaggaatagtctctgtaggaatggtaccagctcttctttgtacatctggtattaatagaatttggctacatcatgatgtttttaatgttggataacctttttttattttgagatggagtctcactctgttgcctaggctgaagtgcagtgacgccatctcggctcactgcaatccctggcccccagttcaagcaattctcctgcctcaacctcctgagtagctgggattgcaggtgtgagccagaatgcccagctaatttttttgtattttttaagtagagatggggtttcaccatgttggccagggtggtctggaactcctgacctcaggtgatttacctgccttggccttccaaactgttgggattataggcgtgagccactatactcggccgataacctctatatttttataactttaaaaatgctactgttggggtaataaaagaaaggagagagaatacttaggtcagggatatctagagctacctcaccatgctgtcattcctagggttatccagtaaaataagcaagtggcattttatacttgtatattggaaaggaatgaaattttctatatgtcatagattgtattctctaatgatagctacaacaatatttcacattttgcaaattctcctctggcatgactttgcttttcctccatcaaaaagatagagtttaatacttttcttcttgaatcttggctggacttaataacttggttgaccaactaaatatggcagaagtaacattctaggacttctgaggctagattataaaaaggcttttagctttcacctgattgttttggagtgctcaactttgagacatttcccctcagaatgcaatttctaggctgtatgaagcccagcctacacagagagataacaattaggtaggcactctggttgatagagctgcattcctagccaaaagcccgcattaactgccagcactgtaaatatggtatcttgtatgtctagcctattcaaaattttatatggttcccactgcagccaaactttgactgcagctgctcagagacctgatgtgtcaaatctcagctgagcccagccaaacctcagaaccataagaaagaataaaaaattgttgcctttttttttttcttttttttgagatggagtctcgttctgtcacccaggctggagtgccatggcacgatcttggctcactgcaacctctgcctcctgggttcaagtgattctccttcctcagcctcctgagtagctgggactacaggcatgtgccaccacacccggctaatttttrtatttttagtagagacagggttttgccatgttggccaggctggtcttgaactcctgacctcaaatgatccacctgcctcggcctcccagagttctgggattacaggcatgagccaccgcgcccggccagaagttgttgctttttaaacattaggttttgcaatggcttcttacacaataatagataatcataatactatacaattttttaggcaaagactttactttgagaagaacataaaggatctgaattaccctaacaacaaatgtagggaatagcctagagggtattctaggatgagttagactgtctccttagccataatggtcaagagttgttagttacagctttattagaaagaatccaaaactgatgttagtaggtagaaagatgtagagaaaattattaatggattctattacaaagaatagatttagttaatccctgcaaatctttcatgttctttaagtctcgggttaaaaattaaaccagtgtatataaattaaacacttataacagagatctgaagtgggtgaaccttatctaattataagggtaaagattctagtgtccagtgtgaaaaaaaaccaagaaagctaggtaagttacactcttgcagaattccattttaatgagtttagttttgtctgagtgcatttatgttataatgatattggtaattgcatttaagaatgactgaaactttttcaggtgacccacaattgatatttctaaaatgtgcgttatgatcacctgccctctttagcagtattaaattagaatcattgaatacctagtgattatataatttatgctgtggaatagtcacaggcaaatgtttatttagcctcttgcagtttctaagtctcccttcctccttggcaattttaagtgcagtactgggggctcaggagaaaaggaatatgcaaagaaaatacaaagttggcaagacggttagtatggcagttggcttacaactgggaagagaaaaataatttttgtttggtgcatagcagagatatgataatcactatttgtgataattatgttgtcttttgtagaaacaagctctttctaatttgacaactcctttagaagtattgactgttcattttatttagtttctgacttttatattaaacctaacacttgtaaaaataaaactgactgaatctacttgataactgcttttaattttagttcagctgtttatgctatatgggaaagcctatccatcttctctcattttcgtcccaggaatacctctcaaagactagaaactaaatttttaaaaaaacttttaattttgaaataattatagattcaaaggaagtagcaaagacagcacagagaggttctttgtaccctttgcccagtttcctatataggttgcatcatgtgtaactatatagcaagatatcaaaacaaggacattgacatattgacataaattatgtatatagttttatcacatatatgggtttgtgtaatcaccaacacaaaaacgatacagaaatattccatcactacaaatatctcccttgtgctaccactttccaatcacacctgcccctccctacccctaccacctgcccctgccccgtgcctaaccctcggcaaatgcaaatctattctccatttctataattttgttattatacagtgttttataaatggaattacacagtgtaggaccttttgagattggctttttaaaaactcagcataatgccttagagatccatccaagttggatatattgatagtttattcttttttattgctaattagtattccatggtaggatataccattgtttatacatttgactatggtaggacattctgttttttccagtttggggctattacaaataatgcttctatgaacaattgggtacagatttttgtgtagtcataaattttaatttctctaagagaaacacccacaagtgtgattgctaggttatggtatgtgatgcatagtttttaggaaactgccaaactattttccagagcaattttacattcccaccagcaatgtatctagttattcaacactctgaccaacatttgatattttcactattttttattttagatgttctaatcagtgtgtagtgatattatgatcttcattctaatagccagtgatgtcaaacatcttttcatgtgtttatttgctgtctgtacatactcttcagtgaaatgactcatcatgttttttgcctattttctaataggattttttgtatagtagtttactgttaattattaagagttgtttatacattctatatatgagaccttttcagatattagttttgtaaatattttcttgcagtttgtagctaatgaagtaagctttatctattttttcttttatgtgtcatgctttttgtgtctaagaatggttcaacgagttctaggtccaaaatttcttttctgctattttcctaaacgttttatattttacatttgattttgtatttatgatccattctgagttaactttttatgaagtgtgagacttttctcaaagttcctactttttgcctattgatatccagttgctctagcactatttgttcctccattggattacttctgcatatttgtgaaaaatcaatttgctgtacttgtgtatggctatttctagtttcatgattctattttattgggctgtttgtttattccttggccaatatcacaaagcattgactactgtagctatataataagtcttgaaatcacttagagttattcctattaatttcctatttcaaagttgtttttagctatcctagctactttgtcattccatgtatattttacaataatttttaatgtctaaaatttttttcttaggttttataagaattataaaaacttgtatatcaatttaggagaattgacatatttactgtgttgtcttccagttcatgaacacaggatgtctctccattcaattagatctttgatttctttcatcagcattttgcagttttcagtatagaagtcgtacacgttttattagacttatacctaattgtttcatttttcaggtattataaatgttattatatttttaattttaattttcacctgttattagtatatacaagtaaaatcgatttttgtatgtttatcttatatcctgcaaccctcctgaaatcacttaktagttcaggaattgttattattgtcgttttggtggattccttgggattttctacatagaaaattatgtcatgtatagatagtaggaatagttttatttcttccttttaaatctgtatgtcttttacttaattttcataccttactgcaccgattagaacttccagaaatatggtgcgtaagtgtggtgagagctgatatccttgctttgttgcctattttagggggaaagccttcagtcttttgccattaaatacaatgttagctttagatctctttttgatagatttttaaaaatcaagatatagaagttcttctctgtttctagattttggagagtttgtgtgataaatgggtgttgaattttgtcagataaatgccttttctgcatcaatttacataatcatatgatttttcttgtttagtttgttaatatggtagattacattgattttcaaatatcaaactagccttgcaaccctggaataaatcttacttggtcatggtatacaattcattttacatatggatgaattctatttgttaatattttattagaaatattttcatctctattaatgaagagtattaatttgcagttttcttataatatctttgtttttggtatcatggtagtaataaaattgattggaaagtactccctctttttttatcttctagaaaggttgggtagaacaggtgttacatatgtttaaatatttggcagtgttctccaagaaaaccatctggggatggagatttcttttccaggagtttttatattatgaattccacttccttaataattatagagctatttaaattatctgttgcatrttgagttagttgtgatagcttttgcttttgaaggaattggtttatttcatctaacttgtcaaacttacatgttaaagttgtttgtataatcccttattgtgctttgatgcctgtaggatatttccttgtttcattcctggtcttaaaaatttgtatcttctcttttatttttgttaatttttctagaattttaacattttatcttgatagtttcaaagagaagcttttttatttcattgaatttctcgattttcattttcaattttatttgtgttctttattattttcttctttctgcttactttgggtgtatttcatgctttctttctagatttttgagatagatgattagattactgatgtgagatattttctgtttctctgcctctttttttaaaaactcaagcccagtgagagctggaatgttttctcttttgcagattttcctgttrtctttcaataatcaattttctattttgatttgattgtgcrcagagaacacactctttgtgactaatttttttttacatatattgaggctattttatggcccaggatatggtctatcttaatatagtttaatgggcacttaaaaataatatgtatttacccttattgtcctttgctgcctgtaggatatttccttgtcccactcgtggtcttgagaatttgttgaaaaatttaaaacaaatttgaaaacttgaaaaacttaaaaataatgttgttaggtaaggtgttctataaaatgttgactagaatctgttggttgatggtattgttgaatttttctatatcctagctgattttctgtctagttgttcttataattgttgagagaaggatgttgaagtctacagctataactgtgaatttgtccactcttccgttcagctttgtcagtttttgcttcatctatatttatagctctgttgttaagtacatgcgcatttaggctagctatgtcttcttgaaggattgactcttaatattatgtaatgtctccctctctcctgagtaattttctgtctttgcagtcttctttactggatattaataaagctactttcttttgattaatgtttgcatggtttatctttttccacccttttacttttaatatacctgtatcatgatgtgtgaagtaagtttcttaaggatagcatgtagttgagttaggtctttaatctgttctgctaacctctgtcttttaattggtgtatttagaccatgtatattaagtaattattgatgtggtaaggattatgtctaatctatctacctatccatctaatttgttttctgtttgttccctctgtttttaatttatttttcatgactttttgtcagttacttgaatacactttagattcttttttgatgtgtctatagtatttttgagtatatatctttatatagctattttagtagtttatcgaggtatggcattatatacacataattatcataatttaataaagttgrcattttaccagtttgaggaaaatgtagaaccctttatgtaattttatctcactcatttattatataaatatattaaatatttgttttatgtatattgagaaacacrtaagactgttttaatttttgcttcaactatcaaacataatttagaaaactgaagaaagaagtgtatttttattcatatttttacttttttgttatttcttctctcttgatcttcagagattactacttttatttattttaatttatttattgtgacaaaagcactcaataagagaactacaatcttaacaaatttttaagtgaacaatatatcaaatgaaaactagaggcacaatgttggacaacatatctctataactaaattgttttgcatatcttaaactttatacctgttgaatggcaactttccatttctccctccccaatcccctagcacccaccattctaccctctgcttctctgtgtttgactatttcatatgcctcatataagtggtatgatgcagtatttgttcttctgtgactagcttatttcacttagcataatgttctcaagaattcattcatgttgtcacagtgcaagatttccttgtttttcaatacagaataatatttcattgtatgtatataccacatattttttatccattcacctggtgatgaacatttaggttgtttaaacatcttggatattgtaaataatgatgccgtgaggccgagcacagtggctcacacctgtaatcccagcactttgagaggctgaggcagggagacctctcgagcccagggtttaagaccatcctggggaacatggcaaaaccccgtttctacaaaaaatataaaaattaactgggtgtggtggcacacccctgtggtcccagctctagggaggctgaggtgggaggattgtttgagcccaagtggtcgaggctgcagtgagccatgattacatcactgcactccagcccgggggacagagcaagaccctgtctcaaaaaaaaaaaaaaaaaaaaagatgtgatgaatatgagagtgcakatatctcttccagctactttttattttcttcatgtataaacccaaatgcgggattgctggatcatatagtatttttatttttaatttttttgaggaaatgccatgctgytttccatagctgtgacatcattttacatttatatcaatagtgtacaagcattccttttccttcacatcctcctcaatatttgtgatctttttttgtttattgataatagctttcctaacagatgtaaggtaatatctcctggttttgatttcattttcctgatgactagtgatgttgcacattttttcatatactctgagtatctgtattttttctcttgagaaatgtctattygggtcctttgccattttttttattgggttatttgttttcttgctattgagctgcttgaattactgatctgttttagatattaactccttatcagatagatgtatgatttgcaaatgtttccttccattctataggttgtgtcttctctctcaattgttgcctttgatgtgtagaaaatttttagattaatataatccttcttttctatttttgcttttgttgctcatgcttttggagtcatacccaagaaattattgccaatccaatgtcatgaagtttttcccctatttttttctaagaattttacagtttcaggtcttatgtttaagtctttaatccattttcagatgatttttgtatatgttgtaaggtaaaggtccaaattaattcttttgtatatggatattcagttttcccagcatcatttgttgaaggaactaccttttccccattctgtattcttgacacccttgttgaagattagttgactttacacatgtagatttttaaaacatttttaatttcatttttaattgataaataacatgtggattcatttctgggctctctattctgttccattggtctgtatgtctgtctttatgttagtaccatactgtcttaattagtgtagctttgtaatcttttttgaaatccagaagtatgattcctttgtagcaggacgagccgcagacaaaacctctcagacactgagttatagaaggaagggctttattcagctgggagcatcggcaagctactgccttaaaatccgagctccccgagtgagcaattcctgtcccttttaagggctcacaactctaaggatttcacatgaaagggttgtgattgatttgagcaagcaaggggtacacgacaggggctgcatgcgctggcggtcagagagaaacagaacagggcagggagtttcacagtgttsttctatacaatgtctggaatctgtgaataacatcgatttttaagttatgagttgatttttaactactgggtttaggccaggcaggcccaggcctggtttcaggcstggctctgggctgcctgtctttggttttacttccttgttgttttttttaaaaacaggtactgagtataaaacaatataaaacaatatgagagggtctctctcttccctcctttcccccctttgaggctctcacttttttattagtaggagttctcacttttatttttgttactttttttttttgtaatagattgatagtgatttatatagtacacttgtgctgaagcattttggtgaactaagatagcgatgaagctttttatcatttgaagaagtacaggtagcaagcaaggaagcagtaagtaggttcttattactatcataacttttattataagagttttaagttctcctagtgctgggaactgatttttaaacatggcttcagggtccaattcgtgctacacttatgcgggcacatgtgtcagttttgtcatatttttaactatgtctttaactacttgcctttgattatctatgtgtagacagtaattagtaaggttaaatttcttatagacctctctttcagctgctagcaagtagtcgagagcccatctattttgatagatagcatttcttatctgagttttttgccaggccagaatagtcaaagcttgaccggttttattagtgatgatttctaaaacagcttgcaaccgtatgattcagttgagcatgtaaatgggggtccagtattcccatgagccatcttgtgtctaagtgccaggcctatagtattatataattttttttttggaggtcatttatcatctttccaattacctatggctatgcttcatttttcgcgggaagcatagacagggaagccaggagtttgcctgtttttatgggcagtaggaagaaagatggtttaatagtgccagtaacacaactacctgtccactggtcaggcagcttagtgtaggctctatgtctacatattcagtataacccggtgggggcagtccagtcccggtggaattctgggtgggccgagacagtctgcaaccttggaaatttactgaaaggatctctttctatgtaatttgaactccaccatataactgctttttttgtggtactgttatacagtttttgccccagacaactaagtcctcctacagaatgagtgaattctttcctttttctagctatgcaatattgttcaataattgagacttttagaacctagagatgatcagggtgatttttttgggctgggaattcatcaggaactggctctgtaggcactaattcttgggcttcttatggccattgatctcttattacagtttctccacaaacataacatgaagtgacatttagagactgggctacatgcgcggctaattgcaaaaacaaattcctggtttttcctagagtctctggtactggcacatttagttcatcatagaaagtctgaaatactggttccggagagagtttacaaacctcctcttttactaagatatttactgtaggacctagtcttttcctattgatgcccagagatatgtgttctccttttttctaccttgggtttaagggatttgtaattattaatttcaaggggttgtagcttccactcatacaggaggggctgccttctccctttyggaactaaacaggacctttttcaccttttttaaagtagtctagatgacacaagaccagtaattacacatgtttgcacatgagcttaattcatggcagatatacttatttgtatgttgattttgtactctgcaactttactgatacgttttgttggttctaacattggtgtatttgtgtgtgtgtgtgtttgcatgtgtgtagtctttataatttccttcatgtaagattatgtcatcttcagagacaatttaacttcttccttttaaatttggatgctatgtatttctttttcttgcctaattgctctaactaggacttatagtactatgttttacagaagtcaaaaactgtactaagagagaaaggaggacattatatagtgataaaagggttgattcattaggaagatacagcaactataaatatatgtacccaacatcagagcacctaagtatgtaaagcaaatattaacagaactgaaggaaaagctagatagcaatataatataacagtaggatattttactatcctactttcagtatgagtagaacatacagacaaaatatcaataaggaagcagcagacttgagcaatactttagacttaatgcaactaaaaaaacatggacagaacattccatcaaaaacaacagaatatacattcttctcaaatgcacacagaatattatccaggatagactacatgttaggttacaaaacaagtatcaacaaatttacggagattgaaatcttaccaagtattttttttttctgaccacagttgaatgaaactaaatattaaatattagtagcagaagaaaaactggaaaattcacaagtatgttgaaattaaacaatatactcttgcataaacarcaagttaaagaataaatctaaagcaattgaaaatattttgagactaatgaaattgaaaacaaagcacaccaagctcatggaatgcagcaaaaccagtactaagagggaagtttccatgactgttgacattcaaaaagaagaaagattttaagtaaataatctaactttgcatctcaaataagtagaaaaagaagaacaaattaagcccaaagttagtagaaggaaagaaatggtaaagattagagcaaaaataaatacaagagaacatagaaaaataatagaaaaaaatcattgaaactaagagatggtttttttgaaaagatacaaaattggcaagccactagcaaaagtaagagaaaaaaagactcaaataaaattataaatgacagagtagacatgacagctgatacaacagaaatagaaaggatcttaaaagactactgtgaacaattctacactaacaaattggataacccagaagaaatggctgaatgtctagaaacatacaacttagccaagaatgaatcatgaacaaataaaaaatctgatcattatatgtaactagtatagagattgaatcagtaatcaaaaacttcccaacaaagaaaagcccaagatcagatagcttctctggtgaattctactagatacttaaagaagaattaataccaatccttctcaagctcttctaaaaattgaagagaagggaacacttctgaacgcagtaacaaatgacctagggatgacaaactttggaaggcagctatgctaaccattataacaccaatgcaggatgccaaacttagtaagttttactttatgctagaaaaacttagaaaaaaagtactgataaagaagatggaagccaatcatggataaaacaattataacacaatctgtattttcatctgtaaaatgaataaacaacatatcccaatctacataataggattatttggtaactaaaagaagaatgaatgtaaaacacacacacacacatatattaatacaaacacatatacatagtatatacatgtatattttaaataatacattaatgacacattatatctcggtaattattaatgataacttaacatttctttggcctgtactagataatttacttattgtcatgtaatcattacaacaattctctaagtagctagttaaaatgctaactttaaaggtaaaagaattaacaaccactttgtagttgaattaatgatggcaccaaggcagcctgactctagagcttctgctctttacctctcttccttagtatccagttaattcattcatttgataaatatttattgagcttctgttatgcacctggcattgtaaaagtgctgaggatatattaatgaactaaagagacatgcttcttgttcttgggaagccaacagcctactggtaacatagacataaacagtagtcctctaaattaatacgtaattacgaatggagtagaaatgaaagaaatatacagggtgctaaaaaaragaaacaatttgaatttaaagggaaagaggtgatgtagaaaacctctctatgttagaggccaaaaggataaggtagatgttatccaggagaagtaggaggtgaagatgaaaaaacacaytcctaaaaagataacagtttaygcagacatcctcctggggaaaakagctcagtgcccgtgaattctggaaagaactgagtggcttcagttcagagattgagggggcatatagtgttagatgagactgggaggcaggtaggcaaggtaggggtcatgctgggccatacagctcatatgaacattttgggacattaaactgagtgcagtcgctataggattggaggggtgaagaatgaaagggggacctctgcaaaagccgtgtagcgggtttgtataatgaaaaagtaggattaatgacttctatggttgtccatttgagctaaaaaattcatgcgttttattctaatcttcaagcatccaagggtttttccttttttcacagtatattgatttaatctttgtagtgctagtaattcaaaggcaaagctcttattggatttgtaattcaatgagaaatacagccctcacataggtgtctgacttaatgactcctgctgaagttgaattgtgagatgttatccatctcctcyctgaaatatgaattctagtttagcagaattcgttgtccttagggagttggtaatatcacctttggtatgacttaaaaaaaagcccattaacgatatattttaagatgaaaagtaatagaatgmaggttattcatatatttattttcagcttgacagttgaaattacatgctaacattttactcttatcgtaaaagttataaaacattcctaaattaacttataatatgtataggcttgtttaaagtttaaataaaatattgaaatgtatttatattttaaaatacttatacattggatatagtttgtaaaacaaagttttttttaattgagaattctgtttaattttggctgctgtttaacaaataattatattttataagaaattacctttctcccttaaaggtggttgacaaaataaaatggttggcaaatataatctactttttgttccttgaatacttttacattgcattttccttcttatctctgataagaaactctaaaatcaataatttttaaatagtgtacctatgaaaaaaaggaacattttgaaagggagaaaatattccatactttatgttataaaatacaaagcaacttcattttgagtaacagcttaattagttcaataaagaatattgtgttttgctagcaaattaacgtaaaacatactttactccaccacctcttgaagccaggagtaaaataaaatatagaaatctactctaaattcacactaataattctggtgttttgaatttgacaaagtggaggttagaaagatcgctgctgtcggagaactctgaatttaaattctaactctgataccttctctatgccctggggcaaatttcacaacctttctgaaattccagtttcttatctgaaaaaaggaataatataattacctggtcagattgttttgatgatgacatgagataaagtatataaaattgtgattttcaatcctggctgcacattattatcacatgagaggcttaaaaatttctcaagtgaaggcccccacctttgaccaattaaatctgaatctctggaggatacactcatgaatcaaaatgttttgtaaaaagattcctggctaggcgtggtggctcacgcctgtaatcccagcactttgggaggtcaaggtgggtggatcacctgagatctggagttcgagaccaacctggccaatatggtgaaaccccgtctctactaaaaatgcaaaaattagctgggtgtggtggtgggcacctgtaatcccagctactcgggaggctgaggcaggagaatcgcttgaatctgggaggcagaggttgcagtgagctgatatcacaccactatactccatcctgggcaacagggaaagaccctgtctcagaaaaaaaaaaaagattgctgggcgattttagtatgtagtgtgaattgaaaactggtaatataaaagcatcagcacagtgcctcgcctatggtaggcatgtaataaacgttagtttcattctctttctcatataagttagttgtcttcaatttataaaaaacttagattccttctggaaagacagctataagctatataaaggtttactgaaagataggaaaaagtataatcattctctttggcaaagtataacaagtagaagctattttgtgggtaattataaatagtccctttctttatagttagatgttgaaatttaatttagcttatcctatatcaacagagatttaattaaaaatgtgtaattataatactgggaggcattgatgaatatggccatttattattcatttgaaaatgcttaagttttatgataagctttagaattctttgtcatttcataagtcaycatctttatatgcatttcatctaattgcattatgaaataaatccacatttatagattactaattatgacactaaacgtaatgtatgcttttcccaatttattgatttctatcartggtgttatctttctcccagwgtaacgggcacataatttttaggtcaactttgattcatcttctcttatttcttaaatacaaaaaagtacctaatttggcagtttcttcttattctgtatgtagttcaatatttttcaaacttgatgatatgaagacctgatctttcagtgagtgactgggagccattagacaagagaggtagatgatgaggctgaagggaagtctccaagttcactccctgcctccacttcaaacagcaactctactctcttagtcatatgttagagtttggtgtacaatttcacttttcaaaaggttcctctgctaaaaagaaagtttgacaaacactgatttagattataaactcttacaatatggagctaaattaaagaccacatcaaggaaaacaacaattgtcaactagtggcttcagactttcttttggggagggcagaatrgggggaaactggagaagaaaggaacaacagaaaggggatgacacagcatgttatcccctaggggaatggctggagtggcctataagaacaagagtttttaatggataatcttaagtttgcattctatcatgtatatttccttcctcaaaacttcgaacaccaagttttattttgtgtgagtcatggaaaagagctgacttgtacatatggatgctgctctgcrgaatgctgtgatactccgtaaactgaactgctttgatagaagctgcagcttagctccctgagcatgtaagcctatggtgatttacagaaaccttggggagcacatcaggctttatataagccatagaaagggaatttgaaggacttattttccagggtgaaaagggatacacaatattactgattattctgaggtcatatgagggagatgaagcttgttttgttcctgattatctgacttgatgtcttgtatttttgtttataaacctaattaaagtgattgggcacttttccacttttccatatgatacttggtgtcatgttattgttaactcgttgtcttgctttttgaaataataaaggaataaaatacattaccttatttttttttattcactgtaagtttgcacagtgctggaaaatttgatggcatacttctcgtggttctacatacagatgaaaattaaacaaaaaggcatattgacatttaaggattctctttaatgttctgtattcctaattgaattattttgagggagatagccaaaggaaggcctttcttctcaccttataagaaaaacaagcactattggaaacatggtcttgaaaaaaaatttttaaagtaatttttagttttaggaggaaatgaagaaaaagtatctgtgtgaagacagccttgggaattagccatctgtgcatcatgggaaaaaattccattatctactgaagaagagttttttgaagatgtgtgtagagctggaactcagggtggggacatacctcttactatccatttatgaacttaaaagaaaggatagccgtgtagattgagaatgaagtcttccaagtaaatcttttaaaaaattcttcccctcataccaaatctcaaaataaggctgataaatctgttaaacatgatgtgttgttggcctccttacatctccccatgatgagtgcatacagataatggaatctgtccatgtcttattaccctatttatcactgactttgggctagtaaactctcacaagttttgtattatacagcatcattgaaaagagaatgttcttacagctgttgaagacttctaatgatctcaactctgatattgttgtgattctttttgactatattttctggtttagaaccttaaatttgaaatggcattataattggattaattctccgttggagaatctgcaagaatgttactaacatgatctttgtggaatgaagggcatttacattaaagtggagatgaatattttgttcctcaaacaaataaactacttggtatttaagcaaatggccaaaataaagtcatattctgattaaaattagtgtttctgtacatgctgattcattcatatttatttwtttcctacatacagcatatgtcttaagtatattcaaggtaattcatttcagacaaattaaaagtagatattgaagtaccttatatgtgakgtttgcaaatcaaaattccatggaatttccaaatacacatttaagcattaataagtttagcttattaaagagagattgcttgatattccaagtttaataattaaaaataatttttatccttagattaagtaacattaaacactggagataaattattcatatgcataattgaccttaagtaaatcgatcttttataacctttctatactcagtggttttggtaagctcttttagataatttgatttagggaagtgattttcaataaatgtgcattgaaatcttctgatttgtaaaatttctgaatagtgtgaattatttattaaaattctaaataagaatgcctcattatttgttgttttataattctcaaactygaaaaacattatcaaaatgccagggtatgctgattgatagtgtrttacactcaaattggactaagagagtttgatcggcgcaggagctgcattctttgaatattgactatggaccaggcactgagctatgcattttatatacttttatttatttggtgttctcagagaacttctagactctagcatttactctgtgatgttggacaagctacttaccatgttcacatgcaaatcaggaaatcaactcttagtttagaagtttcatattaccacctttcttttgactttctttttgttttttgagacggagtctatctctgttgcccaggctggagtgcagtggcgcaatctcggctcactgcaagctccgcctcccgggttcacgccattttcctgcctcagcctcccgagaagctgggactacaggcgccygtcaccacgctgggctaattttttgtatttttagtagagacggggtttcaccgtgttagccaggatggtctcaatctcctgacctcatgatctgcccgcctcggcctcccaaagtgctgggattacagccgtgagccactgcacccggcctcttttgactttctgctcaaactgtccccttacttatagttgaagaagacaagaattgcattttccaagccatgattgtycctagtacctagtagtagtagtagatgagtgatgttcacaagctatattaatgtgtaaaataagtaagcatcatgactgcctgagagtaaactgggaatattggataaattttatgttgggcgtttactttgaaaaatatattttatgtcaggcccctgcttttcttgcctttcacattacctgagtgttgttaacaatggtcacagtggagggctgaattwggatgttgaatttagccataagacaatttatactttgaagattagatttaagctttatttttcattatttaatatgctgaagataagagsagccaaaatgggaaatatgagaaatttagcttaaatgtataaactctcacaaacccagttcttacagctatgatagaagtcctattgtggatttactgcatttcttggcagtaatgcttactgcaagctttattacaaattacctataaattgctatgtgttttcactttcatctttatgtagatttcaccttgggtcacatttgctcccacatgtaagaagagggtagtgcactggatgaggaaattttgatgtgatatgtttgtcagtaaatgcatcttatctgaatattttcatttctctatgcttattgggtattaaagatatttttctgaagaaggaattacagtaaggacaagcctgcattttcaggcaagctaggatttaaattgggagaatcaaagtcattccatcctaaccccatgatctggtaaagagaaactcatacttccatctgttctaatttatgtgaggtacctagatgatcatattacttccctctacgagacactggtgacagagagtcagccttttccttctgcactggcttgggcacacatggagaagtatattagttcattcaagaggacctcaaggaggttgctggctattcaggaaatatatttccttttcctaaggctggatttggttttaggaggatggctgtatgcaatgagaatggcagtttatttgttctgggaacaatgtatttttgggtttttgtgtgtatgtatgtcctaaatccaatttttccccagtgggatcttctttatttttctagttcatatatagcttttataagcaagtgataattaatggaacagacattttagttgttgttgaatcctttccakttctcttcccatcataagggccagcttcagatgctgttaggtcctaataacttcctggtgataaccatgtggcccacccatcccattaatttctgcttttattctgaagttattgaagaaacaagagtaattcttgtatatatttttgatgcttacctaataagatactaggctttgaagaaatgcaaataatgtctaaatgttcaatctatacagcttcaatattagcaaactgctatgaaagtaatgtttacacatttttttcacatttttgtaattttgagttcaatgttgamccaaaatttcctgggactagaaaaaaaagagcctgattatgagaaaagaagagcaaaacaacagaagacaaatacaattgtagtgtaaaatgtactattttgatttgaaagtttacacgtgtactgaagaccaggaaacaatctgaatattgcaatacaaaaatatcttgcttttctcatttatctcagtttattcttaaaggtgttcatcaattactgttagatctagcaggctatttgaagagctattagtgtattttgaccctggaagaaaagaatacattttgtgctttagtgaaatatttattttatgtggttgataaayacttatagaatatttactcagtaccagttactgttttagaaactttatacatcatttaattctcataaccattctgtgagataggtgttattattatcccaggcttttagatkagaaaatgggcacagaggttaaataacttgtaaaagttcaccaagttgtctggtccagaacttaaaacttcaggctattttgcctctcagtgctgcattcattctaatctacttaagttgtattcatttaaaagactacaaattgcaatttgaacagggtcaatttatgattttttaaacttagcaaggagaaagatttaaatgtagaaagaggtggatgtayagtcatgtgttgcttaacagtggggatgttttgagaaaagtgtcctttggcaattttgtcattgtgtgaacattatagaggggacttacacaaacctgcatggtatagcctactactgcacacctaggctatatggtacagcctattgggcctaggctataaatctgtacagcatgttactgtactagatactgtaggcaatggtaacataatgttaactgtttatatgtctagatataggcccagtaaaaatgttattataatctatggaaccagagttgtatatgtggtccattgttgactaaaacactgttatgccatgcatgactgtatataaattatagtacatgatgtttccagaaatttctggatgttttttctttaatattttgggaaatgacctagattgcctaagctgacccagattgcctaagagatgcctatgcaagcatctctcttaaatcccaccaatcctgtacttacctttatacagaatgaacgttatttgcccataattgagagtcccaaatgattactaactggctttcttttttgaacaatttcatttattctctgagatgggtttatgtgagtgctataatatgtgtggctataatatgcatgaacagtgttgtgtatatatttttgtaaaaatgttcgtctagattcctgaagcaaggagaatatgagtatgctcatatttgaatctctttgctactctcctagaggcagaggtatatagatagacacttaaaatattctcagttagtttggaaaattagcacttagacaatttctatgtatctataggttatcaaactatggatatgttcttaaaaatgttgcaattcacagagagctaggcacttaatgcagagaagaataatgaaaggtttgcttttcctaagtcttgttcttcacttaatgcttttgagccaagtcatttcaacattattttaatgcaaatttcaagaaagtatctgatgagtgtgtgtgtgtggaggggtgctggggtagaggtgttggttggaaggtgcagtacatggatccatagaagatgattcagtacaatacccagtaattcacacttggaacacctgacaacaattgaaatatattaggccaaggaagaaattttttctcctagcaaaccttctctgaagtggcatttttcctaaccttcaaggtagaataaatcctcaatatggtaataaccaagaactgcaaataaatattagagatatttgctgactaaacatctagctttttgcacatgtggtaactttgttcctattattattagcttaggataatagtgaaaaatatttcaaatatatatttataatagataccgtatgaaaaaataatatcaggccgggcgcagtggctcatgcctgtaatcccagcactttgggaggccaaggcaggtggatcacgaggtcaggagttctagaacagcctggccaatatggtgaaaccccgtctctactaaaaatacaaaaattagccaggcatggtggtgtgcacgtgtagtcccagttactcaggaggctgaggcagaagagtcacttgaacccaggaggcgaaggttgcagtgagtcgagattgcgccactgcacttcagcctgggtgacaaactgagactccatcaaaaaaaaaaaaaactaaaaaaatttaaaaaataataatgtcagcttagttcctttattaccaaggtttccacacctactaccccatcaaacaactcttttgggttaactgattcaggaatagggaaaaagtctgccagtgccatttttctgacagcatgtactcatttcatgtttctgtgttacgctttggcaattatcagaatattttaacctttattagtattatatatgttaaggtgttctgtgaccagtgatctctgatgttattattgtaattattttggggcaccatggaacatgcccatgggggacagtaaacttaattgataaatgttgtgtgtgttctgactgctccagagaacagccattcctccagctttctccttctccttgggcctccttattccctgtgaaacaacaatattgaaattaggccaagtaataaccctacagtgccctctaagtgttcaatgaaaggaagagccgcacgtctctttaaatcaaaagctagaaatgcttaagcttagttaggaaggcatgttgaaagcttacgcaggccaaaaactaggcctcttataccaaaaagctagctaatttgtgaatgcaaaggaaaagttcttgaaagaaattaaaagtgctattccagtgaacatgcaaatgattaaaaaacaaaacagctttattgctgatgtaaggttttagtggtctggatagaagatcaaaccagccacaaagcctaatccagagaaagaacctaaccctcttcaattttgtgaagactgagagagataaggaagctgcccaagaaaagtctgaagccagcagtgtttgtttcatgtaaggaaataagtcagctctataacataaaagtgtagggtaaaccagcaagtactgatgtaaaagctgtagtaagttatttagaagatgtagataagatcattgatgaaggtggctacactaaactacagattttcaatgtagataaaacagtcttctgttggaagaagatgtcatctaggactttcataactagagaggagaagtcaatgcctatcaaagctccaaaggacaggctaactcttttgttagatgctaatgtagctggtgactttaacttgaaaccaatgctcattaactcttctgaaaattctggggcccttgaattatgctaaacccacactgtcctctataaatgaaacaacaaagcctagatggcagcatgtctgtttactgcatgttgtactaaatattttaaacccagcgttgaaacctgctcagaacaaaagattcctttcaaaatattgctcattgacaatgcacctggtcacccaagagctctgatggagatgcacaaagaaataaatggagttttcatgctttctaacacaacatccattctatagcccatgggtcaaggaataattccaagtttcaagtcttattttttaagaaatacattttgtaaggcgatactcgctgtagatggtgattcctctgatagatctgggcaaagtaaattgaaaatcttttggaaataattcaccatttttgatgccactaagaacatttgtgattcatggaaggaggtcaaaatatcaacattatcaggagtttggaagaagttgattccaaccctcatgagttactttgagggtttcaagacttcagtggaggaagataccacaaattaaagcaggggaggaatagcaagataactgagttagaaatggagcctgaagatgggaccaaattgctgcattttcatgacgtagttatcgtggattagaagtggcttctatggatgagaaagtggtttcttgagatgaactctattcccagtgaagatgctgtgaacatggttaaatgacaacaaaggatttagaatattccataaacttagttgaaaaaacagtggcagggtttgagaggattgactacaattttgaaagaagtgctactgtgagtgaaacactgtcaaacagcctcacatactacagataattttttttttttttttttttttaagacagagccttgctcagtcacccaggctggagtgtagtgagtggcgtgatttcggctcactacaacctccaccttctgggttcaaacaattcttctgtcccagcctctcgagtagctgggattacagtcgcccgccaccacgcttggcttagatggtgttttgccatgttggcaaggctggttttgaactcctgacctcaggtgatccacctgccttggcctttgactcaaagtgctgggattacaggcatgagccaccgcgcctggcccagataaatcttttgtgaaaggaagagtcaatcgatgcagcaaactccattgttgtttcattttcaaaaattgccacagccacccctaaccttcagcaaccaccatcctggtcagtcagcaaccattaacatcaaggcaagaaccgccaccatcaaaaagatttcaactcactaaaggctcagatgatttttagcattttgtagagagagatacatatacatttgagacagagtcttgctctgtctccaggctggagtgcagtggcacgatctcagcttactacaacctctgcctcccgggttcaagcgattcccctgcctcagcctcccaagtaactgggattacaggcacatgccaccacgcctggctaattttttgtatcttactagaggcggggtttcaccgtgttggccaagatggtcttgatctcctgaccttgtgatccactcgcctcggcctcccaaagtgctgggattacaggtgtgagccactgcgcccagcctttagcaatatttttaaaataaggtatgtacattttttttagcataatgctccgcacacttaataggctacagtaatatagagtgaatgtaatttttacatgcactgggaaaccaaaaaaatccatgtgacttgctttattgtgatatttgctttattgtgatggtctgatacgaaacctgcagtatctctgaggaatgcctgtattttttaacccagcaggttcactcattgtaataggaaaaaacaaaagttgatatatacacacatgtatttttcatgtgagtatgtactaatacacattaaaaaaaatttttttttggaaggaaacccagggagacagaactgtggaggagaagagaatataccttttactaaccttgactatgttctactttctaaaaaagtcaataagcagttatctgagaaagggattatggatatagtttttgttctccaataatatctcttttttttcctctcacctgcccccgactacgtcctaatatatgttattttttcttggtatagaaaacactttttttcattttcataaagaaaattttgttgaagaagattaatcttccatttccagaaaatgagtttgtttttataaatcaagcatatggaaaaattgcatcaagctattgctgtaggtaatgcactgaattaccagcctcttatcattttggtatattttataccagaaaattcacaactatgcagctgtttattaaactgtaaattggcttggggcctaggttttatgtgcctctaaaatctataaataagaaaaaaaaacaccctggatatattttagaatatataaaatgctttccagttaatttggtgttttatataaattttatctatatttatagtcgtgaccttatatatcccataaaaacagggaagaaaatcaagactaaggcagctgcatttatatttttggtgaatgttccatagaaagaaaatagctgcttttgccctgagtcttagacgccaagttgatatcagtaatttagggccattatcaaacaaaaatggccctcactatggctastctgttgaacccagcatgtcttctcagttctacattttcagaggctgaactctattccaagggggtaattttgacttggtcattgtcacataatgygggtattaccgtacatgaccacacttcccrgggataatggcacagctgggctgccaattgggcttaggagaatgacgtcgggtttattttgctcccagcaatcctaggaggacaaaacttgctttggttggaaagatagaatagtaatagatattttgttgttatatagcacttgcttgtaaaaaaaaaaatcttagagtgcctttgcaagcattaattggcattcctcttaggttgataagtgttgttacatggtgtacatttaaagatttttttatggtaatatatagagctggataattagactatggttaaatgacagagctaactacaaaaacaagtagtttagattcctttttctggctctgatcaccaaatattatctttgagacggcaagggagcatgcctctacattgaggtgatgtcctattttaagctccttcaaagcagaaactgtttttcttaatttcttagctcttgattctcttctcaagcatgggatcattttaatagcatttctatgtacattcctcattctctttatgtctttcttggcatatgatcaacacctcacccattaaataggcctaaagatgcaatgtaatgtagcaatgctgtcttgtaagaaagcactgttcatgcaggctactgtggtggccgtttgaaggccctctctcaccaggaaaaggaataacaaaagaactggtatttcccccttcacgtggcacataaaaccaaataggacttgacctgtccttagaatattagtatttatagtaccaaaaaggactttgttttaccattttcactaatatcacagtctttgttattgggccatattgaagtttaaaaataaacgtgtttgcttttcatacattttagctgtcttttaaattatacttgtttttcttccaacttatagggcatctctctttgtacatgtaattagtagatctgggttcagaagtctttttatttttaaaaaaattattttaaatttcagtcatgtatatatatctgggatgtatgcaaataatttataaaccagttatatgtaattattaatataaatcgaatgcttcttctgtgttagagctggactattaatgcagcccattttgctattctaatacaaaataatcataaatagtggcaatttgtttaaactctcagatggatttaaatctttaaatatgttattaaccataacactcaaaaagagaattttataaaattgacctacaaataaaaccatcttataaagaagtgatgacttaccaattttaagatattttctttttatggctatttcaatagcaatttgaatgaataaatgtagatatgtgttgtctgtatatattaggctagaaataagggatgttttcaaaggtaagaaataaaacatcccatcaatcctactgcatttctttagtaagagattttcctaatatattttcacttggagacttctaaaaaattgcttgaagaattaaagcactctatagacagatcaaagttgcaagtgtctaatgtaggcttagaaattccataatgttcattaggaaacattaatacttctcagagatttccctttgagttaatggaagctttctattgggacaaaagtttaagcattacatttttttctgaacttttaaattctgtaccataatgatacgctgttttataaacacactgattataaaattatttatagccttatttcaatattcactaaactatggatttatatttggcttttaaatctattacattttttaggttgggcgcagtggctcacacctgtaattccagcactttgggaggctgaggcgggcaaatcacctgaggccaggagttcgagaccagccaggttaacagggtgaaaccctgtctctactaaaaatacaaaaattagctgggtgtggtggtggtcacctgtaatcccagctactcaggagsctgaggcaggagaattgcttgaatccgggaaggggagaggttgcagtaactccatcttaaaactccatcttaaaaaataaaaataggccgggtatggtggctcgtgcctgtgrtcccagcactttgggaggctgaggcgagcggatcatgaggtcaggaaagcgagaccatcctggctaacacagtgaaaccctgtctgtactacaaatacaaaaaaaaaaaaaaaaaaaattagccgggcgtggtggcatgtgcctgtagtcctagctattcgggaggctgaagcaggagaagcacttgaacctgggaggcggaggttgcagtgagctgagatcacaccactgcactccagtctgggcgacagagcgagactccatcacaataaataaataaaatcaattaaatgttttaatctgaatttgaaatattgtgaaaaagtataatgtcaaatttaaaaatcacatatgtatcttttattttcacactgtagcttttttattgtacctgaaaatctttaagagtatgattttattttgtatttatattaaacagatttacatctgctaaatatataagagctttctaagatccgtgctcatttctgttttccaagaaaaataattttaaagtgccctgtccactgtccctacccctatagatggatgacttaggaaatttaatttctgtaaaatctctaggatatcccwcagaggaaaatgcatggatgctggtggacactaagatatacatacaaaacaatamcaataaggcaactattttttttcaaaaaacccagaaagttgggttgggtgctcatttatgggcaaatcatctgagaagctggcagctgccatttgaaccctctggttgaaaggaataatttttagaagaggagtgctgtacgacaagacaatgtctactttaaatagctttattttaatgagcaygtatgtgagttgtgtcagggacagtgctgggcactkattagccattgtttcagaagagagaaaataaacaaatgctaaaactgattaagaaatatttgatagagcagtatagataagttagatgctcaggcagcagtttcaattctgtttcagaggacagggatctacttatttagtttgctacagattatgatctactgaacagtatgatttataaatgagaaatgttatttttgttaaatcctgggaaagtttatttctgatatccacttatgttgttctttgatgactacctgaaggggtccactgctggcttctttgtttatgggacatgtgtactgtgtttcctaattctgaatcttcattaattcaagacttctcatggattttaacagttttacttccattccagatttcacacacacacactcacacccatacatatataaatctaatgtttcttcttggaggtgcatctgaaagggaaaaaataaacaatcatgaattttgaagtctcttcctgttataatatacaatatttattttgtaagcaaatgtccatgcctggaggatggcatatcccaagaaaggacacaattttgtgcataagcttgaaccttaggaccttgtattctgggattatattttattatatatttaaataaatatataaaataaattacatactaaattctattatctacaatctagtgatgcatgtcatgataactcatacaagccctcctttttaatagacatataatcactacattggcagggctagggtggaagatggaataatactgtttaaactctttttttaaaaggatttaattaaacatatttattcctctgcaggtggctttaccaagcctacacaatttcaggaccgctgttagttcatgctattcagtggctatgacaaaggaacattatgtggagagaaaagatgtatgtgtgtcttcaaaattggttgtgagaatgagacaattttgaggtggctagggtcaaatgggttttgtgctatgatttgttacaaaactaaaactttttctgacttgcatatataggagcagaatttctcaaccttatcttgtgcctctgatatgaaattgagtaactataggaaaacactttgttagatgacaaatcatgcttccaagtgtaaaggttaatagttaagattactaaaattaacaaaattaaaacatgataggctcaatctatttgcggaactgtgtaagagcaatccaagatgtttgatattttttttaatacagaaaatgcaacaaaatcattttcttatgacaaaaacaatatataaacaatatataaacttttattacaatagctaacatacttttccatctatctgtagacttgtggtaaccctcagagcgatcatctctgccaaatgccattcatgcaacacttactgttactgctgtaggcctgttgacctgggcatctgtctttctgaatgtttcgggtctgtcctcctgcctctcctcatccaacccttgatcttcagccacagctacccagaggagcaagtacgaaatggtgggaagactgtttctactctgatgttggagtttaggttggagtcacttcttgcctggtcctttttatatgccccctactctctcaactaaaaatgaactaatactcatcatcttctcttctttcttctctgaatgagagatgttgtccctgtaattttggtatttacatccaaatacttaaggcaatttggcttttactcttccttccccctgctaggatgatttctttctatattctcaccctggcaagatttcttgtgctgggttcatagattcaagtttcttttttgaggaagttcagtatagttggaggaagcttatgttaccttcaaattgaaagacttttctagagtatttttccttgattttgtttaatgtaggaatactagttgaaaatatggccagaagctggtgggagatagaaaatgcaaacttctctctctgtgtctctctctctctccttctctctttctctttttctagtgttcttgtaattagaatattgcaatcattcttttattttctcttgtgtgcactatcgtttacctgcttctcctttggaaatttactttctaaggagaaattaactttctaaaaattctaattacatagaaatttaattaaaaatatagtgtaactattgtttatttcctgaaagcggaataaataaaggtagcagcaacactctctgctttttaggatttatagctttggaagcacacacataaatctttataccatatgagagaatataattatataatagtggtataaggaaaatagaaattaccctaaaaatagaaaatataagggataatggaatatgtaatgactggtaaaaaaaccaaccaaacaaaaaaacccagatgaacagataaccaaacaaaaaataccctctcaaatcagaacagcagtgttgtttagcagaaaagttaaaagcttcaaaggaatatgattgaaggctaaataaaaaataaaggaaaagttaaaatgaccttgttctccaaatcttgtttatgaatactagaatattctataaccattatgtgaactttaaaagaggcattcatgattcaagaagaaagataaactgctttgcttcttaagtggttcttgaaacttgttatgcaaatacatagtaaagtagaaacatataattgggtcaaaagaaatttgaatgagttaatttttttattatttataaggaaaactgagatatttgtgagattgagactagtgtgagatttaaatcaatgcttttggtgttggtatgtggagggcatatatgatcatcttacccttccaaaacatgtacatccattggtttttttgtttttgtttttttgacacatgatctcactctgtcatccaggctggagtgcagtggtgcaatcatagttcactgcaaccttgaattcctgggctcaagtaatcctcctgcctcagcctcctgagtagctgggactacaggcatgtaccaccrtacccctttaattattttattttattttaattttttagtagagatgaggtctcactgttttgcccaggctggccttgaaacaatcctttcaaccttggtctcccaaagtactgggattgcaggcatgagccattgtgacttacctgtatgtccattgttgttactgcatatatctggtcaggtctgttgtgacacaaaagatttactctcattgtgaagcggggattatgctcagctgaaagactatatttttgttatgtcagagatacaaggaaacacatgaarttagtaccaccattcttttattccctgccatctgtgtcaacctaacaaaatacaagctccaggagtcacccatattcatkaatgaacttatcattatactatttcattctctgtatctctagatatttcctccctttgtttttcatctcccaacccttcccataattctccagaaccatatcaacttgaaaacaaaccagaacaccttaaggaacattacccctctatcttttttctattaattaaaagatagctctatcctgccaccatatggaatggtgtctgcctatgttcccaccttctaggaatcatgggtctcagcggtggtagtgggcaatcactcaccttgccttttacttctgtgtctacagagtgactcctctctgtcatataaaaatccctccttctttggaactcataacttctggatatcccatatcctgaactaaccactcctcagcagttattagaggttagaagactgtaggatgatgactcagccttagtttaaagttgcttttaatttgtcctatcactaaactagcaaacaaagagtgcaagctaggatccaagctagataaaactgaatggatgcagatatctaggatacaagcttaataaaactgaatggatgcagatttccagtctccttgctctcttgatgggtgctcaaagttcagggtcaatgtaacaagcaggaattgaggaatccaccagctccagtttcccagaacttggcttttaatgagagggtttgtgagagtggccccataaaatctctagcatccatcgtattattttatkaggaaattcattcatgatatgctgcagtaatatacattcctttttttgtgttcttcacccatcatggtgccaacctgtagcagagctcatcatgggatactccatttatcagtctcgttatcacttctctacatttttcaatgattatggaattaactaatagattgttccattcaagtttagctgtcaggtgaatgacttctgtgtctacctgaatcaccccatccaccatctagtctcagaattctttaatttacttacttcaagtaatctttgctccatttttccctgacaaccttctcacattgagcagttggtgtgttattctagaaagagtatatgctttggaattacacaggctagagtttatatcccagttcggctactgactaactgtgtaacattgggcaaatcatgtaacttgactcatacttagtcttttcatctataaaaataatgaatcaagctgagtgtagtggctcacacctgtaatctcagcaactcagaaggttgaggcaagagtatcacttgagtccagtagtttgagaccggtctgggcaatatagcaagaccttgtctctctaaataaagaaaatcattatcaaatgagatggcatatgtaaaatgccaagcacaatgcctacagatgctcaaaaatgcaagtttcagctctccttcatatggttacatgttaggtcttttccatgtattagaattttcagtctctgaaatcttaaactccaagacgtaccttcttattctttgagttgatctgctgcatttactcttcaaattaattagagttttaatctcctgattctttcatttttttcccttaagcctgttaatcccttcttctaactacattttttctctatgtggcataattctcagcaatggatgctccctaggcatgcagctccctccattcctttgctcctttgtatttcttcaccacgactttgtaaagcttcagctttaaatcagtccaaccatttaccttctgtgtttctctactattgttgctatatatatatctaccattgtgtgtgtgtgtgtgtgtgtgtgtatatatatatatatatgtatgtatgtatgtatgtatcyaccattgtgtgtgtgtgtgtgtataaatatatatatatatatatcaggcaatatgctctagctaaggctatagaacactatgcatttaggtatcaagcatatatatatcctttccttgctttttaattttttctcttttattgacatacaatgttttacctatttacggagtacatatgagtttttgctacattcataaaatgtgtcatgatcaagttagggtatttgaggtctccatcacctgagtgtttatcatttttatgtgttggtatcatttcaagtcctctcttctagttactttaaaatatacataatattgttgttaagtatagtcactgtagtctgctatcaaatattagaacatattttttctatctaactgtatgtgtgtgcccacaaccaacctctcttcataccccctcacccccactcacccgtcccagtctctggtatctatggtccttttttctatgtccctgagatcaagttttttagctctcacatatgagtgggaacgtgtggcatttgtctttctgtgcctggcttatttcacttaacataatgacctcaagttccatacatgttactgtgaatgacatgattttcttttatggctgaataatattccatygtgtatatatacgacattttttttatccattcgtctgttgatggacacttaggttggttccttgcctaatatattttatgtgtccttgataaccttcttttccatttctctcaaaccttcactaaccacctcaattcgtaacccatatccctctcatttactttgagttgataatcttgactaaaatattactagaaaggatcgtcaattcttgtacatctcctcgatttcttgtacatctacatatactttttaatccatgattaactttctctttcatctccctggaaacacgatctcttaatttacaccaggttttatagttgtccagcaaagaccactttccattttctttcttgatacctaagtgcatataacctaccgactcttagatttctacttaatctcatagatgcctccatatgcctaaaattcagcagttgatctccattttgtcgcatcaatcctaaccttattctcatattatcatctcacttaatgctttgcaatgtatttagcacccaagctagaaacataagagtcatattagatttctgtcttttcttcaaatgctgtatcctattggcctatcagacctattgtcttaattttgctctatccttgtctgtctattcacactgatgctatcttagatcacattttcatcacatcttatgcagaatactgcaaataccatcctattttctacctctagtctcagtttcttccaatcattggccttcacagtttccattctttctgtaatggaaatatgagtatgatactccttacttaaaatgctttctgaattcccattctaagttaaactctttctcatagtattaggcccactgtgatctaggcttccttctcttcagctgcattttctttcacttattctcatttaacctgggtcccagccacacataatttcagtgagtttaatgctgttgcatgtctacaagccacatgtttttttcctctgctcaggactttctggggttatttttaaataatttttgagcacctcttatatgcccagctctgtgataaatcctcttctaggtgctgataacacacaaaaaatgacaaagattgatctctgacactgggaggcatggagacacatactgaagaatgagtaattttatatagcatcactgcagtgggaaccaagcctcctttgttcaccaatggtctaccaacacccggcataatgactgccacatagtacctgataaaagcataatgtgttttaataataataataacacaatagctattacttatatagttgtttatttgtgccagatattgtttaaatggtttcacatatattaccttgcttgataaccaaaacaatcctatggagtatatgctattattgtctccattttacaagtgaaatagaggcatatagaggataagctgcttgaataaattgtatcatataaacacatcctcagaatacaatggaaacaccaaagaaaggtacctracccaaccctcttggctcagaaaaggcttcctagagcattctaggcaaaggaaagagcataacgaggagacatgggagagcatagtgtattctgagttctgagttggtaagcgtaaagtaggaagggaagaagagtgaaaaataatgcccagaggtattgcaagtataagcaggataaggtaaaaaatggagccaagtttctttaattttttgaatcaattactctagactctgcatgccctatatttatctttgtgccatccttgattcatttcctcaccttcttgaatgacttaccttcttgatgcctgtccaaaatgccagaagttaatgcaattcaagcagaggaagaaagggtatccaatgtctgtattactgtcagtgcttccatttgtatgtagtgctgtgttggatatcgtctaccaggtcctcatcttctgctgtgggacaggttccaggccaggacccattgatgctccaagctcagatcacaggattataaaccattctagttcccatttccatgctcaacataactatgctaaaatgtattaatttagaaaggcttccaacataagctacacaatgtattgaaaagatctcttcaacaaatcgttaggcccttgtattgagtatatttcttcagatttacactcttatctgtcacaggtccatttcagaaggtttatctaattttaaattttgggaattatgatctggagtcttagtaatttctcagagtgacttctaatgtgagtctatccaatatctccccattgaccagctttgcctaaatggtgttagggtcagcaaccttttgagatagcaaaagttatgggttactctttcctcacctccctcatagagggtggcttctccctgcctgccctataagtggatctagatcacaaagagcctcatcatacaaaccaaggagactggatttcatctagttgatgggaaagagacactgagggcttaaggcaccgtgatgttctggtcaggttttagaaagatggcactcttagtagtggaaggaggttcatagaggagcaacactgaggcaggaaccctcctgaggtttctttaaaggagggtttctttaaaggaatggtgatgggtgcttgaacaagcatgatgttggaaggggggtagatttcaaagacagtgtccttcatgtgcttttaatttctgttctttgcaagacattctctttttcattttatatatcagaaaatatctaagtatgcttctatatggatcctagataactctcttctagtcaagatttatttttcagaataagtgagaaataccaggcaagaatcattctttacagatggttccttaactgtcacaatcatggtggccacatatttcagtagcacagtgattgactacagattgtgatcagtggatgtttgctaaatgtttgaatggagtgaggtctcaaccaaggttttctacttcttaaaatactgaaagacttcacttagcactttcgtttctattgtgttttcatacagggcataaggaagtaaagaaacgtaaatggtgaaatttactatctagtaaataacaagtgctcgtttgattgtaaaatcctagtattcaacatttttctcatctctataatagtaatgattcatgtgtcattattgtatgcatttcaaagcttcttatgtagacgtggggaaatcctatttgactctgcatctgagttttaattgcacattatacttgatttaattcataactgtttgtggttaataagctatagtgtcagaattgttgttaacttaaaagcaagtggctagagaaaattaacagctaaattataaagtcatttcaggatttgagatacttttaaacttagaggaataagtaaatttagcaagcaaagtggtaacatttgaaatgaaatggttaatgttccaaggcaattgggatgacaaacacatcttgttagtttcttatttaatgaacatggttccactgaaaaaatctgaaaattttttattatgaaatactgtcacaggcatagtacagaggcaagtgctatgtagagattaatacaaaatgtcacagtcccttccctcacaggggtggcagtccgaagaagatagagtgctttttatcaaagggtttcaaatgagtgagcagtctaattttcacagttcttttttcctcccttatatttgcagtcttttataattcatgtggtcagaagaatttttaaattaatgtacatttttaatttacactttttcatgattagcctagtttcaacttgtattaattttctatgtttagaaggaaaaggaaaaaaatcttactagatgtagttattccaccattaaatgaggaattgtatttttttcttttactttttaaaaagtcttaaatacttgaggcattaagatttttgtttccctcaaataggtatttataaaaaatattttatgctcaggacacctatttattttcatgtggacaccttctggggcaagcattacttggagaattattgatttctacctcacttaatgcccaaacctttgccaaagtaatactgaggaagaaattggaaaaattaaacttgattgttttaaaatcttgtcaaaggggtaaagctgttaaaggaacaaaaggaaaatatttctacccaagtagctctgtatagtgcagcctgcaaagtgcttgtgatcgagaatattgcaggtgggctactagttttgttaacctggggaagaatatttcatggttattctttaaaaaaaaaaggatcagattattttggaattattgtttcccagttgagagatgtagaaattaaataaattacttttaaaagtagaaatagaattgggctttctatgaaggactgattttagaaaaaccatacatccttttggaataatcttttttagataagattaacatttaaaattataaactgagtctgctttactcagtctataactttaaatgttaatcttatctaaaatgtcttcacagaaacacccagaataatatttgactgagtatctgggcaccctatggccagtcaagttgacacataaaattaaccatcacaaggttaaatgtgaattttataaaacttgaacattaattagatataggagatgatgaagaggaggagtcaagaatgactccagagttttgaccttgagctattggttagtgtcatttgctaagttgaggacatgtgaggaaaaacatgggtagtaaagatgtggggtaattaatgtgaacgattaaacccaagctctttttgatacacatgcatgtacatgtgcacgcacatgcacacacacacacagacacacacacagaattataaagtctctgatcacaatctcaagttctttcctaccaagtttgaataataactctaagtcagagtgtagaagaaatgtttattacttgttacagatataatgtaaaaaatgagtgagggtgagattaggtcctaaggagagactgaaaaggagcttgactgtacctggtacagatgtacctagacaggaatctcggtacttcccacacaatgttatttttgttatattctcaatgttatgactcagatgttggggagtgatatgaagtctgattgttttgctggcattgcagaagatcaaaccacatctctgattatagggtcatcttttcctggaaagaatggatattccactctcaatcatcttaatgcgaggtcagtgctagagaaggaaagaagacttgggacatgtagcttaaatcctggaatgatgatgttcattttatgtaagtgaaggtgattagtagggcttgagaatggtctttctcctatgaagcacaaactttggaactccttttattatttatgtactgaattattattgttttcattagctttaaaaatgaagtgtataataagtcaataattctccagactatgtcagtatctctccacttataaaaaattagggaaagagtaaccaaatagaactagataggatagaatctacagtggggttgtatcataaatgtttatttacatgggttaaaatctaaatacaaatgtacaaaatacatcaaaataaagcgggaaaataattatttcttcatgaggaaataaagaaatacatagaaatgagtgtttagtgtttactcacttgagttgtcaggcagaaaatatatgctgtagctgtattaaaaggtttgatggaattcagtgaagaattctgttagagagggttctgctccctaacagaagaaaaaaacaaaaacaaaatctgaaaactcccaaacagtgcatagtttggttcctcatttacttggttgtcattatgtggcttcccagaacacctgtctagttaaaccatccagcaaggctcagagtgtctcattgttacattaggttacatttggtacaacggttacatttttggacaaagatgaattcaccccaatgtatatggatctttttaggaggtttctcaaccaccacctatctctyaaccacactttgaaagtagagtttagtcagcatatatttgccttgtggctgagatatattgaagaaagtgctggcatgaagattttctttgagatggaatctgagtaacaattataattttgtattctttttctttttcttgagacagagtcttgctctgtcgctctgttgcccaggctggagtgcaatggcacaatcttggctcgctgcaagccaagtgcaatggcacaatcttggctcygcctcccgggatcaagcgattctcccgcctcagtctcccgagtagctgggattacaggcacgcgccgccacgcccagctgacttttgtatttttagtagagacagggtttcaccatgttggccaggctggtcttgaactccttacctcatgatccacccaccttggcctcccaaagtgctgggattacaggcgtgagccaccacgcctggcctaattttgtattcttataaataattttatctgtcttgtttgtctatcattctgaagctatgtcagagattccttactattttaagctgtcctgaaacctctcatgaaagatacataataaaattagtatttcttctcttttccacaatgtcttttatgctgaaagacacttttgtttttctttgctgtgaaaggcatttcatgatatgattgatccacaggaaaacattgcactgtattcagaggttagattccagaattaacagaacgtgaaaaaccaagcataaagtactcttaaaaagggcatattggggatcaatatactatgtctcagtaagttcaatagccagttttttctagttgagcatcagaaatacttgactttttttcaagggttgtgatatatgacaagacatacctttaaatatcataatcaccctcaacagggctacttgtgcttatgagggcatggtggattaacacttcccatttcacactctgtccaggccatacaaattggcagaccaatctttggcattattgctttcttctcaacttacataattgaagttgtgtaagttatatgcgtttacggtacaaccccactgtagattctattctcttcagttctatttggttaatctttccctaattttttataagtggagatactgacatagtctggagaaaagttttatagtcaagcaataaatgtttaatattcatagatgtaagtttgaggaatggtataaatttattctaggatacacttttaggctttaggggcactaaaatatttggaaagaacatcaattgctaatgattcatttttttataaaatgaattttttaaaaaatgagatttgggggaataacgtattttcccgggcgcattcttactacattataataagtatattttagacaaatgacagtcacactcaggtcactgaaatcagtattttaattttattcatcatcactgggaaaatgccaagttcctgagctttgctaatgtcataggactttcaactgtggttgttttggtttccttacatattctatagtgactattgaaaaaacgtattaaatatttacaacataaaattagtaatatttatttctattctagtttgtgaaacaaacaggtaaaagcaagaatcaatattttcttctgtagctcataacttaacttgattccttcgaggcactgcagttccagcagagctctggtcattgattacagactcacctggcttaacttgaaaaatgatttttcccaagcctcctgtctgagaggcctaattcagtccttgyagatataaaattattactgcccctttagccatgaatgccaacattattggtgataatctttggttagtatgttagtatatgtcagaataacaatactgtgaaaacatgttggcaaattagttcatgtcactttgtgacattatgtgaagaaaaaaacattttgcatttaatgtttcatgattaatttaagtaagttttgaataggctataaatgaattatcttgatttaggaatgacgaatttattatagcttaatatacctgtaaaaatatgtaataaattctgttattttggcagcctttactgtaaaatttcgaacactaaatggattatttctctgtagactgcagatcttccttttgacatagctagtcaattcaccgtgaatcagttctggtaataggttatgcacccatgacaagtgactagaaattggttattctccatgtgacaaatgtaatctagaaattgattttttgtaatatttttccatatagatttgtttatgattgggagtaaagagtgtttacatagaaccttccacagtcatttatagaccacacacacacacacacacacacacacacacacacacacacaccgctaacacacccctacacgcaggaggagagagagaactagaggaagcgagaagactggctcccattaatcataattaagtataagtaacagctatgagcttgagtagcatttcatatttttaaaatttgaaacattatgtcaattttggaattgagaggtctgaacattttatagtatcatttcttatttttggagcaatgattttctattttcagcatgcatcagaatcccctttatgtagaaacacagatttctgggccccacccttagagttcctgggctggggcctcagaatttggatttctaactaattttcaggtgaggctagtctgaagtttacactttatgtccacacgtgtgtgtatgtgtatatgtgtaattgacagaagatttgatgctagattctagtttttctctccttgtcctcagggctgtgtttagtacccttaagatagcatatttgtagtattggaaacagtataacctacttggttgaaatactggagtagaaagaagaaagcattctaatgcattacattatctgattaattcaagattacaaggaccaaaatttttgatttctttctttgacattgaagatctttttgatgtatgtgtgatgcttttctttctcagtaagtacaccattctatgaaaatttactttatcttttataattgaacattttgcaatgctccaaggttgttacttcaaggtggaattttattgtgtacaattttaggtttagtagtgtagatgggttaaagaaaatgtgttcagatatctggcagcattttgttgtggctgttaatgatttaaagtaaaaagttttttgttataagacaaaataaaattaaataatggtgttaataaactagagctgttattgtaattgtattatgctgcagtggtgaattgactctgctatttttgtrgctatgcacatagaatagatactatttagttggcatgaattaactggccgttcattggaataatttttttccaggactagcatacatcaagcagatactcaataaatatttgttaaacaaattaaatgcagagacctggtctctagggctgtagcttatcagttttattcaggaatgctgggtaaggagagaaagctttttgcctacttaaaatttcagcctctatacttggttcatcagaatgcatggtgctcattcactgatttacaggagtgtttcttcattacatatgggctgcacatactctgatcctctaacagctgagcctttccaaattgtatttaatagtatggatttggggttgaaattagactagaatacactaatacctacctgctgatactgctgcagccctatttttttcctttcctttagagtaacaacaaacaacaatcaatttgtcttggtagaagtgcttatttttattaatgtggctttttaaaaaagagctgtacaattctgacacattaggtaggaatattgatggtaagatatcctgtatatggcctcatcagaccgatgctcctgtaactcacattgccttttcttattattgaaaaatctttccctttcaggcaagggagtattaaaatcctaagtaggaagggatctgttctgccctctattttggctcacaaagacatcccttaatgctttttaaatctggaaacaaataatctagagagtcaaaataagtaataatgctcctttgttttgatatgcagcatttgttactgtattagttatgaacaagatagattcatccacaccacagaccaaattgtatgttttaaaaaagaaaatagactttgcaaatggacacatcttcccccgccccatgcagataataatccattttataaattaatggctaatgagatttttgttcttttgactgtattcagcgtgcatttggtgtactttaggttactattactaacatcatttcttctaggtctttcataatttatttttacttttattctattgaagactttgttatgttattgtaaatcttttttyggacaaagggtaaagacaaagttagaaaataaaataattaaaaagacctttttttaaaaaaatgaataatgtacattttcttaaaatgtactattcataacaagtggcttactgcatttaggttttcatatgtagagtctgcttgcttatcctttcccttaggaaagacgctatctatagcccttacctggtctcttaattgacagtctagaactcatcctcatcccaactgaatctcccttcttcacgtccttgactggcattctaggaaattgccaacaagttggccaaatctggccctcagcctttttttttttttttttttttttttttgctcagaataatgttggctaagagcgtgctacacaattaaattagtttctaacatttgaaaattagagatttcacataaaaaattcagattttttacctctctagaaaacctggaagatatggacctatatccctgtttggcaacagttctctggagatcagtggtagttgtcccttttagatgggacaagggcttacctcagtttacactgctctctattgttttgcagacattgaggctgctggtcaattgacattagcacttgcctgtttattttttcatgcccagtacttgcttgaccctctgaacacttgaggttgtgaatgattttttggaacttacgtgtactgtggccagcactgcggggcactgaaagttatcctatactactcaatagtgtgttccaaacatgatactttcaactaaagtagtttatcttgcagccattatcttagaggaatgaatctaacggctaggagtttcagattacatggtctatggaggaggtatatagaggctaaccatctctttggatgccattgtctcacccatgcactgggtaatctgccattaccatttacagtttgactcccttgattctctatcaaattggttttgttcatgatttattctggtgtctatcagtgagtacatgtccaaagcttctgtcatttccataaacttcttacaaagctgataactacaacaatgcttacactgagacactgttaacaagaatagccaaaatttcatccatcgattggtcaaaaataatctgcaatacggaagatggtttttatgtagctttatgacagaattgaccagttgggagagttcagataaactattattagtttaaaaatttagaacagagtaagatttaaggtgttattcaagggaatgcttttataaaggttttggaatcttgctcagtgaatatcattggtgtggtaaaattgaaagagatacaatgacaatagagacttagaagaaattatttctgaaatatttaaaatcccagttcctatttgaaacctgggaagggataactaccagcaatgggcatgctttatttatacgttaatggtacaatattgcaactcaccttcaccaacatcagttctttctccacgtagtagaataacaaccaaaattcagtctctgtgtttaggaaagacttacgcattacaaaacaggataacttttctttgtacggtaagggaatcttatcagtctgtatgttcctataatattcatcaagaaaatgggcaataaacaagatatatacagtaggtgagatgtttttgttggcttttctcttttgtaactctccttgtcatgcaggagggtgccctgaaatattgagtcttttattttctggaaagtgctcaattttcttgactactccatttggggatcagaaatttcttttcatttcagagggttttcaaatgccacataacttcttgtgaaatgcaaagtattttaagattttgaagccatggtatagaagagcattaatggtcattcaggatacttcttctcccttcaacttgctatttgaccttgaagagtctatgtgtatgataaaatcaatatatatatcttgcttcaccaaaggaagcttatacagtctaatgccatgtagtttggataagatggttgctttccctcgtagtataaagtgataatttttgatcaaactaacaagtcattcacttgattcagggtagaaatataatacacaatggattatgcaagtagaaaaagtcatttcataataattgcctgacatttaaaaactggaattcagtaaaagctgattaaatttatttaattattatgtcattgtggatttgcagatctgacttctctttgtaattcagcacaaaattctgcatccctcttgtgtgctatttcatagtttaaggtctgattcagatttgttggttttaccatgacaaatctctttatctagagctaagatatggaaatgttctcatttttagaaacactatttggttattttagaattatctgatttgcagtggtggattctgcctgcctttttgtctgcctaggaaacctaaggcaggaaatacttgcagtatttcataatcaaggaacactctgaaaatgtcctttaaaaataaatacgatgtgtcacataccttagagaatgagtttactcccccagagatggaattaaatttgctgatgtttaaaaataccagcatgattgatagactctttgcatttgaccacctgttaatgaattctcattcactacttgttttcccttactaaaattatatttaaatcacactgcacaaaaacccatagatactaaaagatttagaaagaaaaattaacagaattgtcacacctctgataagtgaattgttctccaagttgtaattttatattttaaatagataattccagaccctctggtaaatctcattagtaagtatgtttgaggttctaacagaggttcattgtttacttaattgctgaaaatttgcttttcgctgcaagtctttggctttaattaatgagtttttgtgtgtatgttttttttatctccggtagtagtatgtccagtgatgtagagaagatgtatagctcaaacaatggttaacgtctgagtttccttttaacactgagattctgaaagtctgtgaattcttatgtgatcatggtatattactctagatgtttacatctgaaatttgcaggtggacataaatagagaatagagatgctttaccaaatcttccaaaaaaagaaaaagaaaaattctcactctcagtacttcacacatatcttcattctgtcagtggatttgctggttggttattttgtagagctaatatgaacacacattgatgttttcattagtatttggctttactccagttatattggcctactttcttagtcccaaacagtccagaaattgtatttttctctaaaatttggggaagtatctaagttatatttcatatgagaaaatttacctcagggttcataatattttctctggtacaaaagataaatggcagcggaaaatgatgctttggttaaaaatgttattatatatttctacataaacagttctgattcttattaattttcatatatttcaaattatgatataattgatgacatttatgtgtagtttatatggactaggattgagaaatgcttagttcatgagaggggagacatggctttctaagtttttagggcaggctccaaatatttttattaatatcatttttattctattactactgtgctttagataaaataggcactcagaaaatattttggaatgaatgaattataactgaaatgatgctacatttaagttttctttctatgcacaataattaactttgggataaggggaggatataatagagttcatgctattattgaatagtgttatgccatctttcttgtgaaaagggatgacttttaatttttccaaagctttgagatcttcaacataaaagttaatatcaatgaaatcctttagaacagagcaaagcagaagtgagaagggcatgtccttgtaagttttattcctgcctgagaggcatctgggaatgccagtgaatggatatcggagaggaatggatgataatggaaaactacttagaaaatcaccagctaagacaccagataatcctagcatgtggtttgggaaaccacactcttttccaacagtgccattcagtagagcaagtctctggtgtgtagaaattttcagcaataattattgatttagataattcttttgcattattctttattccaacctttattgattatgcttttttcctaaagtgctgtttactggacagatgtcttagatgcgcccactgttgtctgaaaggcaataactatttcagttagctattagcatgctaagaaaacttgggtaattccacccacttcacattaatttgctcttgttgattatttgctgtaatgtgttaaataatkgctcttgaatcggtcatgaaaagcagtcatttacccgtttgattgctataaatatctatgaagtcatccaaatgtgcttccatattattcagaactcttctaagtcattaataaatatactgaacacctgtgctagcactgatccctgaggcacctcattattaacctaattgcacagcttcatgatatttcatttaaccttgattttactatcaaacttttttcaaaccaagacatttcaaattaataataaaactttaccttgtatcttgtgatcaccatggctttataattgaatttgcacatttaaaaaattctgaatgaaatacttgaatgttcattttttaaaaaaatttcaaacaatatttatacacttgtctcccaggtattttctgaaattcgacttgtttacagtcttcttttcattgtttttcttcatcagctatttttaatatgttagggtaaagaaacaataattccatagtcacagtattgtggttttggatacaattctttttgtgagtcccaactcctcaatgctattttattgctagctggtacctccatcaaactggagcaggaaagggaaaggagatggaatgttggctgacattcctattcatcagcgaagctatcgcaagtgaagaatgaggtttgaaccttctggtttaaatcatacttatggagtatagttgtttttttttttaaatattggagccagaagggactctgaagatcacatggttaaatttcccttatttttcagataaagaagcagaatcccaaagaagtgagctgacattgctgaaggtcaaactgatcagacccagggctgtttttctctgttgttcaattcatggcagcctggcttaggttttcatcatctttgtttcttactaccagtaattaaaattttctgtcttatttattctgatgattttgagatgaatcacatttaagcctcttttacaccatcagctatatctaatttattttttaaatctctaatagtgtcttgaagatagtaagttctcaataaatattattgaatgcatgaataaatctagaagcacactgtttagtagactcaacaatatatatgcatatacatgtgtgtttatacacatataaagtaaagctatagaatttttaatttttattttacttatctcatagatctacttaaatcacataaacaaaatcataaagcatattttatatattatatatatatatatatatwttttcaaaactgacttccagatggttaggtgctacgatccttagatttatttcaactggctgttctaaataaactgagttgttctgtgatgttgactgtagcctttatataaactttatctaatatcacttgctctcagactctcaaattcaaccaaactccctcayagatatctgagctattttggagaggcaaaattctacatatgagaagggcccttctacaaaaactaagggcagagaagccaagattcttattgaagttggttcccaggctccctacctcccaagggaggcattactagagaagcttctatatttacctattttatatatctatcgtactttatttttgataataacatttgaaaatcattgaaatgctattcattgcttttggaaggtcaccactcaaatcaaatggtcaacattctatcatctgartaagtcactccttagaagaattttaaatgcctttgaggtgcattatgtatttcaggttcatgattcatctgctttggggaaaagtattatttcctggcacgtgttcaaatgctgtaatttaagacatttatagtaaattattataccactgcygcaaatgcaattgatatgaccccaggagttatgcctggggaatagttgactcatctagttggatctggctgattgttctttagcaagctagagaaaaagaaaaaaacaaagaaagaaaaaataactctttaaatttttttgtcaaatacctatgaagcataggaatactgagcataaatgtaacttaaagaaataatataaatgagcaagcagagaggatcaaattgctaaacttctttagaggtgtctatttaaatatttggcctaggaagtgtcagatgaaatgtcattacaaaacaactaaagatcagctctgacctaaaagagagcccctttctgcttgtaggatctgaagacccaacttttgccctctctccccaccctcttaaccatttcctatcacaaatttctttaaaagttttggtgtaaatctgtttatttatttttatttttatttttaatttcattgtattggtttgtaacatccattcctctagtagatgaagaacaaaagataaatcctgtggctaattttgtgggcttcagaattactcaagtctgaaattcctttgatacttgtatcatgtagcacccatgttcatcaattttattttattttattttatttttttattattattatactttaagttttagggtacatgtgcacactgtgcaggttagttacatatgtatacatgtgccatgctggtgtgctgcacccattaactcatcatttagcattaggtatatctcctaatggtatccctcgcccctcccccaaccccacaacagtccccaaatctgttattgaaaaacataatatctacagcatgcttccagaatctgtctatctcatttttatttccctcatgttctttttcatgatcacctgggtgattatagtcgtcttgtttgcactgttgttagattaattgcttccatgaggcttttgcatgaggcatagacagtgttgacataatcttgaagttagtcaaatattagcccagagatggaatctgtggtgtgtagggaccaaagtggctccaagagatatgatctgagcttgtgaaagaactgtggaagttctgagctgacacaaatggcatacgacaagacatgctatataggattcttagatacataatcccatttctggggtatccaaatttaaattttcccacactcttcctggggtcttcttgatcagggttgacccaaagctgcattaaactccacatgattcatgcttcagacccaagccaagatctgagatttttttaaaaaaagaggtaattgaattatacccttcagggctgattcttagcagaggaaaatcacagaaggttgtatcctctccaggacaccttccccacatgctacacacacacacacacacacacacacacacacctttaagaaccatcactatggtgatttattaatagtgtgttatatctttaagtacttaggattagaaaagaaattaagaactactggattaaaatttcttatttaattttaggtgtgtgctggtagttatgtaggtacagttacatccatatttatagtataacaaaagttgatggcagcaggaaaaacaataaaaaaaatctacagagactccagaataaatacattttgtgtggactagctttaatattaataattcaattaaattagatttttactcatgtttttatattgcttagatttgtaaattaatttcactctgttaaggagacatctctgtttttacatttccattttactctttgaacagaattgaaatataatccagaaccttgtctaagaatatttttaaaatgtaaatgtagaggccttatattccaaaattttaacttattaaatataccaattatagatatataattagtacattggtacaaattcagtctttaattttcaaagaaagttggtgatataggaattatataataattgggaacagaatttaatattttgatatacattaattttttttcttttcttgcatctaatatctgttttgaatttttttttttgagttctccccctgtcacccagactgaagtgyggtggtgtgatcatagctcactgaagcctcaaactcctgggctccagtgatcctctcaccccagcctcctgagtagctgggactacaggtgtgcaccaccatgcccagctaattttttaaaaaactttttgtagaaatggggatctcactatgttgctcaggctggaaaaattctttttaagtattttctaaatgtaagctaaaagtctataggttgtcattaaatgatttgtaccttgttttattaacaaagttagccaaattccaccttgtagataataagccatgataattatatccaaacatttattcttccaccttctctgatagcctaaatctctttttctgagctgcctgtctgcccctccaatcccagcctagtaagctattatcataccactgtactgcagcctgggtggcagaataaggccctgtctcttaaaaacaaaaattgttgagaaattcatttctaacgcttgctgactcttttgaaaataaaccttgttggactctaaccgatcacctgagaatatgtttctgttagtggagaaagtcttgaaatgttatctcctattttgcttagtgatctttatgtctgaacaacagcatatgagaagagtggcgtgctgtgtgagtgtgtatctgtgggtttttccacacatcttatatgtaaattgcaaataaaggaactaaaattttaaaagatgagtcagggatgagataatggtacgtgggcatgatgttaggaagaaaaaaattagcatcctaaagttaagataatgccaccatttcagtaaaaataaaaaaaattcttttaaagaatagtatctctggtttatttcctcatttctaccttttacttctctctaaataatttcagagaacatattacaaaagacatatgatataggattaacaaaacaggattagaaaaagtatataaaaagtatttacaaaggagaaagctgggacactccatgggagtcttaacatggtcaccatgatagcgaatgtaacccagttctgggtttctgagcaaaggtatagagaagacaggttgtgttacaggcctctagtactcactggggatgaagcataaccatttcccaagggaatcttttttccagacctagctctgaagtacattactcacatgtttttttttaaaaaatgatattccataatgtgatggatgtatttctcaaaaagagttttgattaaatrtagaagaaaatccctgaaggctttttcctatataaacctgcagtgcagattgagggcagagtccagtgcatatacagagtgttatgcagcaaaacatacaaattgttgaatgtaaccctgcaaaattaattacagtgttrgaactggaacattcaagggaaatgttcctctctgctctgaaatttagaaaaaaaaaaaagaatgaaaaacgaatgaagtcttcttgccttgactcttaagaccaagaatttttttctctgaaatacaaatcagcttmcattatcttactttatcyattctgcttacctttatctcagaaggaaaacaaggtaaacttgactaaataagtgctgacaagatccactttatagtgattacataaatgtattctgcagctacttaaaattcatatttcagactctagttacatacacttaagatatggataaattccaccaggcaaaaagacagaaaattggaaggaaaaaaaagacaagggaaccaagtcagtaaaaacattttaattacaccccaagccaaaggaacattaaaattaagggaaagcctggaaaagaagaaattttaatggaagcatatgattttagatcagctataaaataagacagttataacatatccataatatattgaaaagggtggaacatgaaggtgtattatcataatgaccagttataaataaatcagttgttcattatttccattgagagaacaaactgacgacaacatctattcaacgtgtgaatgattcatttaatagcttttcatgcctcatttctgacacttttttttgggaggctaaaaattactgaagtgattgaaatacactgtgctagagtgacttgtacataatttgttactaattggtacttttatttctaaatgatgatttttttcaccccataatgaaatagcttaaatgctagttcttcaggatttgctatgatgagaagcttacttttggaatttcctcatcagtaacaggtaaattagatggatactttgcatgtattaaattatagtggtatcctggggagactggcgtgttatctgttgataccatgactctggagagaaatgggaatatcctgtagtggatttctttttatcttgccatttattataataatattatattaagtatatggaatacacttcaatagataactttctaacacatattggtttgacaaaaataatcttgatatattttaatttttttagcaattgtccttaacaagcttttggacctttcatagaataccacacataaacagtcatgtaaaaccaagaccttcattattcaagggatttgtgaaagtcctaaattgagccacgggcaaagagctgtttttatgaaaaatgccaaaggattttttaaagaggagattcggccttatgtgaattttcttaacctctagtatattcaatctattgataaaaagaaagrcttactttggaacctaggtttggttgtcaggtctggcactgagtgaaatataatcttatttatgttatttggtgagctattagcactctataatgttgtataattggacatttcatttttcaagataaattaatgtaagcttttcctcttccagtcttgtcactcacattgtgttggcacatatgtgtatgtcatatgctatataaaactcaaactgagaaggaaatactgaagaagacataaacgtgaagaggagaggaagagtaaaataagcagagtaatatattattctccctgtggttgatttaggaccctgcaactctaactgttcttcgcttactccctcaccaagttcacctgtgatctgtcctaatggaatggagaaatttaagatgtatttattccactaattcaaaggaacgaaaacttatttaggttaagtcttacctccttagaaccatctcattataagtgtaagaccctaatttaatttttaatctatttcttctcttttccttattttctttttttaaaaattataacagatattttcaaggcaggattttgagtaattaatttatagcaaatgtaatatacactgggcagttcaacaaaagtaataaaatatggcctgtcttcttgtcatcattagcctaaaatgtttaattatgcagatgttttaattaaaaaattgtcacaggttcttgcaaagtaggtggggtacaaacctgcaaaggaaagatagagatcatctaaggcttgtatttcagctattgttataccttatgaacctggaattttcaatcagcagatggagatttaatagtatttcttaaagcctttctggaaactgtccaattgtccaattacttgccatcatcattccatcctgctccccttctagtccactcaggagtgtaaatgtcagtatttcatgctaatcttaacaatcccagagccccatgaaataaaaagcatattgatttttttttgtaagccaagtggagtttcccagactagattttgagcctcttaattggaatacagaacaattgtgaaacttaaaaaagctaaaggttgttataatttaatttatagtcactaacaaattatagactctacacatataaaaataaattcaaaacattcacattaagggtgttttaggtatttaatagaagtagttattgtctaatgagttcagttttacaggctcatttactaccacatagcatgtgccaccctgtagaaaactatctagagtgaaaatttatanttttgagaaataattatttgaatacagtatacattttatatattgggaattctcatggctgcctttgccatactgcacactcttcataattctcaagagtattttagaatattaggcacaattccctcagcattcattaaaatagcattattcatgataactttcttcgagttaatacggayatgttctgaaattctaaaattaaaatatattcattttctttttcttttctttttgagatkgagtctctctctgttgcccaggctggagtgcagtggcgcgatctcggctcactgcaagctccgcctcccagattcaccccattctcctgtctcagcctcccgagtagctgggactagaggcgcaggccactgcgcccagccaatttttgtatttttagtagaggcggggtttcaccatgttggccaggatggtctagatctcttgatctcgtgatccacacacctcggcctcccaaagtgctgggattacaggcgtgagctaccacgcctggccttcattttcttaagtaggaaaatcagaaaactatgccttgaactggttgctgaattcactaatactactttggttcatcttaatgcaaagtgcattcttgaaaatttaaattaaaaagtgccataagcacaaaataaacattggaatcttttgagagtaatggtattctcataaagagaagtgtttgctaaggaaagaaatacttatttaaagaagcaaaaagtcagtggtaccaagcaacttccaaaacaactgtgcttattggtatatcaggcaaattcaccaccttagtaattttttccctactttttaaatgaaatgttttatagtaatagaacaaaagacaaaagactctacatataacctaattctcattcattttcatatcagtcttatgccataacctgtaggtgatgaaaatttaaattgcacagcccaatataccctttctacatgttgtcacatattcctgaagttagaaattgtattataggctttttaacccacataggtagcattttaatggacatttttaaaaacaaaacaaaacagaaaacttctgacagtacattgaatttattaattactttaagtttattcaataaaattgcatattttttatttatcatggaatagctaaattaaatccttttcatttgaggattaatttgaaaagattgtgggaaggggtaattttttcaaaattttatttgacatatatactagaaaaaactgagtagctatatggggaaaatactagactcagaaactattagagtcccagttttccagatgataatatccacagacatctaaagacttctaaattttagttaggatctggatgtggagcctgtagacagacctgagttttataaatggcaaacctaaagtttctcaagtagcatttactctgtgaggtcttttctgattttcagcaaacccaatcatttcacagcatcatgtacagacttcatttttagaaatatcacattgagtcacaattatttattcactataagcatttgatcactgtgtctcacatcatagtcactggaataccataataaaaatgaataaatgcttattttattgatttgaattaaaaatatcaaaatatcattatatagtataaaatatatagaagacacattgaacaaatacccgtgaatgaaaatttgtacctaccaaataaacacagaggtaactgtaacttaattgtccagaatttgatgaagagaatatttctcaacttaaaaaaattcaaaaaaactaaagtagcttcttatgtatcatgtttcagattagaaatatatatatttgactgtactttttaaatgacaactttactgacaattatttatacttttaaggcagaaataattctgcatattctttaatgtcagtgcattcataaattaaaaatatttcactctagtgaaaaataattataagtaaatgtacattctagtactggtctgtttgctattgttgcaggacttttccttatttcagctaaagataggcctcttgtcccatggccaggaatattcaggttcacagacaatttgaatggtgagtaagacagggttttattgggtgaaaaggaagaaaagggggaaacagggactctccgcaaggccagagtccctgctagagcacttcctgcttggccgcttgaatcccaagttccacacaggaagaggaggggccaggctcttccttgctgcaaatggactggaacctctgtgtgactgcacccgagtgcacsttcccagtgtgcagacctgtttggagttttgccagggaccccctcacacctggctgtctcactatcacctaaatgattttgatcatggtctttaataatattctactgtagtttgtttgtttgtaaaatgtagcaatcaaaaatgatttttatttttactctttgaaataaaaattctggttaatattcaccaatactaacataaagactaaaaaggttgaaaagaaaaagtcaatcaatctaaaggccgtgttttcatttgtgccaaacagtattttgttggaggatgttacaattattagcttctaaaaagttgtttgatttaattcacataattrtttgaaattaatgccattgcctggatcagtcttcaaaatgttgtatgaacattttattgaaactgacataacattttaaacaaaggattaatattcttttcccccacctcaaagaagataaaatagaaatgtaaagagaattagagttcagaaaaatgtgggaaatatgtaggcttgcctagaaaggccaagagatttaatttggctctgagcttttaggcaatcaggacaaaaattgagcctggtctttctcttccagagaagcatgaatttaacaaatcctattggaataatagatgttagtaaataaaaatataatattctcccttcactgccctctcatctttgtcttgcccatctgaattcactgctagtttgaagttctatgtcatttatcacttttgccttgagatattcccaacaaacttattaactttgattttatcttctcctaactgctgtttatgattgcaggtattaaacttagttcttgaattttatttctgttgaatatggatgtcttttctctttgctaagactgtaagtcccttgggcacagggactatgtcatatactcatgtatctctaaaattttcttaccttccaagaggcatatattaggtatgtaataaacacattaattatattgaaaaaatgtcttcagtgatagccttaaataggtagaattttgaacttagcattggggtctatacagtggaccttaaatgagcagttagaggggtcagtttttcaatatatcagtcaactggatttgaatccttgctgcacaatttaatagctatatgttatataattgctttgtgcatccgtttcttatctttctaagggaaaaacaatagtatctacttcataggattattattaattctgtttgccatattaatgttgactgaatgaacacccgtaaaatgcttagaaaagtaaacattcagtaagtgttagttgttattttgtcttaaagtgtttggcattaagccattctttctgaaactaaatagacattctttttggtaattacagaacacaatcagttgtctgaaatctgtcctcagaaagcgaaagtatatgacaacaaaaccatgttttcattacagacaatagtatttatattctcagtggcagaaaagcatgcagttatctgaaaactatatcagattattaagttaaaaagaagtggccccaaactacatttcagttttatattacataaaatgtttatctgttagaaggctcttcttccagtacccctgtggtagtaccaatgtgtcatgtcaagttcacacattttatcccataactggatccaaaggcaagggaaaagccgctaagggctacaaccccagttgtgtaattcttccacaaaatgatgaagtgtaacaaggattcattattaaatagctgcgtgtcaaagccaatggtggctcaagaaactcaggtttgaagtttgttaaagaggaaactggcagggagttttgaaggatgtccaatacactgaacttaagtttccatcacatccaaaggcgraaaaatgttgacatcacaaggatctcagtcttttctccagataatatgcaagttcagagatgttcagtgtctttccctagacctctctggtgtaagtgtagtcagactagagctggtatgggctctcaggcttttgcctcaaggcaataattttcttaatttataagtgaatataaaataagacctctagagaggactttaaaaatcatatttccagctccccattgtggtggccattccactctgataattgccttatggtagaacagaaaaacagcggtgaccaatctttcaccacattttcatcagactgtttagggcattatatttatggatctgtaattgaaagcaaatatatcattgatgtaaaacagcaagaacagatggagtatatttaaaattacaattcatttctcaacatcaggttttgacaaggtgtatgtgaattaatgtaattactcatatggttgaagcagcaattcaagagtttatagttttggactatttcaaatttgaccttggaaagaacatgtagcatttagtttaaatctttttctctgtctattcagtttctctctagagaaataatagaaatagttcttggactaatttttattcttaatagtctctcttttggtrgaattaattctatctatctatctatctatctatctatctatctatctatcatttaatatgtattgccatcacaaataccacatttctcttatattccaaatatccacattagcctttatgatgacacttgatggcataaatgttattgtaaattttaataatgggtcttagtttttaaaattactggcagattatttaataataaatcacatgcccttcacttaccttggtatgtgtaatttttgtcttctttgttgttttttaccacatcttcaacccagataccaggagcatctttgtkgtccacaatcagaattattctagatatttcagataacatttctgtatggtggtaatggtgccacaatgagaagacacaatgatattagatccagtgtgctagaatttctttctttgctggatttattgttttaaatttatagcctagtttttatcacagttatagacgtgatcatttttagtaggaggcatgacttacagagtgctttactggctcttgaatgctgtgtgtattatagaagtatgtttttcatggatgctatatgttcagatcctgtgatggagtaaaatgctaatgtaattaaaccaatgggattacttgcacttgtggagttcagggagagatagaagagataactcaatggtttaataaaaagctcctgagacactaatggagtcgagagtctacttaagaatcatttgtgaatagctgagactgaggaagatgtttttcaagatgtgagtttaaaaataagtttcaaaaaataattttatttgtccatctccacgaagtaatgaaacaaggaaatgatatttattttatatttaaactacatattacattctgagtaggacaagtagagtctgccttattataaaggttatctttcagcctcttttgatgtagtatgcttccagatcccatatcatctgtgtaagttataatactcctataaggaatattgccatttaaaatcactcacaggaaatattctgtagctcaagccatgtcattgctacagtttgcgactgtagattattggtgtttttctccaccttgtcatttgtacttggtgactttattgaccattcatccatatagtttttggtaaaattggcaacctgacctctttttttcagccagttgaaggttatattattgatatttctttatcaattttggctgtaattttggctgtaattttggctgtaaatttataaaagggctaagatgattggaaataaaaatatgacatcaatattcaagggtatttatgttttgaaggatttttctttcaaatgtctactctttttagggaaccatgtataaaacttcaagaaaatattgttgttgttgttgttttttccattaggcctctggtttaggatattgaaggaagtctctacacagtgtaagataatttttctatttggaaataggcaaattctttttctgctgtgttcagaataagaatttattctgaatacagaataaataattctgtataaattattcagaataatatatataagcctcattatgttgattataatctcttctcacttttgaaaatgtgctatgatgggggtaggagcacatccttagagcctaacaaatctagatttgaatcttcaaccccactgtgtgagccttggcaaattatttaattactatgagccttattttcctttctttaaaatagtggttatacttctttcctaaaatgatttaaaaatgagaggagggcatagtgcctgctacatcataatttacttcctgcctttctccccacttccagcttttcagttgttatattcatgggtgcaactaacaagtaactaacccagaagccttaagacttttcagatatgcctctcgaaagagttaatggggaataaaatctataaacaacagtctgtcaggaagcaacctgagcattttatatatagttgtcttttggtatgctttcctcagtcaagaaaaatgttcagtcaggcttagaaaactagattcacattgatatgggaaagcacaagaattcacaattttactttagaatagaaagcaattgaatgatttaggaaaaataaattcatttgagcactatttttcaaaacttagcatgcattagtatcacctcagtcatgtcttaatgcatattttgggatccatcccagtggttctgattcagtaaatctagtattgacacaagggatttggagtcaacttgacctcttaatagtaacttcaaggatattataggtggcaaaagtttaaacaaataaaattatttgtcaaatttatccatccatgttgtcttactactattttccacattaatccagataaagtcagtaagtggaaatgactgaaactgctcaactgaccaactcaaaacctggagtcagaccgtcatttcctatagactgaggaaaagactgtcttgcagaacctttaaaccatgtagtacaagtgtgctgtgttataataacacaagatatatggaaatcaatttaaaaaagataaattagcaggtaatattttagattaaaaagcaatttcaaggttcctttatcacaaggtctcttgatacatttgaaatattatttgatttacacaaaataaattttcactcaccttttcaggaagacaaatatcatataacacaaaatttataaatgagagctaggaggaagaaacttagtagcctaagtcctagatggttgaggcactctgctgctgtaagatcactgtccttcatagaataaaaaagtcaatggtggactttttaaaatgtgaaatttaccctaaataaattaaatataagttgcctcctatctcacaataaaactataatgcaagtcatgagagaccttcaaaaaagactcatcaccactttgatggtgtgtgtgtgtgtttgcttggttttaaatttttaaacatttctttcccattaatgttgatgataaaatgaagcccaattgttgattgtccaggtaccctacctttggggtaaatcagaattttgaaagcattgctcctgggtcctttgtacttggcgcctccctatttagagacagttggggaaaattgggaaggtcatgggaggagttggaagctctttcttattgcaagaccaattcatctgcaccttgagactttttgatgaattaggagattgttatattacccagcattataaactgttaagagctgtgccaatataagatgttattatatctattctggaaaattttcaccttttctcctgaggccaaatacctgccagtcccataacttctttcgcatgctctgacatacccagaacatctgcatttcttttatacagtttaataacaacaattcacatcaggtattggttttcatgaattcaatttcttattttgagtgtttagtttgagagatgatatctgtcttctagtcaggaacaatcaaaaacaaatatatttttactctcatatacaatagttttattttagaaaatttttttttcaaaaagattttactatttctaagcagtcaatggagtcagagagatctgagttcaaaataggattatgtgattagtcttgagtgttaaatttgggaatgttttctttccttgtaaaaatgtaatttgtattaatctgtatagttttgtggttttccaaaacattcaggagggactagaaatagagacttgacaaaaatgagttgatcagtaaaatatattatttgcaagttagcgtatgttttaggttctatacatcaatttggataaattatattttatttttcttataaggaaaatggagaaaattgttctctattattacaagtaaaaaaaatttcatggtttaagaagaaatcttgccaaaagaaaaaaagaaaaagaattttatgtaagtcttcccaattagctccgaattgaacatgtgttcagttgacaaagtgttgaacatgtgttcaaccctgtactatggatctcttttataattatgcagtctcaatttagaaggtctttggttttttccttggggtttctttccttgtgcttccttgattttatgtctgtacctcggggcctacatgcatccacatcttgggagcatctgttctgcacattcacaaacgaacttgtatgttaagaaatatgtgacttgttaaactttttgaacagagttttaatgtgagagcccagagtagaacacagaaataattcagttagctaatattttacagatggagaattgaattaaaatagggattactaaacaacatgtcaaatatatatagatatatattctttcattctatccattatctctggaagttctcttgctctgatcagagaaagaaatcttttagtacagtggaaagactaacagcctgtaaattttgagaataattcaactgcaccaattattggccctgtgttttggggtaagagctcaatttctttgagattaatgtgtcttcatagggttgttatgaagacaaaatgagataatttatgtaaaatgtggtttgtgaacttcaaaacactgcataactttatggtttgctgcagctgctggctgttattgtaaccatgctgggtgaaactttccatttttcagctccaaacataagtaaacatttcagttgtttaaatcggtgaggaatagacaggaagggagacataggaatgggggttagaaggaggaaatgggagattatcaaatgctggaaaagataggttagaaatgcaagttttagacaaaaactgaaataaattggaaatatgtgataaagattccagacacagtctttcagattgtcaccaccctcacccttaacctggacatggcaaaataaaaattaagcaaaaataataataatcatcatccagcattttttttcttgctaaagacccttttggttgaatttaaagatgagaagtctcaaaattcctggcgtatttggtgtagcttagggccttggttgcacagagctgtggttccaaggtgattgcttctatttatagtcgttcactttagatgaatttaaaatatttaagaaagaaagtggtttccttcaggaaatcaagggcatacacttgtaagactccttggaaccttaacatttctaaaaatcattatcaatttgaatgtgtctagaaataggtttattagtagataaacctatttattaacaaatatgttaatttgtgcttgtttacacaaattaattcttctttttctatctttgcaaggataacttctaatgagaaaacttgcaaatgacattttggtttacataataaataaaattttgcatttgattttagactcacgaatcatagctttataaccctttataaatttgctaacgacgtaaagccaaatttcaatgtagagaattaagaataagaataatacattgcaaggaaattagaaaatggaaaacataaagattaaaattagatttaaaatgacaaaaatttttgaagagcaaataatttatgcaaaatatgttacaaaatctgggatgctaaatagttgacacaagtactgtgtttgacatttagtttcatttgaattagtaatagaatttgcttcttccaacatttacatcttttttctttctgactttatatattttcaacaaaaatttgctccacagtttttaagttcattcttcttgaatccgcttttacatttgctgtgacaaacctgcataaaactagattttatagatataacttctttggaagagataaaaatttaaaagtttgacattgttttcagttattcttttcttcattgttttgattggcccctgttagattgatgtattgtcaatctacttttgatggcatgaatataaaatgacaacataaaaagcacttctagtgcaacagtaattgaaacttgcagttttccattaaaaaaaaacacaagaatgcatgattactattgataaagtaacaatattttcaaacaataacctatgtcaagcaaacagcacaaacaagttgattatttcagcttctaaagactcaggttttcttaatttgatttgaatgaactttataatacaattgtataatcaatatatgatctgggctggtgtcaaattactctgagttatttctttgataatttggaggtgaatcccattatggatagcaatataaacaatttagaacatattaaggatgtttaccgtctacttgagtgataaagttctccaccatggctcatatctatattgaatgagctgtacatgtttaaaattcttcctcaggagagaaatgatgtagtgcacaacgcaaaacaaattcatatgtttcctttgaaatgtttccaaaataccggtctcacagttctaaataaaaagttgtcttaagaaccaggcacattttgcactgactgatggttacttttaggtaaaccgctatgggttaattaggataaaaattgctactgtacaattattatgcactatactcccaccttggcctgaaaataatgagatgtaacaaaagtttttatttgtcactggcagctgcaccttttaactgtatcacaaagtctgttgctgtggttacagcctttgtttccagtgatgttttgtccatgctttcccccaacccttaacaatggttactcaaaagaatgaaataatgagtcattcattcggaaatatgttaaaatatccctctttatcattacatttcactgcttagaaactaggctgtaattcaaggcaacagttaagtctgagaactgttaaaaaaatctttgatttttttttcatttttaagaaaaacctgcctatgtaattgaagaacctcttacaagtctgaacaattaaatcctttttggttaatgtattatttctggaacaagtagataaaattctacgcagtaagcataataaaaatcgtgcatgtttcgcacagcacagaattttagagtcaaggtttctgggcacaaaagcagtaacaaaacagtccttacaaaactgagtaactctgaataacacaagaaataatttttgttaatttaaaattttagaaactgaaatgtgtaaagtttttaaagtaaaatgtaattaaattatggtactgtacataccagttgtttctacaattgaaactttacaatatgaaaaatacattagctttgtacagtttttacaggtaggtaggatgagttttgaaaaaaaaagattcttttatttttcagggtcatactctgtttaagtcaaaaaatactgcacaacttagctaattacaaagtgtagacttaaaacaattcatgtcttctttatttcatgaatcaatcttggattttttgtttatttgaacaggggattttgtgttttgttttgtttttagagtccacaatgaacacatcttcctcattttgtccttgaggttacaaagtttggtagcaacccctggctaccaatgatctcagttaagctagctgctgtttatggtcactgattcggccagctgttgtgattgtgctcaggtccagctcagtctctaggtgtgtttccatcgtatcttcctgtgcattcgtttcaaaggacttatgggagagaagttcatgatgcaccccacagtaacttattgtgggctggtcgtatgccagaaaggttgacacattcattgataaaggtatctggggaaaaatgacatgagaaaagtcagttataaaaatatggacaactttaggggaaagatttagagactgaagtgctgacctgactaacctccatggttatatctgtggccctgtggcccaggtgtccctatattatcccgctaatgccccctattccyatatggtgagatcagtgcaacagttttaaatcctgggatgaaactgcttaattctttactagaagattyggataagtagtagcctacatggttctgaaaatgataaaagatttattggaacagtcagaaaattgctttcgctaactgggaaaataattgtgtttttagaactgataaacactattattattattattagtgttaattatcctattatttggttaggatacaatagaacaagagtgattctcaaactttagcattcacaaaaatcaccacccacttctttaastagtcaaccccctgccacccaagtttttcatccagtaggtctggtataggtcctggaatccacatgtcttacaagttcctatatgatgctggactattaatccacacaccacacttcgataaccattgcagaagagaattatctagacaagccattctggctattcttacccatgacttcttaatatttattttatcataaagattccttaaaatattaatgtctgtagtttggtccatatatctaaaatttagatgagcatagagcattcccaggaaaaatctatggttcctatgaaagtccaaaaagcatcaaaggatgatgctagtttgaaggaaccagtagtatacatgaggaagggactcccttgccaactaaagaaagcaagttctaaaggtgagggaaaaagcaagcatgaccatggtgagaagggaaacacagttacagacaaaggggagcctgaaatataatcagatatcaaagtctagagatatttcccatttcgttttcaataagataaaaacttgtcctaaaaagtaggcagatttcaggaaccttcagtcctgatcttggtttaatatcctaattactaattcatgctgttgaattctctggaggataaaagcttctgccattcttgtttggtgaacagatagaatgtatatttgtttgagcacatcagactaaattcctttctgatcttagctgagattagagtccaaagctaagaaaaatagaaggcctaggtattatttttttattaactgcatctttacattctttccccttctctccatgcattagaaccgtctttgccacttctgtttccatccctacagttctacttacatgtatttctacttcagtgaaaattcctggagcaaatattaccttttatctctttaataaaagtaatcaaaaaaataaaaaataaaactaatcacttcttttaagattatttgcttataatatgaatatttcggcatataaaatatatatagcttagttcttagagaaatgtaatccagcttattaaatgaaaattccagagtaactcttcctatttatgtggatttttaagatttaaaacatgaagttatctgatgcgtgaatgaaagatatcacatactttaaaaaatggtcaaggcgactgaaagatcgtaaagaaaatgcttaagaataaaataggatacttccatttaaaataaataagaatcttgttgtcacagatgaaatagcccagataactaaaatacatttttatgtaaaagtaaatgtgcagcatgaatagatttgagttatagaagagaacaaaaatagaactgttactgggtacaygagttttacattatcctctgggaaatcagtgctctgtaatgtgttatgggtcatatatctgtaggattttatatacttgtccttattcgtcatggaaacttatgcctcatatatgcagaatcatttctggcttacttagaattaactctactgtgaataatttgtaatttctatggtgatgatttatgaaaaataataaaccatgatacatttattctgtgtgtgtgtgtgcacacacaatttcctgcttgatttaatgtatcaaggctactgactggtatgcagagtgcaagtcctaatttgaaccattatcaattaaatagttagctctgatgatctgttttaaaaatcccacatattattttctttagtgagtttcttactgttggatatgtcttattttgaaatactttatgccatgattatactgtttaaatataaatccacattttttcacattttattatttctgaaattaggatggaacttataagcaacgtgaatgtttaacatatatcatttccatgtaattgagagtgcattttaaagttgattctatcttattaacaataaaataacatagtaagatgtatcagtaagtagaatgtaacagctagccatatctgaatacagcatcacagtagatttttcccaggttgacctaaatgattttgaaaatttaagagagttagcattggatatatacccatgtgtatatataggggtacacacatacagatacatatataatatataaacatatatgtatatacacatatatgtataaacttaaagccaattacttatagtttcaaaatcatttaaatcaggtatggaaaatgcaaattttggtgatacatcagttttggaccacttttacatactcatgacatctatataagattcatgtaaatatagtatacatacctatggatatatacatgatatggtatatgtatgcacatgtgtgtacatttactcataaatttttcaaattgtgttcaggtaagtctttgttgaattatgaatattttgcactgacaattttattggaatgtcaagtaagataattttttaatatataaaatatttggttaaatttaagtcatttcttcctcaatttttaatttataagtattgtatacagatgtagtacaaggtatgtttattcttttgtggctaatcagatggataaaaattattgaaactgtgtgatatatgaggcaccatgcttgacaatatgaagaacctaaatatcagtggaaggaccaagtgatttaggtatagaatatggccagtaattttctttttaattatacactgttcccccaattactataaataataatttactagatgtttacattaaatacaattgctatcatgtattttaaaatatgtagaatgaaaataaattttacttcaatttaaaagacctagttcactgtttaatgagatgacattaaaaggctatgctatctggaaatacttatttcgttagaatatccatgtaggatatccatttaggaacccaatgattcctaaatgtaataaaaataaaaatagtctctattatctaaatttgtaagggagggatatttttgcttctaattatttataatgagaaaattattctttgtcagagcaagtcttcctcatgaaaaatattacatatattgtttgtaatatcttttcttctctatatcaacatcatatgttgattactttctcagcttagggtattagatttttacataagttaattcgagtaggaagtcagatgctgagtgtgcaacacattttctgctcaagtagcagtgcactacctgctgcctgacatcacggtattgccttaagaggtattctttggttcttccatgaagagattatccgtccctttcaaattatagtcagttgtttgagaatatggcaaatgacaatttgtgttagtgccataatttgaaaaaggagtgtgactaggatgaaacctatttatgtttcaaataaactaaatctaaaatgataagaaattaaaatctgcatatggtatttttcacaccagggtaaatacctgatgcagaggtttgggcaacgactgtgaattcagcaatcttttgttgggggggagtttcagttttgttgggagggtatgtccttgcaccaaaaaatgactggtcgctgggtagtaatggagaggctaccagctggcattaaaaaaacaaatctgtttgactcaaccttgtagatcccttcctgtcaccaactcacaataaattccattctcttcacataaccatcaagtgactttgggtccttttattcttttctttttttcacagtaacctctctctatttctccatttttacctaatttttattaacatggtctctcctgagattagggtgttcaacagtacagtcccaatttatgcttatcgtcccattttgacaataaatgacttagtcaacctacctgaacgttacccaaatacattatttcataaaataaacagttaccctaagtgtctgaactagctagttggaataggctcagggaagggcaataggaaatttaaatctaataaggcatttgcttctccagatcttttgttggaaggctctaatttaaagtgtccatagaatcttcttgtcatatctttctgagaattaagtttctctccatgaatttaccctgctaaactcctgtttatcattacttctggtttcttttaatcctctaaatcaccgttttccaagaaaggtaattcttcttaaggctatgaattgtggagattcaggggtataaaaacttactctctagaaagcattatcatgtatactcttagctaagaaaatcgttatatgctattgtaataatgagtagtagtagctgacccattatttaggaaattcccttaggaataatttcgattctgctacactagtagtgtcttgacatcaatgatatttgccctagcagtaattttccagtgatgtgccaagtctcatatcastgtctcgtatcaacatcaatgctatgtacctttcacataaaaagtacaaagttrgatggttaaaaataactaattactaatggtctttttcccattcatatgtaatatttgagtttgtgattataaaggataagaatagttttttaaagtttctaagttgtgattaagtaaaaataataatttttaccacatattaactatataagtaatatctaggtatatttgtacaaatatctttgtatatatatgaacattcatatgaatttctcataatttggttaaggtcactcaagaatctcttctgttggatagaaaaggttatttttaaagtacaaaatactctgaagaacagaaaatgacagtcttcttttgtgaaggaataacaaaaaggccatgttttccttctctagaattctctctctagtttgcttggtaagtgttatgtctgaatagagattttagtatgtataaatatctctactcattgagagaattctcatgctctcctcatatatcacaggggaaatcttcccatttttgtaaggctgaatgttatctagtaagttttctaactctctaggttgttgaaaagatgatagtttagggtttttgtaaatatcatttttgatcatctgcatacagtgaaagaaacagacttcttaatgaagaaattcagttttttagatgtagtcctttgtcactatcgaaatgtttttctgcattttatcttgaaattcagaggcgtattttcttacttttatttttcatctactaaacttaaggggttttcagttgagtttatttctacctactaacatataaaataagaaataggcatttcagtcttcttctagttaatgatatttctctaatttgtctttaaatttgtttcaaactgagctcattatctctgaatacaaactggttcctcttccttggtccctattttgttctagggaatacttattagattaagtcagcttaatctacttgttgcccatctactttgactccctgtctcttgttccaaatgtcccatgatttgccagttactttcttgacatcaatgacaggcacacacatctctcatctctgttaccactatctcggctcaaagtatcattacctttttcaccttagtgactatgactggtctccctaatctgtagaattgccaataaaactgggcatttataaatttatcctggaggaaattagctatatttttaatttaaatgtaagcaatatgtagaaaatagtaaatactttcttcttttgttttcctttttttggggggtggtcatgtctgaagcattattctttgtctttggaaagaagtgggatttaaagtatactttattctgggaaattggcatccttaaatatattatttacatatattccttaaatatatacrtgtatatatttatgcatgtatgtttgtgtatgtatcacactgtctttaarttctcaatttacttaaagaaatgttttaatttctaaaaaatacacttgatgatgactttattctttttcattttgatgcctctactatctgtttcatttatataagctgattttcataactagctttgggttttgctaaggtatgcgcaatttgatgtgtgtttggagattggctagcaacatttattttgtcctatgaagcttgacctttatatacaggctggtagttttacttagagtcaaaatagaaagctgtccctttggtattatttgagtaatattaagaaactcttgattgaaaatacctttctaccggcttgactcccagcttgaaaattttgtcactaatcactattttggtttctaagtgttaaggcagttgataaaatataagtgctatatgagataaatagtgtaagcaattatcacactgcagcttgggtccctggcaaagtgtcagggacggcctagatgttaccgcaggttctaccttagtttctttaggatttctgcagctgttactctgcctagccacctgaagaagctgtgggcatttgttgcgtctgtcagttgatgcgtggcctggacacgtctctaatattctcttcattattttcattcattaagcatttactatgtagcacaggtactataccacatgctggacagaggttgcctattttaagccttctaagactaacagttgagaaaaggaagacttagatagtttaaataatttgtataaaatcactcgtctagtgagttgcctaagtggttgcctgccttcttaaccactacattttgttgcttatctatcactctatctaattcttactggccttagaacctagagaggtgaacacaatataggcatctgattctctgtaacactaattctcaacatttagctcttatttccattagtgtgaacattaagatttcctatgtttatactgtagttttatgatgcttctttgcacattgggtcttcaggaaagaaacgtagtttatgatggatttaagatgtgggtaagatagtgacagctcaaaatcagagttctctgcttcttactacacacatattgaccaatacaaggcatagaaagaagagtccaatctcgaaaacactcaagatggggacaggaaccttaagtatactcctggatacatatatgtgtaaaaatgttcaggaagacctttggggtttttaaagttagatccctgtgttgacttagaaattggcagatattttccagttaaaatatgttagcttttctttttaacaaaatgtgcaaaaagaaacttgaattaatctgtagtttgattattttgtttcatatgagactatacttgtcttgaattttttctttatgtaaaacatagctaggcaggtgctgcagaagtacaggactgggaaatggagaacaaacatgatgaagacacaatttctgctctctggcaaaattataggcttgtgaaagggatggacaaatggtgcaagatagtaaaggaaggcaatggatggggggcctaggagacaaatacagtatatgtgtttctgtcacacacacacacacacacacacacacacacacacacatatgtatatacacatatgtatactctgattggctgattcgactaactatatcattcatcctttatgtgtgccaaatgaggtagccatcttttttctttgaaaataatgttgtttttgagatttattggcaagagtccatattgctgagaagtgattcaatatttactttatagactcccccacagagataatatactttactttgaaactgatttatttgttcgaagagcaatctatctcctagaactctttagtattccaatggttaattggtgtgagtacaacaggctgttggatcattaattttaattatcttgattctactagtaaattattttttaagaaagcactttcaagaagcacataattaagagcctgaatttatgttgtctatctttaaatttaaacacctaacatttgaaaataacctttataattcttaaatgtaatccaggccctggtacttaatttttatattttcttaagagctaaattgccaactaaagtaacagttactattctgaggtcacaagtacagtcctccctcagtatccatgggggattggctctaggactcccgatagcaaaacctatggggggtcccttaggtttatgtaagtcccttatataaaatggtgtgtagtacttacatttaatccacacacatcctcccatatatttaaaatcacctgtagattactcataatacctaatacaatgtatattctatctaagtagtcattatactgtattgttctattcgtattaattttaattgtattgttattttttattgtttgtttttctcttgtatattttcaatttgcagttagttgagtttatggatgtagaacctatggatatggagggctgacagtataggataataaggcaggaactcaatataaatttgcagattttcaagtgtctgtaacgagaataatgagagacaaaatattttttgcaggaacataataataattcttttagtggtatttgtgcaaaaacttcattatagtgaaatcctgcaaagttaaaatataaagtgaaaaaaacttaagagttctatttgaaaggtcacagttctccttgcatcaaaatgcatttagagtaaggaaaaaacattctgaattttggtagctttatgggtgtcttgcaaatttgtctttcagtaatgcccctagtccatctaagtaacagggagagtcttatgtaatgcaggcaccktttatctttgcaataaaaaatcttaactatttaaatgatgtggccacttttgaatatattttgtgttttatgaagcattttgtttcagttttgcaagaaaaaataaatatggattggctatatgcattgtttttataaattcacatgctaatgtctacaaaaccaaagagaaatattcattcgttaatttattcactcattccttcagtgaaggtttgctgaatgccttctctgggccatatgccaagttcttgtcctgaagggttctggatggaacataagccattccaatacatgcctagcaagcagaagacagaggattccatgtaggaaaagcatttcttatctccccatttggcatctctcaatttttcactcattcwctcactcacttactctctcactcttgttcttgctttctttctctttaaattatcatggtatttccacatgatattattatatgtctgtttttagattatgtctttatttgcacagatcttttatctcatattagaccataacctttttgagcacaagaatctatgactaatcatatttctccatgccttatattgtctcacatgattccttatacttattaagcactatatgtgtatttattgaatgaatgaatacttgaatgaatgaaagaaaagagtaagggttagttaatatagtctgagaagaaatcacaaacctccatcccccggtgactgggctttataggaactatatgactgagataatctattaaaatcgaattatgtaaggatccaggccattatgacattagcttagaggtagagggctaaaatgagtgagcagaaatccacactaatgatgaggcacatggcactgcattatgatgtttgagatccactttattttttatttgattttaactatttaaaaatcctttattatttttatttaaaactttattttattttaaacttattttaatatatttatattagagaaggtatgaattgtgtatctaaatgtataaaactttttaaaagaatattaaaaataagataatcatcccttaatttggtgattttccccctataaattgcaaaatgttatgtgtacactttatcatctaataacttccacaatatctgtgtttttcaaactctttagtgcttcctagaagcactgctcatgatctccaggagtttgatgcagctgccaaattagcttttccactaatggactcttccctggacccttctgtgttaacctctgttttatttttgtagtgccaatgaaaagtgatgtttctctttaactgaggcaaagcaaaatgccccaaagtgtgttcatttacatgtaaatctttctgcacagcccagtgcctgctaaattggtactattgccaggtaaagtgatgagacctaaattgaaactatggctcaaaagcctctctaatcttggtgctgtgtttccaaatccgtttcttcatactgtggtgcaatgaggtgcagttgctaatcagtatgaaaacatctcattcttcttttcctttttttaatccccttggaaattgtagtcacaacagtccactggagggtcttataataacactacatcagttaatgtttttggtctaggtttatataagtatggcagaatgaaaattacattatattaaaaattataaagcaaacaaacataacagatactagtgtttggaattgttatagaagcaactggtggaaagaactctccatatctatgactgatagggtattttggtctcacagagaggctctatatatgatttccctgaacattggcatttatgtttgtgtgtgtgtctcatgacttctaatagcccacttgctttccaactggcattttcttccttactatattgatgtagtcttcacattctttataaaacagactacgtttttgacatgcctsatctaaaaatagtttgtcctgctttggcaggacttggatattgcagaggagcatttcaggatttgctgaacccaagcagctgacatccaaacaggctttcaaatgatatgattacttactgataagcattgaatttctcttcaacttcattactaaattaattgagactttggttgagattatctcccaactaaatgaagtgatattctgtcccaactaaatgaagtgatattctgtatgcatctgccaggttgcataaaaatcttgcacctgttttagttcaagtaacrttttttaaagaaaatccttcagatgagtttcattttatagggatgaggtmttgctatgaatttcttcaaaatttatatttatatccacataagtatgaaaaaaaatatactgtttcttccaccccttcatccatttatctatccatctatccactcattcatctgtccatatcatatccatccatcattattgaatatcctagagatcttgggtgaatgaaaccaattccctgattttacaagcaagccattttaaacaccatgttcctagggtggaattatgtgtaggatatgatgagagtggagggmaagatcttctgctgttgctatgaggctttatatagataacgtcatgtttaagctggccaggttggtcttatttatatattgctgttatttcattgatattaacataatctatctctctagattgtaaattcaatagagaataaagacttctcagggtttgtgcaggcttgcgtattagtaaaagtttgaaaattcttgagagtggaaagattggcagggaactgaatagattataaccaagtctatgtatttacatttgtaatgaaaatatcataataagggatgagctaatatgtaaaggtaaactaactcattatttcaaatttttatatgacacaaacataaactttaaaagtaagtctgacaatacagctcttatgcaataaaatacttcttgttgatattttaataaagatcaacttctaaattttatgagcacacatagattatatgagggtgactaacgttgactgattggaggtaatattggagggtgatgtggtgaatagctcttctcagtgtcttacctatgttttttacttttagtccctctcattttttttttcacagttgcatctagcatttacaaattagggttcattttttcttactttatttcataggatgtagtatttcttttgtttcttataaataataaacaagaagactagtcatatttttgattactattatgtgatcagccacatatatatgtagacaattttctttcaactatggctttgatcaaaacaagttaaaaaataaactacataaaaaatgtgaggtgttattcttgatagtgtatcttgtctcattaacaatgtaattatttgcttttcactcacagttcaaagtagatattgaatgcaattaaaaattaaaaataattcagaccatatttggacagcaaatttgaagctcaaggttaagatcttcagtatcattaggataccctacttagagaatatgttttaactcctttgacatgtcttgatatttataacatacaaggcacaaatataacataatatgaaggagtttcatgtaattattttaaactggttttcttattattagatcctatcatttatactgctaatctataacctgaatgatataaaatcagcaatgaaggaaaggatgaaccttaatttataaacgtagtctaggcagattttttatgcgatacagccttctctatgaaaaagcttaatcttatgcttttatgagtaatagcaataatttattatttctcattctatttactctgttatttaagtgtccattataaaagttatcaaagtatctgttacccaagtagtaagattggaaaggcaggactgatcatgaatcttgtaaaaatatatggttaaggaaatctaatgtaggatcaggaaattttctaatctaaagggtgaaaatgattttttctcatggctgagggtgttctgctgtgaatgaaatttagagtagaattataaacaatatttaaattaatatatattttaatatttggttctccacttcagatttagctttaaaatgtattcatgatgttgtgatagtcaattagataatataaaaatttttaacttggtcatggttagtgactgttgcccaacaggagcatctttggtattttcttcctattatttttccttctctgtaagtatttgtggaattctcactccaggtgtagatttttgccaaccatttgaggataactcaaggaacaatacatatgaggatagattgcttaaatctctgagcttctattattattctgaatatatgaataccaagttaaaagtgataagtgaatttgagattagttataaatataggtgttttaatatatcatattttgtgcttgtttataaggaaacactggagctcctgatcctaccttctccctgaaaagtgttgcaaagcaacgaacctcttccttgaactggcattgaccttggaaaccattatatttctagctgaattgactgtgtccctctcccttcctaatagagaactgattagatttttcttatctttatttttattcttttcatgtgcttttaaattttgctttgattacttacattttaataaaatatgtgtagcttttgcaagtaaatcagactcttaaaaagtatgtaatgggaaccatcccaatgtctatggggagaackaatgtattttgaatgccttggctgtttattttagtgatttcttaattatttattaagggacatgaaactgagacatatatgtattattgatagggtagagggaaagccacatggttgcttaatacatgcacaagttcttattgtgaaactgctatcactgtctagtatctgaataattcttagcttcttctcaaggaaaattaaaatgtacaaattctaaaaaataaaaacaattcacatataactcaaatgtagttaaaattagcacattgttgaaatgtgttgaggtagacaacgaaacataacacagtgggatcaggttattctgctttagtgggggtggccaggaagataggactatactttttttttttgcactgagacaaatttcctagatggtagccccaagaaagaacattgaataactgattggaactgtttcctaatcattatattgattgcttggtcttcatagtgtattaaatgaaaaggcagctatttggcttatatttgtgttatggtgctaagcctgcactttagacactttctttttacttgaggacattagcaatgtggtttcgaataaaggaagtttttttttttctcaaattaggtagacctatggatatttaaagggattcaaagtttaaaaggctgagtaatgaaggtctttataccaggatgcttactggtcccctgatcacacttgcctctcctgacccttaggtgaacacctgcttttttgtgagaacacacaggtggcttctggtagaactcatgactatagcagaaatgcctgtctggttcagcaatccagttaatgcctcatgagcacttaatttcattgatgtagttaatataggaggtgggtggcttctagtcaacaaaatctggttagttgcttgactcataatattgtggtccatcccccagactacccagtttagaacatgcctccaatcagtttcatgactgatatctaatccttaggatgtcttttaacactcatattcagaaatcctcttctctatgctgatgtagaagtactttattttatctttagaaaaaaggatgtatctttaggagaaagggcccttcttggaaataacatattcctatctaattcctgcacggtttccttttttctcctgcgggccagctgakttattcaaagaccttagtgctttcctaggaggcttgtgaagtaattgagaatttggtaggaaagaaagtgattctcaacttcttactatagtaaatgcatttctagagattatggccttaagtatagccctttgcaaaatctgcttgggggtttagggttttaaacttatgccaggagtgatattgattaggcattttctgccttgcctattagctcttccttctgctcagtgctagcgaaatcgcaatttgtgccatgaaaatcaccaaggcaataaatctagcacttatgacttcaatgcattattgagaagaaagcacagatggactacaagggagcaagcagcggttaaaaccaactaatatatttgataattaataaatgtaacaggggaaatgaacagcaaatgaaggagtagcagatccaatttttaattaaaatgtaatataaaaattctctgttttttaattttaaaaaatcctctctatagcattgaaagaaaattggttcttgagaatgctgactgcaatctgcaatcaactttgggtccagcttaaacttctaacaaaggtagcctaggtactcctattttgtgaacattaagtttcaggaactgtgttatgtgctggtaattcaaagataaaacatgaatactgttttcaaggagctctaagtctttaatagggatccatgcatataaacataactagtgagtaaactagtgaataaacagggctatatactggctccagaggagggcatgatcacctctgctgggctaggatcaggaaagacctcagaggggagactcttgagctgagtcttgaaggaagacaaggaactcattcagagaaaagtaggaagactgttctaggcagaagtgcagaggcatgagacagcatagctggtccaggagactagaactactcaaaatggcaggagcaaagaatgtatatggagcaacagtgacaggtatacatatgagaatacaggcatagcaaaatggtaggcgagagatgatgagagcctgaagtcagatactatcaatagggttggaaacaatgggtcaatttatatcatttattagattggtgaccttgggcaagttaattaacctctctgagccacaatattggcactgttaaatggatataataatctgcatcttacagttttgttgttagtgctagagaaaatatatttgtgtttcctgaaatagtaagttctcaataagtgaaagagatgattgtattactactgattgattgaaaaactcctcatgtcctttctttttctacatatttcactgcttgtcactctcatatcactgttcagtatatacctgaaatgagcttagagaattaagcattttaaatgccctgccaacagtcatttctccaataattattactgtttccacattaatctgtatttgagatgcaatcaaattgatgtgctcaaaaatgtataagctctgtctgtcagaactgaaggagagagaaacatttagacattattaaaattgttggcttattactggaaagcatcatagtttaagtgccaaatatccaactagggtaaatataagggactgaggattctaatataggatgctgatttattgtttagctttaggtaagttacttcacctcttctttgtttttttttttgttgtttttttgttttttttcagacagagtctcgctctctcgcccaggctggagtgcagtggccagatctgggctcactgcaagctccgcctcccgggttcacgccattctcctgcctcagcctcccgagtagctgggaccacaggcgcccgccaccacgccgggctaattttttgtatttttagtagagatggggtttcactgtgttagccaggatggtctcgatctcctgacctcgtgatccgcccgcctcagcctcccaaagtgctgggattacaggcgtgagccaccatgcccggccgttacttcaccttttctatgcacatctataagatgatgaagatgatgcctattgaataaatccaataagcaagcttaagcataggaatgataaataataaaayataaatttcctctctgaggagaaaaaaaaatctcatgtcagtagatgtattgcgatgctgggacctaacattctaagtgggaattatatgcagaattcagttttttcattaacatcagtttatttaaatgtgttcctgacttccctaattgtgtcccatacttcggtagttttgtcttacattgtaaacagcagattctctgtgaaaggtagaaattaacctgctgatacttctctttccacccccataagatactgtaaaataaatggaaaaataccatttcaaaacccaatccagcagaaaatggctctagcctgcaaaacaatccagtagctcacgtaaaaggaataattttctttcttgagaagagggaattttttaacgaaatrcaagcacttggggctgtcaccccttctggttcttcttgccatgccctccctgcctctttggatcccagcaagaggcaggttaaattctgcatgctgtaggaagactttggagaaaacaaaacaaaaccaaaaccttgtacaaccaccctcctctaactacagcaattttttattttactcctctcttgacacttcttacatgctgctgtgtgttagtgactatctttgtgtgtgtgtgtgtgtgtgtgtgtgtgtgtgtgtgtgtgtgtgtgtgtgttttgtttttttgagatggagtctcgctgtgccacccaggctggagttcagtggtgcaatctcagctcactgcaacatccgcctcccgggttcaagagattctcctgcctcagcctcctgagcagctgggattacaggtgcccgccaccacgcctggctagtttttgtatttttagtagagatggggtttcactatattggccaggctggtcttgaactcctgaccttgtgatctgcccaccttggcctcccaacatgctgggattacaggcatgagccaccgcgctgggctgtgactatcttattgttatgttttatcttcctaattataacacagatgcttaattgtaatactttgccttttctattgtttcctctgatcctcgggagatatttgcgaatttattggctttattggggttttctaaacttagaaataaatgttttatgtagattgctcatctgttagatattatatctaggaactgccctatcgctgtgttccttctgcaactgtggcagagaactggcagcaagccaagccatggcttacatggccatgatgtctgtatttatgatagtttcttaaattcctaggactcttccccttgttctataacacagagtttcttgtgcacagcgtgtgctcataagttaaccttgcatacatccccacacaaaaaatacagccagcagaacatcagagaaaccaaaaggggaatgcaaatcttgtctctgaaacttataaatatggattattcctggtcctcccagatattatgaattattggtggcttgaaattcatagtgtacattctagttgaagtggattaagagtgtcttagaaattgtatccaaacttcagaaaactcttaatgggagccaaattatgccagtgttctaagtcacataatcaaatgaagtggtctactgcattgcattggcatattctgtctctctctgcttttgcattgtcaaaattacaagtgtcctgctaaccttgctctgaagtttgagaattgtgatgttaagaagacatcagagggccgggtgcggtggctcacatctgtaatctcagcacgttggggggccgaggtgggcagatcacaaggtcaggagattgagaccatcctggctaacatggtgaaaccccatgtctactaaaaatacaaagaattagccaggtgtggtggtgggtgcctgtaatcccagctacttgggaggctgaggcaggagaattgcttgaacccagggggcggaggttgcagtgagccgagattgcaccactgcactccagcctgggcgacagagcgagactccttctcaaataataataataaaaaaaaaggtatcagaaaaaaatttataaatcataataattgccttgactttgttttcctaaataatttaaggggagtaacattttgttggtccctctctcaaatatttttctttctgatcattttctttctcatttccttacagaacaaatattcacacacataaactttagagcaattgtgctttagggcttttgacactgtaccttggccagttagtaggcactatagtggtacagtcttggaagtacacattaagtctttccagaacttgaattgggggaagatcactcttcatgcccatttgaggatgtttactgagatcaagcaaagaacctaaaagtggtgttcttttatttggagactttcagaatacctttgttagaggttattactcctgagagagagctgttaagctgactgaagtttgggtaactgggattgacttggtccaagtatgaccctggtctgtggtctagttaggatgtatcctactagctcagaattatccaaagtaacagatagttacacataaaattgaactttctaagctgttggtgagatttgtgttgtaaatcacttatattctctctctgtccccttcccttcctcctctgttaatctagaaatctagataaaaagatttctatcttttctttattaattttgtctcttattagtaattttctctctttattaattcattcatttaataaatgatcattgagtatgtataatatgccacctactgtcttaggtgctagtgagatgagcgaataaatagaaatagatattatcataaggggatacacattaaacaatagttatacaaatataagattacaaattttgatgttggttacagaggaaaaatacagggaaccagtctttcagggagttgcatcatagaagattttcctaagaaagtttcacaagagttgagatgaatgaatcaagtagaaagtgggaggaagcatgcttcaagccaaggtaacattgtgcaaaggatgagaggcaggcaggggacagagggtccagaatggttggactggagactacagggatatggcaggatgggggagtggggcaaagggactgggtcaggtgggactcaaaaagccatcagggccactagttccttgtggaccattttataaatttttagggattttgaaggatttagactttatcataaagccagtggaagccaatgaaggatttaagcacgagagtgataagaactggtttgcattgacaaaagttcattctggagaggagggacaacaaaggtccagagcgaacatgtgcaaagctgttcaaaggctactggaagatccatgagagaagcaagatggcagtgtggatgcagggagtggccacagagatggaggaaatttagcaggtttcaggagtgattgaggtagagggtcaggatttgctgaagggattaggaggtctcagaggaatgtttagatttctggatgcacaaatatcttcatgttgggggcgttgcctgaaacaagagacaatgcaagttgctttggcggtgagtgtggtgttagacgtgataaagacgaggagattttgacatagtccaatggagatgtcatggaggtactttgttcaattctagagctcaagagagaggtttgggccagaggaattagtatgaaaaacagaggatatgtcaattgattttatttcagtagagcatttttctaaaggtaagttgaacattgcttttgaaagtttctcttagtttatgttgtagtatttttattttccccgttacctaaatgtacaaattcagtcccctgtaccatgtttggttacctggaatttcattctatccaatattattttcatgccttatttatctttggtttgaatgtaatatgacagtgaaacctgttatttgtattcaatttttaaagaaacgcttttagattttaaaagtcaggcttctctatgtkctcaaatgaatctgacttactttataagaagaagggcttggcattctgatggagtcctggaaatagrttcttggagacacagctatgtattggtcttcctacatttgtctctgtgattgtggattatgatgcaggtggactttgctcctttcccctgtgctatgcagcaaagtgaccttgaacaagctgccagccctactggatcatgattactcatattttgaggagaggactgaagtaacatgatctctgaagttcattttagccttaagatccagtgaaaagttagcattaatcctaggaaaatagttagagataaggatggtggagtgcagttattttaagtgctggaaaaattgtagctctctggaggaattgaatcttctgaaattattcactttgtaatacaggggagcttaaaaggtccaccctcccatctttctacatatacttaaaggcagttaaattgctgctaaaaatgtgaaatggaggtgtgaacatttctagaggcaattaagtagttctgcmttttactggtaaattctatcattcttaaaaaaagagagaggtttatataaaaatggagaaaaaggaaattgcatgtgcagatgtaaaataccatctgtgcttctggattctttccatgctccacaccttcgttgaaagaaattgttgattgaaagctcagattttgctggctagttataaaagcttcctgtgttgcttatcatgcattttaaaaatagatggctttgaatgtgtgagttaatttttagcctcatttgccaaggcctcctaactccagaagtatgcttttagtgaacccacagttcagttcatattcaatgcaattaatagtagtgggcacttacgaggtgccaaacttcagaatgtcatagcttccttttcctcctagtggtaggttgggcccatctgatttcctagactggagcactttgtctatatcttactttgagaaaatgttaaacattggcagaactgcaagtatgtagtctcgtgacgttggagaatcttaagtatttccaacttcacctttcttatctcttttccatcttaatagtggcaggtgtcctacttgtgcccagacccaagtcaactctgctctcatttacctcttacaatgaatttaagtaaaactggcatctctctcagggtaactcttttcctaatggtggaatgaaatacttgttcttgttaatacagttttaaatgtaaccattgctttacctacttatggataaagtaggctttgatttttttttaatttaagatttctgaccattatatttttctttaaaattgttcagttaagagcattttaaatagtagtgtgtgagtgtgtgtgtgtgtgtgtgcagaaatccttagaagcaacacaaaacaaccaaatttgtatccctcttctctgagccttagtaactacaaatgtatctgaattgttcaggtaccaaacagctctaggaaacaaacttactgttagaagctgaagatagctttctcaagtgccaaatgcatctttaagtaccaaaagagagagaatcaattacacagatattgcttaatatgcaaaagggaggtagagagctacccattttcagcatgatgtctgtgtgttaaatatagaccattttaataggtagcttgattctcaaatgtgtgcttttcatacataaatgaattataattcataatatacatacatacataaataaattatgttatgttcataatattaagaatgtattttgtggttttatatacatgtctttagctggcataagacagaatctacacagatttctctttgaataatagaaatgtctattcttagaaggacattttctctagataaatttgtatgaaaagagttaaagtgggttgggcgcggtggctcacgcctgtaatcccagcactttgggarcccgaggtgggtggattacaaggtcaggagatcgagaccatcctggctaacatggtgaaaccccatctctactaaaaatacagaaaattagccgggcgtggtggtgggcgcctgtagtcccagctactcgggaggctgaggcaggagaatggcgtgaacccgggaggyggagcttgcagtgagccgagatcgtgccactgcacttcagcctgggcgacagagcgagactccgtctcaaaaaaaaaaaaaaaaaaaaaaagagttaaagtggcagctgggcacggtggctcatgcctgtaatctcagcactttggggggccaaggcgggcagatcatgaggtcgagagatcaagaccatcctggccaaatggtgaaaccccgtttctattaaaagtacaaaaattagctggtcatggtggcacgtgcctatagtcccagctacttgggaggckgaggaaggaggatctcttcaactcgggaggaggttgtaatgagccaagatggcgccactgcactccagcctggagacagagccagactctgtctcaaaaaaaaaaaaaaaaaaaaaagagttaaaatggctacttggcattattttgataattcagtagatctgagtgtagctgtgcgaaataaatatctgtatccaaacctagaaactctgctattagttacattttgttattggtcaaaagttacttaacattttccaagttaactcatcagtaaaatgtgattgaattgtgagaatgaattcaggtaattgtgaaacaaagacttagaaaggatcaaaatgttcttttcattatgcttagcatttttcatgagaattttggaagctttcatttcatttttttgatctctattttgtttatctgtctttgattttttttgatcttttgttcatgtgcttttaaaaacacctcactagataacttcttttgtatctctattattttttgtgtgtgattctctcgtttttttcctctttattttgtatctctgtttttttaatatgactctctcattttttctctttattgggcttaatcatagcatctaggatttttgttgatacttgtttaagagggatgttgacaaacgagagtttttactgaagatgatgatcaggatggcaaaggatttaaacataaaatagaagtttagaatttggtgatatttagactgaaggaaaaacatatttaagggagataatcttaaatagatgaaaaaaagcaatatggttgaaggtaaaatactgttccaggtttcaaaatttagccaattaatggaaaatatgggagagtcaattttgtgtcartagagttttaaaaactaatcagagctattaaaatgtaatagctttgattttcaagtaggtcataggaccagtttttctgtacaaaccaaataaattagatatagttcctagagctgtggaagcaacaaggactaaaagaactaaaatttcagaagggaaaattattccaaggcatgcatgtatttatttccctgagggcatttgcttattctgagtgtggtctgaggactggactgggcctaggcggaaggtgtctttggggagtaagaaaagttagcaaaacttttagtgatactgcaaggctgggacaaactggagacttgagggatctaaaacacacatctttctccaagggatgtttgctgtgttttgaggctgcataggaagccaaaggctaggctaaaagcttctaaaaggcagagcttccaaaaggcagtagaattttagtaggaaataaacaaacaaaaggacttggcagcctggagacaccaaactcaaacataccattgaactctttttgaagatatttaccaaattttgtagctgttagggccctaagataaagaaatgagctgaaaacttctgaaagagaactttttcagggcccagaagataaagatataccaggctttcaatcaaaatccaggaagtgtcatggcttacaagtatagataaacaaggggaagactacattccactaaaactgcaatctagccccaacccagctgagtccttggttggcttgagacgtccagcctctgtctcttctgcttaatatcgaaagtgagaaacctgctctggtggaagatatcgtttggaattctgtagttcttctttaactaatttctatcatacaataaaagagtacgtagacatacaaataggtgaaactacatgacaaataatcaaaagaaaaagtatacatttgaagcagatacatagatgatccagatattacaggtaactggcaaggacttaaaaggtggactaaaaaaagtgaaggaaaagaaaattcgatwagagaagtgggacacatagaaaataatcaaacaggttgggcatggtggcttatgcctataatcccagcactttgggaggctaaggtggaaggatcacttgaggccagcagttcgagaccagcctgaccaacatagcaaaaagccatctctactaaaaatacaaaaaattagctgggcttggtggtgcatgtctgtaatcccagctactcaagaggctgaagcatgagaatcamgtgaacctgggaggcagagattgcagtgcgctgagatcgtgcacagcactccaacctgagcaacagaatgagactgtgtctcaaaaaaataattaataaaaataataatcaaacacatattcttgaactgaaacaaaacaaagtcctacctctatctgaaattaagagtttgctagggacatatgataaattgggcacagtataatacaagtttagtgaactgaaaaaatactcaaagcatagaaagaaaaagggaaaaattagatattgtgtaaatggtatttgtgttatgctaatttttttaaacataagtgaaaatgaagtcccaaaggagaggagagaatacacggggagatgcattttttgaggagttaaggccaagaattttctaaaattttggaaagaccgccacacacaagttcaagaagtttagcaaaattgaagcaggataaatacaataaaaacattcatagggacatttcagtaaaactgctgaaaaccagataacaagatcttaaatgaagtcaaagaaacaaacaaaaaaaaaactttaaagagctctaagtacaagattgagaattgacttaacaaaagaagtgagaagataaatgaaatgtagtgttgagagaagataactgcaaacctacaattctgtaactaatacaaatatatctattgaaaatatcgaaacaaagacattttctgaccaaaaaaaaaaaaaaacccaaaatacaaaaacaaaacaaaaacagagaattaatcagtatgaggcctgcactaaaaggaataccaaagggaattgttgtaagtagaagaatgaccctaaatagaaccttggaaatatctgagtgattgaagaatgctggagagtgtaaatgcattttatacaaatgaatgtgaactatattgaacaataagagtgatgctttgtgaaatttaaaatacatacagaataatatgtgacatcaataccattgcaaaagtaagaagtgataaatgaagtttaaaacttctaggtttagcaattctgggaagatactaaaagtaataattatatagaaccaactcaagaatgcatgttgcaattcctcaggtaaacactaaaagaacagtaaaagaaagtgtagttagcatgttactacaaataaataaatggatgtttgattaatgcagagaaaagttatgagaaaaaaagaatatagtaaacagggcaactaggtaggaaatagaggaaaacatagcagaaaaatctttgtaaccctggagtaggcaaggatttcttttttttcttttctttcttttttttttgagatggggtcttgctctgttgccaggctggagtgcagtggcgtgacctcagctccctgcaacctccgcctcccgggttcaagygattcccctgcctcagcctcccaagcagctgggaagacaggcacacgccaccatrcccagctaattttctgtattttactagagatggggtttcaccatgttggccaagatggtctcgatctccggaccttgttatctgcctgccctggcctcccaaagtgctgagattacaggcacgagacactgctccccgccacaaggatttcttaatcgggacacaaacataaaaaatatatatatagagagagattggtttatattaaaactaagaacttttgttcatcaaaacataccattaagagaatgaaaagacagtcacagagtgggagaagatattcttaatacacacatctgacaaatgactcattcagattacataagaactcctgcaaataaaaaagataaagacaaaagacaatccaataaaaaagtgagtaaaagtcttgaacagacacttcacataagaggatatccaaattgcaatatatatatgtgtgaaaaagaacttaacttcaacaatcattatactaatgcaaattaagtcaaaatgtgataatactacacactgacgagaatgactaaaatgaaaaaggcagaaaatatgtgttggtcaacgatgtagagcaatggaagttctcatggtctgctagtgggtgtataaatggaaacatctttggaaaaattttgagggcatctacaatgcatatcccatgacccagtaattctacttctagatatacatgcaggagaaatatgtacacatgttaaccaaaagatgtacaaaagtgttcaaacagccctttttgtaatagtgccaaaacagaaatgctcatcaatgggtccttaggtaaaaagaaatttgaatattcatacagtagaagtatacagttgtgagagtgaatgaatatcagccatgtataacaatgagtaaatcttataaacataatgttgagtgagacacaacattcagacacaacagagtatatactgagtgattctacttatagacatttcaaaaacagacagaactaatctatgtatttaggtcaggatagtgtttactctgggcagggactgggtggggtggggtggggtggggtggggcgggctgctgtaccccttgtaatatctgtttcttagtttagatattgcttacatagatgtattcagtttatgaatattcaccatcatgatatgtatacatataatatatataaaatcttatacttcaaaaacaagttaattacaatgagcgttttttgagttaataagcttcctattcttggaaatattcaaataaagaagttggatgattacatgtaagggagactttggaaggcatttctgcattggggtaaaagaaatgcactagatgattatccaaactctttttaattctgagattctctaatttttttaaaaaagggtatactttgatcattcatctgcatatttttcttttttctttactaatcaagtttgagactgtagcctactttcactgttgccagtttacctcccatttcctcttaaactcatgccacttcttttgtcttcttctttttctttttctgtttctttcatatatatttttacatatatatwtttttttcctgtcttgctctgttgcccagagtggagttcagtggtgatctgagctgcaacctgtacctcccaagttcaagtgattctcctgcctcagcctcctgagtagctgggattacaggtacctgccaccaggcccagctaatttctgtatttttagtagagacagggtttcaccatgttggccaggctggtcttgaactcctgacctcaggtgatcttcctgcctcagcctcccaaagtgctgggattacaggcgtaagccacaatgcctggtccaaactcataccacttcttaatcactgaccactctaggaacaaatctgatggattattttagtctttttctaacatatttgggtcatttgctgttgataactcattttattaaaactctctcccctcagcttttctgatgtcactctcattttcttcttgtctttttttctctgataattactaaaatataagaactgtccaaagttctgttcttgacctgcttctcacactataaaattctttgtgtgattttaaccactttaagacctcactcactattcacctgttgttaagtttcaaatctgtgtctctaaactcagaactctccagggttctagtcttacgtattcaactacttaacagacagatccatcgaatgtcccccaacgtaacacatgcaagactgaattcctacctttcccccaaaccttatcatcttttattattccctttacctgaaaatagtgtcaccatctatatgtgttttatgcagccttggagctattttggactctccaatccctccctttcctctttccacatccagtcacttcccaggtccaatccaccttcttttctaatattatatatccttccccccttctcttctattttccactgactcagcttagtttagctctcattatttctctaaatagtttccaaaaagatttgtcttctaatttgatactcagctgatacattctgcacaatgaacccagcatttatttctcttactaggatgttctttaattcttcacttggtgattgattacctactaatttgacacttggtttaaatgtgggtttccctgtgaagccaggacaaacctttacccaacctgccagattgaattgacacctccttcctttgtgttgccaatggaccctgtacatactttcagccaagcgtttgtcatatttcattgcatttattcatgagactgagagtatgtcttatttatcctgttgtatccagcacatagtgtgcccagattgaatgaataaaataatgaatgaatgactgcataaatgaatgaataggataattgagcttagtctgaatctatgttttccagtttcttattttgaatcacctaagagcttgttaataatactgactcttagctgttacctaggatgtactctaaggaaaaagctaggagattctttttattagataagcttggggaacatgagtctaaattattatcttaatttatttacttatctttcaaatagtcagcatttttatgcacatatttctgatctgaaacctgccaaactttgtggactaatcactggtcctgaaatgaattgtggaaatgttattatagggacaaagtaattatctttgcagcattagataagggaaaaagtgaatacgagcaaatcatttttggtgggggagggttagtaactttttgcttagtrtatggtttattgctcaataaatattaaacatgcagtattaaattaaagtggttactgaattattccatttgtcataaaatgattctaatacraacagacaaatatataaatatacacacatacttaaaaattgtttcacttctgtggtatatttctccatatagtttgctaagatttattatatgacatgcttatgtcatatgtggtttttattcacatttatgaatacataatgactttctgggaaaaatatatccagatcacacaaatatactcaaagcattttcattcagaagtggttgccacttttaaatctgagattctctgaattgacacataattgcctataaaaacataaatttcactctgttaaattaagagacaggattcactttaaagagggtttgttattcagccaaataaatattgctcatgtccaaacttccatattaatttaccattacccttcattttaaaattaaattaaaggcagatttttaatataacatcactatttacatttccttctgctagatggtaagctagaagagatgtgtctaagtactaaatataatatcgaatattttagttcataaacaaaactttccaaaatgaagaatataaagagtagaaggcagaaaggaagagggataatatttgtttaacaattattcaagatgagaaagtcacattaggatttttttattatttagtgatgtggggtttcagtgtagctgcagaggttgtcagtctagacttgatattttggcttctgtaatggttggtgtgtatgtaccttttttttttttttttgtcaagaactgcatgactaactgtatcttaaaaagcaagggacttggccaggtgcggtggttcacacctacaattctagcactttgggaggccaaggcaggcggatcacgaggtcaagagatcgagatcatcctggccaacatggtgcaaccctgtctctactaaaattacaaaaattagcttgatgtggtggcgcacacctgtagtcccagttacttgggaggctgaggcaggagaatctcttgaacccgggaggcggaggttgcagtgagctgagatggtgccactgcactctagcctgggcgatggagcaagactgtctcaaaaaaaaaaaaaaaaaaaagccagtgacttcagtgggcacagcagtgtgctatagggaaacgagcactggtgatggtattgagaaagttagatctcatctcagctccctcatgatccccagatgattgagagaactaaaagtttcacacagaccctaaataacctcatagatcatcagttctctaaaatgagcaattattatttctaataatattttgtcaaaatatgacaatcatagttgacatctgtatacttggtggcatatttttttttttgaatggcagcctgattgagggtggtatttccttttcacacttaacttgtctatatccctcttttagttgaggtcctactgaattatgtcaaagacaaaccccaaaatctcactggtttagcataacttgcacatgtgaaattcaaaactggtgttcctggtcagtaagaggctttccatttggtcattcacatatatgcctcctttatcgtgtggcttagttttttatctaggaccttggagttctcttcccgtggctcatgcttggggaaagggcatggaggaccaggcactggagaattttattggctaagactggaaatatcccaccacttccttcatgttagaatgcagtcatattgccatttctaactgtaaaggagagtgggaagcttatactkcctgtgggcccargaagaagatggaacagatgtggtgggaagctagctagtttctgtcataatacttttcaatatttattttattttctctgtcacaagattagaataatctactaatttatgtaaagggttgagaaaataatcaatgcccttatacctttattaattataaagcctcctcattttcataatatatttttattgttatcacaactctgtgaagataggaattattaaccttggtttttaaatgatgaaacagagactcaaaggagttgcccaaggccatacagcatgtgtatggtcaacgtgggatttgaaactgtgtctcccgatatgtgtcaaatacsctttttttctaggaaaaaataaatacatacagtttatcaggtgtcagagggaaccatggtgccttgaatttcttacctcatgtcataggatcatgggcattgctctgttttcgggatgtcacatgtctactgaggctttatgggacttgctatgtaggaccataagtgttggtggyatatggaagctgtggaaattatatggctcttttataactccaaggagggtctgggcagttacatgcattttctttattgaaagttcttcttgcctcatataacttttttctcctcagaactagcttaaaggtacctgcaaatayktacatataaatttcctagagaattcatctgtccctctgactgaaaagaagttaccacatctaatgtatgtgaagtaaaagtgagattgaaattactgtcatcttccatacctaactcaagaatattatacacttaaatttcaattaatacctcacacagttcatcttaactgaatttctgactccccatgtaacttagcaaaacaaacccttaaaaaatattttttctttgccttctgtgaataaccttattgacatggacagaaattaaaacacaaatgatgactaaggggaagagtcaaaattatttggttctaattataaatgttatagagaaagcttgctgactaataattcagtgtctatagatgatgtaaaatttattgtgaacttaaacatcctttaattctttttataataatttattctaaaatacataaatttatgaaaattctatagattttggtaatttcggttacactagtactagcaataaatatgctctgcatattttttgtggagcttcaagggatggatcattgtagaaaatgaaattaaacctaacaagaatgctaatacatagtgtagcttcagacacacagcagactcagtaacccaagacttcagagattacaggacaccatcatattgaaatatgtggaattttaacaattcaaatgttctaatgatgtaagatgaaagataagtagttatcatattcatgaaaaaaacaagttgataggctaacacatctgggaagatgactcaagggctaactagaaataagtgcactattaagtgaaaagctgaagcgtcaggtatattgtacctgattttgccaaagcacacgtgcatagagggagatgactctaaaattccatccaactgactgtgttacttttgttgtgttgattagctgacgagtgtgtgtgcagaaggtaaatgcacccataaacatatcaaatcagtttccttctagaggaggccagagtatttgattgattgctagcatcatccttttagaattttctacctttttaaagtctttgtgggattcagcaacttagagatcttctccaagccacctctcaatagaaatttctactgataagagagtaygtaagagtttatatagagtacaagtaaccctcatttggctcatgccaattatctgtgtgacttcatacgtattaggtgtctaagtatttattctcgaaagagcactggtcagtgggtaaagccatgtcatatgcattatctaaaactaaggcagatattcactggtcccaacctttcattggagccacttcatatctgacagtgataacctccccatttaaacctggtaggtcctctattacctgcctgttcgtgccagctggagtgaactcttgaccctgcctcactgttggaacttggagtactcataaccttttctttaatgaatttaactcctgattgagacccctaactttttaaaggcatatatttttatcacattcagctttatctagtttgattctcagttttgtcctatctcaggctatgttgttccccaaaatcatttaatgcaacaaatgtgaactaatacatcttttaaaaattggacatgtgatcttgcatcagagttattataaagcacttcttactaggcattgctttaaggctgtcttgagcatccatacttggtaactgtttttcttgtaagcctgtgttaaaatatgttttcctggtagtctgataatgagttcttattggacatactgcatcggtcagggtttggttaggaaaatagaaatcacacttaatatttcaagtcagaagtaattaactttaggaaattaggtgcttacatagcactggaaagcctaaaagacaacgatcagaaaaaaaaacaaaacgattaactctcagcatatgagagagctaaaaaaactgcaggaaattgctgctgatcttggctacctgggcactgaagttggtgattttcagaagcccacacaaacttcaggtctgacacctgccttccagctgttgttggaggaaaattaatttttctttctcatctgccttccaaatcttttgcaagtgtacctcattagcagaatcaaatttggaaccatgctggtaagaaattctgggagtgtagcttccaggcaatgcagggaaaagtgtataagggggcagagatgatgcagaattgatgagacaattcagaacatttgcaaagaagaatgttaggtaaatattgaggtcatccagatgtttccccacccaatttttatattttgtgttctaagtttgcctgccktaatgccccatatctacacgcagacacacagacacacacacactttcaaccaaaaagaatggctagagaaatattgaaatacaatgaatgtacttaatttttaaagtttatcacctgcatacttaagagataatgctaaagcatgagtcatcgctgacatttagcaccactaattttaaamctatgcagattattgctttgaggaatagcactgctggcatgtacagaagagaagacatttttagtaagtgattttccttataggagcttatatgctataagttacaataaagaatatgggcttttgatcacactgagtaaggtttagtacttgagtgactttaaacaatttactcygtgggttttaacgttcttatctataaaatggggatacaaatatcatccacctgcctcaaactttgttatatgatcctaagagataatgtatatatatataaagtggttcatattagtgagttcttaaagatattattacctccccttcctatctgttcttcaatgttctttctaagggttatactatggttttggggaagtaggttgaaaaatgtgtgggtggctatttcctaagattgttttttttacagtaaataagctttcttataaattttctaatactttgcaccaattctataaaactctgcatgaatctagaacataacttgattctttatcagtaatgttaaatattctccctctcatctgcttatctgccaatgrggaatttgttttgtaatgaagctgtcctttcttattaaggattaagctagaatgcatcaactatttagaaacaaagatacatattagaatatgcacacaactgctgaaatatcgtttctctttcatcatcccttttatgttgaccagatgtgaggacaggtaaaaggaatcacttctgtggaacatcctttctcttctgctaaaacattgctacaattcacaggtagccttcctattggcccttatattcattttttgatatgcmtgttaagggacaagggaagtgcagcctccactccagctaaagatgcagaacagagataagaagagccaaatggtatggagagaagcaggagagagaaaaataaaaacccaggacagggggagttaacaataaaggaactctgataycacatctaaaaattactttgctgatgaaccaaacgtttctattttgtaaatagtgctgtcatcatgtagttcacatattggtgtagcaatatgcacctgatgtaacttcttagggaggcaaaggaaggacaataagctaatagttggggagaataaaggtaaaatgctttcattcagttcagcttctctgagtcttggtagttattaatatgccaggtatcatagaggaagcaaggtgataactctctcaaagctctgttatttttcactattctgctrttccccaaaycgttaatttttagccttagttttttttattgattgaatagaattaatgaatttttatttcaagtgtattaaaataaaatttcattgagtcactaaggaaggttcccatgactctttgaggttattttgacaggtcacttctggatgcctttttcttcattcacacagctttagtttgttctaccagtcaasataggctagtctatgctgcactgtcaaaaacaatttaaaaaaactagttaaagtcatagcttaaaacaaaaatgtatttctttttcmtgtcatatatgtacacaaccatttgtactgggagacacacctagttttaaggaccatagtcactcaggaacctaggctgacagaggcaccacagttttctagctacatcatctggaatgatgcctagactcctcactggccrtggtagaagaagagagagagagagagacaggaacccatggtaaagaaagagaaactgccaacagcacatgagatttttgctaccttaacccagaagtgacacaaatcctttccactagtgcccatgaactagaatgtgttatctggtgctgcctaactgcaaagttactgggatatttagaaaactaactggaatatttgatgagcatggctatttctgccacaattggaaacatttacttttatgtacttgagtataaattaaaatttcatgaaagtgcttcaatactagaacatactttcatatacgcttgtcttctgtttagtcacttggcaattaattgtatacatttacagaatttttttaaaaagacttttctttgagacaaggtctctgtcaccaggctggagtatagtggcacaatctcggctcactgcagcctctacctcccaggcccaattaatcctcccatctcagcctcccaagtagctgagactacaggcgcatgtcatcacacccagctaattttatgtatttttttgtggagatggggtttcgccatgttgcccaggctggtctcgaaatcctaggctcaagtgatccacccgccctggcatcccaaagtgctgggattacaggtgtgagtcattgtgtctggcctaaaaaagacatttttatcatcgtgcctcacctaaaaaagccattcttattagtgctaattttatctccctcaacatatttgtagaatcttagaaacagaaacagtgtcttctattttttggtgtccctatggcacctaaaatatttacatatcttcattgcaaaatgacttaatagcaaaataaagacatacatgctattatatatgcaaatatacattagtataaataaaagtcatggactcctaattttgagacagattaacatagctaaactgaaaagttcattatgcattttcagatttttctccattctgattccttattcatgaagaccaagtttggatgttcagggaaaccatcacttgaccatcagaagacagatttactttctcaagatcagaacaaactgactatgacaactttaaaaaaaggaaatcatttaaaaatcctttaagactcagtcattttccaaatggcaccaaatatactttgacgacatatcatccttattaaaaattttctatggctaaatttcatattaccttcgacctaaattcattcttgccatcgagtgtctcttacaatctgtctgtgcccaaatacccctccaatttttgcaattaattgttttcaattctttatttactcctcattttcttaaacctcattggtcttaaaatattattttgctttttctctgctgaaatagaagtctctaccatttttgacatcactaacatgatgtcaattcatttagctaattcaaatcaaggttctatgtatttatttttggaaaatggtgatctggctcattaatcttataatgtgaccaacttgagggcatttagaaagtggatgttatgttaccttgttactagaactctgaaattagactgcatggagaccaagataattatgactaaaggattagattctcaagactaagtggactcatttgtgtgtgcagatatttatcaatcctttgtgagaaatgtccttcttagaaggctgcattagcagaatttaaagactaaaggagggaaaacaaaatttttagtcatgataaaaataatttcttgcctttttttggtgatttatggcttacaatgtccttgacgcctgcctagaagataggcaggtgtagtcrtactaagtatcttcattttatgatcttagaaattgatatgtgtctaagaatcattagaaaacagcctagaactcagattttctggtttgtagatgctctgtgatgcagacattacaagtctagtcacgattccttagatacacaacaggtaacccttgcaaaaagagaaatagcttgcactacttgtatactgtggttatccttcatgtttctacatcagcatgttccctaaacttgtagaaagtgctctctgggcttctgcgcacagaaaaaaaaggggccttgcagggcaatggaggatgtgaatgataccttgtgaggagggatatagttcatgggccagtcactcagttctgaatatagtggagaaagggccaaagatatttctttcaaaatgctgtaatttacttcaaatgttgtttactgctaatttactgctgttgttttaaagtagtgatttacagccagaaattgtacctgtggtggactttaaaaaagaataagaattataaaatttctcttgaaaccaatgtaatacataaaacaatatgttatctgacaaaagcctagaacaaagttctctagtaagaatgatgtgatagactaagaccaaatatggtatctgcataatcccagaatacttttgtaagttgttgcagtgtagtggttgggggtgtttcatgagatgctgtgattagaaatgtgatcacaaaataatttcctaagattataggaactgtaattcgaggtattaaatatattactgcattggatataatagtgaagagacaccagcatgcaagaaaagattagttgaaagacatgacaggtcttggggacactgtacttttctaggtgtgtctatgatgtggggaactttgcgcaatcacttatctttcctgctgattgcctatcattctggaattataggaaatcacttctgcaaagtgatatccttgagagcattaccttctttgaagtcttctttgtaagaactgatttgtggggtagagtatgaactctcatattttggcttcaatctttggtggtgttttcctcaagggatggcaaaagagactgagacagtgtgaaaggatgaatagctgagagaatagtgagagtgggagagagagtgaagaagaagctcatcgtggtggtggtggtaaaatggtgatcaggacagggctgaggacccagttcagcaaacttacaactttcctgagggtgcttcttgaagtaaaccaacctcgtgttgctgggtcagtattctcagtcttaaaaaagaagtatatcctgtcatttgagacaacatggataaacctagaagacattatactaagtgaaataagccagacacagaaagagaactactgcatggtcccacttatatgtgcaatctaagaaattgaatacacagaagcagagagtagaagggtaggtagcaggggtcccagagtgagagaaatggagagatgttggtcaaggggtacaaactagtagttatgaataagctctgaagaccatgcacagcatggtgactatagttaataataacttagagtatacttgacatatgctaagaaagtggaacctaagtattctcagcacacacacacagtatgtgacataatagatatattaattgattgtggcaatcatttcacaatttatatgtatatcaaaacatcacattgtatgccttgaatataaactctttctatttgtcaattatatctcaataaaagtgaaaaagaagatttcccaaaattgaaagacaatgttttagatcagctaacttttctaaccaattagactagagaagaagccaatccaagaggaggcagaattgctgatgtagtgcttaatgactgtgactaattagagaacttaattaagctgtcaagaaggaataaagataatcagtctcagtcagttcccactcttttgcacccaggagcatgagcarattcactcaggccaccacataatccttgctctctcacttgatattgatgtaacctcatatgcaccttcctgaggtgatgcaggttatacaagtaaatgacacactttgtcttttgtttcatcctgctctagcagatttattcatatcatagttgtcatataaagtacttgaacttgctattttaattatagctcttgagatcatagtgattgaaagttactgtataatgtaattttgtgggtggaggactgttgggtttgtgtttatttttctgtcgccacttaatttggaatgcccttattgttatccttaggaatgtggatattttagaaagtttgtgagtgtcctttgatggtattcaaacctgtcctttgatgcttaagaagtacagtgtttacagatacagatcaggagtggatcttggtttcacaagcctgaagcttatacaatttgagagaccctcatgaagaaaaataatgcaaaattgtgaacataaaattagatgcaaaaatgggtagtacgagcattcctgtaatccagtcctacattgggaagactaacaatgaccaattatgcatagaagtaactgcaagccagagaaatattgcctcacccaaaccaaaggaattcccaaacatattttccttaaacacatcctagtgggtccacaggcactccagttcttgaattagaacttgtataccaaccatattttattaaagctcagttaatcaactcttatgtgatataaattccatgaatgggcgacagtatgtatttcaggctgtaggtagactacccttttattttctcagaggacataaaaacgtgacattgttctttccaatactttacaagcattcttcatctccacctcaacaatataatatacatatattacatgtggcaaaagaacataagaggtgaggcaagagtacagtattatgctcatgaggaaacacattatcatcagtgtaaataaaacctgaaaatattcctccttgaccagaattcccagtcaataactaaatctatattcatgatggattayacaacagccatttacagtggcaacttatcattagggatatggaggttgttggggaaatttaagacacccctgatatcmttatkgcttttaagaacctttgaggtacatctttcatcctctgcccactgttagctctgaggtctgaaattcccaagccttactcccacaaaaataccaggaaattcttacaaagaacaaagcccatggtaagtgatatcctattcatcttttctgaagcattgtctgccttcaaaatattgtgttgattatattttgggtcatgttaagtttttattgcttagaaaattttccataactttctagcctgcaaatggcattgtctcctttccagagctgcagttttcctttttcattatcttagtctgtttggttaaaacaacacctacctatttgctttgttaattatccctttggacaggaactgtgtaaagttctgttgtgaatctctgtccatgactgctttctgtgtctatagtttgactgctctctttttactctagcctcataaaatctttgcttaatgagtttgttccaataatatgaaaactcaatgggaaattatgagaagttttaatacttgtactaatggtgacacctatggaagggataaaaaacaaacttatgttccatgtggggtgccacattttatgtggaaagttgagatgcaaagagcctatgcagctgtctcaaagatgcgtaggtaggaagcaggagaggtggaatttggacccaggatgtgctgactctaaaatatgtcatctttcattttcactatttctatttgataaaataaaaactgcaatgtcctggttaatgagtctctttataacgaagtcagctatattttatttttaattaagatttttggaggaaagttattgtataaactaagggggttggcatatatgttagatttaacattataatgacagtcatttgtaaaacattccctgtagttgctataatgtactaacaggatctcttgggaagtgttggactccctacctcacaactacttaaaagaagtattggtgaacagtttgggttactgagttggtaccattaagagagataagatctctccccaaagacrcctagaaaattgagaagtgttgtacttcgattgtatagaaacaagagtaagtggtgccagatctcattcttagtgcctctcccactttgtgacattgtttctgtctcccgccattggaaatactgcatcatattgaacctggaaggaagagtggtaagaaaggaatcatatgagcattgcccttttctattagggaaccaataaggcattaatagccaagcatttactttaaaaagtcgccattgttgaacccatattagtgtattttgggggaacttcatgctataatgaagcattaggccagagattgaagaagctcagattgacttggtggatcaatggtgtgatcctgctgtcctcattggtcacttagctttgtgtgacacaaaagcttacccttaaaggaacctataggtcacatctctgcttttgttacatttcagtacttttattctacatgtttcttcctgatgttctggggtaaatttttatatctccacattgttgacaaatttatattattggggtacagcctttttatttataaagttttttttttaataaccaggaggcactgactgatcttgaagtacctcctgaattatcattgccttcttacgtgaatatgtggaattataaaggagcgatggatactaagctgcttacttttgaaacggtaaatactaagtgtctgtaatctgcaaagatggacagaattaaggaaactggtcagtgggctcttttagagatatcgtgtaggggagggagttacttttcctaagatatatggatgacataaggtcattagggaaggttagccagagtctcattgaccatttgggaggtaatcatgacaatatagccctttctagcacaagtcatagatatacaagtcatgctcatttacatctgtggtcctcggattttgttttggcttcaaaagattaatctcaatgggaaaatgagtcaattccatcttgcaattcctttagcagaattcgtttcatactccttttctccattgcttaccaccatttattttttcatttgtttttgctcttcaaggactattatttagttcctcaaagatattgactggtagcatttccaggaaatttacagtttagaaaaggatcctcaaagagcaaaaagtgcttcagatgaaaacaaaagaatttatgctgtttgtgtgatagataatggaggaactatttttaatgctaactctatttcaagcttcttcaaatgatatgcatatagatactgactgatgggcagcctggcaaatataatctaaaattcttagtatttggttttgagtacattataaaaatgttcttcaagtctgccagaaaataagaattactagagatactcttaaaaaaattccaacttcttctatctcacctcagatcaatggaatcakatttttccagtaatgtcctgcaaatttgtatttgtatttgtatagtgttctaagattagcgtatttggaaaacactgcatcctagtgtgtaggtagccttattttctcatgcttgtactaaagttaattgtgtgaaggttgaccaaaccttaatattctaaaagatgattggttcccagaaaacagaatactatgataaagtaattatattaccattacaaagcagtattacaaagttcttcatgttttaggggatggtatagctctagcttttgtatgtgttatagactaaatttctatacctgctctttaatgttatttttctttacaactgaaacacatagtcagtgtaagtacaatgaacatactttgaggtaaatggtttggcactttaggtgagccaaatgagtactattattgcttcagctgtattacatttagaatttacgaaacttacatttaggactaatataaacatttattttttgttttttgttttcattcagcagaatcaataaaacttaaaaaaaagagaaaggatttgtaaactttgtttgtttctttgtttgtttgtttttgtagtaaaacttgttggctggcaggatgtaccattatgtaaaaacttaccatttagttgttagcatcttccccctcctcctttctcctcatcctcttaatagagatgccctaagcatattttagaacctttgatggggcagtttgggacaatgccacagactggaagaatgggatctgttagcataagaaatacaaatatttatgataatgctgtctttmttgatcaccatgtgctctctgctgtggtgttttgcactgtgagacttggggaaatattatttggattagaataatttctatttgtgaagcccatttcgttctaggcctaagaagggacagcctagtgaagcccatggaatagacagtaaggcattggccgcttagtgcttttaatgagagaragagagagagagagagagagagagagagagagagtgatgagtgggtgtgaagattcttctgtgttatcccaccttgatcatctgtactgagtaggaagaggcagtgctttgcagtcagaattttctcggagttaaaaataattgactttttggctggtaccacagataaggtagaggacctagcagggaaagaaaactcaatgcttgtaactaggtaaggtggtttctttatctgaaaaatagactctcaacgacccctccaaacaaaatcccatttaaaaatttgtaggttaggccaggcgtggtggctcacgcctgtaatcccagcactttgggaggctgaggtgggcgggtcacctgaggtcaggagtttgagaccagcctggccaacatggtgaaactgcatctctactaaaactacaaaaattagctggctgtagtggggcatgcctgtagtcccagctatttgggtggctgaggcaggagaatcacttgaacccctgaggcagaggttgcagtgagcygagatggtgccactgcactccagcctgggagagagagtgagactccatctcaaaaaaaaaaaaattgtaggatagactacaatgtgtataacttcactcctcttgtataaagatgtgtgggcygagtgcagtggctcacgcctgtaatcccwacactttgggaggctgaggtggacagatcatgaggtcaaaagatcaagaccatctcaggtcatgaggtcaaaagatcgagaccatctcctgatygaggcaggagaatcgcttgaacctggaaggcggaggttgcagtgagccgagattgcaccactgcactccagcctcggtgacagggtgagactccgtcmccaaaaaaaaaaaagaaaaaagaaaaaagaaaaaagatgtgtaaggaaattagatagcatttcttggcttattagctgttaaaatgtccaagggaaaatagatcaattgaaatatcttttggtggctactaacttccctttccatagataagacatagagtacaattgtgaagacatttaaggttaggtgtaagagaattcatattaaattttaaggctgttgaattgggagaaaatttagttcacgtcttcatttttcagagacagactgagaactagaggaataataaatcacccaggtaatgagatctcattcctgccagggcagaatctccactatgattttggctttgtggcattgcttgtatctctgtctttattttattggttaatttgtatctgtaaatattttatcttcccatattgtaaggttcttgaaaacagaaactgtgtcttatatttctttgtaactgttccaagagttcaataaataaatatttgttgttgtgggggctgatttgtgggactccccaacctctgcaaataatgtgatttgtgctgtcaccatggcaaataaagaatmatttgtgctacgtatgtaagtaatccaaacaaaactttgcataaatattttaagaaactgaaatatcagaatagatgagccattgaataaaaatcaacatcaatcacaacctacctcattttaaataagctacaaatcgaagtaaataatttgatgcgagtggtcatttctgctttcaatctgagaggaagtcagtaaattccttttgctgttacaaaagtagtttaaattccatgcaggacacgagtctgggcaatcacatcascctcagcgtaccaaagagcctagagagacagcagaacaatgtctcccactcgagctacagagggaaggtggtcttaggttttgctgcagtaactggaagcttaaatttaattttcagtcagagcctgctgtttaagctccctgtctgttctgcaatctaagctgaatgggtactttttttttcttttctaatattcttaagtcatttggagaaatctaatacttatattttcaaattacatcaccttagctaaagatatattttcctctctataaaattcagttgcaaaaagaaaaagtagaccgaacgctcaagaaagggagagcaggaggcctagaatatgtaaattgtttgatatttgacaaatcagttactgtgtgtggtgtgatatgcaaattrggaataatgctttcctcttatctgcattgcagattcttcagggcatgttctacatgcattctgcatgcactatgtgcaacacagcakaaaagtttagtgcaagaaatccgggcaatggaaatcagaggaaggaaatgtatattagctttatatctttatgtgaaatttgtgcatgcctagccacagtcaatgaattggtgagatcagcatctactaacttacaaatggatactgcattaaataatamatttaaagataagttatgaataatacatccctcagttctgaacacatttagggatttctaaatgtgaaacacagcatatgctaagactaatgcttagaataacataggctaatacaaaatgtgtgtgtatatattactatatttgtaatatatataaaacacatgcacatacctacatttaatctttgacctttgttctatttgtgctactacacagaatctgtgcagtagtaatttttgtgtatagactgaggccgaataggcagttttctatgtagagaatttgtacttgtcagggactgttttcttcctaaaattctacccctgaaaattcaggtgtgttggttcaatggttgttttagttttgttgtttattttcccttttttgttcaagttaaacacaaagcaaccttgtgaaataaacccttgaagttttatcatctcaaccttggtggaattaattatcagtaaactgggtgagtaaatttttgtagtaggaaatatgtatattcttagagtcaaggatatatttagattatagaataattatactgatagttgtatgtggcttagaaattcagtttacattttgtatgtagttcataaataactgcttattggataatgggatttgaaatttaatgctttttccctgacattggggttctgttgagccttcatcattggttgaattggttgattaataatagacctcttaccttatcaggcacggtctacatgatcaatatggaaataactgaccctgcctcctgtttctaccatcatcatcttttcttgtcctcttttcctctaaatgatgctgtctcacttagtatactaacattatcctgcatggaataattactgatcttgttccatagaccacaagttataaatgtcatttttttctaactggtgtttttaagataagaagagtacaaaaaaaaaaaaccagttatcatcataaatttttgctataaaataactatgttaaaagaaaataaaattaaggaataactaagaataactaaggaataactaagtataaaattaaggaatgactagttgtatgagtgaaacttcagcaggataataaagttttataaaaaggaggagaacagctttagaacatgtgatgagctgggaacggtgagacatcatgttactattatgttatgagatataatacttggaaattaatattttcagttattgtcattttggcattttctgttgtctacctcactttgctcattttatcatgtacctgtttttgaactttgatcctggaaatttactgtgagagctatgtagtgcgtcatagggttttctgcagctctcaaaataaaaagtatcccaattttcaaaggaataagtgattttcattctttgagtgttgtgataatgtatataatagtccttaaggtattttgatatttttcccattagtaacttgcagtatattagtgagctgtgcaatatttcctgtattcctattttgcatatattattgcttttgtacctsacagtgaatgaaaatcatcattctttatgttaggtctgagaacagtaagaggtttccttggtgttgatcatcatgtaaggaatttatctatgtactggctttgttttctcaagaacattattaataaagccatgcaaaatcacagactggcttttaaatacgtttaacaatattccttgatatgctagaaagtgggcagaattttcttcctcgtttatataaatgatttttcatgagtagggtcttccaggttaatcctactgttatttttgtttgtacctcatgaacatggcaggggatgaacagaggtaggaaagggaggaagaccgtgaagggaagatgtttctttttacaaaataaattattttattttttgttctagactatttagagaggtggtcacttctgatagcaaatttctaagtttttcattcttagaaagaacacatggtactgttcttgacaatttaatattccccttgctcaatctcactttcccacttcagaaagcttatctgctaatccaagattatcttttaacacccagtaggtgttagggccacttttgttttgtttttttgtttttaggatgacattgaactaagagcaggaaaactggttgaaacttttatttttagaagggtatgttaccatggaataaggaataaggggaaagccacctgttaatgctagaaaatgaaatcttaatttaatttaatttaatgtaatagcttttacactaattattttagtatgtgaaagctgatgggtatttatttcataaatatatgtgaatttatttcataaatatatagtagcaacttgctgaatctttgacaccatttattgcctatacgagagcctgaaacgatgaaggtaaaggtagaagaactggatttggtagataagtggtcagacaagaagcacacatgtttctgcctcttttctccttgtgacaggctggtttaaatataatgmagtaacactcttactttccctccgactcctttccttaatgtttttctttcacacttagcactatcctttcattgttctctcttgtttttgatctttccttctggagttaacattatttaacagacacagtctcctcctaggggcacagggaatttctggaaagaagaggagcatatttgtctttaatctcactagtcaatacctttcccagtaagcattctttattggcattttacacatctagagactccaccactcccataaggctccagaaaaaatgttaaaacaatttcagcaggaaggattgaagcattgtactagagattctatatattgggatgggagaagataagtgtactgtctgagtactgtcttcattgtcctctgtctaaactcatctctggataagcagaagcaaggaatcagatacaggcagtgctcctggaccctgaatatatgttccaaacatattgcaaacattagactattycttttctaccctctgtaccctctttctaaattggtaattatttcttctttacctactaatgtacctcttcttctttaagtcatcaatgtaaaaggaaggcagtgcccaarttttctttggacccttaattcctatctactcacccaaaaagtcctgttgaaagcttcgattatgggccatgcattcagggcaagatatcctgccaggctctgagtccctgcttttatttattcagaactagattttagagagaaggataatggtaacaaaatgctgagtcaatacatttatcttctcctgtgccaatgtatagtatccctagtaccatgcttccaatcttttctgctgaaattacatttttttttcctgaagtcttattacggtggtgaagatcatagattataaaatgtcaataattgattctgagaaaaaggtattgaccagtgggatgaaagacggatagattccttttctttccaggaatcctcttgttcttctaggaagatatcgtggcaatgtctgttagcttgcagttaattgaggtcagcctggattagaagttctatgtgttgagaatccctgtttcagttactctggtagagataactgagtgatcaaaagctgttygctcacatctgtgctcatatgctgaaacttgaaacctggcatatttgatttatggtagcaacgtggccctgagataagaattgtataaacataaggtaaattaaggagaaaatagggcagatgataggctaataagatgacacggggtctttaaattgaaaccccattaactatgttataattctacattctaatatgaaatggataatagaggtagttatgtggataaccgagtccagactgccttttctgggattagccctgtgaatatttaagcttagctattgtatttcataaggcagtctgaaatttgttgtatttctttttcacttttattttatgtaatgatacactaccattacagaaattcaatggatcaaacatgatgtggttatacttaagagagaaaaaaagaaatctgacctactcgagaagttcttgtgcatttttcttccagtaaatctttttacagcttattatttgggggaccaggttaaaggaaaagtcactgtgttaggagtcaggaaggcttcactggagctgccactaactagcaatgtggtatagagtaattcattgaaactttctccagttcggtttctcctctttaaaaaaaacagaggggggccttggctggtctcggatgtcggtcccccgctatccccgcctgggggccgccccatcccgcgccaggactagggtccagtgcggagtgcccctagtcctgggaaacggggtctggccgcaaaggcagctgcccccttgcccgtcacgcaatggaagttcgtggggaacctggcgctaaaccattcgtagactatctgcttctgggtcggggtttcctacgtagcagaacagttccctcgccgcgatctattgaaagtcagccctcgcaacacaagggtttgtaaaacaacaacaacaacaacaaacaacaacaacaaaaaaaccaacaaaaataaaatgaataaattttttttaaaaaatggaggtatttggtgacctccagggtttctgccaatttcaatctcctgtggttctttaaagtatatcatggactccttgggaacaaagatggtttcttatctgtgtttatactctactgtcacaaaacaggtatttaataaatgttggtagagtaatctcaagaactaagaataccactacaagtctgggaaagaaatacaaaacattttgtattttgttgtatgcttcagcatttactgtatgtaagcattaactaggtagcatcacgtatctggtagtctttaatatgtatttatttctttcatatttggcatctataaacttgttcaaaagctatgctattgggaacctggggggattaacatttattgagcgtctcctagatgtggtcagcattaggcaaggttttaaatatcaaatcttatttacttttcacagcttctggttatccccgtttttcccagggggaaatagaggcgctaagaaggtaagaaacttatctgaggtcataaagctagaaagtggcagagctgaggttacttagatttggattcagttttttcttggctccaaagaccatgatctttccactgtgctaggctgaatcatgctttttgctgagcaaaatatctattatgttactttatccttataacatccctaagagttcttttaaaaaaaggtgcaagtcattaaaaacaaaagttatcttagcttttgtrttcatttcacaaacttaatataacatgagctgtgtcaatcagaataagacaaatcctgtctctgagacagagggatagctatcacttcttataatgagcactcacagagattagctcaatggggaatctgggaaactttccagatagcatcaaaagtgatctttctaacattgcatttaaattttagacaatccattttgactccctttgtcctcttcttaaaagcaagtttttattaatttttgacaagttaatgctactctctatttccatattatagtgccaggtaattttaaaatcctatgagaaataaactttaaacgttttggaaatatccccttccccctcgttaaattgttaaataataaattatttggattaggctataatcaattggatttctgatctccttgaaaatgaattttgcctactatgttgcagccatattttttctttaatattacatgttctcacttataagtgagagctagccatggggtacatgtgaacataaaaatgggaacaatagacactggcgactagttggggggaaagagggaggagggaagggctgaaaaactacctatttggtactatgtttactacctgggtgatgggatcatttgtgtccccaaacctcagcatcacacagtgtatcaatgtaacaaacctgtccatgtaccccctgaatctaaaatagaggttgaaatttttgaaagtttttttaaagagattatttttgcattaaaattctccaattgtcagattgcctacagaacagaatgttgggcatatagaagtaaacagaaaaaaaagtagtcctcactgtatcataattatcctgtgctattgagttgctgtgcataaaacctaatcagattgactgaaactgtcaaagaacaaagcacaaataccaatgatagatgaaaagacatataaagatggatgattcctttttaggagcagtgggagattaaagggtaggcattactgcaagaattggtgttaactgttctttaaaaaaaaatcattgttaatgatctggcagactgaacgatcagcacatcaatgactgaggaaagatgtgagattcagagtgttacagcatcacattaggcagagaaatcattgaaataaaccctatactagaagaaattggaagagctaaatgacatgcagcttaggaggaaaacctactccctcagaaaatatttttttagatcatttctttctgtggaacaaataaagggtttcagtagcatgttttggctaattgagcagaccactattattgctgtggttctgtaatcattttgctagagaacataggagaataaatctctagtgatcagagaatatatgaatgatgtagaaccctcaggccattttcataccattcatcatctgtgggatgttgccatatctggtgttcttggcacacttcaagtatgtgagctatagggagaaaagttggaartggacccagatcttattgcacagaaaaaaaaaaaaaaaaagaaagaaagtgagccttgaggcatgaaatctcccaagagctagccctcacacctgcaggtaatttatatctgtatttcctgacttgcttcctcctatttaacactacttcttccactttgcttttgtactattccaccggttgctgattcctcaggtatggagacctagctgctcagttttcacttatttggctcctcttttatagcgttcgaatatattcaaatttgttacaggaaatatagttaaaccctctggtctattgccctttaactacctcctattcctcacatttccattggaactaaattaactctcgttgactatctaatcattgacaactgacaccatggacttctttgttctgaatccagcaaacattttcagtcctactcttccttctttttctatgacaatcaaacttgctgaccacctcttttttttcctctaatagtttccccactcttacctttcctcaccctacttgacttttcctccgttccttctcttccatgacttcctttctcctcctagcttctgacagtactgtgttttcatcaagcccttttcttaccttatatgttcttgcccacactatttgatccactgccacactctatgtcttatacatatatgactccaaatctctctcctgagctccagatctaaaaatctacatgcttagaagacatggaaaactcaaataatgtgatactcttgttatttcccaatgatataattattcaactgcttatccaaaccagaaacttgggagtcaaatcatgttttttattcatgtctcacatccaactgatagtcagctctgtctgtcctgcctctcaaatgtcattcctctatgattctctatcacagagatgcccatttgggttcaggcttccattgctcatcccctgcactattgaaattaccctcaaattagccctctaacatccaggtttgttctttttaatgtatacataaaacacattttagaatttctgtccaaaaatcctcttctttcatagttttctcctgtttattaaaaagtctaaattctgaatttaccacataggcctttttttgtctctcagcctcagctctgctcacgtctcctatcccttcacacgtactttaaggttacttcaattttatcaaactactatatatgcccaatgtgtccttctgtttcaacctcacaaactttttgataccccagtacaattgcttttatgaatgtgatcccaatcccacagggggagaatgaatcattacagccttatttcctatcttaacctgaatacaatatatcagctacagcactttattgtcattctttccttactgaattctaagcaaaactggaggatagaatattatcttatttatctatgagtcatcaaggcctagctcatggtaagaactcaattttattgagttgaatgaaagaattgatgaatgtattaatagacacatgccaattttaatgctttagaggtatgaggtagccaaaaacatgagtttgaaaatgacaatacagctggaatttaatttccattgcttttatgagccagtcaattactatacttgttttccaaactgcgtctgaaaactatttcatgaaaggagaaaaagaggactggaagaaagctttaggaatataagaattgatggtgattacctttccaatatcttttctggtgatatttgcaacataggtatacagttaatactaatgaatgtttagatcacttttggcattcactaagtaacctctattatttatagtaacaaaacaggtatcacgaaggccccttgggcagcttggggagccttaactctccataaggctggaagcatagttcaacattcaagcactagttggttcacattctaacactagctcatcacatctcagaaaatctattctgacaagtttgattttcttcagtactatttgctctggmagaacatgatcaggaaccatttttggctgaattccctagttctcagtgagacaactgacataccttggcatctctatggaccaaataacactaatcttattatcagtacaattctaagtgttttctttgtgtgtgtaaaaagatctgctttttctcctactgtaatatttctaaatctaaaaaaaagtataaaatgcttatatcaccttattagtggcataaatgtttgccacttaaaaaggattgcaagctccttgaagggtcagtcaaggtcttttttatctttgtctctttggtgtatgtcatagttgttcaatgaaagtttgctaggttgaactgatgtgtgcttataatttaacatcatgtggtataattttaaaaataccacagagaatggattctgcttttacgctgatatttcaggatgcattttttcctgacatcttggttaacctttttattactgcatctagtgaagattctcaggggttttaatttgcatcaccatcagtgtcatcatcttaataatgtcaccattgtatactgtttaaaaaatatagacacatattttctctaatccatctagaaaaaaattccatcttatattttcagaagaatccataagaactaagggagagtgggtaagagagagtaaatgtcaccatggggtagaagcagtgtgctggctcatcattttcatggcactctcaaatccaatttgtgatgacaaattggatactttgcatccaaattgtttgacctttgtgcagtggctcccattatcaactggggaaccagtacaatctttacctagttactactgaggttgttctctctccatcacaaaatttcatgctatttatctgtgagaaaatgcctgaggactttcacacagtaattcatcttatctggaacccttaggatcasatgtagaccgagcaaatgtcaagttcacagagaacacctgtgtcttcagaacattaaagggcaccattagagcttgtttcccttcacttaacatgcacatttttggcataagttggggctgaatgatgttgtcatagcaaatactgctagaatgattgctgtactcattacactaccaaaaaaaagagagagatgaatgggtgtggagtgtcactaaccctcctcatgatcagcacatggagaggacaggacagggtgacattcctgaggaactggtaacccccagacagctaatatgctttatgacagattggtgggttggctatctccaaaacttctaagacatagaaattcagattgaggtcataggtattcagattaatctgtaackgtcttggaagattattatataacatagcaatcaataattatcttttaaacaaagcagtgctgatttctgaagcagtggactaagcaagtagatctaaacaatctacttgcttgtttcgattttgcaggtgcatttttgggatggttcttaatcctgatttacttaactgtttacataatgctggtgttctgtcatgatttttaatttttctggtccctttactaattttcacctctaacctctagatattagttctctatgatgctgagctagttatctaataattattttttaaacaaaaaaagtatcaacaactctcctaataaattattatgcatcacccataggtaaatagaggcataatttaaaaattattatatacttggattaattgacaacatatgcttcatttgaatttctgaacattcgaatgtacttgtaagagcaggcttttctaatactaggctttttctgctgcacagggaaatgtttgtctccagaaaaaacttcttagaataaataacttattttagcatttatgttaactggaaatataatttcataaggtataatattcaggatttctaacagctgctacagttctatacatctgctacacttggtataacctgtaattttcctcgagttacagtttgtgaagttgtaattttggttataatgttaagtatggtaacagtatagcttatggtttcatagtaatctcagtgtgaggcatttgttcatgtattattatagagcaaatgacaggtagaaactgtaaaaataaaggagaacatatctgctgatatagcaacctcaagtcctttctaacacgaattttctactgtttggattccaattcttgattatgcctgaaaaattaatatctatcatgaatcttctcaaaagactattttttayatatgctacaagttatctggattttatagttaatttgttcctttctactaaatttgtatgtattattataacataatatataaagacatattgatgttttcattttatgcatttacttttaaagattttaagtatcagacaatataaagagagacatttaaaaaatatctcatattgaactcctggttctgccaatgacctgactaatgattttggacwgttaaccctgttaattgtttcaccttaggaattgataggaaaattttgtaagcaattcttggttgacaagtacttggttgaaagaccagataacaaaaatatactagctgctattatgcacatttaatgtattcttcaaagcattgagcttccactgattttataatccattgaaatttccatgatatcagaatatatatcaacctcattttcataaatgagttgtccttttcctgagctcacacagtagcctaggattttctaattaatggacatatattttcatcttcttatagtacgtatttttgtttctttgtagcactgctatttctttcctcataaatgatattaattgacatatagtgacttaagtaaactaaaatattaaaagcacattgaagtgactacatttgaaggactgaaggaaataattttacaatgcatttttattttaggaggacagatttttttagaatggctaatcaacaacaacaataaaataatacaatatattttawattcaggaggattatccaactgaatttcagataatctttataaatataataacttgctctgaaatgcttgctctacaatactcatataaacagtactattaaatcgaaataaataatcacatcaagtttgccactacaggtggacacagtcaacaatattattagatgtaaaatctctcgtctcctatggcttacatgaatttttttctgtttattcatgttaatccccttaatgaacaattatttctctgcctcctgtttgaatgttggtattcctgggtttctgtcctggaccttcttttaaatctatcaacctctctgggtttccataatatcaactgtcagctaatcataatttaccaatacatctcaaattgtcctaagctgaactcactgactgtaactaccatccatgtatttgttcaagttaaaaattgggagttattcttgattcctcctcctctcacaccacctacacctatttagtcataaagtcctgtcaatactccattctaaaaatggattgtaactttctacttagttcctcaccctctgttagtgtcttagttcaggttttcatcatttttcacagctttctaattcatctccttgcatccagtcatacttcattcaaatctcttctacatgtgaatctacctgaaatgcagatatgatgatcactcctctacctaaacatcttatatagtttcccttacctaaaagctaaagaaaagaaattttaataattaatacttatctctgccacttgagagacatttctttgaggtttggaattatgttttttttttcttttttcttttttttttttagatttccattgttgccacatagtgttgccacatagtaactgctgaatatgattttgctgagtacatgaaagaagagaaaggatggcattaaactaaatgattaaatatctctaaagtaacattttttgctgatgcttactgacacattacttacaagtaaacatcatttaaaaattacctattactattagttgagatgtgtgaacatctctctacttgtttaatgagtcaaatgtaaagtccttataataaactccaagatcctcacccagtcaaatgcctctcttccttgctcacttcactccaaccatttggtctccaggtagccccggaacacccaaggtctctgtacttaatgactagatcgcctgcatctcaaatagatgaatgagtcactccctttgggttgtcaaccaagtatcatttcctcctatttaaaacaactaccctttccttcctcttttatgcattattattttttttcacaatttttatccaatgttttatatattttgcttttatcctactttaatattcatttcccagagttagaattatatgtgttktgagggaagaaacttttgtctctgctcactgttgtatctctagaattgaaaaaagataatatttattgcataaataaacaaatgaatgggcacagcctcgatatttatcctttaaaaagtatactcttaaaaataaaacccctggccaggtgcagtggctcccagtactttgggagtccagggtgaaatgatcacttgagcttaagattttgatactagcctgggcaacatggagaccttgtctctaccaaaaatttttttaaaaagctgccaccacgcccggctaagttttgtatttttagtagagacggggtttcaccatgttggccaggctgatctcaaactcctgacctcatgatttgcccgcctcagccttccaaagtgctggggttacaggtgtcgctacttgggagtctgaggcaggagaattgcttgaaactgaagggagagattgcagtgagccgagatcgcgccactgcactccagcctgggcaacaagagcaaaactctgtctcaaaaaaaaaaagctgggtgtggtggaggatctcttgagcccaggaggttgaggttgcagtgagccatggtcatgccactgtactccagcctgagtaatagagagatactctgtctcaaaataagataaaataaaataaaataaatccccaaattatgtaaaacaattataattgagactatctctactaaggtctaatatctctaatagaaataaggtcatgcctaaagaggttagaagatgcaaattcagtagccatactgttaacataattgctctaattctgtatccatgttttattaaagcattgtttttgtcaaaaaagaaaagcaagaaaagttgtctagttctagttttcagaaaggagaaagtgaaagcataacttgaattaaaattctaatgttggctactaaatagggaatatagaataatgtactggacagtttctttgtaaaatgcagacgcatgcttcagctayggattttttttaaagcaaatgttgataaaagctataagaataacattaaagctcaatacagtgaaagcatttctgtgatgtactcagctgatgtggttcaggtctattgcctaatttgattgaaagattgaattttgagtactgagggaggtgaactgatagcatttcttgggctttttaaattttccttatatttctgcttctcttgtcaaagcttctgatagggtttttggaattgtgtgtcaaaaagttctccgagttagaatttactgattcacattaaaaaacaagtaaactttctcctatattctttactttctccctgatccccaacttcaaaattaaaaaaaaataccaacatctacaagagcaacaacttcaaaggaacttaactttaaataacgcatataaatataaagtcattccaaactccttagcttcagttttggtcccttctgaatcattctcaacattatattttgacaacagtaaatatgatgatgttatatgcaattcttaagaaatctagtgacttgcagcatatttttaaatcatagttttacttaatttgactatatatatagatactctatatgcagagcactatgctatacatatctatatattcatatgggtaaggaacttgtacttggtatcagcaaggaataggacagtctagcagaggtaatatgcacagataattcaatacaggtgaatattagattgggctatgcggagctatcagtattcataaaatacagtgagcacttctaactggtgacctcaataagggcttcttgaaataagtgacttctgaacggggccttccaagagttcctagtatagacataggtgggcatatttcaggcagtaagaaggccagaagaaatagcattgccaagagatatgtcaacatgatcaaatggtaagcagggaactgcaaatagatatattttattagactggagtgcatctgaagcaaatggtaggaggcaagactgatatggtaggttgggggtcaaattgtaaacagtatttaatattacatgaaagagatttacttattatacagccactagagagtcagtttttgcatctgagtaggagggtggtgatgtggttaaataagttcgtttgagaaagattaggtgtaaggagaacagaacacacggccattcttgtaatttatttgtaggttattagtaaagacctgaatttggatgatggcattgaaggagtggaaaggataatataaatgtgttaatggagggtaggagattgaaatgatgacaatacccaggaaccagaaagggagagcctaagacactagagagtataggcactggacactagaagatgtgatagatcataaaccaacatagaagtattgcaagaaggaatatcagcttcttgagggcaaccagaacattttattgggcattgtatcctcatcacttacaagtgtgaggcacataaaaggcacttgatttgtgcttgttgaatgactgaataaatkattgcttggcaaatgattgcttggcaaatgattacacagaataagctccagtgtggttaaagaaagtgatcccggttgccctggcaaccaggcaaaggatagtacaggatggtaaaggataggaaactagtccattggcactagttaggtaattaaaagcactggtttggctgcagttctaacaatgtgtcagcttatttttccttttaagaagcagtataggccgggcgcggtggctcacgcctgtagtctcagcacgttggaaggccgaggcaggcggatctcttgaggtaaggcatttgagaccagsctggccaacatggggaaacctggtctctattaaaaatacaaaaattagctaggtgtggtagcgcaagcctgtaatcccagctattagggaggctgagtgaggcagaattgcttgaacccgggaggcagaggttgcggtgagctgagatcgcaccactgcactccagcctgggcgacagagtgagacttcgtccaaaaaaaacaaaaagaaacactatacagtaaaagttacttatgcagattctagaagtgggctacttgggtttgaatctgagttccaccatttaggatctgtctgtacctcagtattcttctctttaaaatggggaaaataatagtactaacttcatagggttgttgtgaggattaaatgagttacaatatgtagttagaacagtgctcggcacatattaggcactatgtgtgttataagtagtagaagtgaactatgtctactgcactcaacttttatttacatcgtgtattggtacagtatacagtaatggttttcaggtgaattttttctgaccaagtattgatacatagataataatctgatttggggaactcttcaaaaatttcctcaaaaattgatgggagagaagcatcgagatttgtgttgcataactgtgctatgagccacagtttgatggaagatgtgcacatgtggaaatatggttaagacctgagatataatgcttttgaatgctggaaagcaccctcacataacactttgcctcagagagaaagccttatacaaatagaacttgatttcaaaatagctcaaaattcaagaggacttgaagatcatatatttgaaagcaatratctctaaaattaaaatcagtcggtttccttcaatttatttttgttaaaatagttcttttaagaatttcgagtttccaaaatcctcctggaaaaaaatagctgttatctttgttcctttaggcattggtaaaagtactgtaaaataattcaagtaaaaatgaaggtgctttatttagttcaaaggaatttcaaaagccagccattctgaatcacttcagattccatggtgtgctgaaaattaaatagaaaatgtcattatgcagtaccaaaaccttagttgttttaatatacagctgaaaagcttgtatgttagtaactgagagccaaggattcagtgtggtctgataggggagctaattgaactgagaacacataaaaaaaggaaaattgcttttgttgacatcaaagacattttattatttggcttcttttacacaggatattatataatgaagctagaagccttaaacatgatacagattcaatttgaataatgttctgttaactacctttgaatttcaagtgaaaaattgtaactgtagaaattacatcaataacatctgtctgatgcttaatacctggcagtatgtgaggcaaacataaaagaaatctgtagagagtatttttacctgatttgtgatatcttctcattaactatagcagkacctccacaaatcccacccatattctttttttcctcctcttaaattttgtaaaacaaactcatactttggaaatcaacccgttaaatatgattttattggaggcgaaatgggctattgaggaaagtaggcaaatttactttacttgatttctttctaaggatagttttcatatgtcagttacctctgcataggtaacccttgttctggaaacaaacaaaaaaaaagcaatgaagcacaatataaaaaatgtcagttctggagtcaaagtagaggacttaaatcttggctgataaccagttgctagttgtgtgtccatgggcaagttgtatattttttctaggcctcaggttctcacatataaagtggaaacaaaccttgtgggaaaatggtgaagatttcatgagctaaaatatgaaatgtacatgacctacctcattttactggaaaagaaggcagacaaattatgcatggccataaaccattttatatacaccgtgtttttgttagaactcagatttctagaattctgagattaaaaagtaattgctaaagttattgttactattgataaagactggaattagaatgccattattgcatggggataagcatgttttgtgkcccaataaaagaggctgctcaaaatgacctctgatctgtccttcttgattcaggattttatgatcttgtgacattgcagaactctaagaacagagtaattcacactcatttcttagatctttaacacaagaattacattatctttgagcggaaactaaggtcctagtctactcaaagtgcgtatttcaatttgttaattctgacagttttgttaccaggttgatgggcgtatttcaaacctccaacacttaagttctaataacctgacttctgcaaaagtgctgttacattatgtcctcttaaaggtcctaagtagtccctgtcagtcttttagtgacattacttggcagtattcctttttaattatcaggaaaatgataaattttcttgaaaatctttgaagtgagctcatgttaattcaatacattagtgataagcacaatgtatagtagaaagggataatgtagccagaagtgaagacgaagaatgatattcttagatctgacactgattttttctatcatctgcaaaccacttgacttcttgcattttttcccttctctgttactgaaaaatttaaaacctgtgaatttctacctcatttgatgttgaacagttttactaggaaaggacctagacaaatgtattgttatatatagacatatatatcaatttatataaatcagagggttttatttatacctggaataatacaactttattaagtaaaggttacttttgaagtcatctagtttaaactctttacaaacatgtgaaaacagaagtcaagtatgacggggtaaaatgtgtgttcagaggctgtgtgtgacacagctaagttatttatttatttatttatttttttgagacggagtttcgctmttgttgcccaggctggagtgcagcgatgcaatctcggctcactgcaacctccacctctcgggttcaagcaattctccttcctcaaccacctgagtagctgggattacagactcccgccaccacacctggctaatttttgtatttttagtagagacggggtttcaccatgttggtaaggatgatctcaaactcctgacctcgtgatctgcccacctcggcctcccaaagtgctgggatcacaggcgtgagccaccgcatctgaccggtacttttctgatattctggattaaattatctcttctacctcagcttcattatctctatggagaaataataatggtgataaacaaatatattgatctacataatatcttcatgaaaatatgcaaaatcagatatttatcttcataaaaatatataaaattattatatacaatatgtaaaatcactcctttggggcacttcagtattaatttatgtatttatatattttttgtgtgggtgtgaatatattatatacacataatgtataaatatagttcaagattaattccttaattcacaacagggcctaaatttttaactggtgagctatttaaatatttcattaattttataattaagagggtttttaaaagtgcttcaaaagtttataaattaaatgatagcatatgcagattgctttagaactcgacttcaaatgtttcttaactttaaacattgtttaacagagcaccattatgtagagcagaatgctttaaagtgaagctgctaagtgtaaaaatgcaataaatgaatgtctgacttcccttgtaaaccatccaactggtgctttagcacaagcttatttgttattaatttagctaaactttgaaaacagattattttgatgattaaaatacaccttctatatgattattacaagattgttttttagaaaaaaattaattttatttacctatcaaagtgtttgaaatacagggcacaaatatcttaatgcatttatgaaggatttggaatatgtttggataggtcagtgttgtctgacagaactttggccagccatggggctgttctatatctggattgtccagtgcagtgtccagtagccacacgtgtctatttagaatggtttttagtgtcattgaggaaccgtgcttttaattttaattaaagttaaataggtacatgaggttagtggctaccctattggacatcacaggtattgattggtttttgatatagaatcacagagttaaaagttaatttgtaaaaatatcttttgttttacgctttagtagagccacacttaagtcttttgggaaaattaaaatttatttttaaaggcaatgagaaaaagccatcccaaacctctcttttgtaacctacgtaagttttaaataatacaatgttaaaactcacttgtgacattcaaaatcttaagtgctatagcttaaataatgtttgtgtttgtgtatacttgactcaagtagatgagtacccaccggttatcatgcttttcctaagacagtaactaaaccaaccctcaaccatgcccaaatgccaactgctttaacctctctttataggtcttccccatttatcaatcaacctgctctgaaccagctccaaaatatccatgaccctatttgcttacaaatttgcttaatatcctccaaatggatttgggatttgttttaattgtttagttgaaacttcttatttcaactgtaaattcatgttttatttaagaatatttggtacattagtgaaccttttcaaatagctgctaatatttagcttatggagtaatggcctggatagaagtcatcagctaataaaagaggtgattatgctgaacagtagagagacataaagaaagatcagcaaagcacaccttttgaactcaccgtagtgtgctcttacatccacatatactcctgggctagtctgatgttattaatggaaagcacagagaaaacacttagtggggagttgcgatatgattgctgttgatttttgaggcactctaatttctaagtatgtggtacaataaaaagttgagttttgccttatgcttgcaccaaaatgttaaaatgactcattaattttgatattttaatactaaactactaatagtctactcagggatttcctatcttcctaatgtaattacttgtagaatgcttgggaggaaacctcaaaaatgctaaaatgacttcactagcctgcttccatttttcctagaagaccttaatcgttttagattttaaatgttctaaatagtttgctaaatattaagggaaaataaactccaagaactttttttttttttttttaagtagaactagcttgttgtatcagttatctctgacttccttctyggcctggaaaattctcattgcacatgctgtttgacataactacattctattttcaaaatgtctgctcgatttcattgactatttgcctaaagtctttacttcctagtttgccagatgccatccactctcaagtactaccttctagatttttttttttaataaagactgattgtcaaaccctaaattttttggttgagaaatgttaaatactggaagtcatgcaagctgtggatgataggtactctccaaatctattctgtagcttctgagtcaatccataaaattgttgccataaagacaaaatttaatttatctgcctgtgccattacattaaataacaaaacaaaataacaacaacaacaaacaaacaatgacaaaccacaaaactgaagaaataagagtggatgggaaactccagtgaaaagaaaaggttgggctccatataaagttgtccaaygcagtgcagcatacactcatcagtagagaaaagcaaaatgtctcaggatcagaagaataaacgaatatagcagtgtgaccttggatagttccctctgaacttcagctggtctttttcacatatgaaatacagttaataccagctaccttacttgcttcacagggttgttatgagggtcaagtgagaaaacagatggagattttataaacaaaaaagtactatacaaatataaagtgatatcatcatcattatgacattaagagcttatcattcagaagcaaacagcaaatatctatcagtgtaaattttaaagttttaaaaggaaaaaacgaatatactctttgtaggtactctggtggacatattatatgtcctaggcaatctcagaaatacctatggacaattatatgaaaatgtcagccgggcacggtggctcatgcctgtaatcccagcactttgggaggccagtggatgacaaggtcaagagattgagaccatcctggccaacatggtgaaaccctgtctctactaaaaatacaaaaaagttagctgggcatggtggcgcacatgtttagtctcagctactcggaaggctgaggcaggagaatcacttgaacccaggaagcagaggttgcagtgagccgagatcacaccactgcactccagcctgggtgacagagcgagactgtgtatcaaaaaaaaaaaaaaaaagtcatgaaagaaaaaaaaggcaagtcattatcattgacagaaatataggtatttaatattttctgagtcattaaagtaatccaggaataccaattttagaagaatgtcagttgaatgtcagatgtaaaactttcagtgagttccacgaggggaattaaaaagatctaggtgactcattcagctctatcttccttttcctcctctcatccttcctttcctcatctctcctccttttgttttcttcctttacttcctacgctcctttccctcttctgtcttctcaccttattgggcactcactctatcagcagaattctagagatgctataagggatataaaagaagtagaaggcaaaaatctacgctctcagagagttttcagatttggctgagtcctttgaaattatttgtgaattggtaaaaggagatgttttatcatcatttattttctgagaacccagaattaactgtgtcttatacagaataaagaaggcatgatccctcttctaaatggtttctattttaatgtgatcttaaattacaacctctcagagttaaggagatatatgaggaaaataagctttgtagattttaggtttctgaactcttttaattaacacatgagaagagtttgtttcatttttcataaatctctccttatgtcaatcaactctttgaacaactaagaaccagacagaagaggttttaaatgaacgttaatatactttttcgtcactggttgctcaaactgaaagagatgctttatgaagaaattggtttcctcccagggtttaagctccttttccttcaatatgaatgttcagaagactgttctttcttgagagataattttgactaatatataaggagctatttgaaggcatgttcctcttgaatgtcttccctcttagctttatgaagatttaaaacttttccatattacttatataacactgctttatttcttttgttttgttatattattttgtttttattttaaatagtatttaatacaattcattagttctatttttatatttacaaatataaaaatatttacaaaatgtatatttacaaaatgttccaaaaatattaattcatcttcttaaaactctacttgaatctggattgccagatggtcataagtatttttttctctcttttttttcttaattattattatactttaagttttagggtacatgtgcacaatgtgcaagttagttacatatgtatacatgtgccatgctggtgtgctgcacccattaactcgtcatttagcattaggtatatctcctaatgctatccctcccccctcccctcaccccacaacagtccccagagtgtgatgttccccttcctgtgtccatgtgttctcattgttcaattcccatctatgaatgagaacatgcggtgtttggttttttgtccttgcgatagtttactgagaatgatgatttccaatttcatccatgtccctacaaaggacatgaactcatcattttttatggctgcatagtattccatggtgtattatgtgccacattttcttaatccagtctatcattgttggacatttgggttggttccaagtctttgctattgtgaatagtgccgcaataatcatacgtgtgcatgtgtctttatagcgrtcatcagtatttgagtaaaaattaagaacatatgttaatgggcattataacttgtctggattttcaaaatgtaactaagaacaatacttgttgttgttgtgtaatgatatagtacttatatagtactttagagaggatttcaacttgctatatagattttaaaaatattcttcctccaggggttaaagaaaaaagtcagaaaccgagctattctcagtaacattgcaaataacaagatgcaaaatacattttcacccttttaataaacttgcttttattattatataggaagtctggaatttctgagtgattggtaatctatgatcttattttcccaagcattgtacttaggagagaacaagtatatcaaaaaattatataggggaggtaaaaagttggatatgtggcctttacaaaaccatgtttttagtttggggagaggagtttttttttttgcatgggcttacaaaataggcttatgagctaatcaaacaacttaaaaatgcaaatataccagaatttagttaactgaatgagtctttggtaattactttcagtgccaattggtgggtgatactgaaaaatatttcttgtggtttcttttctttctttccttccttccttccttcctttctttctttttttttttttttttgacagagttttgctcttgttgctcaggctggagtgtgcaatggcatgatctcggctcaccgcaacctccgctcctgggttcaagtgattctcctgcctcagcctcccgagtagctgagattacaggcatgcgccaccacacctggctaattttgtatttttagtagagacagggtgtcttcttgttggtcaggctggtctcaaactccggacctcaggtgatccgcccgccttggccccctaaagtgctaggatttacaggcgtgagtcaccccacccggcctcttgtggtttcttttaaaattcattaatattggttataaataacttttgagcaagttaaaatatttaaagsaacatcaatgacatgccaaagaatgtttagtaggctctgaaggtccttccaaataaataatttaccaatatctgagcattaacaagatcaatgaaccaattatctatttttctaaggtaacttttgctggttacacccatttgcatatatggctcattttgttgtttctttcaaagttaggaaaatgattttatagcataactccaaaacataatgactttgaagcatatattaacgtggtcttatggtaggccaaataatgccctccacccaccaaagatgtttacttcctaatcaccagaacctgcaactatgttacctttcacagcaaaagagattttgcagaacaattaaggattttgagatagggaaatgatactggattatccaggtgggctcactgatgtacctgcaaaggtctttgtaagagggaggcaggaaggtcatggtaagagagaaaaaatataaagacagaagcagtaaagtcagactctacgagaacacaatgagatgactgaagcagctagagaggagaaaaatttgaagatgccacattgctggctttgaagatggaggaaggatccaggagccaaggagtgtagtagtctttagaagctagagaggcaaggaaacatattttcccctagacctctggagggaacacagtcctgctgacttgactttagctcagtgaggctgattttggacttctgtcctccggaagataataaacttgtgttgttttaaaccactaaatttgtggtaatatgttatagcagcaagaggaaattaatatagactctgaggattagaaattgagtaataacccaaaataatcctagaaattatctagcccaacttcttacccatgaatttcatagtaacaccatccaagtattgagtgtcattctacctgaagttacataatctgtagcaaaattgtaaaactcctgtatcctaaccttgcagtcttacatgctttcttgtatattatgttaagtaaaatccaattcatgtttcagcaatttatattctatgtaatttttccttgatgtctttgtaagaagattagtagttctgaaatagatcgatacatattgactcaatttttctccatagattctaatgacagtatagagacaggaattagcattcccactttaggtctttccaagctgaggatcatcaccttgtctgacagcattagactttgcttgggtatgagaagtggaagaatcatgtattatcatagatcccttaagttagagctattctattaaataatcagctctaggggtagattttagtcatcgttctctatagaagatccatggataagcctggtggattgtcaggggttggaattattgctgaagtttgatgcttctttcctgaagttcttgacttcaggaagcatgaaaagccatgaggaaacttttcatggaggaatgtcttattctactctacatagaaccttttcagcagtttcacattccctgggtctctatcttctgtggcctattcactgtagattacctagagaattgatcttgatactatcttaagtttaccataccatcttttcctttatttgactgttctggttctttgtatttccacataaatattagaatctacttgtcaatttctacaaaaagtctacctggattttgattggcattgaattagatacatagctcaactggggaaaagtgacattagaaaatattgagtatgccaatcactgaccatattatacctctccatttatttcagtctttttaaatttcactcagaaaattttgttttcagtttatttatttatttatttattttttgagacacagtcttactctcttgcccaggctggagtgcaatggcatgatctcggctcactgcaacctccgccacccgggttcaagctattctcctgcctcagcctcctgagtagctgggattataggcgtgcaccaccacgcccggctaatttttttgtatttttagyagagacagggtttcactgtgttagtcaggatggtctcgatctcctgacctcatgatctgcccgcctcggcctcccaaaatgctgggattaaaggcatgarccaccgtgcccggccttcagtgtatatttaaaatttttcatcatttgtggttggtaaaaaatagtatacttacctttgtatattgactttgtacactgcaaccttactaaattcacttttttgaaggcatagttaaaattcatgaccttcctgccatttcctttgtcatctctgaaaattttatttttattagtctgtgaaaactacttttctagggtcatcttggagtagccaacttctatgatctgttttcccaattttccttttctacttctctataatatgtggataacttgttccttcatagaacacacacacacagacacacacacacacagaggcatgtgtgtacaaaaagctttttctcagttgccatggcagtatgctaacatggatctctaacactgactattcatttccagagtgcttctgtagcttttttgaatttcctatcttttatattggaagtgttgctccatgttctttccaaagttgtcttctcttcttgttctacatccttaaatttgatatatatttttttcccactcctttggcttcaaatacaagctacttcagggaaggtccaagttcctgtcttagcactgatatttcttcagaaatacacttcgtacttccaaatgcgtaggaaaggtctattgcgacttaacaattagagcagaacttgtttgctttaactggcatgaataaacctttttagtttacttttaattctctgactattctaccaggctctcagcctctaagtctgcatccttcttttcattcatcccttcaaactcctagtacttcactcctgtttatttctaccatgtttccctttatagtacttcctttcatttggattgccattgtcctaattcagcatcacattaatgctttaaattacttattgtgcacattttaagaagtccagaaatcttaagaggaaattttttagtatctcaacttttaattttatatgtacttttgccatttttttcggaatatatatttacattttagttgcaataatagtatagatacaattttattccatttttacatgtttctcatatcactacataactttcatgattataattttgatagctacatagcaacccatcaaattttttattgtaatttttgttagacatctaggattttttaatgtttttactgtcacaaataacatgacagtgactctttgtatgaacggtatttaaaattttatattttcagtaaaatatatatgtttcatatgacttttaaaatatcaaatttctttccaaaagtattatttactgatttattcactgattgtatacaagtgcttcttacattttaacttcacaattattgtttaaatttttggctaattttaaaggtgtgaaatggtactatattctgtatatatctttgcttaataattgacaaagttgagcttttttttcccagtattgtgttggataattgaacttcttttctgatcttgatacttttgcctaaattactttcaatagcctgactggccttcctcttccatcacattttatctcctcctgtcagagtaatagttacaaaatgtatataatcaacccactgcaaaaatgaaacaaagagaagttttaatacctgttaactgtcaagtaagggcaaactcttcagttggtatctcagactttccatagtcaaggtttaactagccttctagccttttctcacactatcttccgggtagtgtaagtgttagccacaatgtcatactcttattcctgaggccccttattttcctcttccatgcattagtcactctcatctcttcatctgaagcccctctgttccaaccctactaattaggaaaccatcaaatactacacctttctgaaacttacatggtcattccattagaattaatctagtttgtattttcattatgcctttttaaaacccaggttttagtgcttattctccccttaaataacttttgatgtccaaatctgaattttccattccattttaagttcgttgaagtaaggggctgtccttaagcaatctttgattctctacagtgcccaatacagtggataagacataacaaaatttagtaaatatttgttgaatggtttgagttcaataaacttaagactattgtgaaacttatagaggggataaattgttagactctgtaagtgaacagagatgaatcctacatagcttaacttacaattgagataagttacaatatccctgctgccatccattcataagagaagataataaaagctcagaagggacatattattaagaatggttatgaatataaagaagcccttgtgctcttaataatataatttaacatgaggctgtatatttgagcgcttgtcaaccccttgcttcccctcccacataatagttctttacttatttgcttcatttgttaggatgatattttaaagattggcttagattgaggtggctcacccatttaatttcattaagctatgattataaaaaatactataattctgtccattcattgattttgacaacatgttttttattgtaaggcgatttgggactgtgctgcaagagaaggtgaccttggtagaatctaaactactgtacttcttgacacagtgagggaaagcagtgatattggtattaacacaattatgttgttaaatgcatcacaggtgaggtatttaaagcaaattaaacaagtgacgttcttatttcataaatgcatttaatctcatgcttggctgtttttatggtagaattacagcaatggagaaaattaggcaagaacggaagaggaacagatttgttcataaacggacgcttagaatttgaacttaaagtgagtaaggagcatcaaaagtcaaataggacaaacagggtagatggtattcatggagacaaaggattaactgaggttattttaagactatttatatggaagggatgacattacatagggagacctccaggagtcctgactttgagccccagctatatcaatgactcacactgtgtaacctggaacaaattactcaacctctttgtactccatatttcttatttataaagtgtacataattttatatacgataaagttcttgcaagaatcaattagaaaagaggcaagaaaccaggtacggtggctcatgcctgtaatcctagcactttgggaggccgaggcagggggatcacctgaggtcgggagtttgtgaccagcttgaccaatgtggagaaaccctgtctctactaaaaacacaaaattagcctggcgtggtggcacatgcctgtaatcccagctacttgggagggtgaggcaggagaagcgcttggacccggaaggcagaggttgtggtgagccaagataacgccattacactccagcctgggcaacagagcgagactacgtctcaaaacaaaataataataaaataaaattaaaaaaagaaaagtggcaagaatggtttcaaatgtgaagtaacccatatttatgaggtagtattgatatcctgttgtaaaaaccttatcatcctaccatatttgaacttgattcattaattaactcagaaaatatttagtaagtgcaggcactgtattcattagatatgtaatagtgaatggaacagaagatctaattcctgctctcaagatacttatgatctaataagggtcactagttaacaaactgatactgaaaatcagagtttgtcttaatagtttccctttaacccacttgccagattagctagtgttttccatttcatctgcaaaacacattgactggcgtctcttatacactgaatgcctgggtagtaataatatctaatatttatacacaacacttaacaccttccatgaactgttttaagtgcgttgctcaaattaactcctttaatcttcacaacaaaaccttaattaatgtcattctcattttgcatatgaggaaactgaggcacagagaggttaagtggcttgtccacggttaaaaaggctagtaggtaatggatcaggattcacacccaggcattctggctccagagcccacagacttaatcactaggtaacaacactagcaggtctgtctattactgctctcaccagttgaattgaaaccttatttaaaggtcatctgtatttgttcccaaacatgtttataacagttgtactagattttttatgtaatttaatcaaatatcatgtaacatactagaaatgcaaaatacaaatgtggttttggacatttataaccaatttgaatatgctgataagacttaaggggtgttgcctttaaaaagttgggtgaagaaaatcaggaatcaggaatcaaatcagaaatgggtgaaagcgaagagtaaactacctcataaaacatagacatttactgtagttggcctcatatgcctttatgctctcattttaagtaaaaataaatgaaagtggaaaatacagaaaagtacatatttatagtgagtgaatcactaccaaaatacaaagtcttggccctactgtaaacacttgaaaagtgaattaacatttatatattttaagttaaaatatatgtttaatatatatccacaggccaggcatggtggctcacacctgtaatcccagcacattgggaggccaaggtgggcagatcacttgaggtcaggagtttgagaccagccttgccaacatggtgaaaccccatctcaacttaaaaaatacaaaaattagctgggcgtggtggcacacccctgtagtccyggctacttgggaggctgaggcaggagaatcgcttgaaccctggaggcggaggttgcagtgagccgagattgggccactatattccagcctgggtgacagagtgagactccatctcaaaataaaattgtacacataaaattgtacgcgcgcacacacacacacacacacacacacacagatgatttttgtgacatcacattttgtcaacttttttgattaacctactaactgtcctgtaagaaagaaatattttcaaatacctccacttccaaacattagaactatggctggtgttgtaggtagagccatatgagtttctgttactgcaagagggtgaatcacagtatatttcttaaaggccgaaccatagaggatggattgtggttcccagtgtggtacacaaaagatagattgtggatgccagcatggtatgtggaggactaatcgtggctcacagagtagatttctttttattccacataatcaactctgttcttctttccagagcaacaggatgtggtagaaagaatcctagattctaatcagaaacagcctttctctatgtcagtgtgttcttggtaactaacctaacctcactgtgttcttgggaactaacctaaccttggcctagtttatttgaagttggcaatttcagtaatgtttttagatctaacatagccctcaatgaatattagttaaatggacctgaaaacactttggaaatcacaaaatattaaatcccatattttcatactgtgaatatattgtttgctcagttattgttacatctattttattatacaatgattagctataaatctgtgagctccatgagattccagatcttggctcattaatttttgtacagacacctgcacctagccaagtgtctaggttcttctcgtatatagaaggtattcagtagatacaatttatgtgaactaattagaaatcccctattttgaaccagacattttgatggtaaaacttattttgataggatataaaatattcgtatcattccagttttagatattgttatagaggtgtttttcttactttctcaaagtctactaaaaatatcaaagaagtcaaaaaagagggaaaatattgtcatctccaagaaagcaaggaagcctcacaactgcaatgatacaaattacgaagtccatatattaaatattgaaatagataatcaaacccactaagagatgttgactcagacattatcaataggtgcctttcccccaaaaatatttggtagtttttgattaaagagagcttagtttctgcgtgatacataagaaaagtagagaataaccatgtagaaatcccgcctgagactctagaatggtagggaagggaagcctcagagggactttctgccaacaacctcgttctattctctaccactttgtctttcagcccaggcagtctgtcaaagaaggtggaagaagtaggtggtacactgctgtagggaaacttgctgtgatccatgcaaactccttaaataaaacaaacaaacaaaaagaaacgagggaagaactactttcaatgttaagaaaataaaatatttggaaagaagatgtttgagttcgtaagctgaaatagtggctgccaacttcctcagtacatttccagctatccccttcctcttcccctccccattgtactacttggtcagttgctatctcattcaaagaggagtagcgatcagaaagggaacagtggataaactcatgcataaaactaccattttctgtttcacacatggagaggaaaacaagcaaataaatgacacaagtgtatatcacaacaaatacgtattctaaaaatagggttcagaaaggagacagatgaattcaaagaagagagtatacagcaataaaagcagtgaaaacagaacaagagttcagtaaaaaatgaaaatggaaatgaaaaaaatgacagaaataaaatagacactggaagcaacacaaatagaataaacttgattgaaaacaaagtcacaagcatagatactaggttggaaaaaaatctgacaaaatgaaatgtgtatgaacagtgtgaagtttttataatgaagaaagatacggaagacagggaaaagagagacaacatgtacgtaattggtgatcctaagaatagggaacagaaaaaaatgaatcaataaaaataaaaaataaaaagaagaaaattgttacaaagatttgaatcttcaaattgaagttcatactctgttctaggacaattttagatagaacaatgaatactgagagatactttaaactgtttcctgaactccaaggataaatattcaaccagatgaacatttatggaaaagataccagctacatgtaaggagaataaaggttggctttcaatttccacgtaatatgagaacccagagaagcaattactacacaattctgaaggaggggaagtatgactcaagttttattttcagtcaaatatagtatcaagagaaagacattctgaaacaaaacttagacaatatagaaccctggagctcttctttaaactcatgtgcatgcacatacatgatgagtcaacatcagtagctcaagaatggaggaactctgatttaagatggttagcatcaaatctatctatggataaaaaataacagcttyagaaattagagaatagcatataaatggtataaactatgataatgaaagcatgttaatgaaaatgattaatatgtgacaaggtaatattggaagaggtatcagttaatttccctaactacatagcatggggttaatagctactacctaatgttgaaatagacagatgattctaacctcctaaagtttttccattttttacctcaactttggagtgcccttgtagaaaagaaaacatgttttgggtttaagaaacgtttacctgaatttcagtttttagttcaaattttctttagtcaaattaaaggaaaagaaaatataacatttaaatattaaaatgcatatataatttgatttcatttttttcaaaattaaggcttatgtatgtatacatctctctgaccatttttctaccttggtaaacatttagctatgtttggaatgatgtttacttggtggtagagatggctgttttttttctgataaatggaatttggatgacttaaagtgaaactttctgaaacttctctttattacttgaagtttttatataggacatatatcatctcaatgaaagaatagtcattcttttaaaaaattacagccttaccaccatctcttctttagaattwttttccattagctactaaagaaagtctttggcaaatacattataaattttggaattgaagtacaaaataaaagagatcataggaacagtatcttctccaatattttaatctaaaaactaattttgtctagaagaatatatttcaagaatgcatatgttacaaacaggcaccacctgggattcccagataaagatatttcttaagttatatagtccataatctcacaggttatacaattaggaagtatacagtagttaattaaagctgtaaatagaagccaagattcccttcaacaaaacagaatgacataaattacaatttttgtgtaaacctattaccactgctgcatcaattttataagggatctatgtaagtctactgtggttataaatttaagaaaatcacttgtacacctgtgaagcactaaagcatgcatggtgaagaatggtaggaaaagaaatactttttctagtgaaatgattagtgcacaatagtgatcgacttctacaatgaaccaaaatacaaactaatgttgattctttgctttaaggggaaaaaaggttattttttacactcccccttttgtctctgtccttcatcacttgtttttagagacaaattctctggagtgtttataaaacagcagtcctgggaaaccctgatttagtgggtttttagaccttggggctctggggtaccttttcacaccccaaatggcacactgggaaggctagatatcagagatcaatctacatccttgtgagagtgggcctgtatcttttctgtattcaccagtaatgactttaaaattcatgcaaatcagaagtgcacatttggaaaaaaacttccaggatattacatcagagtaactgtcaacctctttaaaggaaaattttgattatactgagctgctttacctgcctattaccttccttcaaattaattattcctcagatttaactgtatggtattaatacttttaatacttttgtatcaagaaaaggaagtaatctgtactcatagccatcaacaagtataactgtgcttttaggagtactgtgtttgccgaggtcatggtatagttcagtataaagtgttttaatgtgactttttgcacagcacgtgaatggactttgaaatagcattgcatgtctgagaattctgtctctttaaattgtctgctttgcttattggaaatgataacaatgattgtttgaagttattattaatttttttagttttaacaaatcctaataaaggaaaacatatctattaaaaactgaaataactactcactgaaataaacagcaaacattatagatatacaactttaattttgaatggtagagaattttattaaatgaagagaggcaacttaatagagtattaaggacagacaccagatgcatttgacagatctgaatttgagtcaggttcttacacccattagcatttttgactttagtcttttcacctaacttctctgagccttaatttctccatgtagaaaatgaaagatgatgtctttcctatctcrtttaggattgctgtaatataataatatgtataacagtattgcttaaagaatattacctagtggccattgcagtgcataagaactggtaagatgccttacctggaaaatataagggaaaagtgttggtttttttaaaatcatgaaaagataagattgaaaatgrcgtgtctttgctgctaattaatgattgctttatgttcatggagctgtaacatttttcccacctgcagaacatattatagtaagctctagttatattttctaggatcgcttttaataaaactttaacaaacactcgtgaattccaacaaaaatcttgatcattttacagaagtgtatatccaaaaccaccgtgaagctggaaatacrtcaaagacgtgattacatttgtccaagttaagaggacaaccaatgagggcacaatggacagggttctttaggtatgttgggtataaattgtgataatttttatcttcgtagggttcctgaagacaagcaagtaggttttatgttttctaagatgaaaaagaacaatgatgctttttgaaataaagctttggagaaagtctgcagaataacaaaggttttcatcattctaaaatcataaaggcaaatatttataatttcctcacaattgtgagctataacaatttatattatatcaaataatttttaaatgaaaaatcaacctaaagggaaaaggggagaagatactatagagaggactgacctgtaggtgggcatctaggagatctggcaccgaggtggtggcatttctattttctctgggtttcagttctctacccatgaaatgaatgggttggactagatgatccctttcagctctgaaattccgtgaccttgtgacattcttcatactctgtgacataggaagtgcatcacacactgtagggttttccccttctgtcagtacagtgcactgcacagtggataagaatgtagactccagagccagagagagttgtgtttgacttgtatctacggagcttgtgatttttggcaagttaccataatttctttaagtttctgtttcctcatatattaaacctaaagataatgcctatagagttcttgaaatgacagaggaggtaatgttggtcaaaaccatggatgggtactcctggggctccatagtgggtttcaagggcaggtgtttatgaagccaggttctggggcctgatgatctgggactgaattccacctctgccacatgcaayctgtaggtccttgggcaaattacttcctcaagttctgcttccattttctcttctgtatgtatggttgatgataatacctacctcctagggttattatgaggattaaattagttcatacatataaagtgcttagaaaagtacctggtacatgtaagcactctatatatttgctatcgtcatcattatcatcatcattattaaagttrcacatagcctagggtgaaattctactaaaaattttagggaaaaaatactcatttatattatcaccaacatgtacatgttatggaatagaatgaaagtttccataaatattgacagtaaagttttaagtttaactccagaaagacaatgcagcactgtaaagcactttctggcttcctaattgcactctatgggtaaatttctgtttttttcactagcaattgtgtattctactgaatttgtaaccttctgaatagtttattattaaaaacagaacaggctagcttttttttttttttttttgagacagacttttgctctgccccaggctggagtgcagtggcacgatcttggctcactgcaacctccgtctgctgggttcaagcaattctcctgcctcagcctcccgagtagctgggactacagtcacataccaccacacccggctaatttatttatttattttttgtatttttagtagagacggggtttcaccgtgttagccaggatggtcttgaccccttgacttcgtgatccgtctgccttggcctcccaaagtgctgggattacaggcgtgagccaccgcgcctggcctatattgacatagttgacaaataatcttaatttcagtttaataatatgagattttatagatttatattgtagattctctattatattatagttgtctaagattcatggtaaatgtgtttttgaaaatgtcaattcaattgttaggtttagaagaaataatgttaaccataaaggagtataatttgacaaatatttaattagtatctacaaatatgtcaaactctgctgagaactgggcatacaaatatggatatgctcaaatcctttctgtggaggagttcagcatttggggtatggcaaacattgttggttggctgagtcgaaagctcttgctaacactcttctttcttgcmtggctatacaaaagcattggaaaattcctagcagctactgatatgtgagcagaaacttgctggaagtgatagtggtggtggcggtggtaaagatgcttctgttttcttattaaaagaggatgattgtagctagtgctccccccactcttcttcttgccttgagcacagatctaatacctacaggatagcagccatctggggactatgaggtgataagccaaaaataattggagagatattaggcatcattaagtcagcaatccaacattaggtgacactacttcctgactttttattttcaaaggtaaatgataaacccttttatattttaaaacatattttaaaacaattttaaaacattgttggattttctgttactgtatccaaagattattctaactaatgtgggaaggaggtatatttgcctacatacaattatgagacatgttagttgctataactataataataacttttctaaagaacaatatgtatttataaatgatatgtgtaatcttctgctttagtgcatatgcgtgtgtgtttatttttcttgtaatgccatagtactagttagagtatgataaataattctccaaaagcaagagtcacaatcttgaaggttctaaagagccctgactcagaaggaagagatatatagtaatggaaggacaagtttgaatccctaaagcctccaggacaggtagctgaagaagaatctatactagaatgacagggttcttgcttagatccaagtttcagaaccagagaatgccagagatgaagaggagtgaagaaggaagaagagacagtaygtacaaaccataacatagaaagtctctgatgcaaaaggatwtgtttttagccactcactccagatggagaggtgtgacctgggaaaargaaataagagatttggtgacagaggaatggagtaaaaaagtctagcaagagaaacaagagactgcaaactgctcctgttttttctctcaatctacaaccatcaaatagaaaggagactaaagagataataacacaacaaagagctgtataaaaaaatcacaagagaaatttcccaaaaaacattggaagattaggataaaaattacccattcgctcagggaaattatactagatatgatacggacaagcaaacaaacaaacaaacaaaaagcctgaaaaaatatctatgagaatcaaagtagaggttcaatgaaaaacagatgaaagaggttatgtatatcaggagagaaatgggagagaaacacgaaagctttcatagacaaaaatattagaagcaataacaacaagtggaataaatgtgactgaaaaccaagttagaaatatggagaaaagctttgaaaaaaatcccataawatttagttcaaatgcacaaaaacacaacatttattatgggaagatgaaagatgtggaaaagaaaaaaaagggatccaatataaatataatttgtattcttgaatattaaaatagtagaagataaattcctgaaataaagacttacatatgattttaatggcattctgtatcacggtaaggttaataaatattaaaaataatgaatacatgtatgtgtttattcagcatgaatatcaagtcacatggaagagagaaaaatgaggttagttttcccacaggtttattaaataccaaaatcctatagaattatgtgtaaaaattctgagtacaagaaagtatataccaaggttttatacccacccaagttatcttttaaatataaattcaaatgcacaaacattttcaagcccataagaagttacacaagatagtataaaccctcattaaggaaaattaaaacaagaaaacactgaaaaacaataaggtaaacaaagacttaaaaagattcttatgcactggggccttctgtcttattttgctgttttgaatcctgaggctaccacttgtgaatatgcctgagctagcctactggaggatgaaagactacatggagcagagatgtgctatcctagctggggcttctaaatccaacaagcttgtaagagccagacaaatgaatggggctatcctagaccatcaatccccttcaaaactggcagatgacttcagagatgagccagrccagccccgatgagaattgccttgctaactcacacaattatgaacaaatacattattgttcttataagtaaaaaaaaattgaatagccaccctgtaaaaacaaaacaaaacaaacaaaaaagctgtagtgaatttcagcctactaagaggtgaatcaagacaaacaattcaggtatggagggattccaactaaaaaactgaatataaatctttaatcaatgtaaattcagaacgaaaattaaaaaccatgagcactatggttattgaataaaatagaaactatgaatgaacaatgaaaaatataatatcaaattgatggaagttaggataaaacattaatacgttcatttcttcagcttttatagcaagtaatggtcccaactttttaaagcataagtttttcctgaactcatcaatattttattacacaatacattttggagtgttaagaaacatttatctctactgcaggataaagatgggcattaaaaaaaaacaagaaaaaagaaacatctcattttttagtaaattcattaatttcatttaaagttcttatactgtgattaattcaagtatagctatatttaatatggtacatatatttaatatagtgtgggtagcttgagtccattttaacaaaactgatcttcagttcctatccacattacctgttggcctttcttcctctgtagcttcctttgtatatatttttatcaaaatatctgaaataatggctattttgaggtgaatggtttttatgttatgtgtaacttttgagttacttgacaattttttgaactttttttttaaaaatactatttttattaatatattcagtatggaatagaacctttctactatacttatttgtaataaattatggattttaaaatggtgggwaatgttgagtggtctttgaaggctgtaacatttacagggaaacactggcaagggtttcagaaaaaagcctttaccttatgttttcaggttttcccttttactggatatcattttaagattttagattccaagtttgacctaattaaagtttcagtggcagttgaactgcctacagtgtgaaagtcctgcttgtcaaatattttatctcttattttagaaatgaaaaaaatcatgataagtatacatttaagggctattttatgttaaaaaaaaaaagtcagattgaagccaataaaaagttggtcaagggtaatttaaaaatcaagaaattattttaaagttagctactttaatttcaatatccaaatagtgggagaggaaaaagagccaatttgttaattccttggaaatacatggtgagtcacagtctaatttcagttcaatgtgttgatgctaaacaggaactgacacccaagaatttgaaggtaaaatctggtttaggagtcacagaggcataattgacaatgctcttgaacctacagtgaagaaccaataagcaatacataatttttaagactgtaagctgagtgtggtggctcacgcctgtaatcccagcactttgggaggctgagcagggtggatcatttgaggtcaggagttcaagaacagcctggccaacatggtgaaaccccatctgtactaaaaacacaaaaaaattagctggacgtggtggcacatgactgtaatcccagctacttgggaggcagaggtaggaggatgccttgaacccgggaagtagaggtgtcagtgagctgagattttgccactgcactccagcctgggcaacagagcgagactccatctcaaaagaaaaaaaaaatttaagactgtaattttgaggaaataaagagaacaaatrtatcaaacagaatttgaacattcaaagatatttattttaaatatttcaccattaaaatgtttacatcttatagtgtgctgatggcatcataattactcaagttttaaatgaatttaaatttttattacataatttgtaaactttataatacataattctgaatctcttaaataattgagacttctactttagcaggtagaggttgaagttataagagaatagaaaacatctgggggatttgtcccaggaaaaagctaagtttttggaaatagaagttgaataaactacaaagcaaatgaagataaaattactcttttcaagatgtagagtagtatatacatagcacagaaagagggagaaagagaaggggtggagggggatagattctagcttcgacttttgcaaagtttattagcaatttggtaagacagatactttaagaggcttaagcatacctctttatcacaccacttaatagttaagtggtgtgatgtagagaagagagtacagctttggaatcaggcagaagtaaacttaaatcctgactctgccacttcctgtctctgtgactttgtggcttcactttatgcaactcagcttccctgcaagaaacaggcacaggagttcttaccttgcaagatagttgcaaagttgtttgtaaagtacctggcactgtactgttcaacaggtggtagataattactgtaataatggaataatgagataagatgctgaataatttcaaaataaataatcaaaaaaatcatggagtaggttgggtgcgatggctcacgcttgtaatcccagcattttgggaggccaaggcaggcrggtcacctgagaacaggagtttgagaccagcctagccaacatggtgataccctgcctctactaaaaatagaaaaattagccaggcatagtggcatgcacctgtaatcccagttactcgggaggctgaggcaggagaatcacttgaacctgggaggcggaggttgcagtgagtcaaaatcataccattgcactccagcttgggcaacagctcaagactccgtctcaaaaaaaaaaaaaaaaaaaaaaaaaaaaaaaaaagatggagtaaaataaacaaaagcattacttttgcttttgcttgttacatttagagattaattgcgatttgagaccacatacctttttttccgattcatcagatatattcacctttgcctcctcttcccttatctattcctttcttcagcaataacactgggaagtcactagtctacaaagctccctcccatataaaacctatggcctatgtgatcacaggcacaatgaacaggtgaagaaagaaataattttgaattaggaaatacaatgaaggaaatgaactaggaattgagatagagaatgtctgcttgggggaagtgatttagataaagtgtatttagatcaggtgttttctcccttcaattatgcctcttccacattgatgaggaggttggtaaagatgtgaaaattagtaaggggcagagttttaattaaaggtcatcattttctattgaacagcaccattgtctggctttggaaatcattttctttaaatggaataaataaaagcagtaaaatgtcaagaaaccactttttaatttattatccaggtaaaaaagcatttctctccattggaaaaaaaataatccataggaaaaggagcttgtaggaaaaacaccaatcccacattgtgtactatttcctgtttttgtgattatctctatgaaactaccttgagggtttggcgagtaaatagtaacaaattcagtcttactaattttgtccttttctttgggggtaatacagcctaacaacaaaatctgttcttaaaatactgcgttctactagagttatttcccttttggctggaggaagtggtggctttgtcagactgaacatacatagttgtatatgtttaaacaaagcatcagaaacaagaaacttgcagagttccccaaaccaggaaatattttataaagataatgaatagcaaataattgacatgatataagttaaaaaggcatttatcagtgagtatactagtcttttgaaagcagtatttgttagactaaggatttcaactacttgccaatgccatcagttatcttgacttattgtaggattagttctgtagtcctctattagaacggatcaaggttacaggcaataatgatggtttccactgaaaaaaaaagccacaaatatcttgtgtttcaaaatttctgtgatcagcattttttgagggaagaagcattatgggaagaaaaagctaacagagatgaagtatcagacaccatgccatggggctgtccttacatgtgtcatcattttaacagggaagcaagatacatttctctccttttctcatcctcatcattaccatttaattttttgattcacatgaatattgataggtggcttgtggcttttgtccatgttttgactttctttaaagacaggaagaaattttataaagagtcagacttttaaagcaaaaatctttctctgaaacttttttgtagaaatcaaaattcaggccttcttctcaattcaatgaccctgttaattaagtatttgtcactactcaaatacatggctgatacacagccatggctccacagccagatcttggcaggtggctttttttttttaacatcaaaatgcaggtaagttatttatgttaggtgagaaaactggtttgattcaatgtccacaaatattacctccactcaatatttgtaattgttgcttcagaatataagtcctttgagtacagaaattccagacctgatatagaacttactcatgcaataagaaacatgtgcaaggtatagtctcacagtttattctcttccgttttatgctgcactttggctgatgcattgcaaatgtatgttaaaatcaaccaccctctgctagagacaacacatgaatctattaacaaaattaacctctcaatttgtattgatttctccagttaactggccagaatctaactagtctctagaggaataggacctgggcagtcaaattctgcatgaagacagggacacccaaatatttgccactagttttatgttaataagactcacttgaaaaagtaatatgaaataggtttcatggttaagtaagttttgcaattgcgtgagttaaatgtagataaaatatttctttacttcaggacttataagagccttcagtatatgaatagattaggagaatcctaaggattgggaatatagtatgcaaagtttcccaaaagtattcgatcttggaacctctccgcactctgatttttttgagcaatatcccctaagactgaaatacttggaacatactatgggaaatattggtgtagggcttgaagactttgtacagtatgtgaagctctttttatgccaggaatagttcaagattactcagtattagggttaaagcagaagacaccaaagaaaggagattggccaaaatggtcaggaagtcatggacattaatttcgtttattccccaatattattagtcataagcataggcactgtgcctgaataattggggcagtctgattcagcaggcatcctggtarggaatgaagtcactgtggcgggatgcatagattatttcaatggaaaggggcattgtaattatgtttgagtgttgtagctaaaagactgcatatgtttgttagtggcctatgaacataaccatggcattataaatagtatcataattaccgtgaaagcaatactgcatctgatkaatgtattttattcggcagccacaagtcttacgaagagtatattttaggtaatgaaaacttgagccttggtatgtttagaataataatgatactaagtttttatcctttcctagtctagtttattaaaaaattgttttttatttatatgaagacattcataatcaaatacatgctaaataaaacctaattgtgtttatttaacccagcaattatatatgaaatatggccagtgactctggaattaaaaaaaaaattctgcttggtaacttagtactatattagcctgatttttggaaacaagttttataaacaagtaggcatcctgaaatacatggcccagtacccagctagccattagagccattaaacacagctctgagataatttacctgtgttcattgtgtcaaaggagtaatttagactgtcataaataaacattttcaaaggaattttttttctttttgttttctgctcctcaaccataaataccagttaaattaaagtagctcttatctatggcttggatttagattcaaccttgtagaaagcattacttttcctatcattaaaaattaaaacatttctcacttttacagaaagcctttcaatatgtatagaatgtaaacaatgatcctagatgacttgcactgctctgagaawtagtagttatttgaagttatttgtccactgagggctttggcaaaggcgagggcagtttgatatataagtagaatattatagataagaaataattacttattgttttgaaaaagcttcccattcgactctgtttaagagaatatgaggaaaattcaaaaaggggaaattagtgaattgaatccatttcaagtcagagagcttagagatcattgaatccaacgatctcatttttttaggtgaagaaactgagctcctaaaagttaataaagcttgagtatggtcagtcaaccagacggtgacctcctcggaacctaggtcttcggactctaagactcatacccatttctgcactctctgcttcctcaatgtctatttcccagccatggtgaagccctgactgaaagagaaatgcctggttgtagcaaatgtgttttaggaatgagcaagctccttggtaatgatgacaaggctaaacagaaagaaaaggaagagatacagtcagtagaaactggtgggtttcttttcctatagcacccttttttattacatgctttgagatagtgtgagtgtgccttttgtgtccttgatgtgtgcctgacaagatgtatgtaaatcacagttttgtaaattgcattatgaatacaattaggatccactaaagttgtcttgtggtaactttctttataaaattattctttttgagtattaaagactaaatttatctgttggtaattctacatagtaatgatatattataaggttttttaaaataattagaaagttttacttcaagctggtgaaaaattctatattcctctaaattttccacctgtctgtgccccccattcccatttccccatccttctgtcccccacccctgtcttcagctcctacttcacctttttggttttaggtaaatttccatgagtacctagcattctagaagtgaactcacagcccagattttatgattttattattagtttatttaatttttttytctttttttttcttttttttttttttagacagagtctcactctgtcgtcaggctggagtgcagtggctccatctcggctcactgcaacctccgagtccctggttcaagcgattctcctgcctcaccctcccgagtagctgggattacaggcacacaccaccacccctagctaatttttgtatttttagtagagacagggtttcatcatgttggccaggatggtctcgatctcctgacctcatgatccacccacctcggcctcccaaagtgctgggattacaggcatgagccactgcacctggcctatttaatttttatcgtcctttcttggactattccttcctattttctctctctactttcacattttattttttaaactcaacagaagagtttgaaagctgctgagtcagcccttggtcactttccagcctgttgttcatgagtaattgactttggctagacataccaaaattaaattctcagattgccttagcttttacagaattgcactggcattcttctctactcttcataatgcgctccccatagaattttattgtaattgtcaggtgtggggtgagggaggacttgtatttatactaattgactttacatcaagatttcttctattgaattcatatatctaattcagtttaattgaatgtaaagactcctgtaataggaggcagcagatctgactcctgtttcctgggtaaattatataagttcatggtttctttatagatacagaggttggaggaggtgattggtgtaatttttagcttgttgtaattttgtgattactgaactggccttaagcccaattaagtggaagaccttgtgtaagtaggtgttgtctctcatagaactaactaggtagcagtcaacatcatcacaataagtagatcggtttcatttctcctgcatttaaccttcttgtgccaattcgccatcaactttcgtcatcagctgtcttgtctattgggtcagcaagagtaagggcagccttttcttacctcaatcactcaccaattatttatgtaagaggagtttagaaatctattccaaatggttttacttctgcagcacttagtaatttatctaaagattcttgtaaatgtttctcttgagctcatatagcaatcttaaaagctgtcttcaggaaaccagatctagtcatctggaaggccctatatttttacaatagagccttccagagttgttagaaatatggagaaaatgctatcatgatcatttccatgtatactaaagyttcagtagttttaattgtgaaaaacagctatcccataaattgaagtgttagtaagacaaatggatgcattgtattaaagctgacagagcagtgactgggaaaatctagtcactgatctaaagccaacacaacaaatcagatgaccttcaatgacttttaattacaatttctgaatacattgctgttattaggaaaacattttaggaaaataagactagaattagtatacaaatcagaaaaattgatggtcaagtaatctgtcagtgatataaaattcaactaagataaattgataaaatacagtaaaattgccaattgttttttgcttaaagacttatgaaatgtacattattcatttctactttctatctaagttaaggcctatttcatcccaaactaaccctgatctagtttatgtttccggaagcaccatttataggttggcatttaataggatttcttttgtgacctaaaagggatgcatgctgtctgatcacctctatagttagaaaagagagacaatagtgattgaagctagaagaatggattttatggcataatcatgttctgatccatacaagatgacaacagcccagttttctgtgtaatacaaattgatgatcttaatttaattattagatgcttacctatccttgattatatatttttttcaggaatcccaagttttttcttgaaaatgttaggcagaaggcccatgataatttcagattccagtgtcgatttagcaatgcctatttttaattaattgatttacatttttattcagtcacaggtcttttaactgataccttttaatgcataaaatcatgtttaaattcttgaaataactgaagtcttaatgaaatatttgagtgcaaaccrtcaattgaaaatgataaataaaagtagtacaaatatctttaattttgaaatatgagggttttctgtgtttctatrgtgttccaattttattaacttttgccctgtcttccgttttctttataactaaaatagtaataaatacatttctaatttaattgtcttatatgcacagaagttctgagtgatactgaatttttggtgttgattgagatttgctttatgtatatgttcagttttaaagcttattatrtatttaagtgaatgtgtgttctctaattgtagggtccatggttttacatatagccattggaacaaacttcttagttgcrttatttgtatctcctacaatccactaatgccttctgctgcctgatgtatcagttataagaaaagtgcattgaaatctcccattattgttgatctgtgacaattgctctttctaatctcaattttactttgtatattctggacaatgttattwctcacatatgagtttggaattactatattttttgctgattccttctttattgttccrtagaaacttctttatttccaatgtgccttttttgcctctctacaagtgtctcactttcttctgttcattgtcattcttcatctttttattttcaacttttctgtgtcattgtattttatttgtgtgtcttgcaaaaagcataaaaatataatttgcaatatctgtcctttacttgcaaatttagtccctttgtatttattgggttattgatatattttgatttatgtctacattttattttgtgctatgcttttacattaactatgcttcttgtgctttaaaaaatattgttctatcttctattttgaattttattcctgcaactagtactaaaacaacagtgtatgctaagtaaacatagagtaaggaggcacttatttctgcttatagaaaaagaattgtagcactggagtatatgggaaggtagatgagacataaatctggtgagatatgcaaaggctgtgctaaaaygccgtgttaggaatttggtttgcatcttatttatgtaggggaatggcatcagccatctcattttagaaatataattacaattgttgtagaagaatgagctggaatgggggagaaatgaggggatgaaactgagcctggtgggcagggaggccagttagaaaaatcactgcaataatccaagtgatgaatgatgaagcagtggtagtgaacttgaagaggaacaaatagatttgcaatatattcaggaggaagagtcaataggtcttaatcaccaattaggagtgtggggatggagtggaatggatgactgtaggcttctggcttgggtgattttgtggatagttgagccactaattaagaagagaataggaaatagcaacaaatttgaggacttcctctgcctggggaacaattctcttatagattgttatgacggaataaggtataagattatttaatgaggtatttagatgacaaacttgcttgggaagaaatgtgatagaacagagagatggtgtcctaataatgaggggaagaacatccagaaccctgaatttaggaaaacagtgtataggagtatttagttacatgaatacatattaagagatttactaaatagcagggatctaaaagttttaccagagcttatgaacagacaagaatttggtttaaactgttctagatatgcctttgaaatgttattgttttatcagttgttagattaaatcatgcttaaagtgctagttttaaaatgaaatctgattaaaacaatttaacacaggtaaattaatttttacaaacaagaaagaatttgtggtcatttggtaataagtatttcctgctcagattgtatcagtcacattcatttttataagagattgtatcagtcacattcatttttataagacctctgcctatgaataggatatgtgagtcacaactatggaaaattaggcctctgaaatgctgaaataatacaaagggttgttttgccaaaygcttgacactaagcaaagacgaaaaagctgtttgatgtgcagatcatcttctgctcttattcttgccatcacatctaaaagttttgggaactgtttgactctctgttagtattaatataaacagatctataactgctatccaggcagctaaatgtctgtcttattcttgattatcttttgcatttaatccaagataaaatattaaacctcttgatttaatgtcacaaaccagtagtactcacaaagctgaattacagactgtcaacaggtggataattgctgaacatttacagatgttagttcacatggaattgtttagaattactgtgtttaacagtgtaattgtagagcaaaatttcaaatgctactttagataatatttttgcacatacccttagaaattttttttccaataagttgagcaagcagaaaactgcataggcgctaattaactcaaataaacacataagtgattgacacaaacatgctttttttttttttttttttttttgtagagacggagtctcactctctcacccaggctgaatgcagtggtgcgatcttgacccactgcaacctctacctgctgggttcaagcaattctcctgcctcagcctcctgagtagctgggactacaggcacgcgccaccacgcccggctagtttcttgtgtattttagtagaaacagggtttcaccatattgcccagcctggtctcaaactcctgagcccaggcaatctgcccgtctcggcctcccaaagtgctaggattacaggcgtgagccattgcacccagcccaaacatgcattattaaacaagcttatctttgagatatattaatggcactcttgctctttttactttgttgcacagctactaagttagatagataattgctttgattcaagatgcgttaaaatttttaatgcatttgttaacatctctaattatataatatcagtctccttgaaaccattaaacttcatttatcaacagagctttgagacctacttgtgcaatgaagtagcttaggcaatagagagtaagatgaaccacagttcagtcctaagtagttttcagtttagtaggataatattacaaaatatgtaaataagtaggtaaaataaagcgtactaaaataatttacaagtgattgtgtaggatataatagtaaggtaatgtgaaaataatttatgtttataggatacaataatgtaataaaccactgaatacaatgtctaatgcaatatcagtactccataaatattagttcttattagatttatgaaacaaagatggaagtgtataatttcctctgtggatttcaggaaggtttgtagaggcagtaatgcttgtattagaccttaagaatgagtagaaattcatcaggttaaaggcaagtaggggagaagatttgaagatcttttaagcagaaggagcagtgtaagcaaagctacaaattagtgagactgagtctgagtcttagttgtctggcatggataggtagcagatgaggaaagaacctgaacttaataaaaaaatatagagatgtagacaagagccagggaataatgttaaggatttgtaatttatcctgcaagaatattggtaacctttgaaaggtattaaacaggtaggtatgggtaactttatctgcttcgtgttttaaaaagatcacttggtgaatgtttggagaatggattaaaagaggtacatctagaagcagggggtcctgctagctsactgctaccatgggccatgtaagagatgatgaggacttgaaccaaggctatggcagtgggtatgaagaaaaggaaaaagatgagatcctgtgtaattcccaggacttggtaaccaatttgatatgagaagtaacagagaggaaaaagtgtcttcagtgacacccaaggttctgtcatagaggcctgggtggatggtggttctattcacggagagagaaatacaaaaggaggagagtatggaaatcatgggttatgtttgagattatggartgtgcattatttctgtgacattcaagcaatgacacctcagaggaattggaaacatgggtctgttgctcaastgacacatcttgggctagagatctagatttaggagtatttagcatatacttggaatgagaaggcatgaactctgggaaataccaggacagaagtagcaggaagatagaccttgtggagagttccatcttggcagtgtgttgtggtattagctgagcccatgttttccacttgttgcatttggrtttcctagttttacatttcatattgtaacatttggcagattttaaataacttgtacaatgtatrgaaattctcaaaggactgatgttttgtaaaacttcttcacaataattattagatatacaaagccctgcagctgtattctataaatagtattgaatgtagtgaaatagtcatcaagctattccttatcttaatcataacttgaaatgttgaaaattctgtttggtggtaagtcatgattttgtcagcaattttcacagtgtcagatctgcccttgttgagagtaaagaattgaaataatgaactttaggtatccttggtacttaatgctatttttgtatcatttgctattgtaatattacttcaactgcttttttcctactttagaagttcagcatgatgcaaaactaggaattgcagatatttggtaattgagggatgaaataggaatgttcttgtgcttttaaagagactcacactgagcttcattccatttattaagtgagctaatttgttccacactgtacctaatgtagaagcaaatttcgaagttattagctaaaggtgtgattagcaaaggccaggcaaacccatttttaactacgttaaatgtccgtataaagcttggagagcattttcctttcttccttctttcttttcatcttttccttttaaccactggagtacctgggtagttgctcctttacattacttactggtttttatacgagggaccttctataagaatatagtgatggcaactcacttactacatgaatgctacttatttctaggagcttaacttggttaagatagtttgacctggcatgattaatatttacaaatggaaaattaaatcttttacttcagtttttattcagtctgttcaccaagttacattgtcctgctatatctggcagtgtacttggtgctatcagaagacaaaaagttaaaacatttgcccaaagagcttagtctaaatgttgggagaaacaagacaaaaatttgtctaagaataaatcggataagaagaaattataaagcttagacgaaggacataaaagaagacctaaccaaatttgcaaaacaaaatatatttattagaataacaaaggtcataaatattttaattttctccacataatccgaaatacaggctcaatgaaagatggaggttttatctgtttttttttttttttcatttatgtatcattagtgcaagagcatagtaggtactcaataaacatttgttgaagaatgttatctgaaagttcactcaaaaatcacattataaaatttggatggaaccagacaagttaattctaaaatttatagattcatagttggaaggaaaagggtccaaaatggtgttgaagaagcctaatgagatgataaggcttgtcctgccagaatgcaatagattgttatttccaaagatgatcacaacactattttccttcccaggtactttttagcaaagtgacattgccactcccccatcaagaggtgcagtctactttaccttcttttaatcaacttgtaggaatagaataaggcagaggtggctttgagtgatgtctgaggctagactttaagacatctgcaatttctgcctttgctttttgtaatatttcttcttggatcccacctatcatgctttccaaagctcaaatagccacatagagatacccacatggagaaaaacaaaggctttagttgaaaaccccagctgagctcccatttgtcagctagcactgtggtagtcaaccatgcgaatgaggctattttggacctcatgatygtccagtgcctgggctgataccatgggaaacggaattttgtggctgcccacaaaatcatggaaaataatgattttttagaaaacctccactgttttgttttgcagcaataaataactgaaacaccaatccaaaaaacttataaagctataacaattaaaacagtataataatagtaccgggatacaaaaatggtcaaattgaagaggatacaaagcctcaaagcagtcctcactcataaaagccttgttgtatcactaaaaaggcattaaaattgagaagaaggaagaactagtggattaattaataaatgagaagtatccataaggaaaaattaaaattagattcttgcttcacattatgaaaaaatacaaacaacagattgattaaagacttaaatgtgatcaacaaaatgttaaaactgtgataagaacatttaagaaaatagttctataaccctgggataaaacattttcatccaaggcattaagtgttaaatgaaaagactgatacatttattcattagaatttaaatttctgttgccattaaaaaaaaagtaaaggacaagccacaaactggaagaacatatttgtaatgcataaaactagaactgacaaagaattttttattcagataatactaagaactcctaggaacaagaagaaggagaaagaggagtggaggaggaggaggaggaagaataataggaaaaggagaaggagggagaagctcaaagaaacaacaaataggcaaaggatataaacagttgatttacagaagtgcaaaaccaaaggacaaataaacatgtaaaaagatgtttagcttcaccagtgattagggaaataaaaattaaatcaataataaaattgcatctcacagccattagatgataaaaattaaagcatgacaatacatatgtctgggaggtagagaaactgraactttcattcactgctggctggaatgtaaattgatattagttctttggagagcaatttggcaacatctgataaggctgaggaagtccatatcctaattgttgacgttcacaaagagacatacaaggatgtttgctgcagagtgactggatcaaatcaaccctgggatttatacggtgaaagaagacccaagacagaacactgaaaggggaggtatgaaggttaatggccaacaggagtggtgaatagatggccttcttttctagaatgagatttctttggtataaaataatcataactgattaaatgaaagtatttgatattattctggcatatatacagaagagactagaaaactagaaaatatcmtacatgtgatatactttatgaagtttaaacagcacagagttctggcaaatgttactaatgatgaataaaatattttgttttctggtgcatgcctctaatcccagctactcaggaggctgaggcgggagaatcacttgaacccaggaggcgaaggttgcagtgagccaagatcacgccattgcactccagcctgggcaacaagagcgaaactccatctcaaaaactaaataaataaataaatttgttttcactgagtctacaaaatgttttatttgttagtgtactttataatgtttaaatatacccttttaaattacttcaaaaatcaaaataaatagagataaaacatgatggtgttacctgtgatttagtgttgatataattttctgagtaggctatttatgttgataaaatatcctttaattttaaaaaggattatcttaaatattatttcagaaaagcaaactaattcctggacattggcacttagaaatatatgtcttgataagtaatgtgcagatcatttaaataacttccctcaaattatactaatttgaaatatgaaaatttagaaaacctggcatagtgacatttttacttccctgaatgtttgaaaagttggaaaaactccaaagtgctgctcatttacaaaacccctatgttgtgtgcttttagaacatctgttcttcaaggtcagaggttattttctgaaggttcttctgcagcgtgtcttgtaagacttgtaccactagcaaatacatttccatcattagcagatatttgtttcacyaaaatgttcaatacatgccatcatgattactcaaaaactgttaaatgttcataggaataatgatgctttgtttgcctcaccattcaaaacaaattaactagagttctacttggtctactgaaattgacatgctaaagatgcccatgatactagtgaaattttacttccttgaataggatatctgtattggtaaaggacagattttggttacataattcaatttatgaacattatcaagtagtgagacataaaattccagattatctacatgaatctcaacaggttcaatgttaactttgctataaacatccattatccacatggtgtagagaaaaggacactkatctggtccacactggctcctaacttgctgagtcatcttgagcaacatttgacctctttatttctcagttaccttgaatgctaaatgtgggtattagactagaactagatgatttctagttttttccataattctctaggcatccatgtacaaaaaaatctaaataggttccgtctgcaaacatccctggaataatatggtgattagaaattccatatgcaaaatatgttcaataatgggtgggttgaacctctgtgcatctttcttatttaaatggaaacaaggatgtggttaattcagcatagaggagaagaactgtggtagcttcaaaggatagtactacagtttcagagtcccttcacctggccacagcactacagtgttgagtggctgctgtggatattgggagacaatgggacacattggccccacctcattacttttgccatggaagagaacctgacttggttcatgaagcagattcaactgagcaagagaaggaatctcataacagcttaatgwtgtctactgacaagcttgagtataaactcttaaagaaaatgaagacttctccaacccatctcatagtgagatgagcttctcatctgttttatgcaaggattattattgcatttctcttcgtataatatatatgtgcctgaaaatgtgtgtataaactaagatattgaggtggctatcttaattttttaatgaagttcaacaaatatttcttgaacactaaatgccaggaactgtggtaagtcctattgccgctaaataatcatagagtaacttctgttctttgagatctactctagtggataataaaagcactcaagtctgtttcctggatgagctcagaccagcagccaagtatgataatcctctgtgccatgaaaatgaattttctgaggaaattcactcaaaaacccatctagaggtaaattcttttaaaatttaaataagtagtcttattatrtaaagactgttacgttaggtaagctattcactcatatatagaaaaagttctttcagtatgtatatatatacacatctctttacccactccttttgtttgttagctaacatggatatttgagttcatacatgtatcaggctaatcccacatgaccaaacatatataacaatcaaaccatagtgtggcatctgcagcactcattttattccacaatgaaataaaaatgaattcagctattaaagtagtctaattctgttatacctacaaatataatcaagaagcaagattttggaacaatatttttcaataaattttcctctgccacaatgcttgtttctgtggacttttagggaataagttgacatatattaaatatgtgagaactttatgctgtattctaaaataacagttgattaattaaagagttaaatattgacccctaggagggccctctgctacagtcaattggagaaagaagaggaataagggcttggcattaccttcaaaaagattttactccaagtcggattcttcatttcttgctgctagacaagagccatcaaagtaaaacagatacaatttccaggaaatacaggaaataaaaaaacactttttcttgctatgagaggtaacgagactgataaaagagaggtagaaaagggattttttttttttaagtgagaggaaacatcgaggaccaaagcccaggaagcacccggatgtgtaaggaaatgaagaggaagatgatccttcagtgagtagtggagcaaataggggaacccggtgtatttaagtgtgtgtgtgtagggtggagagaaacagggaggagggcagagtttcaggaaagaggtttataatgatctattgattatattattattaggaaatgagaataagtaggaaaaaaattgcacctgtctcctttcttcttagctgtggtctcattttagttcctagtattsagaggtgacctaatcagactgcagaatgttctgaaaggttttaaacatgaactgttggttttggcaatcagaagcactgacataacatagtgtatcaaacaaaaatatcagcttcttcacaatactatataaaataatgcatgcaggtctaaaaatagatttaaattcagaataaaattgtcaaagtgactgccaaataaaaacacacaatacacagaagttggagcttttccactcagtaagaatgactgagtttgtggaatgtcagtaaaagatgtatactttaactttagatgagtatttgtgtaatagctagaaaatcattgtattggcttaaatgttgctttgatgaatttctaccaaaatcataatctctgttaaattagtaaattccaaatgagctaaattcaaacaaacagaaaacttgaatataatcctgtgaatataatcctacctcaatgatcctgtgaggtagtattattttggggatcatttttaaatcaatgaagatacttgagtttgaagattaggaaacctgatccaagtttatgatgccagcaagttacaaaggaattggaaatttgagcttagtttctgtcttcaaagcctgtgttccttcatgatactatacagtctctgccatcctaaagaataataaattattgacaaaaagactaaattatattaaataaagttttgatactaaagcatatgattatattctaattccttataatttggtaacccacatttgttatgatagaaatgtttttaaaagaccatttgaaaaattgaaaacctgattttttaaaaccctctgcataaaaaggagttcctttaattcattgtaaactaacttaaattgtaaagccactgattaaatcttaaatctggatcaaaatccatctttgcaaaatttatccaaatttagttatcatgagctaaattcacagaaatgaagtagttcataatttttattttgccagcatcttaccttatgtttatattctatgtttaaagtgtaatggtaagtctttgaatggaaaaatggtgttccaaagttaactatacaaagcttaaggacaagacatttcctcaatgattcttgggaatgagacagtagtaactggatgaattttcatggcaatgaggtaaataacaactggatgagcctctctttttcagagttaactggaaaataaattaaacaaacaaataacaaagtctttctgggcatctcggattgctaagaccccaagcctcagcattttttgactcctttctgattcttcagccctacattctatcatcaagaaatcatttcacctctaccttcaaatataagtccacagactatgatcacttcttccatctctcatctgaatcaatgtgatactcttataactgtctctctaattctgccttgctcccctgttacaatgtcaatcaggtcatgtcatgtgccactttgtggccaccygtttcattcagagaaaaagttaagtccttacaacatattctgcttccctctcccttagtcctgccctgtgtccgtgtttcaaaacctacgcacgtggctctagacaactttgcctgcttgctgtcctctaaaatgctaaaaggacttcacgtcgggacttttgcacttgctattctttctctccagaaaatcttgtatatctgcttggtttcttcttcttgcttctttcagatcttggctcatgtatcagcttattagtgaggcccattctgacgatgtgaccttgactccttattcaaatataaacttcatgaagacagtgatttttggctatttggtgcacttctgtattcacagtgtctagtgtaatcccatagtaggtgttcaataaacatctgttaaattaatagattaattgatggagaaatgattgactatcatatgtgttatttaactgccatgttaactgcagataggtagtatgatctctgttttgctagatatgataaatcaacctgattagcctgatagccatggagttgtaaaagttgacttacaaggtatagttgactatagttgattcattctaaaattcttgtcaggtaaaatgaggtatcattttgtatcattctcctataaactacagagtatttcctcatgaatgattagttttttcaatgtattgtttttaatcacagaggtcttgctactttattttattttagtttagttyagyragatggagtcttgctctgtcgctgaggctggagtgcagtggtgaaatcttggcttattgcaacctctgcctactgggttcaagcgattctcctgtctcagcctccagagtagctgggactataggcatgtgccaccatgcctggctaatttttgtatttttagtagagatggggtttcaccatgttgcccaggctgtctggaactcgtggcctcaagtgaactgcctgcctcggcctctcaaagccttgggattacaggtacgagccaccatgcccagcagtcttgctattttaattaatctggcaagtaattatatctaaagtatacaggcactggtttaatctctgggacatactgattaaccagacaggcaaatctggaatttatagttagttaaacagatgcacaaactaaaaagaaaatatcaaaattgtaagtacaatgcaaataattaaaagaaggaatgtgaggccaggcatggtggctcacgcctrtaatcccagcacttttggaggccaaggccagaggatcatgaggtcaggagatcgagaccatcctggccaacatggtgaaaccctgtctctactaaaaatacaaaaattagctgggtgtggtggcgagcacctgtaatcccagttacttgggaggctgaggcatgagaatcgcttgaacccaggaggtgaagattgcagtgacctgagatcatggtactgcacyccagcatggtgatagagtgagactctgtctcaaaaaacaaacaaacaaacaaataaacaaacagaaagaatgtggtaggaagtgactaggggcaatgggattgggttcttgatgatcatttccacctgcccttcctggtctctttgcccttctccattctgctttccactccagaagaccaaactttatggactctgtcgttggtctgccttacttctggcctctggttgtgtttgaccaatgggaaccatctgcagaagatttgagaactaggggaggaggagggctgggtatactttcccctggatcctccctgccagctccccactgattggcagtgtttttctttacctaaggccaggttcctgttgggcacccttcccctatattttcatgttctgagctgtaggaactgtttcttcctttattctctcacccttggtaaccactcctccctggctcttgtagtacagaattctgcattatatgtgctatcatattgttaaactttataacaataaataatcactatattactataaatcacccctttactaaataaactatatgagtacctgatttgttttttactcacccatgactgataaaggtggtaggaaatacctttgtggtgaagtattagataatgttagtcttgcagaaggcagccataaggaaaatatctaggaaggaacattctagacaacggaaaaatctgagacaaagaaacaaaggcagggatgagctctgtatgtttgtagaactgaaatattttggctcaacagtagtgaagaagagagaggattgtaggaaatgagggtgggatctaggcaggtgcctaccttgaattaatgttcttattgtacttaaacaaaaaaaaagcaccaaaacagagcaaaaaatgtgtgtcagtaaaaggcagtattttgtggggcatgtctttacctaattctgtttatttgtgagttttgtgaaagtgaaaggaaaattaccaaaaataaattatttaaattttcgttttcctttctttgtagcacattttcttaagtcatttaagtgtgactttagtcatcaagtacatacaagaaaaaaagcataaaggaatgaaaattaagagggtaaaacttctgcaggctatatttactatttacyctaataatattaaaaggaatcatgaacgcattgagaagtattttgaagatcaagtttatgtagcagtttattttttaatctatcctcatggctttgttgtgtttgtgagacaaaatgacttcctaagaaacacagattttatttccttagtgttacttctagtaattactctttctctcatatttacatttggtcaattttatctgcttcctctatgcaagaaaaaattaacttcttagacttttaaccttccttcttgttcccccatcactctaatttgttgtattcacatactaagaataatgtttggtattctcttagtttccctttagccagtttatcaactatcttctggatttctggttctcaatcctgacaataaatgaaatcatattctgaaagaacgtcatcattcgttgaaatattttcatttctggtaaatacattgtcttgacttaaaaagtgttttttttggtagcggatgactcctagaatagtacctggcatgtgttaggtgctcaataactatttactgatggaatgaacacaggctctagtgtaaacagatgagacttcataatgtcacttaccacatggcactcaggagatatttagcctacctaagcctcgattatcatcaactataaaattgagataataatagtatctaccatttaccgttgttctaagaattaaatgacatagtgcatgcaaaggacktagcatagagcctatcacctagcaagtgctaaaacattagctattatttttaacattaattatttttcaaccctagaatggtacatttttaacaggtagtacattttaacagcaaaattttagcagaatgtatttatcccccactttgcattttttcctaaaaactgtatcatgggataatttattttgctgtggagaaagactaaactatctatgcctccctccacctgaggtcatttctgaagctgttggcattgggccaggggttgagtggcagaataatctccttatcaattttgttatgtttgatgttgtacaaaataaatagctcaataaaaactscagtttagatgttaccatggttgggaagaaaatggcagtggctacctattaagaaccacaatcacaaatgcagtccttctgtattttatatccttggttaggtgggtttcttgttcttttccttgtttgctccatctggggatgcctgggcacccgtacaaaactcactagtgcctaaacacagacacattagttggggctgcccctgcttcagataccagggagagatttgttggcataatgcaccagggtcttatgccagctcctgattctttgctgatgctgagatgaggaacatggctgggagggggctaggatggaatgaaatctgtggcagccaaagcctccatttgtctttctgccgagtgtgctgagctgtagacactgcagtgttttcaaaaataataataaaaaaatttgctcattagtttttaagtcctgctgactttgtgaaatcaatatagcacattgtaattgatttatgaaatcaaaaaacccctgcttgaccaggaagttcggcagtcgctgctctcagcaacctgcccttctgctcattagtgcatttcctttagtgctgcctgagccgagggcgccttcagagctggaaggctcaagccctctgcagacagtctgcttaagatgtagcttgcattgtgtccctggggtcttatgcttctccccttyttcctaccaggtcagctgaaggacttcagcttctctcttagggtccctaatgttctcataatatcttactggaaaggcaagactccattcatacctgtattttgacattttaatctatttgctacttttcttttctctcaccttttattcttccttgtcttattacttagcttatcttttgccatctgaccttatctattcattgatctcttttattctattttatataacctcacaaggtkaacaatttttttctatttcaattgtctttgtctaatttcagtacctactgttttattcttaagataatattttatacctcttcctgccaaagcctgctataattatgtttgtatgccacctttcaaaaattgaagtaactgctatacaccaaacattgtcctgggtgctttacatcaaattatcttctcaagaagtgtgtaaggaatgcattatccttggttagaggtgaaaaaactgagatttagagaagttagtaacttgcctgagtcaccccactactgaggggcaaggctggtatttgaaactaattctgtttgactccaaagcctgtgtttcttttttccagtacaaaatgattattccarttggcctctgttttacattaaatgcttaactagcaaaatctagctcttggctgcccttaaaggggctcattctctttagtgccattcttccaaataactctgctgttcaaactgccagaatgcaaatgtatttattttaagatcttggtctatgctagcatattggatggcttatcctttttcgtggaattctcrtctatctaatgttatgtgtatggagccccttgcytcatcattaaaggtgagggaagtgttctcatattgtcaaaagtcaccaagagcaatctcataacctagaaaaatcgacagacagctgagccaaataggcagcctttgggagcttcctgtggatttcattttctctttgttcttttgatgcaactttgggagcaagtaagtgggaaaattatagaacactgcagcagcaggaagatgatgcaatgtgctcgatgtcctcacttcttaagtcgttgaaggaacctgtagtttctccatacaggtactgtatgtttcaggtaagtgctatgccatgttcataatgcatgagtttgcaatgagttaataggttccatccatttgatgtcttgcataatattgcagtagcattgggcattactgccattcaatatgtgcaatattgtactaaaaattaaccacagatgccatattaaaacagctgcagatttagatttagctacagaaggaagaaaatgtgctatggaagttggccagaagtgcaatggagatatgctgtaaatgaggaggaggagaaagatactgaggttgaagtgccaaaaaaaataaatggaaatggaaatggggatgggtaagtcatatggtcagtggcaattcaaagggactcaaaatccagaagagtgcagaatgcagggtgacttatgcctgagtgagctgatgaagttttaaagcaggaggtctaatcagaacaatatttagagatatagatgaaggtgtaaagaaaacagctataaatgtaatcattcatttttaggatgcttractgtagtcaggatattgatttaggaataaactactagaaaaactggatgtggctgggcgcggtggctcacgcctgtaatcccagcactttgggaggccaaggtaggtggatcacatgaggttaggagttcgagaccagcctgaccaacatggagaaatccctctctagtaaaaatacaaaattagccaggcatggtggagcatgcctgtaatccagctactagggaggctgaggcaagagaatcacttgaacccgggaggtggaggttggggtgagccgaaatcacaccatcgcactccagcctgggcaacaagagtgaaactctgtctcaaaaataaataaataaaaaggaaagaaaaagaaaaactgtggatgcttgaagtgatcaatgtgtgagaagaaagttctggtgtacagggagtcatagcaattccagaccattacaaaattcaagattatcttgaacactcttgtacatgaaggttgtcctctgacaatggacccttgtgagattgacgattcccattttggagaaaagtgttggagggttcagttggcacaattttgtactgaaaactgaagtgacaaaattttatttcaacagaattgcgggcttgcaagaatctcattaactgtagggccatctgccacgttgctactcatttggctcatttaatcacaggtgggtaggaaggtctcaatagtttyggttccyrttcaattctgatttttgcttgggaaacagaaggaaggtctcaatagttttggttcctgttcaattctgatttttgcttgggaaacagaaaaggccagtgacagctgtggcagtgccagggttctcttttctctgtgtgagccagaagatggcttccctatatagtttgctgctaacagagcaagcagacagtaagcatttcctcgccctagtgtttggctgctgaaagaattatctttgttgacttgtggtatacttggcttaggagaagagacaaggaacacagtggtctctaaattagtaattgacttcatcaggggaggaaagactggttattgactgccctaggtcagttaaagcacctgacatttacctataacttgtgtctgccttcctggctcagaaatgaaatagaaacaaatttgattagtaaccaggaaatacagttggtgctttacaagttattaggtacattctaggcctctaaacattttagggaaaaaagtgtctccagtgccaatgcataaccttgttttccttcctcttcttttgaacacaaaagaataaaaacttgatggaaccccctggtgttccaacggtacttgaggaaagtaaagcaaagcagaacacaacaaaatacaaaaacaggctttttctattttgttttactttgtttttcagtctagtgtttcaaatccaggaaatgtcagttctttcaaaggaccttttctccatagaataaaattttgggaaattttgaaaaagctgtagttctattatgatagtgataaagtagattatagctaacatttattgggcactcaatgtgtgcacaacagtactctgtatctcacctatataatcctattcatccccacaaacatctatgttctaagttctgtttatrctccccattttactgatgtggcaattgagggatagaatggttaacaaattcttccaggtcgcatggccagaagtatggcagagtcattatcaaagcccccaagttagtgcctgagtctgcaccctgggccgaaattttccagcttctgtgatacagaattttatgccagaaactcttacattactaaatttttcattctttcttttaatataaatatacataaaaatgaggaaaacttccataggtgtgttctaatactgtgagcaaattaaaactcaattgaatactattttcacaaatacatgtatgcttatctcactttaggatgaaccaattctaaaagtcctacttaagaaatagttatgaccaggcatggtggctcatgcctgtaatcccagcactttgggaggccgaggcaggcagatcgctagaggtcaggagtctgagaccagcctggccaacatggtgaaacactgtctctactaaaaacaaaaattaaattagccaggtgtggtggtgggtgcctgtaatcccagctactcaggaggctgaggcaggagaatctcttgagcccaggaggtagaggttgcagcaagccaagattgcaccattgcactccagcctgggtggcagagcaagactgtctcaaaaaaaaaaaaaaaaaaaaaaaaggaaataagtatgtgaggagtggctatttaacaagggacttgtcgctagtcaagatttagtaatggcttccttcaaataataggctttgtgaaatttacataaaatacagttaataataattcaggctaagcaataatttaggaccacatttgttgcatatgtcaggccttgctttcatgctactttttatttaattaaataaaaatcctttataaaataatgtgacaggtttagtaaatgtatttattcactggaactttatgaattgctaatttttatttgctatttatagtttctttcagctctgtttttttctctctttttaaaaactgtggtaagaacacttaacataagatctactcccttaaaaatattaagtacaccatactatatatatatatatatatttttttttttttttttttttttttttgagatggagtctcactctatcatccaggctggagtgcagtggtgtgatctagactcactgcaacctccgcctcccaggttaaagtgattctcctgcctcagcctcctgaatagctgggattacaggcgcccaccaccacgcccagctagttttttgtatttttagtagagacagggttttgccatgttggccaggctggtctcgaactcctgacctcaagtaatccacctgccttggcctcccaaaatgctgggattacaggtgtgagccagtgcacttggcccacaatacaatattgttaactctaggcactatgttgtgcagcagatctctagaacttattcatcttgcataactgaaattttatrcctattgaatagcaactccccattctcttaattatctaggatcatattttcaggaacgtcatcgcatgtgtgtgtgtgtgtgtgtgtgtgtatatatatatagtgtgtgcaaatttatttcactcatgatgttatactaaagtatggatttctatatacaaccttgattattccacacttaggaataaaagtttgactaagtgtcatttttcctaaaatatgttttggttccataagtattaaacaaggatacttacatttataaactattttgtattgtttccaaatgaaagcacaagtgatccagacatataggaggctataaagcatgacatatctttagtgacaattggaagtacagaattatggacaaaaactatccacccaactcagaaaagagaatcctgtttcctttactttgctatggcaaaaagttgactcctttatctaacaatagtagatagctatctgaagatttatttaacctttaaaacatacaaggcccagcttacatctacaaatttagagcacatttggaagctctttagataggaatgctgaagtacctctggctttctattttacacgtgacagtgaagcatagaaaattgttccttctgtgagctcttaacagaggccactcttgtagtttctaaagttttattgctaagcttaggctgagggtcatatcatatgatctttatacattttttttttttttgagacagagtttcactctatcgccaggctggagtgcagtggcgtgatcttggctcactgcaacctctgcttcccaggttcaarcaatcctcctgcctcagcctcctgagtagctgggactacaggtaccagccaccacacccagctaattttttgtttttagtagagacggggtttcaccatgttggccagtatggtctcaatctcttgacttcgtgatccacctgcctcggcctcccaaagtgctaggattacaggtgtaagccaccgtgcccggccaacctttatatattctacccattataggtcctttaaacaaatcttgccatttcaagccttaatctattttcccattgatttatattaggtcattattttagacaatggaactatcaaccattggctaattctcctggaagcatttgtagatataaaattacattgattttcacctgaaaggcccaataaactcgcccatactagaaatttaaattttggttcatttcagtaaccaaatgataagcacatcaaagtagttatttggaaagcaatcactgtctttagacaaaaacaagagcaaaaacaaaaacgtgggtatctcctaagaggcctgtgacttgttatacattttaccaataaaataatcatttacrtgaaatttaaagacttactctagatgaaatgaataatgagaaaacagcactaagttcagagaataaaattgtattgacgaagaaagtaaatagatcagtgtggcagaaaagtcatgaaaataagattggaaaagtaagtttgattagtattgaaaagggccaaaaatgccaaacttgggaatatgaccatttttctttagggaagtcactgtagatttttaggaagagatgatgtcattacagttatattatatgaagacatctttcaacactttgtagggtaggctagtaatgaggctattggagtaatctatagaaaaagagatgaaggcaagaatagaagtggtggtgagaaaaatggaaaggtcatgtgggttccagagtcgagaggatgtttgacatgtttttctttgtctgaaatgttcttctctactttttctgccttaccagttccttaatttcaggtctcagctgaaatatcccttttacaggggtatcgtccctgattccctatattagtgctgccattccatttctatgttctccaacactgtttctcacctgcactattagaaatacttataattatttcatgagttactttaaattatttttaaagtccttctcacaagaacatatgttttacaaaggcaggaacaatgtttgtttcattaatacaaatctactagcacctaacagtaagtattcaacaaaattttgtggactaactgacctattattgggccttttatacagggaaattaaagagggcagttggtagaaaagaatcaactctggtttttaactgcagtagcatgttaagcagttattggtctataatttatgctttagaataaatgacttttatatattttcctataaggaggtattgatatactgattgaagaagaccaagatttttggtcagatagaaaatgacaagtcttaatggagtttaaaataccaaaatatcatgtgttaacttagaaaaacagacagaaaggagtgctaaatagaggaaacagccaagaataaagagcagaaatactgtgtctgctctgcagataggacgaacttagcttgatggagaaccagataaacttgtggatgaaccagctcaatgccaccactaatcctgaaaagttatacacaaaccactaagccaagtgctctgtacatgacaatcatagactcatagaattggatagtgcaagataagtcaaagacagaccgcttcccaattcttgatctgatttgcaatatccagccaaatagttgcgaagcttttcctgaaatcctcaggaaagggaaacctttccaacttatttttacttacaccagtagctgatgattcagaagccaatctgaacagggaacatttaatcaaatcataactaagtcaagtacatccttacctacaatgcttaggcatctgctttaatactttgcaaaagacagcagcatgcatgttgtgcatactactcacagatagtacttattactattaattatatgtgaatacctttattagaaaatatgagagctgtatattttctaagtgttccctcttatcaaataaatcagttattgagctagctatcaattgcagaatcacatgataatttgcttagattgaagcaggctttttgaaatgatgaaatgccgattttaaatgggactaaagaatgacccttttggtcagctacaaaatggcgagtcttaatggagtctaaaataccagattactcatctcctcttcatcaagagctacctttgattccaggcctattgtttcagaattgcatctgtggattttagacctattcttgactcagagcttgtgctgacctggactggaatacttttttctccttaaaaaaaatgtattattaagaatgcttagaattcaatatgaagaaaaaacaactcaactaaatatagatgaaagtcttcaacagacacttcagaaaaaaaaaaacaaatggttggtaagcacatgaaaagatgtgcaatgtcattagtcattagggaaattaaaaataaaaccacaatgagaatataacttcctgctcattaaaatgacaaaacaaaaacaaaaagtcacatattaagtgttgtattagtagatgatatgaaccaatgaaactcttatacattactgatgggaatgtgaaatggaataaccactttgaagaacagtttagaagattctttaaaaaggtaagcattcacttacactacgaaccagtaattacaattctaaatatttacccaggagaaataaaaacatatgctggcgaatgacttgtatataaatgtttacagcagcttaattcacaatagtcaaaaactggaggcaacctaaatgtccatcaacaccaacaggtgaatgcgtaaagtgtgctgtataggaatacacaggggagtattactcagcaattaaaatgaatgaactgctaagaagcacttttttagattactcctttcttcttaaggaataacttattctccagcctatgtcaccagaagctgtgaatcagaagtaggcctaaacttgtaatgagcaaaagaaagcaagaaacaaaaacctacattgaatgatttcattcgtatcaagctcgaaattaggcaaaattaatctgtggtgatagagacagatcagtggctatctggtagggcataagaagactgactacagagagactcagggcaacttttttggtgatagaaattttcttatatcttgatttgtgtggtggttacactggtgtatacagttggtaaaacctattaaaccgtatactttatgcattttgttttatgaaaattatatttcaataaagttgattaaaaataaataaggctggacgcggtggttcacgcctgtaatcccagcactttgggaggccgagggggataaatcttgaggtcaggagttcaagaccagcctggccaacatggtgaaaccccatctcagtaaaaatacaaaaaattagctgggcatggtggtgggtgcctgtaatcccagctactgggaaggctgaagcaggagaatcactkgaacctgggagatggaggttgcagtgagccgagatcgcaccactgtactccagctggggtgacagtgagactccgtcttgaaacaaaataagtaatttaatagtctaacaaaattatttgagagtgtatttaatttagcactttaaaaaataaattatatattgctaattataaatgagaatgttactaaaacaaacttagaagggcatacttaaaagtcttctatatagaattgcttggttaccaaaagtttagttactatgaaattaatgcttctaagcttacagatactttattgttcaatttagttcagattgttcttgtcatttgttaatacaaattattgagaattcattgtaatattgatgttagcgtcatatcaaaaatgtggaaagtcctagtacaatgaatattatgaaattttcttctaattgtcaattttctttttcaaaactcatacattatagtctttactcaatactgttttatttcaattggaaactgacatttttgatatttataagagatttaaaattatttttcataaatatgtagattacaagactatgaaatcaatttgaacaattagaaaaagaactgttcatttgatcttagccaaaaggctgagaagcaataaaaaragaaccatttttaaccctcctcaagtgtattactattatagcatattttgtaaacatgatgtaaaactgcttgtggttgacttagtttttaatactgacatttctgaaatgttatttctctctactgtatttatttatcctactttttaatytatgaaacttgtcaacatggtgaaaccccatctctactaaaaatacagacaattagccaggcgtggtggcaggcgcctgtaattccagctactcagaaggctgaggcacaagaatcacttgaacccaggaggtggaggttgcagtgagccgagattgcaccattgcactccagcctgggtgacagagccagactccatttcataaaaaaaaaaaaaaaaaaaaaaaaaatctatttgacagaacctttaaattgtatctatataaagcttttaatattatgggtttgcttatgttcatgtcttacttagaaaaagcactttatgaaataaatttttatcaactgaagtaataaaacaatctggatgggcctgttaatgacaaagttaactattctccgagagcaaatggaccaaaaataccatttatgcagaagtaagaggaaaataatgatttttacgttaataaaatgtattctgcaaggcacagtggtgcgtgccttaggtccagctactcaggaggctgaggcaggaggactgcttgagcccaktagtttgaggcaagcctgggcaacatagacctcatttcatctctaaaaaaatgtattctttgatgctatatatagtataataaattttgagctgattatgtcatgtgggtaaaggagttgaactctgaagccgaataatgaaggagggagaaaactttagcctgtgagagaaagaaatctttgttcattccagtgaaactggaaaaccacaataaattgactatatgttgttaatttgagaaggcgatattctatcataaggagtaggtgtgctatggcaacactaaacaaagcttaaaagctcagtggagtgtagagttcaagatattataaagactgttaaagaccatagattcaaggacaatgaggaaaattttcaagagtcatgggggttaattaaagaaaatttaattttcatttcctgaaacaaatattacagaatggaatatactgaagtacattagcatgtttaaaaaaaaaagaatatgctctgaccttgttgaaaaaaaatgattttggctcagaaatgagaaatattaaagagaagaacctattgttaatttataataatagtagagatgacagggtctcttgtaattaaaataaattatgtttatggtatattttctctttgttgggcactattgccaggaattgcctgcaaattcagtgaggtgggagtggtttatacccttacctgttcttaccaacacagttataatgatgacatttgtcatttattgagtgtttactctaagtgggcactctactaggtgcattacataaagtaatcctcatagtaaaggagtgaattacactcctggttttataggcttaaagaagatgaaaactggcacaaagccatacaaattataaagagtacaattgggatttaagcacagtcttatgcttattctaacactgtttatgtatgtatgtatgtattttttttttgagacggagtctctctctgttgcccaggcttagagtgcagtggcacgatctcggctcactgcaacctccgcctcccgggttcaagcgattcttctgcctcagcctcctgagtagctggaattacaggctcacacaaccatgcccagctaatttttgtatttttagtagagacggggtttcactatgttggtcaggctggtcttgaactcctgaccttgtgatctgcctgcctcggtctcccaaagtgctgggattacaggcgtgagccaccacacccagcctttttttaacttcactatcctgcctcattgctgcccagtgtaattaaagtccaaatagatacattttcattttttttcctttaagatgattcaaaggggaaaaagagcaaataatgcaaatactcatagaaaggcaaataaacttgcatgaaaagaagaaaggaaagaaaacaactgaaatcctggcacaattaatagataacttctttctatttcacttggttgagggaattttcttgcttgaacattgagaattcttgagatctgtattatcttgaaaaacagaaggactaccaagaggaaataatacacagaggatggtgttaccatgtatatactgtctcttttttggtataattcaaatatcacttgggcaatcatttgttatcttttgaaatagttctgcctggagataaggaaagatttttggctttctaagatatcattttggggctatgtgaaaatagtgtcattatgtagatgcagattttctggttatatttcatggatatttgaggtcacagtcatctctaaatttctataccttcctctttgaaatgtattttcttggcattattagaatttatgtaaaaataagtaggtgataaaaatttccctaatagaagaattgtatcccccccccacccaagaatatagaccttttgtggagtatttctggctaccagttacctcactgaactcaaatgtaatattaccatgactgtctgggaaggaaagaataattgttacatatctgctgtatatcgagaagaagctgactgtgtatgcaggtaatatatggatgacttcctaagagatagtgctgtaaaaccaaagtgaaaatacaacagagtaactgtaaagaaatcccaatagccatccttatgactgacagactataaacttttgtggatgcttgaatctaataccttcttaccacaactgaccttgctctagtttagagcttctaactttcatgtaatcaaagtgtctgtatttttgtgtgggtttaaagatgtggctgtccatgagtggccctgggattttttacaagttacagtgattttgcagttgttgagataggtgccacgcattaaacctatggaactcgccttgactccaagtcaattctagccttatagtactttgtaataatgatgtgggagaaatctctgaggtaggtcagtactgttactctcatgttcatgtagtaatcctgaggttcataaactttcatgctgtttcactaagatgtttctgataggagttacagatactctccatgttgtggaaatatagagggtctctagggtcaggaagccttatgaatgttgtgagaggcagcttttctcctcaaatgtgaggcagctcacacaaaagaartacaaatagttaataaacaaacaaaaaattcaatctcaccagcaatcaagtttgaagtatatcagctttgacctatcaaattgtaaaagagatcttaaaatttctagtttgaagtatcatggaataaaaattttcataactactgggagcagttataatacaaattatcatgaaaacagtgtggtgttatggatcaaaaatgctaaatctgtccttttgatgcagcaatttggcatataaaaatgtatcccgaggaaataatccaagatacaattaaagttttatggataaagctgcttaaaattttctccccaactttttgatattatacattattcaaatgtgcatcaatagcataataattcaattattgcacattcattttatggaacgatatgaggccattaaaactcatgattttgaagaagttttaatgacatggaaatgttcacaatgtaatgataagttataaaaataagacataaaattgatatacagtatcatttcacatttgtaaatataaatgcctgtgcatagatgtatgaatgtttgctggtggttttatctgtctattaatattatgttacattttcttattaatatttgatttttaaaaatattctgcaatgagtatatttgcttttgcagtcagaaaataaagcaatggatgttattttaaaagaaatagctcataaagtaaatatatatatttacatataatattwgtttatttatttatttattttgagatggagtctcattctgttgcccaggctggagtgcagtggtgtgttctcagctcactggaacctccgcttcctgggttcaagcaattctcctgcctcagcgcccccagcagctaggattacaggcacatgccaccacacccagctaatttttgtakttttggtagagacagggtttcaccatgttggccaggctcgtcttaaactcctgacctcaagtaatctgcccaccttggcctcccaaagtgctgggattacaggtgtgagccaccatgcccggccaaaaatatgtatttaaatttaacctattaaaaatgtaactttaagactcaatatggtgctgtatacccagtttcatagccacttatttattcttcttttaatgaatatgtattgagtgtcttttctctgttaggtgctgttttaggcactgaggagacaacctttttgtttgcagaaactcctgaatccaatcgcttctaaccacgtttttttagatatgaactttcttcatatccagtttcttcattttgtctttcctaaatgtggttctaaaattgtattttctctagtttaaattcatcttgtctcttttttttaatttctttcccttaatgtcaaactaatatgtatgtatatcttttttcgatgtgttttatatatatatataatatttatttagatatatactctaaaatagtgtctgatattccttacttgccatactgtagaatcaaactgcctcttggtattgttttggaaactgtttttaaaaattaaaactataccaaaatccacagccagcaacatactcttatttgatgatggtagagatggtattttgctcttgagtaattctatctaataaattctgtggattttgttggcaagttttttctagaaacagattgggtttttcaggctcagcagtcatggggcaaagaactacttccaagtggtaacttcatgctcagagtataaatttcttttcttttagtatagacttagacttttatataaagaggacaaatccaattcagtagctgttaaaaaacccattcatcaaaaagcattcctaaatgtttgaaacacactgaatcatagattttattrctattcagtagtacaatgacttcctcccttctaagaacctattaactactcattgttgtagaattgaacctttcgagggggtatattctttcttaacaggatttggtgaaatataatgataatttaaatctactaaacagattatttttctcactggcactcttatctttatgtttcacacctcagaattttcttaagacttcatttttagaacgttcatttttaaaaattcttaataaatgttagaaaatgtgtcagtttttatttgatctgggaaaattattttaatggactgttttacatagtcccgcctcatatggttgtatcatttgcatactgcttaaaggtatagagggtgcagatgcaagtagtggttgaaatcttgtattgctgagggaaagatgtcattttccaatgcagttaaccagatgggaccattattgattaattaattgtaattcatatgcatgctatgtgtatatatatatgcatgtgtgtatatatgtatatacacatatgtagatatatgtatatctacatatatctatctatctatctatatatatatatgtctatatccatatctatatctatctatacctatatctatatctatccactagcagatgacctgggcttatataagacaatgttttaattgttaacaaatagaaggtcatggtttatgtcaaggctaatgtatgcgtgtatgtgcttgtacacataagaaaaatctcacgtttccagaaaaatagtctattttttgctataaccattgtttcattagcagaaccatcaacgttcctaatggagtgttaataatcacctgcttatagtggtaccaggttctatgttatacttaatatttctttttgcgctatgaacttatattttaagaaaattgcaatagcatatatcaaatgtaagataggccatgatatccaaatacaaaaaatttctcttctaattctcccatttagttgaatttgaaacagggaatgaattcaggaaagtatgggaaaagctactaaacatgtcttaaataagctatagttctatgttgggtaacacagagatatggagatgtgagagcacactgattcatgttgtttttttccatatttattttcttcttacagatttagaaccctgctaagttctaaatatggtttgcctatcagtgatcaccccaaaacttgtggtttttattcttatgttaatgtttgtagaagaacatcttattttggttaaatgtagccactgcttccccctcgccgtaaattaggtgtatgatctattaaatttttaacactaaaactgacctacagttggctatgttaaaaagcttctttgaatctgatagctcatttttagctatttctttgaataatctgaaaggtatatcctgaaaaaaaaatatattacatagccgagttaacccagctgcatattaattctttaaaatgataaatatatgacatttggttattttaaaaagtaatgacatcaaataaattaatttttcatttcattatacaaagtcttttaggattagttagatgatgctaaaattctgtacatcaaaaatgagaataagacttttttacttaaaagattaatttaattgtctacacataatttaaaaggaacttatttttcctaaattctgaccaaaaatagggaaaattgttttcgtttattaatgctgatggttaaaatatgtaacatttattgaggtcttctgtcagaagcttcactatttttcaaaatggcactataaaataataactattgttatcccaattttacaaattaggaaactgaggtacaggcctctcaagtaatatgtcaaagtgaaggaagcaaaagactcaaatcttaagtcctgactacagttctatacactgcctttatggtactgagctatattaatttcaggcccctctccagacttatatagtgcttgcaaagcaaacaacaggctttggaattgccaaggaggatggatttctctcaaaattgttttataatgatgggaaggcacatttcatgaaatcattattttcacttaacatagaaaaaaaatctgcatgctgaaagtactgttctaccctcctatatcaagtatcctttgaaacatatgcggcctttgactgagcaaagaaataaaagaagatggaaggaagagagaaaaattcagggaaaggctttgctacagttttgctttgggacaatcagtaaccgttttctctacgtggaagttcgttagacattttgggaactgtcttgccctcctgggaaatatttagtttggtttaattacaaaaaaaaaaaaacagcttttttttttttcttttctttcttttttgagacggagtcttgctctgtcgccaggctggagtgcagtggtgcgatctcggctcactgcaacctctgcctccccagttcaagcgattcccctgcctcagcctcctgagtagctgggactataggcacctgccaccacacccggstaatttttgtatttttagtagagacagggtttcaccatgttggccaagatcgtctggatctcttgacctcatgatccacctgccttagcctcccaaagtgttgagattacaggcatgagccaccatgccgagccaaaaaacaaacaaacaaaaaaaccccaaaaaaacccagctttttaaacacaacctggaggagactagtacctaaatccagggcattgtctgccttccaccgtggctcccagctgtctttttggcatgggacaaagaacagggcttgacccacagttggccctcacagagtggaagccagcagaataaaggcaggaagttttaggaaggaaatatttgcttgtttgctttaattcaagagtggaacgtggcaatcttattgcagaattcatcttattttattgctttttaatagctttaaattttctattattccaaaatgtaacttttgtgtaaaatgtttctaaacacaggttttttacattagtcagggtttaattttgagttgtgacttgaacttgacttttctgtgagcgatgaagctcagtccttgcaaagctggatgggtttgcagtctgcctctcatctgctttatctcctcccttttccctcctacttccatgctgccttatcagttttagggagggatcatgaaattctgtaagagaagaaaaccaagtgcaggctgtaggtataattggtgactcagtcctgtgatggtcatcaaaggtgtcagttcctccgaagtgaatccaccatcacctgacagatacatttattgtttaaatgtcatgatgaaagtkcccaagagccccactggtctaaagtgaggtttctcccaggctgagcacattccttaggaaataggaatcctggtccctaatttatgaatatttrcaattgttatcatctgatgaacattttatctattttcttgccttctcccaagacagtacttttgtgccagtttaaaaatgtatgtaattttaaagtatgagagaaacaaggtagagtgatttatgaaaaagcacactgcttctaagtgtatctcccccaccaatgtaaacatctagattgaaatgcggaaaaaaaaaaaaaagacctgctcttcaatgtagaatcctcatactttaaatgtctaaggaaagagaagaatgttgtgctgaatcccaaagcagtgtgacaaagtttttcctacgatgttactgtggacagaaattgatgtctggctgggtgcggtggctcacacctgtaatcccagcactttgggaggctgaggcaggcagatcacgaggtcagaagatcgagaccatcctggccaacatggtgaaaacccatcactactgaaaaaaaaatacgaaaattagctgggcatggtggtgcatgcctgtaaacccagccactcgggaggctgagacaggagaattgcttgcttgaaccagggagttggaggttkcagtgaaccgagattgcgccactgcactccagcctggcaacagagcaagactccatcttaaaaaaaaaaaaaaaattgatgtctatgcactgataaaacaacaaatccttgagaatggggcaacaccactttctagcccaaattctgcttggctttgtcaccttccatttcagatgataatgtctcaccctgctctttctcatgaatagagtcttggtctccttctattttggaacctgttttcgacatgccctctataccttaccctgaaaagggatctaaatatcatttttgtgggaactgtcagggttagggtgaacccagtaaacctctctacccaaactaccactgcaggtgatcagttcatctgatcacagtctttccaatcctgttcttatatttgaccatttttaagtacactattatttgctcacatctacttggaaagtaatcgttgtcaagaggaatgatgaaaggatcatctttttcaagtgcccaggaactttgtgcatataatttcatttaagatgcattaatcatataatcacattttccatactacaagcaaataactgaggcttatagaggtaaataatttcccagtgctacacagctcacaagttgcagaggtggagttcaaagctaaaagtctgtttgtgtcaaagtgcttgctcttccatggcataatgaagcatctccttgtggatgcactgtcccatgtggttgtgagccactagttagtttttacagtatttctatagcaaatactgtaagtactagctttgttttatttcaagcatcacatttaaaataattttggttaatttacagagtatgatatagttttggcaagtagaagtatgtgtgagtcttactgcaatggataaatgtgctagacttcctggaagataagattccaaagaaccccttcattcattcattcagtcaacaactacttattgaattcttgccttatgccaggcactggggagagatctgtgaacataccaggcaaaaatctcagcctttatggggtgcattgttgggcaagacagataaacaaatgaataaaataagtactatattatatggtgataattgctttggagaacagtaaaataaggagaaacaattctaaaagccattttaagtagggggtatcatgaaggccttattgaagggacatttgaataaagacttagaggaggtgggccaggcacggtggctcacgcctgtaatcccagcactttgggaggctggggcaggcagatcacgagatcaggagatcgagaacatcctggccaacatggtgaaatcccatctctactaaaaatagaaaaaaaattatctgggtgtggtggcacgtgcctgtaatcccagctactcagtaggctgaggcaggagaatcgcttgaacccgggagatggagattgcagtgagcagagatcacaccactgcactccagcctagcgacagagtgagactctgtctcaaaaaaaaaacaaaaacaaaaacaaaaaacaaaacaaaaaaaaacttagaggagttgaggaggcagacatttggggcaagagtattataggcagaaggagktgtaagtacggagaccatgaggaagttctcttcctgtaataagccaaagagaggctagtgggtgataaggtcagtgagaaaatgtatattgtatgaaattctgttaggccttgaggcattgtaattactttgcctttcatgatgaggaaatgggggatgtcactagagggttttgaacaggaaagtgactgctatgagttatgttttaaatgatcactctagcccacattttgagatgaggtgaaggtggaagccttacttcaataaaccaagacaggaataacggtggcttaaaccagagtagtggcaatatggttagtaaaatgagagacttaagttacatttacagcgtggagtcttctaatcatagaatttagtgatgagttggaagtggctttgagagagaaggaaaaacatcaagaatgacttcaaacatttggcctccatatgccattaactggactggagaatattagaggaggaataggtttagtggggagggagtggaggtgaagatcaggatagtcactttgcatgtattaagtttgaaatgtctattaagcctttgaaatgtcctcaaggagtaatagacatttcaaacttaatatatgcaaatattgtatagataataggatatacaaatctagaattcaggggagagatcaaggctatggatataaatctggagtcatcttgatttgtctatatcagtagtattgatgaaatcactaaaggagtaaatttacacacaaaagagaaggtccaagggctaacctgggacaccccaacattaagaggttggtaagatgaaatggaaaagagaacttcwcaagagagtcccagtgaggttggaagaaaatcaccagtgagtggcatgcttgaatgtaatgaagatggtaggttaagaaggagaatgtgatcaactgtgtcaaatagtgctgacagttcaagtaagaggaggatggagaactgactttagactgagcaatgtggagtttattgatggccttaaggrgagcagttttggtagaattgtggagcaaaattttggagtgagtaagagagagaatgagatgaactggagatcagagactatacaaaacaatagaaatcaccaatattgtcataatagactacaggtattatagctagctttaaagataatgtttatgttcgtaactttttttgaaatgatggcagtttctagacttgctagaagaccttgctattgaacattttatgaattagcatatctattactgtatcactaatttgtgtttttaatattgtgataactatgtcaagttaattgaagttatttatagtcctatatttttatttatgcatttaaaaacattgttctcagaaaggatcccttgtgattaactagtagtccttagcaaaaaaacttaagaaccattcccattttagggtcactctcaagatttctacagakcctttccttctcctatgctttatcaacactgtcactattcctaaccctaccatccccccttttctaagggcagtcacaaagtggaattaaaactaaagttgctatccaccatagatcctatgccattctgttctgttctgtatttcccccttaaaattttaatttggaatattatgctatgaagagatgcttgcaaatttaaatgaaccttccaatatctttcagaatgtcaaagatggaatatgttcacaatatttgattcaattaacaaatgtcttctgtttttctctcttttctcttgtagtcatttgtgaataattaacttgtattttcatgctacatattatctgagaaaagatcattgtaattagtaattagttctctactctaaaactttttgaagttcttaactacttctgttttgctgtagggtttcaaatgaggcaaattgaaaaattcaatcagacttagctggtattttccatacaacatctggtttgacagctagatgtgtagtcaagcttataaatcaaaatgaagctgagttggaagtgatatagaaatgcaaaaatgctccatgatttttgtaggagatttgtgatcattttttatgttaatgtaattaaactaaaaatgaacttctgtattttaaattctacacattttcattgtgaaaatggttttattataatcactttatgaaaaataaagttatctgcagagagagaaggcagagagcttgaggaaagaggagagaaagaaatatttttagggagtctgctagcaaagaaaaaaaaatttcaaatagctatgagggtcaacatgggaaacttacatacctggcttgaagagacttctgaaaggaaacaattataaactcagtacagactagccttgtagcaggatctgttgtttgaggtgttgccaactcatgcttagaaacttagacataggagtatagatgtggagggagtcttgagattggagaccttgccaaatggctttggtagaagaagatggggctaagaaagagaaaagaaagatagcagtttgtgtcagcaaagtttcttactcctgagtttctggtcggatagagagaaaattaaagctaggaaaagaaagaaaggtgtgctaagaaattaggacgagcttaagaaattagagattgcaatgagggacaagtaagttcagttgcactgagagtagaatgggggcattggcacaaataaggttgtggaatgttagacctgaaagtagttgtagaaatcatctactttcaccagttcattttccagatttcccagagaggttaattctctttcccaagctcatggaaataaccaggggcagagcccttagaactcaggggactgaattctgaacccttgcatatttttgttctcttggcccaattgccgcagaagtggaaagaatgataatcctgactcctcttcataaaataaatgatttaaagaaacatctcattatttttactgggcatgaggattgaaacaggaataaaaatagaaatcctgtcttggtttctagctcaaagagttccctgatcatcaatccaggcattccctgagaatgctaccattatcactgaagatttgggaacatgaaattctatagagaggaagaggttttgaagagaataaaagattgtcaaaaagttgaatctgctgcattaggacactaagccaacttctgctgtaagcttttgccgtgagtctgagggtgtaaaatagcagcagactgaagatagtaattataacttttttcaacatctaccctgtggataccagcgcttggcaggacctgtgcaatrgggatgtgtataattaagagagaagggtctgtagaaaggctgtggggaggagataattcatttacactctctctccctatgtctgaatagaagcgtaactacttggacaagttaaatgatatctgacctataaagggaactttcatgaacctcccatttatcacgtatcttgaaagtgcattttaaatctcaaaccttagctctccccattttaattcctttccttcttctttgagcagtcatatttggaggatctcaaaatgcaagagtgtgagaatcaaaattaggatagtttgccccaggagtagtaggatagtgagtgttcctttgtcaaatttggctctggtgctggaattttaacatgtgttattggctctggggattatgttctggttccggctgagttaaagcttgctttgcttttgttttctgtaagtatttaataaaatggcaggattcgcttacttacttattgaattcttttgcctgggaaacatgcaaattctgaacccagctgcacatttgtgacaaagagatagctaataatctgagctatatgctatttttttttaaaaaaaagctttttatttttctacaaaggcagaactatagtacacaaagttaagccttttagagactgagtttaaatctgctttctattaatagctttcaagagtttttctaaataaccttcaggcacaggcattttttttttttttttttttttttttgcaagaaagcaggtggaggraaaaaagacctgtggtttgttaaccaataaatgctaagttgctaaatcttcctgtttcaaataaatcagttgggccaattagaatatttattttcttcctttctcttttattcaatattcacaaatgatactagagatggaataaactcctgagattatctggctcagattcttaatgttctggaagctggtactgaaggccagcaaggatgaatgatcaaaattgcatagtttgtgtgttcaataactgcttttggcccctctagttctatgtacccttcctctgtaccctgctccaggccacagaggctcacctttatgaaatgcttcagagggccctctcactgcttctggttgcatttggccatatgtagggttcatatgcgtaagtccaggtggcagaaggagagagaaaggagaactctaatttctctggctcccttcaggcctagcttagtagtggctgcaatgctggtgaccatctcctgtaagcacacttttcagcagttctagcaaattttccccttgtcttctgccttaggatggtgatgccatcctgctgatgctgtccccatgtttcaccatccttgccagctccccctaagtcggcctacatttttgcaaaggtttgctggattaactttcttgagtcactccttttgagtgtatcatctgtttcctgacagaatccagactggcacagctctggtaagcaccagtgctgggactgggacccaggactctttaccctattctaatgtccttcccactatgcccaagagtacaagaaaactttgtaatcttccttcaggatcaaacatatatatatgcatatatatatatgcatatatatatatgcatatatatatatgcatatatatatatgcatatatatacacacacatattctggatatatttcttctaaagtattttttacttgtctctcatttctactgtggaataaatgtattctttcaatttaataaatgagcaaatagtaaatttaggaaaaaatgataataaaagattacatctcacttcttttgatttacttggtgaagccagactgtgggagatatctttgataaagttggtcctattgaccaagaaagaaaacattatactaaagacttcacataacctgtttattctctatttcccatcaggagatggtttgtcaggaaatgtgtgatagatacatgtcatgaattcaatttagacagagctaggtagcattatggctgtttgtccacttttcccttttgaattatcttctacattccatggttttattaccactagttttctttccccaaagcaaagccattaggcattctttttgctgtgcacttactacataatttccccaaaaagcttctaaactctttttgtcccgtaggaggatgaggcccttgccagatctcctaagggttaggattaaacggaatattggttactgttgagcctgtcactgcatcagttttctggctcctcttagagtgtgatttgccaaattcagttgaaatcagttaagcaaccactttggaaaaatacagatgcttttaaacacagtcagaatactgagatttactctgcaggaaaacagagcaacaggtaaaaataataagaggaattaatttcactctgaaatgacagcattrtgccttttgactattgactttttgcagagaacatttcactggagggaactgacaactcttactagctgcctgcaaagcttgcctcctccttgctaaggagtagaaataatgtaattattgtttattgcctggatgacaataacttgcaaagattctcagcccaagctctgcaagccagttaactctggatatcagttggttttacagggtcaatacattaacaagatagcaagcaatgcctactcattaaggctcaatttactcccacttcccttgggaagaatcccctctgctcccaaaactcttaccagtggttttcaaaccttactaagcttgagaatcatttgctgggtctggcttattgaaacgcatcctagatttgcacragacagccactggcctatccatcacctttgtgttaattagaaaaagaggaactctttgggcagatgcagcccccacatgtaggaaatatgaaggctaacaagcaaaaaggttcttcttccttgggtggtcaggtacctttgcaaaatgcacaagaacaaaaccaaatgccatagctctagggtcttaatatttttgtcagcttctgcagaattcccttaaaggctctgcaagttagatttgagcacccctttctggcagagcactactccatgaccagaatgactaaattttgcctaagcaaatttccaaatgccatgttgtagcgtcactagagaaagataccccccagtcagatcttggtgatgaaggtgagacacaatgggctccaagaatttgaaatccctcatctgtgaaggcagaaatactaggagaatgggtaatgtttataccatcaatgaagaaactcttgtaacctagggttttcaaattacagaagaggaagaacaatggaggctgatctccagtttgtgacagtctagataggtggcctcagtcttgctcttataaattctaattcccagaagtcatgcagtcgtgtgtctatccatatatccattcatccaacatttattgagtgtctactctgtgccagctgttatgagaggcaatgaggaaaactggaattaatgtaggctttggagccaaacagataagtgcctgaattctgtctccctcgacttcttagatgcatactgtcatgcaagatgattaattttactgaattggcattgtcatttggaatgtattttatcacctacatcatagggtgattgtgagaataagatattatacatttctatagtgcctactgggcttggtacatagtgagtaatcagtaattgatagatattattcagagtcatgatacaatgataccacaaaataatcgktatctttttcttcctattctctattgatgatctatgtatataacatccattttcctgtcttatattgtacctgagtcagaataaaatggatcttttcagggaaacaatactcagagtaagattagaaaataccaaaggcacctaggaaaagtttctgacttttcagaggttagaggaagtcttcctwctattttgttgtttaccatgtattatatgataagaaatttggaaagactttgataatgctatatatgttaatgtgctccaatgttttccaaagcatgtttacgtctagtatcttggtacttttcctaattgagatctgagcttattacttccrttttatatatgagaaaactgcacaaaattacattacaagccaatgacagtgtttaggccagaatccacagctccaggtctagtccagtaatttctctacttgtagcccaaggcctataataatcagccttttgtgggaaagacttgaacaattcagcaattaaaaaagaaaaagtagcagtcgattccgccaaggaagggtatacctgggctgtgacagtttctcaggaaatcacttaacattttgaggcctgctagcacattggattttaatccaaatttatctaaaaataattttcaatggactttaaacctcattttccttctgttaacaatttgacataattttaactgaagctaagtttatgtattcatattcatccatggggcatgaccagtgcctacagtttgccctaagaggtcagcattaatattgtaatccattgcgggaccgtgtagtgcacaacatgctctcctgtacatagtagccttgcctttgcctgaatgttgtcacattattttcgctattttaagcgtttttatttctcctctgcagtcactgaggagccctgcaaaaggagctcaagaagcagcaaccttgatttttaaattagtttaactagacacagaacaaatttaagataagtttcaaatatatggtttacaacatgattcacatttgtctgtcaaatactatatggttacattcaatttataaaagcagatactgaaatgtattaagaaaaatctatatatttcaaatttcatactagaaactttattttaaataaatattttatgtttagaagaggctggatttactgactagtagaggcataaattttatttttgaccagcattttaagttaggaattatgatgtacatatccagaatggaagtaacagctagtatttgcgagcacttactatgcaccagctttgttctaattattttgtatttcaaaacttctgtgatagtcttaacaaccttttgagatagattttattattatcctgattttatagcagaggaaatgaaggttcagaatgggtgggttatttttccaaggtcacatagctcttctggttgagatttgaactgaccagtgtctctagaacctggcctacaaagccttgggctaatttttaaaaaaataaaacttatatcatctaatattatcttaggaggacagtgtcagcatgtcataaaacatatcagaagcacaatctggatgatatctattttaagtttcaaagataaaattattatgtagaaaatagatgaaattctctaagcaatatttattatttttataaggtaatgtatctttgaagtttatagctatcttagaaaaaaacaaaacccatgagtcataactaactatggtgtgccagtaagactgtttcaagcaaagagtctttctggaagaacatgatggtatgacttattctttgttgggaaagtacagaaaaaaaatgtaatgtaatcatcaccatttgatcaaaatatggaaaatcttaaaataaacctccttgattcatgtattcattttcaactctctcatttcagacaaccggcagtgagcatttactagggaagatttttgtctttaataacttgaattattggtgggtgcacattcaaagacaattaatgatttccttcttcataagaattacttttctgtgatatcagaagtgatatgctggattgatttgtgtgttgcttacacaaaagtcagaaagatcttgagggaactaagttatgagcccatcagcgaggctcaactgggtcaggtttatgattaagataaccgaggtcagacctgaatagaaacttccacttggttttgctggttggtttctctgtacactagagttgtttctcagtaggctctgttttcttcagtggaaggtaaagaacatagtgggaatcatattaatagctccaggtttttgaaaactacttggaggtcttctgtggaagtatttcaaaggataccttgcattctgaacggctgtaacactactgtgctggcttttgactcttaggttagctaaccagggaagaacctgtttttgtatcaggcttatcttaaaattgttgaaattatataataaattacaagcagggctaattttcaaaatatttaacaactagtaggacataagcactaaccaagcagaagagtccctggctgtaaataatgggtacattgataataattgcaagtcagattataaaggaaaatggattttcagagagatcctcaatttacctgactatgacaatgtcaacttagaattaattgatttaccttctataatggcccattattgcttaagtagtacatcatcatgatgcacatgcatgtgtgcgtgcmtccacacacacacacataaatacacacacaattaatttttccattaggtatgatatcctaatgtcatcaaatgaaaaacaagacggcataccctgaatcgtctccaaggcccttcgtagcttaaaaaatttactttctggctgctacagatgygttgcttatgtcttttgtctctgaagatttgattttacctcctgatgagctgttgaaaggtagtagctcttagattgagtataaaagtgacatctgtctcttttcaaagcctcagaacttttgtatgcatctgggaagctytgtcccctgcatagtttcaattacaatgagtattcttttcattttggatcttagcaaagacttttgccactgtgtggctgtgtgacagctgctgtacacccctccagtggtggttgaygtgatttctgcacctgtcttatgcttaaaaatattggggggagaaaatggacccagcatgctggaaaatattgacttgtttcccatattaggcttagctgctgaatgtcacggatctggaatgagaggaaagccagccaatttgtcaaggtcactagctccctctctgaaaagtgctctgtttatctaaagagttctgagacagggtcttatgtccattaaagatgaaggttcactgttattttagggctggacttggagatgggctttctgaaaaatgtaaacaacttaatcaggccaggtgagatgagcctatctctgtatgcatcccctacctccactttctgtcctctagatcccttcccagtgtagtattaaatgtttcacatgctaaaataaatattctgaacaaacagcaggtcaagtaatccagtttcctttttgggaaaaaaataaatcacattcaggattaatggagaggaacaaaagccaatagtrtggttaagaatttggattcaggagcaagaaagacttgggttcaaattccatttcatgccctatctctgtgatcttcaatatattacttaaaatttctatgcccagtttccctatccggaatatgagtaaacagtacctatctcatagatttgtcgtaagaattaaatacgttaagggacacattattgcaatgcctcaaacatagtaagccatttaaaagatatggtgttgggctgggcatggtggcttatgcctgtaatcccagcactctgggaggcagaggcggatggatcatctgaggtcaggagtttgagaccagcctggccaacatggtgaaaccccatctctactaaaaatacaaaaattggccaggggtggtggtgcatgcctataatcccagctactcaggaggctgaggcaggagaatcgcttgaacccaggaggcagaggttgcagtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtcttgtatttaaataagcataccatctattcagaggaaatctagcattcaaagggagtttctgcacagtgacaagagaggtgctgaatccgacagatcagaattcaaattctgtctcatgtgattacacctcaatttctttacctataaaatgggttaagaccaaactccctgcactgtgcraagcctctaaaatctctctctatgcccctcacacagtgtggcccttatatgaactcatgcttttttgtttttgtaaggattaaatagttgcagctgaataaatgttttgcatgtagctacaaaggttgcttataattcaggagtaattttatacttcataggatgatgcttttatatttctaatggttcttttgctgtatggagccattcacataactgaaaatggtaaacatttattaaaaatatataaaatatattaaatgcaatgttttatgatatgaactaaatctcaaatatcatacatattttgacaaagatagggaaataaggatcttttgtttaatatactagagtctcagtgagactctcacaagtgtgacattcatgtattcacatatgattctttaaacagacatttattaaacatatagtatatctcaaaacctgccttaagcatgtttaggatacaaaaaaaatgtaagattttttcctccctgtaaaatttccctgaaaggaagataattatagatataagtaaatatamttcaagttagaaaattttaatggctatagaagtaaaataataataatatmcaattagagttgaatggggaagaaaaatgcttttggttgtatcagaaaatagtttatgtaagagttaaatttggttataaaatataatttgtcaaaaagcaatgttccaggcagaagaaataatttgagcaaattagagatagaccctgaaggagacgttcaaagagtggtaaatcatggttttgttggagcatattggtattaagagtaattgcatagagaaacagaaagactaggttgagcccagattgtgttaagtcatggggagatgttagaactttctgagctgtgaagtgacaagttttctatttaatgtctggctttaggcccgtgattctgaaccactcagaaatctagagcttttccatttcatagttacagtatccattcctctctgcacacattgttagaatcacaaaacatgtgagaaagctatccttttaggtgtgcattgggaacacaagccctgtgaaattggaggctgctgcctgtgtctagcaagtctgctggtatttgccaagcataagaaaatggactttaattttcacatactataagcatttgaaacatacgtagtggtactccaatcatgtttaatcctatactcactgcagactggatgttttcaacctaacaggtcctaattttcatattggccatagtgacttttttttttttttattttgagatggagttttgctcttgttgcccaggatggagtccaatggcgcgatcttggctcactgcaacctccgcctcctgggttcaagcaattctcctgcctcagcctcccaagtagctgggattacaggcatatgccaacacgccaggctaattttgtatttttttagtagagacggggtttctccatgttggtcaggctggtctccaactcccgacctcaggtgatccacctgcctcggcctcccaaagtgctgggattacaggcatgagcccacagcacctggtctggccatagtgatttttaaaggggatgtttatcataatatttccacaactgatagtttctcagtaaatttattattgatttggcaaaatatatatttgaataaatactaatcatagaaatttgcctgcattctttcatattgctgaatggctccattgaatactttaggaatgttatcaatgcagattataaatttttgctaatgtttgacaataaatttgttatatttgtttgcaagattacatgctttttccagagtctcctaatcaaatagctttaacagcaaagaaaaaaataacacaattataatttatctgatctggaattatgtctttgttctcaaaattaatacaaagcctaattaagagacccacacttgacaccttctcctccctctcttttactgaaaagaacatttcactgaagtattatattggactgctttatgttatgatttatggattcacattgagtttctgggattttttttacttcattttaataggatcataggaatgaagggagcaaataacagattgttatcatttaatatgttcaatttcatcagttggtgtgattgcatatgtggtttaccagtccaggatagaacaccccatgtccttgtggtattcttcctgtagatataaattttataatgaaaatgagccatgctatatcttatggttaagctccataaatcaatgactcttagataaataacacattaataaaatcttcccgagtagatctttaattgagagcattgaaaataagaatcggtcagttgtcacaaagtgtcacataacacatgtagtaacaggtctgctctcttaaaaacgcatctccatgttgttacgcaagtgcatttgtcttttatcctatccttgatctagatatttcctagacattctccccattctgtccattttgcttgttggaaaatatctttggtcaatgcattcagaaaagctttattaaaactttctttgtacatggtactatgttatacgatgcctcaactaccaggtttttcagtctgtctgatcacagttcaccaagtgggcataatttgagaatttcgagaagagccctctccctaaaatatacagtgatgcactacaataacaatgttgtggccaatgagggactacatrtatgatggtgatcccacaagttatgatattgtgtttttatcctaccttttctatgtttagatatgcgtagctacacaaataccattgtgttacaaatgcctacagcattctatacagtaacttgctatacaagtaagttcctagcctaacagcaatagcctataccatatagcctaggtgtgtagtagactgtcatctaggtttatgtaagtacactctgtgatgttcgcacaatgacaaaattgcctaatgatgcatttctcagaacctattcctgtcgctaagcgccacatgactgcattttcctctcttggccagcctaacttagtgtcagtgattaaaattttttctttaagaaatagtatattttattgagttaatctgtattttccctaaatttatcaagattaaaaaaagaaaaaaatatttgaaaacagaatgaaagaaaaagtatgtgaaaccaagggtgagaaaggtagggaaaaaatacaaattatgaagtcctagaaacttattagtctctggaaatttattagtgtttgtctctgatgcttttttatattttcagcaggggagagggagacagagtgagagagggtgggggaaacaaagagggcaggctcagttgcttaaataacaacacattttaaaataaagttatgtagaagaagcagaaccattcccctttccccatggaccctcataaagaaaataccttgtgatatagtgaaatggtaatttcaataatgttctaatagtaaaaccagcattgagtgtgatagctctgtttcttagtgtcctttaatatagtgggacctcagaacaactcaagaaatgcatctgtacaagataccccattagagagtaatcagagagtaattggtcctctaagttacaacactgtcctggggccataccttggaaagataaagatttaggcatgaacaccttggtgtaaagtagtttatgcaagttttttctaatacaatcattagagtagggctggctttctaagttgaaggccagagacagaaagaaggctgccctggagagattaagtaaaagtcagggatttggggctgaaaacaagggcaacttaaaaagatgattacctcagtgtccttcttggagctggttgtgtacatgaatagattttaaaaatgcaaaatattctaagattaagatttaccagcgccaagaaaagagactgtaggaaaattttcattagcaattcctgagtcattcatgctgtggaatacatgaaaaaagaagtttatcaagaacttccaagtacatacgtagatccatcatttgaataagagggggattaattctatgtgtgtgcctgggtgtggtggggagagaaaatggggagggacagagatgagaaatatgtagttctacaactacactcaagaatatagatgaatcttgtaaaacatgatgtcaaatgagaaataagtgagactcaaaagtacatgctttatgattgcgtttatgtaaagtaccaaaacagataaagctaccctatgctgttacaggtaacagtagtggttaccttgggtatgggaatagtgattggaagaactagagggggctttgaaacactgctgatgtgttctgtttcttgatctgtgtgcagagaacttgtgtgtgctcagttattcatcaagctgtacattgaccatatgtgcacttttctctatgtatattatatgccaacaaaaaaagtttttgtttaaactatacaaatgtctctcacatattaaaatattgctaacttaattatgctgctgctatcctttctcaactttccagcatgcaggtcaaaatgtgatcactatttccaaagaataagataattatcattggattccaattctctccctctctattttctcacagaattaattatccaacagagtgcaggcacacctcattttattgtactgcattttattgcactttgcagatattatgatttttacaaactgaagttttgtggcaaccctgtttcaagcaagtctatgagctctgtttttcaacagcatgtgctcatttcatgtctctgtgttacattttgttaattattgccacatctttaaacattttcatgattattatatctattatggtgatctgtgatccatgatctttgatgttactactgtaattgttttggggtccttcaaactacaaccatagaatctgacaaacttaatcaataaatatgtcctgaccgcttcactgaccagccattctctatttccctcccttactgtgggcctccctattccctgagacacatcaaagttgaaatttcacccattaataaccctacagtggtctctaagtgttcaagtaaaagagagtcacatttatctcacttgaaatcaaaagataaaaatgataaagcttaatgaggaaggcatgttgaaagctgaaataggttgaaagctaggcctcttttgccaaatagctagccaagttgttagtgcaaaggaaaagttcttgaagaaaatgaaaagtgctactccagtgaacacatgaatgataagaaaccaaaacagacttattgctgatatggagaaaattttagtggtctggagagaagatcaaaccatccacaacattccctttaagtcaaagcctaatccagagtaaagccctagatcctttcaattctacaaaggctgaaagaagggaggaagctgcagaaggaaaggttgaaggtagaagaggttggttcatgaggtttacagaaagaagccatcttcataacataaaagtgcaaagtaaaacagcacaacgcttgaagtggaagtgatgatgtaaaagctgcaacaagttattcagaagatctagctaagataattgatgaaggtggttacactatacaacagaactttaacttacactaaataatcttctagtggaaaaagatgccatctaggacccccatagctagagaggagaagtcaatgcctggcctcaaagctccaaaggacaagctgagtctcttgttagaggctagtgcagctgctgactttaagttgaagccagtgctcatttaccattctgaaaatcctggggcccttaagaatgatgctaaatcaactctgcctgtgctgtgtaagtggaacagcaaagcctgtatgatagcacatgtgtttatagcatggtttactggacattttaagcctcctgttgagtcctagtgctaaaaaaagattcctttcaaagtattactgctcactgataatgcatctggtcacccaagagctctgatggacatatacatggagattaatgttgttttcatgcctgctaacaaagcatccattctgcagcctatgaatcagggaataattttgactttcaaagagtattatttaagaaataccttttataagtctcttgctgtcttggatgataattcctttgatggatctgggcaaagtaaattggaaaccttttataagtctcatgctgccttggataataattcctttgatggatctgggcaaagtaaattgaaaacctttaaggtaagagtcaccattctaaatgttgctaagaacattcgtgattcatgagaggaagtcaaaacatcaacattaataggagttaggaagaagttgattccaaccctcatggatgactttgagaggttcaagacttcagtggaggaagtaactgaagatgtggtggaaatagcggggaactagaattagagatggagtgtgaagatggaatggaattgctgcaacctcatgatcaaacttgaatggatgaggagttgctgcttatggatgaacagagaaagttgtctcttgagataaaatcttctcctggtgaagatgttgtgaatattgttgaaataataacaaatratttagaatatttcataaacttataaacttatttgatgaagcagtggcagagtttgagaggattgacttcaattttgaaagaagttctactgtgaataaaatgctatcaatcaacaccatatgctatagagaaatctttcatgaaagagtcaaccaatgcagcagacatccttgttatcttattttcagaaattgccacagtcacctcaacttttagcaaccaccaccctgatctgtctgcagccatcaacatcaaggaaagaccctacaccagcaaaaagattgtgattctctaaaggatcagatgatcatgagcactttttagcaataaagtatttttaaattataagcacattgtttctttgacatagtgctactgcacacttaatagactacagtacagcataaacatagcttttatattcactaggaaaccaaaaaatttgtgtgactcattttattgcgatatgcactttatggtggggttctggaaccaaacctgaaatatctctgaggtatgcctgtatttgttttcccctgctgtacaaaagtacaaaactatgtttaagtagcatgtttaattcttgatgccattattaccacataacatctttatatttttatacaaaacacctcgccgtgagagtttcttaaggctgtgcttagtgttaactggaagccaatgctaatactgaaaaaaaaaaaagggtgggggaattggatttgggatcaggatgtagataggcttcccagaatttcaggaaaaaaattcagaacaggaaagagcatcttgaagatataccataaaaagatggtctttttgagtggtatagtcagtttctaatttaagagtaatttctctctcagatgtgttaaagtgtaaaaaaaaatctaataagatttaacacttcaaagtcattaactaactaattaactaatgaatccacacaacagctctatgaggtttatgctaaatatctatcatttcacagatcttgtgtcatttagaaactcttctagcttttctcgtctctgctcttttcaaagtctttaaaaagaacgaattattttcatgtctccagtgaaggacatgtatcaaatttgtctcttgagaaaatccaatgctttgtgaagtaaatttccaaagccagtcaattaactcagtgcttttcctattaatgtgactccaaatttctgatatcccttgccctgagaagctattttgtttgccctgggaagaaagaaaagtcaacctatgtgcctgcacattataggtgctcattaagtgcccattggaattcttcctttgtaactctttgattaatttgcttttgcttaatttagccatcatttcacagactctactggaatttttaaaaacataaatattgatattgtgttttcttcctttaaatgcctaaattatttcacactagaaatgtaatagttactaagttctcagaccattttggtttactgtaataacaatagcatgttctcttgagtgctgagtatgggaaggtgtgatatgtccatgtttggggtagagaaaggaaagagagagtgagaaagtgaggaaggagaaaaaagggaaagagagagacacatgcacacacacgcagacacacacacacacatacacacacacagagagagagagagagagagagagagagacattatggcaatgttttaaagagagatttgtaggataatggaactaatttctcaagtaatgtttataaaatggaaatgatgttgaattactagaagaaacacaatactaacaacagaatttttctgttgtgttgctgaacaacattgttacagaagaatacttaatagagcaagtccattaaaggatattaataacgggcttgcaaattgctggtagatccttttcaggtttgatttaataatgattggtaagcgtcaaggacatttaatcattttttatatattgcagacttggcaatttatgtgtttaatgtgagaatttccacttcaccacttgaatcaacttgctgcattgtgaaaatatctagcaaacgacaggagaaaactaacttttactgacacctgctgtgcctgcaaacatatgttatctcaatttatcctcaaaattgtgctgggacatgaagtattgttcccattttacagatgaggaaactgataccatgccgtgctaccaggctaaccaaaactgcascccaggtttatttaacttcaggtctagtggattcgaagtctacgatctccctcctacaccatgaaatcaaagtaagtcttccacgaacagacttaatttgaaaacctttaaaactctgccggcccatctatcttaaagtggtttttttaggtcatcctctgtatatgctgatgtactgatataataaaaacttggatataagaacctcttttgtcattttttgcttttgtcttctaagatgtcatttgtgtgctccctctttcagccacactcagctcacgcggcttgaattctggctggcacgggcagtgcggtcaaggctgcagctgttagcatcccctcctcccatgctcatcatgagttctgcaaatgagccctgcagactgatatcgtgttctgcagtttatttgacaaatagcttttatggcctttgattttttttcaratcacttataaattctagcaacagacaggttgtttgtcagattcaaattccatacagttgaaaggaaagaggtgaagattcctgcgttcaaagtggactctaaccttaagatttatttgtaaattttacttaaaattaccttgagaggaacctaagatattctcctggcagtgcctagttgcaaattatttctatccttatgtcataaatcttgataataagtcttttaaaatgcactcgagaaatgtattttgtgtttatagtgctggattttagtgagtcaaattgtgttcaggcagtatgtttgcctcttcatgttctgtgtgacactggagtaaaatggagacttcagtcattcagctgcaggctctaagaaagtctgttgtaactgtgcattttaattaaccgactcagctgaggaaatattgtctctctactgtggtgwagctgtctgccttgtaaagtacctccctggataaacagaggacttttatttcttaaactgcctttcccccatcgtctttaagagtatgttgggctttcttttttttattaaattacaggtggagaaggtttaattaactctaaaatgattcttcagcaaactcagttgcatttttttacaacactttgagctacgatatagttactgcaggctgcatactgttattggagcatacagaaacatttagaaacctaaatctgttttgtcatattaccagagatggcatctgcacttgggtacagttgaaatacaaactgaagatcagataagtttttttttttgtttaaaccagtcagtgggctactgtgaactgagctaacaaaatgggaataatttagccattgattactttgtacaacacactgctggatcttaaaactgagttgaatgtgaggagatagtcatagttcaaggagttatatgcaaatttgacctctggaaatataatttgtgggtttcatatttaaagctgctgaatacattttgtcagaaacctcttgcttctatgattaattatagattagttaaccactggacttcttttattcagtcatcatgagacactctatgcaaaatatacatatattttttaagagacatgatcttgctctgttgctcaggctggagtgcagtggtgcaatcgttgctcactgtatcctccctgggcttaagcagtcctcccacttcagcttccaagcatgtgccatcacacccaggtaattttttttcattttttgtagagatgaggccttgctatgtttccagactggtcttgagagctcaagtgatcctccttgcctcggcctcccaaagtgctgggcctataggcatgagccacctaccacacccagcctatgtggaatttttgaatctaaagtagattaatgcaaatttcagaacaacgttttccatcttttcaaactatgcgctctggagcccaagattctctacctaagttggaccaagcagattccagtactgaaagcaaaaacaaacacaaaacctaactacttattttactgttcctctttaaaaagaatgaaaacaaagaagaattaaaaaaaaaattaagtaaccactgggtttatcttaagcaagatgcgtataggggtaaaaaatgatgcagtgaccacagtgaaaccatgaagtggataacaaagagagaacttgaggattgcagttcttggaagattgttacaagtacaatgaaattagtttggaatttcaaatagaaggtaaaaaaaatggactgcaaggttctcaaaagtccttataactacaagtttttataactaaagtgaagttttatttcaatttgtttatcacgtatgttccaaaaaagaatccactctgtgaatgacaaagtttactgtggtccagaggctgacagatacttcacatgaaaagggatatggatggtctgtaagtctgccctaccttacaaattgtaattaaaatgcaacttaaaatatattagggaagaggtcatttttatttctaaaattaaactataatttacaaaattatagttcttcatttataggcccaaacaaaagagttgaatacaaatagaatttttccctccttttacattaaattattagatggtgtcattttaattattgctttcatgagagataaaactattagtattttccttttaactcagtytgaaggcatatatccaagttgtatggattgacttaaaagttggatagaaagaaaaattgaaagaaattttaagtggagatgagaaagagaaaaagaaatgtagtgcaaaggaataaaggaatgaacagaagggaggaaaggagagactcagaaaagggaagatgcttcagttctgtatgatctaacatgccttctgcatgatcagcttttaggaggtaaaaaagatgagcattactacttgtcagcttctgagtgttggaggcctccagtagagtagttactttggaaacgcgtaaaatcagaggccaagacctagtttctgtcatagcgtagggtgttcccttggtgtgggtaagagaggagaggcctcagaatgcatctaaagctgaatccttgcagaactggggctgagataaggagacatccaagctaaagagcaaaggacctttctcaggaggatgtggacggggagagatcacaaatgtatggcttttaaacaaacgttgactacctagcctctacaaaaatgaaggtgtattcgcagctagacttaaatattatttctttgtctcaattttttgtagctcttattccctttaacatatccctccaaatgttcatagctttggtaactatcacaggaaaaaatgattggtagattattcacaacacacaagcaatttaaatcagaacatgatcctttaaaactgtattttcctaagaatacgattaacctttggacaatatgggtttgagctgcatgagtctactcacacgtggattatcttccgactctgccaccctgagacagcaagaccgatcgcttctctatctcctcctcagcctactcaacatgaagatgccaagaatgaagacctttaggattatccatttcgcttaatgaataataaatatattttcttttccttatgattttcttaataatattttcatttttctagcttactttattataaaatacagaataagatacatatataaaatatgggttgactctttatattatcagtaaggcttctggtcaacaatatgctattagtagttctgggggagtaaaatattatatggatttttgactgtatgggagggtttgttctcttgaccctcacattgtttagtggtcagctataatttttgaagcccgttaaatggtaaatgagaagagtgtacatagtgaaaaagtgtatattaaattaaaactaaaaaaagtttttatgactacacaaagaaatataaggttgatacaattaagtttccatagagttgaaatgtttactgtagattgtttgcaataataacttcataataatgaccagaaaatcaattcaacaacatctatcatgcataaaagactgtatcagccaccattggaagaagaaggaaaagaagagattatccatttcctcaaatcgtgatacaaaccccttaataactctaacataaggtagactgtgatgcagtctctgggagagggggaaaaaaaacagaaaagagggaaggaaaagattaataagacatctggagtgagcagaatttgatctattctggaaaagctcagaaattgactggaggacttgggagggaggaagggcawttctcacaaaggaaattgcttgatcaaaagcacagagattgggaagcatgggctactttgagaacctgccagtggtagagcatgggaaagggtagggcaataaaggtggttgtagctgggctttgttgggaggctgaggacattggttttatgtactaccatcactcttcagtattaactacgtgcccagatgcccttgagcttatggaaatttagattctatttccggaaagtccaccaggagtctgttattcaaaataaaaataggtagtgtaatatgactttcaaagcgcattrtggtactgagatttttagcagttggaactaatgaagggaaggagaaagtattatgtgccaacctttgtattaaatgattttatctacatcatctcattgaatcttcataggatctttatgagtattagattatatatgaaatgtaccaggaaaaatatttaacaaatgctgattctttgccttcttgcaacaatcccatgataactacattgttttacacatttttattaggatgacgatgttgagactcaaggtttcacagttactaaaatcccagaaacagaattcaaactggatccatagtccaagttctttctggtatacaaagttgtctctccatgaaaaaaatttaaggagaaagactttgtataatggcgattcactgaaaaaaaaattctcaaatatagtttattgaatgaaacatggattatttaccctgccttggctcctttggaaaggcccaaactcatgtttgagaaaaatactgaggaatctatagaggatgatttcagagtgctttacaaaggtctttgcctaagaagaactttccccaaccctgctggctatgcctgctcttaatatataactttcttacctttagctgaagactttcatctctatttaaaggtgagtgcccttggaagggacagtaatcctgctctcactctgggagcagatatttgataacgcataagaaaccaagaaagctctgggcaccactggatggaggaatttcaatatggatactacttccaaatagagaaaatacatggaaatgggatgctgagaagacacaaggcagacatctcagagttgactagattgcgctgtagagttcaatctagtccatctgtccgatgactccaaccatgaaactgaccctgtgactttctgacaggatcaacatttgattgggaattctagaaaaacaggcaaggcagtgcactcaaagaattaagatctgcaggcagaaaacaacagagaaacaaaacagaacaaccaaaaaacaaacaaacaaaaaaacaccaggaaaacctattagaaataggaaaatagaaggaatgtcagcttaaatttaagaatgtgatggcaaacttagaggagggtaaattagctttcaagaaagtgaattacaggatctccatcatttgggattttttttttaacattaagaaacgtataatgtgagcttttggctattttgaaatctactttgactttctcttttcgtctatatctagcttaatgctcttgcattttagtgtaaactaataaagactccacacatctgtgtgtgttagaccataaaagtgaccagagtaaagcccataaaaatatatgtagatttttacattttattacttagtcctccctgtaaaagtccaaaagactaaacacttactgctttttaatgaatgacatgagataggctggagtgggtgccacaggctggaaggaacactatactggcagattagactttaactagcagagggatgttctaatggtaaatcatcggaaattatttcctaaagggatctggagatgcatgatttggctttgagaagccttttgtgggtggggtataaattattttagagcagtcctataaagaagtgaaaatgtataggattaatgagtgaaacttacaggaagacagactcaatataaagggctctgttcttatattttaaggaaaactatctgagtttacgaaacgcataaaacactttttatcaaatcattagataatatatacaaattcctggtacataataaggactcaattataccaaaatatcttcacattataggaaaaatattcacctaataggaaaatatatatatatttttttaggcatgtacaacatacgtaccttggtggaaatacaaatacgtatgtaatatgtcctctgccatattagaaagatctttaaatattccattttaatcataattcagtgatgttacctaaccctctattggtgccagtaaacaaaccaagtatttatacctttcacattaaaattttgaatacattaggcaaaatccctttcataaattgacaagtacatgccaacactaatctcaaagcgctgaattttaaacttcttggagagttttcactatggtaaacttcctagagttttcaccgttataactattttcactgttgtaccttagagaggtttcactgttgtaatcttgtcacacatttatcagaattttaaaagctactctactttttcaatatcaacatgatgcattctacaagtttcctttaaagctcttgtgagattctggttgactgcatcaaatattaatgagggaaacttataggaagacagtcaatatgagggctctgttggtaagcatattctttcttttagaaagtacatagatcaatattaatgacaaggagcacttttttagctacatgagggccacccagttgaagctatgaacaccactcaaggtagcatagcctcatgatactgtagcttcactgtctgatgacattttcattctgctcccacttcattaataagctttagcaccaagaatgctgactaaggatttacatttaattgaagtcattgcctccttactgacaaaatgtattttccaccctgcatagatgtaattgatgtgatgaaatgtcaacaaaaattgcctttgctaaatgtagtatttgccttactattttatatgccaggccaaaaaaactatattttacccttgagaagacaaaattctgattgttggaaagagtgtttctgattggtgaaatatagttgagtacccctatacataaagtcctatactttgttttctaggaattagctaattaaggaggaaaacagtaagctttaatactttgtaagactgtaattcaactatatatcctgttttttcaattgcaaatcataatatactgtagaggtgttttatagattgtagaggaaagagaagtgtcagccagctttaaatttgttttatgtcctaatatttaatgcaagtgtgtaacttttcttttggagataatgctgctcttttgagccaaatgactgaattgtgttggtttataaaggaagacattttttggtgatataggaattacagactctttcaaataaggagaacaatttaagagtgagagaaaggataaatgagaatcctgattgggagaagtgagagcccttaaaaataaaaagaaaacatggagaattgttaataaagttattaattatcattacaacatttgctggaaakgataagatagaagctgtttttcttttttttcaataaaatggattattattgcttatagaagttctgttgttagaaagtataattgtaaaatacattgtacttgcttggtcttatatcatgtcccagatattcctgttctctctgtgttcctggaattttcctcacgtgttcaggatccctaactcaagagcgtccattcatgaccctatgaagttaaaatgtcagaaaactcacaactgcttccccacctgaaaaaccatcatcctctctctgatctttagatatgccataggaactcagctgtcaaagaggaacagtctgtgtcttcttaaatgacaaacattttgaaaatacacctgctacttcatattggtaagagcagctacatccagcggaggaagccttttgtcattctttgatgaattaatgatgtaattttgcataagcaatgacatataaaaggaagtccctgtacatttatacccctttttatccagtgatttttcaataattataattgataaagtcaatagtaatttctatactaagaggagatcttgggcacagtcttccactggagtggccaggggagaaacatcagagcagatatcatgtgactgatacctggaatgcgtgctaatcctacagtaacatgttatatgcaattactttttgctcaataatgatgtcatgttgccatataaacattatattgatccagtgtaaagtcaacaaggattgaacacaatgatactagaaagggagtggacaggtaaacgtcctgattgaaagcccttgctatagttgcctgatctgaaatacaagtagaattttcaatgtgtttgataattatttgttttagtgttcgctggtcggtgtctttatgtctgttgtacattgtgataatcagtataaaaatcatagacttagataacatgaggtggaagaagctgtgcctatgtgaaaacagaaagtcaaagacgatgttctagacttctaatgatgtaaaatgggcttggggttctgtaacatggaggttactgatttctttttggctcatgccaaacatagaacaacaaaccccactcagtatctcactaagggctttttgaaaagaagaggtagttgccattttagagtttacaaagtacttttcacatttcgtcctcccaattaccatgagcagtcaatagtacacatctgtgttacatatgagaaacttcaaattcagaaaagccaggaaatgtacctgtgatgacttgattagcaagtgtcaaaggaacttgaatttaggtcttaatttctaaggcccrtattctaccatgcctggctgtgatatttccctcaaatgcaaaagaatcataaattattgttatttagattttattggtagtattaagtatccaaaatcatcaccaacttttggaggctaaaagaatttgggtccaattctgtaggctattatgattaggaaagcagtgactttcacctatgtattattattatttctttaattcatttttaattagagctatttgatacaaactatttaacatccatccattttatttctcttaaaacttgtgtcattcaaatttacctatatattctgttgtgctcattgtttcccccaactgcctctgatttttagtgtaggtagctaggagaatacaacaatagcaaaactccgtgggttagctacagatctggattctaatgagaatccagagcaaaaaggaatagatgaagcaacacagattctgaattttttatttctcatggctcgattcttacttgccatgtctggaactcactttatctcaggcttcatgacctgatgcttgtttctgatgcagtctaatccacactttaaataaacgatttgagttctcattttggtaaatgtcaagggaagaagagatatttcatgcacctacagcatcctaaaacctcttgccaaatccatgaatctgactctgcattatccttccccagaaggagagcataatttcattatccatgaatcatcacctcttagactgtaacatcattgtcagagagcctaatagaaccagtgttcagctggctgaaaagggggagggagggagaaagcgctgaggcaaagcacaggtcactggcacaatcagcaaactggagagttctaaagccggaaggggaggcccccctcctttgacacctttgacatatccctgaccagtaaatgactgatgctgactcttttgatataatattaaaatttgtttttcctacctaaattacatgtatcttgctgatgaaaaatattaacccctttaataaaaatatcaaaatgcttagccagcatcgatgagtataagcactctaaaatatttcttatctattcttattgcgttattactcgcttttcatcttggacacttatttctagccttcagtaccaattctatggcctctgttccagcattactataaaagtcaaaatgaaaagtataacattcaaaaattacattataattatatttcccaaggaaatgaattaaataaaattcaaatctgatttactagtcaaaaaacatgttgtaaaccacgtttacataaggattcaggataaaaagctaaaatgtgtgaatagctgtggttagtctaaccagacactagaggtcactgctgctccatagaaagacaatttactgcctgtctacttaggtagttcactcaccaaatcaagtaaaaaattgtttaaattctttgaaaagatgtaatgtcaacrtccttggaaaatacaaactcatttcaatgcaatatatcttgcataagtattgcttacaagactgtggcactgggactatttaactacatgctgtggtagcactrtgtgtactggggttaataaaaatggaaaaaaactcacatgaagtttagagactaaatcccatttcttctctgttttggtaaagcaaagtattctgtgttctgttgtatagttcaacaggtcaggctttttttttttttttttttttaactgttgtcacctttgagggaagtccaatattttatgtaaatacgtactagaaaaataaatatcaatcacatttctctaatctgcatgaacttgaaatacttatacaaatagatttatgatatgtagtccagaaagtaccatgggatggaggtgaggcaacaacttttgagcaggagactggcagttggcgttttaaaatttacagtggtaaactagttattaaatctacaaraattatatatctgtgctcagaagatactgagaattacagaagattcattctcaaagagtgaggagaaagaaagaacttttttcccataatttcatgtcccaaatcaaaatgagttttaccacctaagggattttattttcgttcttatctattattatgtttattagtaaagttaggcattaaaaagtgacagctttcaaaatattggtgattcatttagtgttatatcatattttatattccaagtagctttgaattttaggaatgcttttcaatacagcaagcatattttatatatactagtagcaccatggcattgagaatttgcaataattcaaaaatataagtattccttgcctaaatatatttggtatccatcacaagtaaggcagaaggttaagtgaaaaagaatagaaatggggttcttcactttaagactgcatttcattaatacaaacatctttagtacagataaaaatgaggctagccaaagaaaatttctttttaagatggaatatgtatttactgatgctttatgaaaaatgtaaagttacaacttcagtaaaaaaatcacaataagctcagtcatccagtaagctgtgaggaagtatctgcattattaatccattggaaatatgtgactttttgtcatgaatacatgtatattcaacaattattcatgggtaaacattgtaactaagatgtttttctgaagtggcatctattgtaagatttaatcaatatcaaagtaccttgagaaatccactttaactatttctttttctttattgcttataaaagtatgattttaatratctggcatccttaaaattttattttatggtgacttgcctagatttttcctctcagcatatgaaaaacccccaaacaataaaaaaaaattagtaaaaatagccattcactttttctttgttgctgcagtgattctgttttcagagaagagggacatggttaaagatgtaggggttggcaagccaaattaaatgaaacagcctcaatgttgcagttcctgatatttgcttctataatagaactgttcattttggaggatgaaggagaatacagactaaatatatctttctaaaaaccttaattgactgtggttcaagttactcaaatatggaagctatgatattcgtgctgcagtcaataaactttcaccaatgacataaaaacatgcatgcagcttgcagattgccaacagggtctgtacagaactgtactgatggatgagttcacaatacagatgaacgcagggacattgtaatgtcagcaatagaaaagcaacagagaactgtcatagtgttggtcttttttcctctaagattcgttttrtacatttattaaggtgttatcaaagtcgtccttttcaatgaggctgtgggtggaaggcacgtcttggaatgtgttctctttacacatctgaatgaagtgtctgtcattaggggactggtgtgtgcaggacatgtaatggaacacaacagggcagcctgacaaattctgaacagaacaggacagagctaaggattctactaactacattagggtcttcgaaaaaactggaaagagaaattctggtaagctctcaaccacatgcctgtagcaagctgctytcccattcgcgaaccttatctgaaaactccctaactaatgtgaggtgtggtggagaaatctggcttctcaatgctgtttcatttatttatttatgaaacatacaggctagaagaaattggcagtgaaacctctagtctgattttacagagatgggtttcagagacaaggctgagtcgaaaactttacatttttgtcatctcctcacattttgcagttgtctgcttgcagtattttaacccttcatcactttgtccctgtgcttgccttactgtaattcagacacctctggaaactgctcagggtgctgctttaacctagcaccatcttttgatagtttcctgcaattttcttttctaagtcaggcattggtttaaaggctctgcctgtctgtaaaatgttcccataactgagtcatctccaagaatcagctcaagctccgagcacctggaatcattcacctctttccttgatttgccagtgaggtgcaaaccttctataactgtagatttggtcccaccaggaggctaacagcgaatgtgggggattacttatgaaagaagttttatcttaaaacaaatgcgacattaatggaatcagtaaagggtcttatacaataggtattatattaaaccggagttcaagcttcacrttgattgtggtatttaaatttcaatgggttgattatgtatgagaggaaaatgaccagtattatgaatgcactaaaacggacaaggaaggatcttgccagcaaagtgagagggagagggaaggggagggggggcatcgcgttcccttgatagtcaccagagttcaataaagcaccacttatttcccagcttttaagagctctttttatcacaatggttcatacctcacactccctggagcccgatttgttataggtgcagggtcccgtcccattcagcagcatctcgctggtctccgtgttggtgggtttataatctacataaaattcctgggtgctgggagtcatttgctttagggactgtcttttctttttcctgtgccttcgcatgagggagcgctgctgcagctgcttcatgctcgcagggtaccgcttccatgacacgtagataaccagcaggatgacgagcacggacaggaaaagcgccacgctgcccgcgatgattttatggaaagagatgtgctcggcgtcagcatcggtctctgggccgggctctgtggctcccaccgtcgggggcaaagggggtttgctctcatgcttcggcctggggagcttgggcttaaacgtcggctttgggagagccctggccagatcaaacctctctgtagtacttttgccacagatgctgtagttcttcactgcatcgatcacatttactccttgcagctctttgggactggcacagataattgtattctcccttagacctttaaaacttttcagccagtttacaagggagcaaatatttctgctgcattcccatatattcccagcaagactgatgtcattgagggatatccaagaatccaaaatctcttgaccaataaatgtgagcttgttggaatccaggttgaggcgctgcagattcgggacacactggaaaacactgggtccactgaaagcttcgatctcattgcctgataaatcaagcctttgtaaggagctccaggtccaggacatggtctgtcctatgacactgattttattccactgcaagtaaaggttctgaaggctgaccaaccttggaaaaagggccaggttgagcttggaaaattgattgtgctccaggtgaagttctttgagtctgatcatgccagcaaagacattcctggctaaacttcggatccggttatatcccaggtccaaaagttccaggttgcggcagtcttggaatattcgcacagggatggttctcarggagttagaccgtaaatgtaaactcagcagcttccgcaagccccgaaactgttcagatcccagagaatgcagctgattataggacagatccaagttccgtaaatttgtcacaggtctgaaggtattgttaagaaaataggagattctattggaactaagaatcagctctttgagtctgcgtattccattaaaagcattttcgtcaatattgctgatatggttatggtcaaggtatagccaggtgagctggttgagccctttaaattgattatacttaagtttttgaaggctgttatagcgaagggacaaacctaagcaaccagcagatatacttgagggtatctcctgtaatttctgagattcacaatataccattttgccttcacacctacagcccttagggcatcctcgttcggcagaagaaagcattgtcagtaagacagtgggggctataaccagtgctacagctgatccgctcagtagcctaattacattgaaacctggaaataaaaacaacttagaaaagttatccccccaaaaaagaattaatccttaatcaagcaaaaataggcatatatttttcatttttaaaaatttaaatctaaataacacttaacatcacatattatctctttgtaattaaagagaattgtctttagkgttttgtttttttaaatagttaaacamggaaacatgccactaagcaaataaattcatagtcttagagcagagcaaggtaatctctaaaataattaaggcagaattattacacacactagaggttttttgttttttgtttttaagaaggaaagaagaaaaatgacaaaacatacccatcctttgtattgttcaaaggtcgtccttaggtcttttgctttggcttaggggccagttgcatgacagcccctgtcagctgcactgtagtgagtcagggctcgctgacacccaggaagaaaaattggaccccttgggagatggaccgattttggaacattattctttgccagccacgcagaacactccaagaacaaataaatcccaacaccgcattcgcagcaaaacatcaaaatcttcctaggtaataggatcttcatggatattacgtttttgcatctttacagttttttggggggtggggagggggcggttaaaaaaaaaactggatcctacaatttcttcttatcgaaaaacatgatgtattcttccaggcaatttggggctacctgagctgccacatctgtattccatascccagcagttcccgtgatgagcacccagttcagccacagagctgcgttggagcccagaaggcaggagagccccgtaccgcgcacacgctcagctcacttctgcagactgtcattctgaaagctgctcggactgttgctttggtttcagtgaatgcartcttatgtaaagctgcccccagtggtgaagaacattatgggcatgtgcagaaatgtctctcttttatcttgcaaatgagcaggctctctgctggaaaatgaatgrttcttttgggtggctcagtaggaactgaatggtcaccgtgatcaataactagcaacattttctgtgatttccaagtcttgttttacaatttggcaacgtctttattgtctgtgtccacttaattgctaaacatgtgctgcccagagtttttctggagcttgacattaagttcacagaccgaacgtcaatttttcttaacctcaacgcaggctttaaactgaaatttataaaatgaattattgagcttttcacagagaagcattaactgcctgcccatttgacctcttggagtcacagtgattatattatgcaaggtgtctcaggatgttagaacacaaacattttggaatagaggggatgactgatgacaagtgaattaatgtgtccaatagcctttccggttttctcacagacgatataattgattttatggctatagtttcgtttgttgttttggttgttgtaattctcttttaattagaagggaaataaaccatttttagtgttaggatacgaatcaagagatcatttggttcatactttattgatgttgctgctatttattacactaataatatttatggagcactttctaagtgctttaaatgggctacgttgttttctctttaaacaatagtatgatgtgggtcctattataacctctcttttaaagatgaggaaacagacttggggaggtaactttctcaaggtcatacagcaagcgagtgctagagctgagcttcagaagcgagtcattcttatgccgaaccactaaccactagatgatcctgttcaacaacattgttatcttcatttaaaaaagaagtcagtgaaaatgaagccgattaaaggattggggcaaggaagctgtgattagcaaattcttgcttgttctattagaattgcctaaatttcttttggtctgaggttcctaaagaagtataaaaactaaggcagcgtagtttagtgattaacagcatagattttggcacctagattccaactcctggctacaatttaccagctatgtaaccttaagcrcgttacttaccttccctatgcctcagttttctcatctgcaaaacgggcataaaaacaaaaactcacttcatgttttgagaattaagtcattttaatatctgtatgttacttagaacagtgtgttgcatgcaataagcctgtgtaagatatttgaataatattaactttatttgtacttgctaggattacgtactgaatattgactatactgaccttcattaactcacaaagaacaactttagtgagcatttttaaatattgtacatggtggatttctgagatttactcagtcttgccttctttgatgagataacttcctttatgttcatcatctgaactttatctttaaaataaatcttctggttctgtggaycatractaataatgttcgattcttttcatctccaaagtagaacataataacatctgccatgtagaggcattttatttaaaaataatggtattcttgaaaaagtttgccttgttgttttttgttaggtgaactgtctgtggaaaaccgtggagagctttcacattctccaaggatgagatgtttgataaaggctagtaatgacaatcaaaaggggtcctacagatatagtacaatggatattaccaattccttgggcagtatgttcttaatagggcagtgctttcccccagagttacctaagctgtgaatgcacatgaaacatccagtgagtttcttaaaaagatagactgcccaatccctcccccaggattctcattctagggggatggaagagtgtgtgcttttcaatagtctctgatgaaataagtttaagaaactcactgtgaaggaatgattaaaaataatattttctcctagtaggaagagagggtttgcacacttataatactgagatgtaagttccacaaggacaaagacaatgttttgtctacttcatttttcctaatatctacaacagcacttggcacattgcagacatgcaataaatagctattgaaaaaaatatgtttttatatcagtcacaagtacaatggatatagtataactgattatgtaatgttcaacatttgtacatgggattgagtcctgaaaatttcctcagtcagtgagactggaaacaattttggagaaagtattcttaaaggaggtatatacaaagacaaaaactagaaagtgagaaaacttagttgatcagaaagtgatctttacttttcacagatatcttgtcttcatagttaaactacaaatttcatgagaacagtaaatatgcttttgactattctcctttgcacagcacagaagggtaatactgaacccttatcatttaatatcccaaatgggcttgacaacttgtatctctcaaaaacagactaatgagaattatattgataacttctctctcacacctctgttgcttgaaaggctctgagttttcccctcactctcccacgtagtcattgagacatctgttttgcccaagagctgcagagagccactccaggaggctggaggacccattaactttgtgcttcttgctcatcatactttacttcccattgacagaagaacagaggaacccactgagaatgtgggctctcactttgcttttcctgggataaatcttcttgaattatttacggtgaatattattctctgctgtgttacacacattgctcttagttttcagacatttttcttttatcttggttcctgatcttatcttactgcatagttctgactttacacctaccctttggatcttatgattaatatttatttagtcttaatactaacaactgagggtataaaatattagartgagtaaataagacctagtattggctagcacaatggggtgactatagtcaataatgaattaattgtgcatttaaaaataactaaaagtataattggattgttttttatacaaagcgtaaatgcttaagggcatggataccacacttacccttatgtgattattacacattgcatgcctatatcaaaacatctcatgtaccccataaacatgcacacttactatgtacccacaaaaataaaaaataaaataaaaataaaacaaaactatatgacaggaatgatgtgctacaacaaaaattgctttggtagcaatgtattgattgacaaggaaaaatgttcataatgaaataatattaaggaaaaaaatactgaccatcaatctctttctcaacagtaatcagtagccactcttggactgagtcagcctccaggaactgtgtatggcccctactttggcacgaccccttaagtcggcatcacaaccaggtctgatctggttcargataataaattgtttgaagagggaagattatccatgaggctagttgagaaatccaaaacaaaataatgtgattctaagccacactgaatacttgaggctgcrgaagttactgcaaagacatagagtagtccctcaagagaaaaagaaaagactgtgttctaaaagattttagtaatttgcctgtatactttttaaaagttttttctccttttacttgtcgactatagcgagctgattatttctgatttgcctttcagcagaagcaaaattatattgcattatgtatttagaaactagcaacttcttttgcacttaatatcgcatacagaacaaaccgtaaactacctgacgagttaaatatccccaatgcatccagggccttaatgatttatacaattataaaaatagtgtcatgtatctaaagactttttattttattgtgcttataggacttcaaatagctaaacatattttgtttarattgggtaaataaatcaaatctcagtttggcaatactgccaaattttagtccaatatgaaactgagttgccagatataaacttagaaattcataactgaaagagaatggactgatatcttaacagttgttgacttcagatattttatttattttacaaatatttaatttgaataaccattgtgtgctaaacactgttccagacactgggaatacatctgtgtgcaaaataaaggcctgtacccttgtgaagattacattctaaagggataagacagacaattaaaaataaacatatacagtatattagtaggtcatatgtactatgaaaaaaaagaaaaatataaggaagattgggagtgcaaggtatgaggtgggctgagttttaaataggatggttagggccattaagaaactggcctgagcaaaccttgaaggatatgagcttgtgagacttaaatgtatatatggggagtggccagtgcaaaggcctaatgtggaagcagatcatgtgttccatgaacaacaaggaggccaatgagtctagaatggagagaccaagtgatagaataattggagatggaggtcatggagggctttggatgacattctaagaatactggctttattatggagaaaacggggagctaactggagatttttgtgcagagttagtatgtgatcaaataacctattaaaaggatcactgctgtggatcggatgttctcatttaccgtccccaaaagccatatattgaaaccccaattcccaatgtgatggtatttggagatagagcatttgtgaggtaattaggtcatggtattggagccctcatgacagatcagtgggattataaggataaaaagagacagaaatgagagagcttgcttcttctctctctctgctacaagagaaggcagctattaagaagccagaaatcaggctgtctttgacatcaggtcttctgttaccttcattttggacttcccagccattagaactgtgagaaataaatgcttactgtttaaaccacccaggatatagtatttttgtttatagaagcacagactgactgagatgatcactcttagcaggggacacagtaacgaggccaccatatcaatccaggagatagatgatggtgtttgggccagggtgttagcagtggaagtggtgagcattggttagattcgggatatatttacaataaaatcaacagaacttttctaaggaaatagaagtggaggtatgaaataaagagggaaagtaaagatggttcatttttattggctaagcaaccctagggatggtgaagccataactgttttcgtgggtcacattttgtgagcaagaccaagagtttaacacatttggattaaatctggatttggctcttgctttccttcatttttatgagactttagttcttgaaaatatttcttaatcttaagcctcaaagcaccatgatgtatttttaaatattttaaaggtagtttttgaacagaaagttatgaaatgatttgcaaaattagcccccaaacaatagcaaatggatttccattcaaatgaactagacagaggcaacatytttgcatatggccttggagggcagtagagccaaaagatttgatgaaaatctaaatgcgagattgcataaagactaggtaaggaaacatttggactcaacacatgtactgtttattgcatatgtcagttgacatttggaatttggaactgattctgtgcaaacttctttgggtctcagtttgctcatctgcaaaatgggacttataaaacctgacttataaacttttaaggatttttacttaggaaccattttcatgatttatgagtaagtacattgtacaatatttataaagtgttacagatakttctgcaatcagagtatctatgacaaaattaattttcccttgattctgtataggttctgtggccatgagcatatattaagggttatcaagggtcatgaacatgaccaaggacatgccagaatttactaatattataggaaacattcctcagtatttcttttctactaattttaataccacaaccatttattatacagaatacaccattgatattctgtgtattcgcttataaagtactttcaccaatagacgcatttgatttagcttttgtaaagagtttaatgtttgtgacccaacaatatatcagggttgtcagaatgccaatatagagtttcctacagctgtgaaaataattttcttcatttctagttagaatactcatatgcatgtctacttttgtaattatatccagatcttcatcagagcattaacacttccctgaaatatccttgatttccatctgcttgctttaagggctccattaaaaaccctgtctggtcacatatggttatgagtgaatatctctgacttagataaatgaataaagaatattccaggtctgaccattaaaatggtctctcagtgtctttctgggaaaagacaaatttaatgaatgagacattgcaaggttatccaacatgtctccctcccattcacctgaagatacatttatgcagcagcgtcaatccatattctcaggttttattgcattcctcactgtcacttcctgcaaaggtagtcctaaggtaaatatgggaatacagaaatctagccaacactataaacttcagtggcagacttatgaaggctgaaaagactatatgacttcaaggaaatacttttttttcttcctttcagtaggaaaggtaaagcatacgcaaaagttgagaggctagtataataaatatcaactccaaaaattattactattttgctaattttatttcgtcgatactcacacctcttcccacataagtgcaatatttttttctttctggagtattttaaaagcaaatcttcaacatatgtcttttttttttttttttttttaagacagagtctcgctctgtcacccaggctggagttcagtggcacgatcccggctcacagcaacctctgcctcccgggttgaagtgattcttgggcctcagcctcccaggtagctgggactacaggtgcctgccaccacgcccggctaattttttgtatttttagtagagacagggtttcaccgtgttagccaggatggtctcaatctcctgaccttgtgatctgcccgcctcagcctcccaaagtgctgggattacaggcatgagccaccgcacccagccaacatatgtctttataacctctctctctctctctatttatctatctacacacatgcacatttcaggatgcattcctaacagccttttaatttaaccatctagcattattatacctaataaaattaacaagttcttcaagtaggtttgttcgtatcaagatcttagaaaaagcccacacattgcatttgtttttgatgtatttgaagtctctttcattttgtaatgccattgatgtgttggatgccacgtcatttggactttagctttttccatgttctgcatttggtggttttcccattgtaggctttaacttgcacatagtcagttttcatggcatatatgtttaacaagagtctattcattaatttgagcagaatatccagccccaaagtggatatttkgggcatctattcattcttggtagcagtttaagatttgaagaacttttgagtaatacaggacttagagcttagagtaaagttgtacttctactttgtggtatttatgccrtcagagaattcaggaatgcgctaaatggcaagtttgagaactttattggttaacattcatatcaccaggatttctgttcttcacatcccatcacaattgcctttttacccttagcaacagcaattatttgttgttggtacttgctaaataaatctgctaatttttgtattgccattgaagtgttcatctaactgaggcacaaaaaattcttattaataggatagcaatcaaaattcatttgtagtcacttaagctgagagaaatcagttttctagcttttctttcagaacaaattccatcaagaaacatgtggcaccagagtcacattgtaaaacgtctagttttatatatattcctaaatttcctgtattttctcacagtggagaaaagacttttagagggactataaaaacctcttaaccaaatttataccttaatatttgatgttttactttgcatctatgactgtgctttgaatgtaaagtcagtcagtgttctttaaatggtatcataacattttgctatatccacttcacatgtattctgaggtgacaagagtttttgaagaaaatttcatattgtatttttaaagcactgtatataatagtttcaactggatacactggtgtgttttaaaattcgacttcctggcaattatatcagcgttaggaattaaattccccagtcaccaggaggagaaagataatagacaatcttgattttgataaagaaacagctatgccataggttggttttatttttgtttctgaaacaatgtctgatttaaaaacgtttttattttagggcccagatctgaaagatattaaacttctgacaaatgagaatccctgcatagtttgcaatgaagtagcagagaacaggagtctgtgggtccttatattactctaaaatatatcagcctatatgtcaaaccagaggatccttccttatactgttagtacttggtagctgtagctgtggccattcccagttgaacagttcccttaagaatgttggggaatgcttaggatactcttgcaactaacagcagagcccccatgtgscaatattgtaactcgagcaaaaatttacttagtcccgggtagcaaatgccacagatccttaataaaaataaaattaacttgtttattcaatgagtatttattaaactcttacactgttcttcgtgctggggatacagtagwgaataagacaaagtgccttccactggaggacttcttgcattcttgttgatgagatggtaaaaaataaaaatagctacacactgcaatgtcaactagtaataagtgctgtgaagaagactaacaaggatgagggcaatgaccatttgatactgtggccagaaaaatccctttctgagttgttgacgttggagagcaagtagggagcaactcacataatcctgtcaccttagatgtaatctccttttgggttttcattggccaccattaaaaaggaaaagaaaattgtttttttatatactccacacttctgacaccagggtgtggagtttttccataccaaccaattctccaactctctggacatcaactgagtgtcctgcaattcaatttccccccagcacctccttacctcttccttactgattttctttcatttccactttgtctccaggtgcctgtggtgacccagttctttttggacatttttccacttatcaacaaatgaatcctatggtattagctgataatggcttatagtattagctttctcaggattcttgaaatttaataggtgagtctgagaaatggaaagtattaaggaagcacagagaactgcattttatgcacatactgtagcttaaaaagcaaataggagaaaaggcctgtattaaaaacattcatccttgctcttccctctcaatttcttaccaattactctttttaggtgcaatcattttattttagctactgtttaattcttataatatttttgaattttgttgatattttaatttcttgctattttaactgaggattcagtatcatttactctccctgcttcccatgttaatatgttattattacagtattaaataaataggcgatatgactcacaatcactgtgtaaacaaagacactgatgaattaagtggtgtactagactgtgttgccattctcattcagcgttttgcttttcttgcagtttaaggattgttcctattttctttctctctctacctcttttacatttgcttttttgtctgtatctagggcttgttgtttgtcccaacatttaaaaatatatgtcaaggactgggcacagtagttcaaacctgtaatcccagcccactttgggaggccaaggtgagcagatcaccaggtcaagagattgagaccatcctggccaacatggtgaaatcccatctctactaaaaatacaacaattatctgggcgtggtggcaggcgcctgtagtcccagctactcaggatgctgaggcaggagaatcgcttgaactcgggaggcagaggttgcagtgagctaagattgcaccacggcactccagcctggctacagagcgaggctccatctaaaaaaaaaaaaaaatgtatatatgtatatatgtgtgtgtgtgtatatatatatattatatatatatatatgtcaaatgccgaagctttccaaacactcaggcatttcagataatcctatttgcctgcagcactccatttcttggctccaatatccaaytctagctatgtacctagtacttcaccattttccagaacaggatccctatttcctggattccatgtatttattttcttagtttaccactcattttgttgaagcaccttccactaatagatttttaggaaagggtgcatgtgaaataaaaatttcatgtctaagttttttagtccagtattactgattgatagattgctgtaatataattctgggtggtaaataattttccctcagaatctttgagacattgaattactgtcttcccataccactgtcactgtagagaatcagacaatattctgattcttatttctttgtgtatgatctatttttttcctctgtatgatactttcttccctcctggtattcggaaattgtttacagatatactttggttcgtgcttttttttttttttcgttagtttttgggcagtcagtgagctttttaaatatggagacgtgtccttcagttctatacaaatgtattgtatgtttcaaaaaatgatctctccacatttttctttgttctctttctctgaaacttctattggacaaattttggatttcctggattgatcctttggtttttctttcctattttccatctctttatctctttccatcctacagagtaatgtctatgctttatgatccaatcttttatttatttattacaaattttggccagatgtcagaagattatggcacaatcaaatccagcaatgataccactgggtcaagcaatataaataaaattaagtttttgtaaataaagaaacattcatgtgcattcttttatgcattgtctatggttgtcttcaagctacaatggcagagttgagagatggcaaatcctgcaacttagaatatttactacgtggccttttacagaaacagtttgctgatcccccaactcccatcctaatttaggtgatcatattggttagctccatgagctctttttaagttgtctttttgccccttcttcatrgcatactgttactctcatggatgtgccattttttctcactgtgaggatattatttgcagtttttttttttttttggtggtatactgcttgctgcggtgccactacttcttctgaggtaatttagccagttcgtgttggcccatttcatgttggaggcgtttctctacggttaagattcttctgtgttcattcatattaatgagtgaatcactaaaaactgatagaaagtaccctgccggagggcagatcatgaggtcaggagatcgagaccatcctgggtaacatggtgaaaccctgtctctactaaaaatacaaaaaattctccggccgtggtagcaggtgcctgtartcccagctactggggaggctgaggcaggagaatggcgtcaacctgggaggcagagtttgcagtgagccgagatcgtgccactgcactccagcctgggggacagagtgagactctgtctcaaaaaaaaaaaaaaaaaagaaggcaccctgccagtgggcaaggttttggtggtggattttgtgttagcaagattagacagagagcttgcttcaggtacatgtatttagactccactccccacacacccagagaagactgccaaccgctcctacatggaagatgtacacctgctaccagtgttctgggggcaaggcagggaaagggtgctgggtgccccaagttcaacatgtacattctcattttagtcttaggttgtcagtcccaagtctcactgctatgcctagtatacttcagtgtagcttttcaggtttgaatttgccagaaaataaactcttttctgttagagggatggggtagtcttttgattgcttggggtaaagaccgaaatctggcagttgatctcgctctatgaagatcagtccccatcttttttgtgacccctacttctggtgcttctcatgacttttatggcgcgacataaggtcccccttcagtaagcacttagactgtagctgccttgactctaccatgtattctgttctccaaaaatttgtagaaattgttcattcattcctcttttctctatcctcatttgtattcatttgtcattgcttgagttttgacgtgaaagagacaataaaagcatgcgatcaatctgccgtgtttcagatatggatttctcatgacagatttcaggcatggcagatgatactggaaggatgccgtatgaattaagactgtagcccaaggttgaaaatgggagctgaagatctttgtaaaagtgagatgctgtcctcctttgttatccatatcctccaatstattttgcactagtgtcattttaaggtctcttactatgtactcatttcttttttctttttctttttttttttttttttttttttttttgagacggagtctcgctctttcgcccaggccggactgcagtggcgcgatctcggctcactgcaagctccgcctcccgggttcacgccattctcctgcctcagcctcccgagtagctgggactacaggcgcctgccacagcgcccggctaattttttgtatttttagtagagacggggtttcaccgtgttaaccaagatggtctcgatctcctgacctcgtgatccgcccgcctcggcctcccaaagtgctgggattacaggcatgagccaccgcgcccggcctatgtacgcatttcttaatacaacttttaaattggaagaagcttggatatattgtatttacttgtggcttccttggctgtatagttcgttaagggtgtctgccattatttcatttactctactgtgggagtgattaaaatgttcccccgtgtgttcatttatttatgaattttgaatcatcactttgatgaggtttctcccacatcctccttttagcctagaccaacctgctaatatcagcaagcccagcagcctccaaaaatgctaggaaaaaatattttttactaccgttcttgggggttatatcttactatagatattgagggaatgtatttggtggaaataggatgactcttcctggtgttgtgttcatgcacactaaatttgctttggcatcttatactttgtatttattataactttgcaaacttaaatgttttcaatatcttacaggtgtttaattttcctgagcccaatgtttcttctaaaaaaaagaacttttaatttttaatgaaatagaatagaattttatgtaaacttttaaaagaaacaaactataccctattggtatctgtattcattttcctacttttttgtatcaagattttgtttttaattattatcatttatgctttggaatactttgctattttcaaatttgtatttgttattttatagtaaaaaactagaaaacctgaatttgatacatatgtgtatggttctggtggtggtgtggtgtgtgagggtgagtgtgtgtttacaactctaggaagtagaggtttacaagtaaatttaaacttcaaataggcaaccacttatgtataatccaaatctgtaatcttctgatgatgcagtatgggcctgtatgcaaaatctggtaatagtaatgtaaaatttcttctcttcattggctatatttgaggccagactttttctatttagttaaagtcatgaaaatatttttgatttagtgtattcaattttcaatcattgtgttttccttttgaaatactctaggcttctgcctagagaaaccaaaacagttaaacatgtcattatatgttcaggccattagtcctgattcttaggctttatatattttctgtgggtagttctaaacgacttgagaggttttacataatttcaagtggcttacaagctttgcaagttaaacttggaaaatattgtagtaataccaagtagtagtgacataaaggcttaagagactcacgtaattgggattttgagattattttgtccaattcacattttacagatttaaaaatgtagaccagagagatgaagtaactggttcaattaatatacgacacagatacaagactttgagtagagcctagatcctttgagattagtctatttcttataatcattctgtcttctttgaagtcaaatcaatgtttttgtacaatgtgaaaaacagtagttgacactttatataacttttttcctaacctcatatagatttaactagaccactaggacttaaaatctgttttgttaaatagaaaggaaacaaacaagtcttcaattattctctaagtttgttttctttgcattataatagtgatatatatttattataaaacatgaaccatgatctcgccatccaaaagtaatccttactaatattgggaactatacaaattttttattaacttgaatttaatgcatggcattctttgccatgggcaaaacaattcttttaagttcctcctactgttggaaatgtatagaacggtctttattaatgttgaattatacagactttcccttaagtaactgaaacgtgcataattggctctgaaaaggaaagaaattactaatattctagcacacataatctatcttccacatggctagcataatattttaagtagaaagttattccccttcaagtaacaaggtaaacaaaagaattattgcttccttcttgtttgaaatttggttaggcctcagtggaatggctcaaagggcaacttcagaatggtcttactactttcccaatatactatctaaaattgcttacgttgctgtcttctttaaatcccatgaatagctcactgtgacctctggttaaatagcgactcattgtcatgacgcacaaggttgtcattttgtttatatttttgttaaaggcaaacaattggttttcaagaagagcggaaaccaaactggagaggcatccatagcttcatttcagtgctctgccactttgcttttctccacgtcacctgtcttgtgttcacctctgttctgcctcacagctctagcttattcatggtttttgctcgccatggagttggctttacatgttatcttcaatgcctacatgctaccttgtgactgtcttagttgtactgaaaatcagttcattcttttgatagttttctgtttaaaattctagagaataaaattctgattttttttccatgccatcttataggttgctatctggcttatgagttggctattctaggwaaaggtgatcaccctaagtttccagcagaagtgatggttaagggtagtgataaagttggtagagtcatattgtataagacttggcagatgctttaagcgaggccatgaaggacaaagaattcaacttgatacaaagattatttaccatctggcttaaatctacccttttgtcattacttgcacttactaaccaagatgctatgcatacctgcaatacagccacactgtaagtatttattatttattattccccgaacaagccattttctagctgactttaaatcactgtttatgctactctctcttattggaatagtcttcctttagtttttatctggtgaaatcttctataagatgtatctaaaacattataatcttcataaacattttctagggattttggtgacttcctcataagcacttttataaaccatttatatatgccatataaatgcatagtattaaattgtttatttgcccttttccccatagaatattctttaaattcagggattgtggtgtttcattcatctctgaattctacttttaacagataatggatactcaatatatgtgtgttgaaaagaaaacattaagatgatgcagaagtagctactcctaatggctatatcattatcataattatggttctctgggaatacctgtagttgattcacaaatctgttacccaagatgtgataagtgcaagcggaaagtatgtactaagcatgaaactcactcaaaatttgggccaattaaccagagtactggtgtatttttcaccatttggtctctatttgactaacaagtgttgcagatggatttttattgctctcttatttgcttccaatctgagtaattggttggaggaaatttcctgttctgaaggaaatttcatttgtgtccgaaggtagtgatttatttatttatttatttattttgagatggagttttggtcttgttgcccaggctggagtgtaatggtgcaatcttggctyaccacaacctccacctctgggttcaagcaattctcctgcatcaacctcctgagtagatgggattacaggcatgtgccaccatgccctgctaatttttgtatttttagtagagatggggtttctctgtgttggctggtctcgaactcccagcctcaggtgatccatctgccttggcctcctaaattgcagggaatacaggaatgagccaccgcgcccggctggtagtgatcttgtatttactcctgatttggggtgtttgtcaacatgtacaggggcaatttggggacaattccttatttggagctgtttactcttcctgtttcttacctctagtattatcgcaagtggctcctagcttaagtgggctttcaatgaggaccttactggaaatacctgtagcctaaataaataaataaaaacttgccaacaataccgtgtcaagaaggctggctttaaaatccagcttgaagaagcctcatttaaatgactgtttgtaatctggtcctcatatgtctaccatgtgctacttcccattctaggtgctgaagaattaagagaaaagatacatttccacacttgtggcgtttacaatctaatctggcatatcataaacacttgttacaatgtgtgtagggagtgctagcatgaaaaaagcacagggtgctttgtgactccataaaaatggcactatccagactcaacttacaggggaaaaacctgaattaagtgccagcaaagcaaaactactataataaaaatgaatttttttaaaaaaaaacaatgattaatctagccatagcagcagctagaatactcttattcattttataagttctcagtttatgctcgatagagatggttgacacaagttaggaaacttaacctaagtagtattcagcatgaccaggacttcttagagaacatccataacatattggacgatgaaaaaccacttcatagtgtctttggtagtctgcaccagcctttcattctaaacattcggtaaagcaggtgaaatgcaatggtgacagctttgatgagatccttgtccacaaataccctaacttgactgaaagaaatgtgagcctgttgtcagaaataattgtgtctggcagcctgtatgctacaagaaactggcatggagtcacattgtcatcccagaggcttgaggtagaagtgaaagacttgatgtcactgtgagaagcagtatactaaagggcaaagttttcatctcataacaagatcaatgtgaagtcctggtccaactcttttggtcttttcccactggaaaattaggtgtcttactcagttatgccaagtagcctggcatgtggcatgtactaacttcctttagacttttcaatatcagaattaatttgaggccatcaaatagaacttctagccaagactttcaagtagacaattcccagatgtgctatgtgtagtgaagccaagataatgtcttctgaaatcataatgtaacttctctacaaaatacatccctcatgttaagaaaattcatatggatgttttgagattggctttaatttttttggtcagttcctatgatagccttcaccatatttgctttatgacaagggacagtctgggtttcttttaatttaattaccttatttcatcagcttgaaaataagaatcaaggaagccttcacttatctaatcttccagtggtagtggcacatatgttttgatatctgttggggtagatattcccaactacttgatattgatgatgttctctgaactataattgatggtagagtgaatagaaaacttaaatcattgcgcaaactcatcaggtatataaatctgaaagttcctaacatgggatattgagagctagaagtctggcaggaacataatacaagtttttctttgctttaagatggaaatcctctcaaaataaggatttcaggaagcaactgaaaggatatcaaccctttcaatacagttgtcagcacatatttttcaaagagaggagaaaaagaagtatttatttgtagattatggattgtctacctgaaatatctaagaggctcaagtgaaaagttattagtaccagaaaaagagtataacaactaggaaaattacaaagtaagtatacaaaagcaattgcttcatatttgttttcaaactgcttattgttactaaaacacaaaaagacttacaaattagtgaaattgaaaaaaatctcacaaattataacttacctctgagtaagcttaagaaatgtgcacagtttatacctagaaaatagaaatgaaagtggcaatgctaatgacaagagaaatgttattgagggacagaatgaacagagatacatttttgaattgaaagaatcaatagcttaaattaatcagtgtataaattcaatgcagcctgatcaaaacctcagtaggatttttttgtatctaattctatattttaatgttttttattgtttagcattatgttatgtaaatttccaaacatacacaaaagtcaagagaataattaatggacttccctgtatgtgtcgctcaggctcagtgtcagcagttactagcataaagccagagtttatttacttatactcccagttataccccaccctcatggatcatcttgaagcaaatctcaaacatcatataattcatctcagtgtaactctaaaagagacgcactaaaaaaaaatgctataatgctatcattctactttaaaaagttagcaaaaatttgatgacttcgaatcaaataccagtcaacaccaaattcaatatgcacacacaaacacaaacacacacacacactgtcaatttttgaaacaggatcaaaagtagttcctcatattgtatcgaaaaattaattgtagattaatataagtctacaattcctttaaacttgaaagactggtgcagactaccaaaagacactctgaagtggacctttgaagatacttttgaagatagactttctcttctattttccacttgtattctatttgttaaagaaactgggttatttgtcctgtagaatttcccacttttggatgttgttgaatgcatctccatgatatggcttaaaattttcctctgatcctttgcttcctgtaagctatttctaggcatagagttttgatcagatccaggtttgatgttttggcaagaatacttcattcaagatgctgagttccttctactgcattctatcaggaagcccataatatctaatatctcttcgttatggtgttaagattgatccttagatttaagtgtggttggcctgattcacccattatcaagttccctgtcaactattcatctaatgctttagtagtcactgatgattattacatagatctatttgttcaacagagattgtaaaatagtaatattctgttattcctttttcatttattagctggaattctaaagtttttattaaaatatttttattatggtaagaacccttaacatgagatctacttcttaacaaaattttaagtgcacaaaacagtattattaactataggcacaatgttgtacacagatctgtaggatttatttatcttttataaatgaatctttatagctattaaaaagcaattttctctttcctcctcacccaatgcctggcaaccaccatttactctctgtgaatttgactattttagatacctcatgtaagtgaaattatgtatttgtccttccatgactggcttatttcacttagcgtaatgcatgtagcaaaatttccttctgtttttaggccaaacactactccaccattatgtgtatataccatgtttttctttatctagtcatgatcaatgggcaattaggtgcttgttatrtcttgactattacgaatattgctgcaattaacatgggagggcagatatctcttcaagatcttgatttcaattttttaaaaattatgctttaagttctagggcacatgtgtacaacatgtaggtttgttacattggcatacatgtggcatgttggcttgctgcacccatcaactcgtcatttacattcggtatttcgcctaatgctatcccttccccagtcctccaacccccaacaggccccagagtgtgatgttccctgccctgtgtccatgtgttcttattgttcaattcccacctatgagtgagaacatgtggtgtttggttttctgtccttgtgatagttkgctgagaatgatggtttccagcatcatcgatgtccctgcaaaggacatgcactcatctttcttatggcgtcatagtattccatggtgtatatgtgccacgttttcttaatccaatctattattgatggacatttgggttggttccargtctttgctattgagaatagtgtcacaataaacacacgtgtgcatgtgtctttatagtagcatgatttataatcctttgggtatatacccagtaatgggatggctgggtcaaatggcatttctacttctagatccttgaggaattgccacactgtcgtccataatggttgaaataacttacactcccatcaacggtgtaaaagcgttcctatttctccacatcctctccagcatctgttgtttcctgactttttaatgatcaccattctaattggcatgagatggtatctcattgtggttttratttgcatttatctgatgaccagtgatgatgagcatcttttcaagtgtgtgttggctgctgcataaatgtcttcttttgagaagtgtctgttcatatcctttgcccactttttgatggggttgtttgtttttttcttgtaaatttgtttgagctctttgtagattctggatataagccctttgtcagatgggtagattgtaaaatttttctcccattctgtagcttgtctgttcgctctgatgatggtttcttttgctgtgcagaaggtcattagtttaacttgatcccatttgtctattttggcttttgttgccattgcttttggtgttttagtcatgaagtctttgcccatgcctatgtcctgaatggtattgcctgggttttcttctagggtttttggggttttaggtcttacatttaagtctttaatccatcttgaattaatttttgtataagatgtaaggaagggatccagtttcagctttctacatatggctagccagttttcccagcaccattaattaaatagggaatcctttccccatttcttgtttttgttaggtttgtcaaagatcagatggctgtggatgtgttatttctcaggcctctgttctgttccattggtctatatatctgttttggtaccagtaccatgctgttttggttactgttgccttgtagtatagtttgaagtcaggtagtgtgataccttgttctttttgcttaggattatcttggctatgcaggctcctttttggttctatatgaactttacagtagttttttccaattctgtgaagaaagtcattggtagcttggtgaggacgactttgaatctataaattaccttgggcagtayggccattttcatgatgtaaattcttcctatccatgagcatggaatgttcttccatttgtttgtgtcctgttttatttaattgagcagtggtttgtagttctccttgaagaggtccttcacatcccttgtaagttggattcctaggtattttattctctttgtagcaattgtgaatgagagttcactcatgatttggctctctgttggtctgttattggtgtatgggaatgcttgtgatttttgcacattgattttgtatcctgagactttgctgaagttgcttatcagcttaaggatattttgggctgagacaagggggttttctaaatatataatcatgtcatctgcaaacagggacaatttgacttcctcttttcctaactgaataccctttatttcgttctcttgcctaattgtcctggccagaacttccaacactatgttgaataggagtggtgagagagggcatccttttcttatgccggttttcaaagggaatgcttccagtttttgtccattcggtatgatattggctgtgggtttgtcataaatagctcctattattctgagatacattccatcaatacctagtttattgagagtttttagcaggaagggctattgaattttgtcgaaggccttttctgcatctattcagataattgtatgttttttgtcgttggttctgtttatgtgatggattatgtttactgatttgtgtatgttgaaccagccttgaatctcagggatgaagctgacttgatcatggtggataagctttttgatgtgctgctggattcggtttgccagtattttattgaggatttttgcatcggtgttcttcagggatattggtctaaaattctctttttttgttgtgtgtctgccaggctttggtatcagtatgatgctggcctcataaaatgggttagggaggattccctctttttctattgattggaatagtttcagaaggaatggtatcagctcctctttgtacttcgggtagaattcatctgtgaatctgtctggtcctggacttttttcgttggtatgctattaattattgccacaatttcagaacctcttattggtctattcagagatttaacttcttcctagtttagtcttgggagggtgtatgtgtccaggaatttatccatttcttctagattttctagtttatttgcatagaggtgttatagtattctctggtagtttgtatttctgtgggatcggtggtgatatccattttatcgttttgtattgcatctatttgattcttctctcttttcttctttatttgtcttgctagtggtctatcaattttgttgatcttttcaaaaaaccagctcctggattcattgattttttgaagtgtttttttgtgtctctatctccttcagttctgctctgatcttagttatttttagccttctgctagcttttgaatttgtttgctcttgcttctctggttcttttaattgtgatgttagggtgtcgattttgtatctttcttgctttctcttgtgggcatttagtgctataaatttccatctacatactgctttaaatgtgtcccaaaattctggtacattgtgtctttgttctcactggttttaaagaacatctttatttctgccttcatttcgttatttacccagtagtcattcaggagcaggttgctcagtttccatgtagctgtgtggttttgagtgagtttcttaaccctgagttctaatttgattgcactgtggtctgagagacagtttgttgtgatttctgttcttttayatttgctgaggagtgttttacttccaatcatgtggtcagttttataataagtgcaatgtggtgctgagaagaatgtatattgtgttgatttggggtggagagttctgtagatgtctaataggtccgcttgggggtacagagctgagttcaaaccatgaatatccttgttagccttctgtctcattgatctgtctaatattgacagtggtgtgttaaagtctcccattattattgtgtgggagtctaagtctctttgtaggtctctacagacttgctttatgaatctgggtgctcctgtattgggtgcatacatatttagcatagttagctcttcttgttgaattgatccctttaccattatgtaatggccttctttgtctcttttgatctttgttggtttaaagtctgttttatcagagactaggattgcaacccctgcttttttttggctttccatttgcttggtagatcttcctccatccctttattttgagcctatgtgtgtctctgcacatgaggtgggtctcctgaatacagcacactgatgggtcttgactctttatccaatttgccagtctgtgtcttttaattagggcatttaacccatttacatttaaggttaattttgttatgtgtgaatttgatcctgtcattatgatgttagctggttattttacctgttaattgatgtggtttcttcatagcatctatggtctttagaatttggcatgtttttgcagtggctggtaccagttgttcctttccatgtttagtgcttccttcaggagctcttgtaaggcagacctggtggtgacaaaatctctcagcatttgcttatctgtaaacgattttatttccccttcacttatgaatggtagtttgtcttgatatgaaattctgtgttgaaaattcttttctttaaatgttgaatattggcccccactctcttctggcttgtagagtttctgctgagagatccgctgttagtttgatgggcttccttttgtgggtaacccgacctttctctctggctgcccttaacattttttcttttatttcaaccttggtgaatctgacaagtatgtgtcttgcagttgctcttctcgaggagtatctttgtggtgttctctgtatttcctgaatgtgaatgttggcctgctttgctagactggggaagttctcctgcataatatcctgaagagtgttttctaatttggttccattctccgtgtcactttcaggtacaccaatcagatgtagatttggtcttttcacatagtcccatatttcttggagactttgttcatttctttttactcttttttctctaatcttgtcttcttgctttatttcattaatttgatcttcaatcactgatatcccttcttccacttgatcgaattggctactgaagcttgtgcctgtgtcatgaagttctcatgccatggttttcagctccatcaggccattgaaggtcttctctacactgtttattctagttagccattcatctaaccttttttcaaggttttttttctaatccttcccatgggttagaacatgctcttttagctcagagaagtttgttattaccgactttctgaagcctacttctgtcaacttgtcaaagtcattctccgtccagctttcttccattgctggcgaggagctgtgatcctctgggggagaagaggcactctgtttttttgaaattttctgcttttctgttctggtttctccccatctttgtggttttatctacctttggtctttgacattggtgacctgcagatggggttttaytrgggatgtcctttttgttgatgttgatgctattcctttctgtttgttagttttccttgtaacagtcaggcccctcagctgcaggtctgttggagtttgctggaggtccactccagccccttttgcctgggtttcaccagtggaggctgcagaacagcaagtattgcagaacagaaaatattactgcctgatccttcctctggaagctttgtcccagaggggcagccacttgcatgagttgtctgtcggcccctactgggaggtgcctcccagtcaggctacacagagtcagggatccacttgagggggccgtctgtttgttctcagagctcaaacactgtgctgggagaacccctgctctcttcagagctgtcacacaggggcctttaagtctgaagttgtctgctgccttttgttgagctatgccctgcccacaaaggtggagtctatagaggcagtaggccttgttgagctgcggtgggctccgctcagtttgagcttcctggctgctttgtttacctactcaagcctcagcagtggcagatgcttctccccctgccaggctgcagcctggcaggttgatctcagactgctgtgctagcagtgagcaaggctctatgggcgtggtacctgctgagccagacatgggagggaatcgcctggtctgccggttgctaagaccattgaaaagcacagtatttggggggaagtgtaccgtttttcccggtacagtctgtcatggcttcccttgtctagaaaagggaaatcctccgaacccttgcacttcctgggtgaggcaatgccccgccctactttggctcaccctccgtgggctgcacccactgtccaaccagtcccaatgagatgaactaggtacctcagttggaaatgcaggtctgcgtcgatcttgctaggagcttccgaccggagctgttcctatttggccatcttggaaacgaccatcttgatttcagttcttttgaatatattcccagaagtgggattgcttggtcatgtggtaattctgtttttattttttgaggaaactccatactgttttccacaaaagctgtgtcattttacattctcattaacagtggacaaaggttccaggttctccrtatctttgctgacatttgagttgttgttgtatttttctataatagccatcctagcaggtgtgtggcgataactcataattttgatttgcatttcccttatagttagtgaagttactgtttgatataacctgtttgccatgtttatgtgttctttgaagaaatgtctattgaagtcctttgcccatttttaattggataatttagttttctgctgttgaattgtaggggttcctcatatattttggatattaatctcttatcagatatgtgatttgtaaatattttctctcattccatagattaccttttcattctgtttattgttttctttgcagtgcagaagcttttaagcttgatgtagtcccagtcatctaattttgcttttgttgcatgagcttctggtatcatatccaagagatcattgccccattgccaagctcagtgtcatgaaactttcccattatattttcttctaggagttttacattgccagattttacatgtaaatctgtaatctattttgagttgatttttgtgtctagtgtgtggtaagttagtgtgaggtaaggatccagttttgttctttgcatgtggatatccagtttcctcaacattatttgttgaagatgctatctttcctcattgtgtattttttggcactcatgttaagtatatgtgtgtggtattatttctggatgctctattctgttccattggtctgtctgttttttgtttgtttgcttgtttgttgccagcaccatactgttttgactattgtagctttgtagtatattttgaagtcaggaaatatgatgcctcaatctttgttcttctctctcaaaattgctttagctttacagatactttgtagttccatatgaattttaggatttttattctgaaatccctgattctacaaagaacaaccttactatattatgtgtgtatttatattgagtcacattttgtacagagaaggcagaaataatgcaagctactctctctaatgataagtgattggttctctaaaattccgtagatatgaccattgagttgtttttaaatgtcattatgactgcatagattttgtgatatttggtatttttcaatccattgcagttattgttccttatgatgttcagtttatctcatttgccaataggaattctttcacttttgctcctgagtccttttgatatgattccactagtcattagcacattttcactttctggtaggacaaattagcctcttctcttatattttctgacctgaccaggacataaccatatcaataaggcaccttggttccttttgtatccacagtccaggtactggaaatgttcatttctcacttagtcactgtttctaggtcttttctgaagagaagttttgaaagagaaatattttgcatgtttatgttgatatttttatacttctaatttaagtttgagtttataggtttttgttttcaattttaattcatatgtttatctcttttctcttaaactaaaagtgttagttttatatgattctatatatgcaacaatttaatagtattctaagagtaactcatattattaacaatttgatgaataaaaatgatttaagatttccttgcatttttcattgtccttagaaaatacccaccaggagtatacaatcaagttattggtttttgccttttaaaataatttgttgttggttaaactaccaatccatacacagttatattccctttttaaattttcttttaatttttatgaattactgttttactttgaattaattttgtttaataattatttgaaacattttcatgtttccaaagtcaaaacctcaaagtaaagcacatttggagaagtgtaacttatcttgtttgctttactttgtcccttttcttcccatggatatcaccacttttattaatttttggtttaaaatatatatatgtacacacatacacacacacatctttatattttcctatatatataaaaggtagcatactgtatatgcttaaacactttgcttattttcataggaataatatattataacaatatttagtaatatttctcatttttttcacacaaagcagacattttaagcatgagacctatcaggattcaggatgggtaatctcattcattcattcaataaacttttgctgagaactcaataaaagtaggggtgaagttcttggatactaagattaatacaccacagcttctgtcagaatggagcttcagatgcagtagcagagaattcacttaaagcaaggattgctcctcaatggtaaggactaatggaggtgagcatggggtgctactgcaggagcgcaacaaggaacacaaaactcaagactgagaggccttgagccgactcctacagaatggtcagaagttaaccaggttaaaggtagaaacaggaaggttcaggaagagggaaaggcatacaagaagtcccatggatgatgaaatgagagcatggacgctakcaagaggaggctagagaaacagatgaggaaggcsrtgactggtgaagtccttgtactatgggtgtggcctggaagattctcactggcccagaaagggaaaaaaaggaaccttttaggcaggagttaggttttataaaaaccactcttcattcagttatttaccagcattatttaagaaatgatctgtagtccatgttactgtcagtcaggttcttaaatatcagaacacagcctgttggatacaccataaaatttgcagcctttaataaaatatcattattagtgtaaataaacaaaaacaaacaaagctgtggcccaattatccatcatctggctaaccacaccccctaaacttgttatgtaatctagaaatatgaaagaaacaaaatatgaattctgttttatagagtccattagcctacttaaataacagagttatagctatttaggcctagaaggaaggatatattcagttgtaaggcacaagaaagtcatggcactctttgtggagcaccatgcagtatttacctttgaattttagaataaatatcagatcttgtgctaaacttgttcctattgtatgcattgtttatggcaactattttattttattttattttatatttttttgagatgaagtttaactcttgttgcccaggctggagtgcaatggcgcaatctcrgctcaccacaacctccacctcctgggttcaagcaattctcctgccttagcctcccaagtagcttggattacaggcatgtgccaccatgcccagctaattctgtgtgttctttttttttttttttttttttgtagagacaggttttctccatgttggtcaggctggtctcgaacttctgacctcaggttatcctcccaccttggcctcccaaagtgctgggattataggcgtgagccaccatgcctggcccaactattgtttatgtgatgcttaggtctgtactgttctagtgctttatgtgtattacttccattaatcctcctggcttctttataaagaagcacttgtattatcctcattttataaacgaggaaaactgaggcataaagaaatggactgtatcaattataggtggtgaatggtagggattcacatgtaggcagtctgactccagggtgggtgctgttaattgtaatagcataccatgtctctctcctggaatataaaagaaagaaagaagctgaaagataataaaggtgaagataatatgtgaaagaacattttatattaagaaatttttaatattaacattttcccgcttaatgaacaaatctttcttgattttactgataatccatttttgatctacttcataaaagtttgagtactcttaaaggcattggttgaagatccattgatacccaatgtttgacrgatgaggtacctgcagtcttgcaagatatagtgacacagctggtttgtaacaaaaagactgcaattcatgcctcctgtctcacacaataaagtgtgagaattggggcatagcttttgggactttgagacccaatgtaaccagaggtcactccgaaaggattatatttagttctagacccttctatgctctagagaagtgaaagatggaattgaggatgcatcttcttcaggggctacatttccaagtaggacactttcttttttttttttttttttgtttatttgtttcactttttctctatagctctcgccaatggcacaattatatataaatatatataatttattgtgaatttcttcatttttcaatattgaaaatgctctgatcattttctaaacttcttgcaaatgaaacgcctactatatatacacataaattacagtattagtatctacaaagacttgcttcaagggaaacaagattttttgatttggtgccacagctaattggttttaattatgcataaataaagcccaaactgcatagttctatgtctttcctttctttgttgagcttgttgtgctttgaaaaaatctacaatgtaatcagtgatacgtattatcagaaatataattgcaaatgtcttaattaaaatatacattcacacaaatatgaggaataagaaaattaatttttcagtaagtatatagactcctatactaaaatgttttattatttttttaacatccggttacaaaaatattttgtttatactatattaagttgcccttattttatatctttaagttctttcttttgtcttttagataacttttaaaatcttctcaatgaagaaacaagcttgagtcagatattttgtaacattttgacatatttaagagaaaggaagagagagggaagcttgtaaaataaaggcttatataagaagacataagaacaagcaacttaaagaaacagaaaatcagagttctggatagactttagagtgataaagtggatagaatatggtttccggtattgttccctgtcatgagttctgttcaaactcctttacctgtaaaactctgctcaagttattaaccatctctgcaactcagctttcttttttttaattataaaaattaacgtgtataaattacttctgaagttgttttgagaacatgtgacaccatctaataaattcatggataaacacctaattaatatttttgttttatttgtatatattttgttagacacatgatttaaggtaacatgcaataacttttttctttctgttatgatttattctccaaaaataaatttgtagatgataccagttgattcagaaaattttaaaaatacatatattaaacacctattgcttttcttacagcattagatacaaaaaacataaggatgagaaaaattgtgctgctattgcaaagaacttgtaaactttttctgctgacctctggcagaaggacttccttggactcagtcttgattatctgtgttcttttaggtagtatccacgacaaatcaaaaggacttagtatgtagccagaataatttgagtatttcattcagtactgaaaagattcatcttgcattgaatttgagtacattaggtttccctcatattttccccccattgatttgctggacagagtaaacaattctctaatcttatcttgtaaatcttacttttcttagtctttgtcatcaacactcataagtagctagtaagtgcaagtcactgtaattaaatgggtttttttttttttgaaattctgttgtttacaatattctcttggcctgtctcccctagaaagtttgtaccttaatctatgctttagactgagtttattgaatttcttttattggcaattctctggttgttagagacattacacataattatttagatccttctagaagaactcagagggccaaaattaaacattcttgttaagacagcttctctctggggatcacttgttagtttatttagttattcttttatgtaagcggttaatcagtgcaagcaatgaaaaggtatagggcatcttggctgctttctgcatttcaaaatatttttgatgtcttttcagatctccctatagagagctttgtaatgcttttctgcaacagagaactgcatgcacggacccaagggtcaaaccttttctaatgtaaatttaatgccatggcttcgtgagctaagatcatttataaatataaaactcacagaagagcagattcatctgttaccatgtatagtaacatctcaaagagacaactaaacatgacagttgaggggatttgcaagtgaaagagaaaaacatgagcagagttgagagccatataattatgctcattcacactgtgactagttttaaagtgatttattcaaaatggttaccagtgtactcttagtcaccttctttcttgactatgtgctaattctgattttggcatttgtctatagaatatacttgttcttcctcttgaaagggaattgtgctacattttcgtagtgtttaaatcagttgatcatatttcacaattattccataacgttagttatttgaatttcaagttgcagtgttcttagagaaagcttaatatcttcattatacatacagtcatggctagctaattagcatcatgaatgctgaagtttaaccctggatgccactatttctgacttcaagaatatattggattttttcactttaaaaagtttagaaggaaaaatatcaytgttgaattctacttcttggttatttcaaattatttcaaatrggaagccccctgtaaaagtgtccagacttactataaatgcattatagttctcatctattggtttataaataaaagcatccttgaacgttttccaaaagagtaatgcgatttacaatatagttaatgaaaattaagctatattggttttccgggagggaaattgcactacataattaattttaaaaatcactgtttatttattcagtttattgggaaacaagaaacagattcaaaataatgaagctaaaggaacacattgcattttgacatcgtccgtaattaaaagttcagtgttttggaggcaatttcgttttgtttgtgccgccattttagttgccattgtacttaaagctttccttctcctttcttatataggggttctcagcttttaaataaaagatgtaaaggaattatggttatttctgttttcagaataagtgtctaaaattttaataattttaacatttttgttttggttttttatttagtgattattatacaataggcaaaaccatagatcagtataaataagacaggtaaagtgatttgcacaaggttacatgtttggcaatggcagactaaaatgcggcttctagatatccagtctagtgttttttcccttatctgaacttatggtgccttgtgattccttgatttgttaaatttcagaaaataggcattaagagatttctagcccagacaggaatggtacaggaatggtaacttctttatttgagtggtgacttaggctaagctttatatacatacaatcacactctacatttgtaaaacattccgtagttttaaaaagtctctctcattctctcgtttccaacttatctttccctctctttctttcttgctttcactgtttcagaaagtgagaactttctctgaaatctacatacaagaaaataaaatgaaatcatggaaaaggtacagaagcagcttatgacatctacaagggaaatggctagtttttttaggataaaacaaattgactgattatccttacagtgaagacaaagtttgaagtttttcagaatgtgattaaaaatgatgaatgatataatcaaaatatccttcaaaattctgttttagaaatttgtgtaaaagtttgactttctttgaatgaggccttccatagtgagagttgctttatgagagctatcagaccctcatcatgaacttaaattgacttagactgatttctacggaaatgcctaacctgcatttctttcaatttcccttcatcttttcaatgtcttccaagctgtatgattcaccttaatatgtaaaaataaagtaaaatatatttgtttctacataatggtctctatattaacatctttgatgcacaattgaaataaaagctcaaatagaaatactgattacagtggggtaaatagcttaccagaattattcttatctggtcctaagatttggattggagatatggtaatacttccactcacaagtccatgaggaaaagatgggaggggaagggttggaattttaatatgaactataccttaggttggagatgagcctggggactggccagaggtctcttctagaattgaggtgggtggggcacacaaatggctcttatcctgcccctgctccttctctctgtgctctgaatttcacaccttgactccttcaaagggctttacttcagtccttcagtggtggcatcgtccctgcatcaccattctctctctccctactaaatcattcctaatagttcaccaagatttttcaaaatctttcttcttaaaaagagaataatctaaagccttctcttggaccttccttaaaccacaactgctcatctccgttctttctatactaacctttttgatgttttgtcggtatccatcaatgctaattcctcatacaccattcactcttcaacccacttcaatctcttttcacccccattgcacccttcaaattgttcttgttgaagatctccatgctaccaaatctactgtcctgctttgccttaatcttaccccatctctcaccagtatcaatacaattgcctactttctctgttgaaccactctcctttcttgccctcctagccatcatgcacttaaaagaaatgttttcatgttctcctccttctttgctactatttttttttttttgattctgaaatctttgaatgcctcagagcctctcctcttttcctacgttcacttgcatacttctctacttaggtaatattattccgttccatgagcctgaaaccacctgtaggttgatgattctcaagtttatattaactgccaagccttcaaccctgagctccagatttattcatttatctatctattctgcatctccactgagatgtctaaaggttgtttcaaaccttacatgtccaaaatggaaattttgctttccaaattatcacttaaatctgtggttccggccgggtgcggtggctcatgcctgtaatcccagcactttgggaagccaaggcgggtggatcacttgaggtcaggagttcaagaccagcctagccaacatggtgaaaccccatttctactaaaaatacaaaaattagctgggcgtggtggcgtgagcctgtaatcccaactacttgggaggctgaggcaggagaatcgctggaaccccggaggcaggggctgcagtgagccaatattgcaccactgcactccagccttggggacagagcaagactctgtctcaaaaaaaaaaaaaaaaaaggtctgtggttcccctgatcttccccatctctctcagcttttcttcttctcaagccaaaaacacaaaagccctttttgatttctccctctcgttcacttatttcataccttatgcatcataaaatcttatagttctgcctctaaaattcagctccaatcttgctgtttcttattcttgcaagtacctgctaccctacacatacaatccacttaggagccacggtcatctttttttctttttttaatagactttattttttagattaattataagttcacagcaaaatcgaatggaagatagatttaccacatacacactgcactcacataggcacagcctcccccattgccaacatccctaccagagtggtacacttgttacaattgctgaacctatattgacatatcacccagagcccacagtttacattagtagtaactcctggtgttgtacactctgtgggtttggacaaatttacaatgacatgtatctaccattacagtatcataccgagtagtgttactgctctaagaatcttctgtgtcccacctattcatccctctctcctacccaagctctggcatctgctggatgtatttatagttttactgccttcataattttgtatttccaagaacgttatagttggaatcatacagtatgaagccttttcaggttgccttctttcacttagtaatatgcatttaagtttcttccatgtcttttcatggctggatagctcatttcatttagcactgaataatattccattgtctggatataccccagtttatttatctgtttgctaagtgaaggacagcttggttgcttccagattttggcaagtataaatgaagttgctatacacatccgtgtgtaggttttagtgtagacataagttttcaactcctttggggcaaataccaaggatcgcagtagctggattgtatggtgagagtatgtataatttcgttaaagtgtcaaactgttctccaaagtggctgtaccattttgtatccccagcagcaatgaatgagagttcctgttgtttcatatccttgccagcatttggtgttatagtgttttggattttaaccattctaataggtgtgtagtggtatcttgttttaatttgcatttctctatgaggttgtgaagcatcttttccacagtaatcttttaggaaaatcattttcctccttaatatttgttattttttccccattgcttaaaaaaaaaaaatgaaaaactaccatgacctgaaaggcctgcatgatctggtacctgtatagcttagtcatctaggtgtatcttgttgctataacaaattaccacaacctagtggcttaaaacaacacacatttattttctcatagttcggtatgtcagaagttcagcatggacatcactaggctagaatcaatgtgtcaggagggctggcttcctttctggaggttccaggggagaatctgtttccttactcttaaagtgtttacagaattcagttccaagtggttgtgggactgatgtctttatttccttgctgggtgacatccaggccactctcagcttcttgaggcctttatctagtccttgcacatgggccactacagctcagaaccagcaataagccatcttatacacttcaggctgttgcctctctgaccactcttctatagtcacatctttctctgaccacagcctgggaagcgtctccacttttaagaactcccatgatcaaaatgggccctctatataacccagggtaattttctctctttgtgtctataccattagtcacatctgcacagtccttttggtatgaatttaaagattcctgcagacatgagcatctctggagggctgttattctgcctagcacacatctcacgtaaccttgaactccagcctccagggagagtaacctccttcctgtcctcaaatctgcaaagcactccactacctcagagaatttgcatttcctgggccttcctcctaggatcttttcctctggttctgtgcatgacagctgacttagttagggatggttctaaaagtaagtcagattaaacccatagggattcagggagttgaagttacaaagatttggggatgacagaagctatagacaaaagattcagtctgacaagtatgatagtaataactttactcactcctatctgtttgggctgttggtctctagttctcgggtacattggccctgatgaattgttaaggttggagaaagttttggacacattttttttttcctgcaactgacattcactcttgctttgcagataagaaaataattacgtaagagtttaacaaaagtaatcatgaaacttcattttttcattgtttttcttctctwatactagactttttcttttagcataaagagttagtaggctagtgatattttgaaactgaatcacatactcaaagaaagagggcattactactgagaaagagtgagagcatcattcatcttttggataccagtttgttttaaagtgtatattgctgagttgctaaggattttttcccaaataataatgagctcctaattgttagtctttatctgtttgcatggagagtgagcaaatatatattgtataactgttaactagcaaaccagtagagcatatagaatgaagcaagtggtgtgacagctctcctggtgtgatgaaactccacagacatccatcacctcatgtttgaagatacagcacagttcttagaaatgccattgctatttacaactcaacattagtttgagactggtaaatcaatcagtcaatcaaaatctctccctttaaaacagtaccatttttctaataaagacaaacaaattggcctcaggattgatttggagtttgatggactgaagaaaaaaaagcttttctccatttatattctgagaaatgtaagccttgcatttaattctgttgcttcacactgagtaaggaaaatggtgtatctcaggacatgttctgacgtaataacaatgaaatgggccagtctgaaatggggtaagaactggaattcaggaaacgggatgcaggtatggaatgggattagacatgagacagaattccagcctttctggaaaaatctagctcctgtcaactagcacttgttaaggctattgattggctgaggatgttggcagaacagtgaattagatggtcctggaggtagaattcataacatgtcgatggaaaatctatgagcagataacagtgaaaagcagaactttatgagtccttggaggtaagcatgtaggcagaatgagggagtaccctgtttctgagggtctaaagcatgcagttcaacataagggtcccagtatcagggatgtgatgaaggcagacattgggattggagacagagtgaagatacctgaatacaaaaccacaggaccattaggttgatttcatgctcagtcacagatcatggagccagagcttctttagtctatcctgcctgaggtcacaaatgggtttctcgcaataagagaccaggtctgttgagcttataagtgggctcaggaccccagtcacagggttattgaaaaatgattccagagcattctccaaaatttatggcactcctatttatttattttactaatttttctctcatttgccactctaatcctacttttaaacccatttttatccctttctcttctctcctttggttcttggcaaaaggacttagaggctatgaggttatggcggcagtaaggaaaatattgcaacaaagggaaccattttgggaagtcctgacatagacatttctatacatttttgaaaggggatattttacaaataattatcaaatgaagaaagttggttggkcagttatccagttgggcagagattggattatcagtaactggtgtgataaattcattttcttaaagaaacaaaggccttttatagcattaactgcaatgccagaggtgtgttacaaagaattttctcaaattattttcttatttttctttctattatcctttattcagcaggagtttattttatttttcatctttcttatgatttttaagatatgtactgaatgcacaagagggctaaaatacaaccttrtcttggtctagagacttgccacccagctggtagttttattgtaagaacagttacctggggaggtgatttactggtaagaataaaggtagtatatcctattatcttcccagtgtttctctaacagactcattagagcatggtatatggaattcagtggggacttgagttctgaatctggacattccctaactgaaaccctaaataaggaagagcgaataatggaatctcaaagatctatatctgcaggaggatatggttgctcattaagatataaataccattttgatgtaagataaataggcaaagggatattacatataactcttagcctcacattaatacagtccatattaataacatcatactctcacaaaaaaccttattgaactatgtaaaatagcaaaaggactttaaaagtcctgctgaatatcatatgtccaaataagactacttctgaatccacaactattacagaaacaagctttgctgcaaatgattttgactttcctgacttatctttccacacgatgagggatgtcttttgattctctctgatacagtagtctcatcttgccagtgagtaaattgtaaattacttgactttggatgatgcattattgcttcaggttcttgggtgccctttgatacatcacatacagtgctgtcaagctatgtaataacctgggaaaatgaatttaccctcaaatcagtatttctttcctttgcaaaagagctattgtaaataacttatgaccctccttgctcttactttaccccaaccccttctcatatcttatgacttgcctactaccacacgggtatcccctgggtgttcaggattgcccaaactctaatgcatcattgaatcacataatcttgaccttttgttatcttcctccctctgtttcttgcccctctgtattggttatctattgcaatgtaacagattgcactgaaacttagtaacttcaaataacatatttattatctcacagtttctgtgagataggaattctgaagcaacttagctctggttctgggtcaggatctctcaggaagttgctgtcaagacattgactggggctgtgtttatgtgaagtgttgactgggactggaagatctgcttccaagatggctcattcacatggttgttggcaggaggccccagtcctttgtcacatgggtctccccatggggtttgtgaaatatccttttgataggccagctggcttttcccagagtgagtgataccttttatcacctaggcttgaaaatcatacaattcctccatattctcttcattggtagcaagtgactaaatacagctcacacacacacggaagaaaattaagctccactcttgaagggaggtgcatcaaataattgatgtgcatattttaaaaccacctgctatggtttcggtgttttttcccctttaaacttcatatgaaatttgatccttagtgttggaggtgggacctaataggaagtatttggatcatggaggcagatctctcatgaatagattaatgcccttcctcactctattagtttccattagagctagttgttaaaaagagcctggcacctccccctctctcatgcttcctctttcaccatgtgatttctgcctatgcaagctccccttcaccttctgccataagtggaagcaacctgaggccttcaccagatgcagatgcccagtcttgaactttcaagccttcagaatcatgagtcaaataaacttttttaaaaaaaataaattactcagcctcagatactcctttttagcaacacataatgaactaagacaccaccgtatcttacatactccacccttgccttcaattcatctctctcacatcttctgacctcagctgatgatataactgctaactaaactaaaataattaggagtagttgtgttaaaatatttaactcctttgggcaacatagtataaaaatgaaaaaagagcaggcagccattttatatcctagctctgccatttaataattaaggactttgggaaaattatttaacttttataacactcactttaatcaaccataatatgggcattttggtatctaccttgcaggatgtaatgcagagcagaggtcatacatgtaaggcactgaagacagcattttaggtgcaacaggtgtgtgataatttgtagttgtaataacaataacacttaattattactgtaggctttgcattatatctgggacttctggtgaccttggcataactttctaaatggtaggaatcactgtggcagatggatgtgaagtgacatttttatcagagctctcctcagtccaaagacttgctttcttcccccactcagcctgtccttccatgatctctgccctgaggcttcagtacatcttagtgaaaatgtcagtccacgtaaggtcctggatctgagcactcgctgtaccacctatgagctggtggccttaggcaaactttccaagctttgtaagtcatcttttctcatacatatatttaggaatacttatttctttcttgcagtacagtgaatcaacattgtctctacaactgatacttcattcttttgttcaaggcagtagttctaaaacatggctgtacgttgcaatctccaggagctcttaaaaaattcctgaggcctggtcccaccccagagattctgatttaattgatctaggggccagatggtgcccacacatctggggtttttaaaaacctcctaggtattcctaatatgttaagaactgcttattagattaataattttatctcctataacagttgtgaaagcaattaggccaaagttaaaatagtctaaatacaattatttacatcctatgtttccatgcttttgtgctttcatctttttccccttgataaattatttcacttctctcaatatatatttgactcatttgttctgtagcttctaattttattattcttgctttgctcaaaccccaaactctcctttgtgctgttatatattctactttttgaagcaataagaaaggaataagcaagtacagattcacagtgttgcttttaagtagaatattcttccagtaggagaaatgataccatgttgctttggtggaagtatgtaagcatctttcatgctctgtaagaaccgtcaatgcatggtgccattggcacactggactgtgtattggcaatggtgcacatagcagatggggttgagtgtaggcagtcaagtgttcaagctctgtctctgaattgactaatggttttgatggccgaaattcaaggccaaaagcactgggatgccagtctttgtgttgtattgagtgtctgcaattaaagctatgggactgttccctttctgctctaactcaaatttaattaattttgaattaaaacaaatagtttccatgaccacatgaggtacattttgggtttgcctgatcaggattagtgtaatgaagtctccaccctttcgttatcccccaccaaagacccctaagaacctgatttaaaatgctatccaaagtggcatgttgctgctaaatattttgatatgtatagggcattttcatgtccatgtcctatgtagagaatctgtaggtgtcctcttggmaaatgccagtgacctaatgtagcatagaatcagcatgtgtatttggcactcctccacaactcgagaaggtcatttgttaaggctttctgaactatttcaggctaggtcctggtctaaaataaagatatagtataaaatttagtttgcagtttgaagtttgtcatcgtacattacctggttattgttctcagaattagctctattagttaaagaaaagctcagtcctagtgtatcatgaatttagtttccaagattatgaatttagtttccatgtgagttatttagctttattctattgcattatcacagattgctcttttaatcctgctggaggctttgtgagcatcttctcttttgaaaaagagagttgctgatcagtgtcattgcagccaccttactagaatattgtaaagcctatacccaagggcccacacccaagaatgacaacagcacattagatgacaagcaccacaaatctaaagttattatttatttgaatatgtttctgggtacagatgaagtgctcttggcttctagtagaatcatgttatatggtgtgagtcctcaattgatcactgaagccaaggcctttgtaggctgaatttttgtgaggttgtccactgtgataagaataatccagcacacagggtattcagctacatcatgacagaggacacagctctgctagcttttgcctaaataaattgcactcaattactcatagactttatagattgtatataattgcttgtttgttctgcattttctatgttggaagaccatttaactcagattatttggctttgtgtgtgaacaccagtgcattatcttgagtaatgttggaactgagttcatataaactgtytcttatgttgttttcatcctgtttccttccttttagagactccaagagtagaaacatccatgggtactggaattgggtaattagaatgatttggaaaaacctgccagtaggtcacccaggatgctgcctgatagtgtctgacagctgacgtagagtgtgaactgagtggcaggatgaaactctgcttgcttaattcaacattctccatggctagccctgtgctgacacatgcagatgaatgtcttatagcattttccttcttatctactttaattctattattatatagttagaaaactgaaagaacttcctaagagttgtaaggctgtaacttcagggttacgtgtagttctacttagcttccaatttagcattttaggaaaactgctattatgcaaacggctgccatttgctatgagcaaaagaaattctgaattttgtcaaagacttaattaatattatgattaaaaaacccacagttaatctaatgaaacacaaatggagaaaaaaagtgtcattgctttcattgcctagcaggtattctctaaatgtgatgtgttagtgccattttttaagtcactggcaaattctagctgctgtctatttttagttttatttccaagactagggtcatcaaagtccctgagcacagctataaattctgacacagttatctttgtattagtaggaagagattaggctatgtttgagtaacagaccctgaaacattaatagctgaacatacacaagtctagtttttgctcgtgcaaagtcagctgcctgtccatcagctctccagggtagctctctttatgcagtgacttggggaatacactctgataccatcttgtggctctttactcttaaatgtggcttttagttccctatgacatggaaaagaaagagacctaaagagcttgtacctacttttttcttatagctcatagtccagagctaactagggaatgtgtgtccaggtagatgaggatgaaaggggacctgataaacacagagcattatcacaaccatactttcagttcattctcttcactttccttccctggacttcatcacttcatgttcaattacctgcagttgtctccatactgtcttcctggttttgttctctgacatctatagtacattctgaacgttgctgccagaacaatcttctttaaacactggtttatatcagttctttgctgcaacatcttcaaccttccttcctccagcattgattatgtatactctctacatttcccagtatgtgtcaggtaagactttattgtttggctccaggctacatttctaagcttatccctatgcatctatctccaacatgaacactcaacttcaattcccaattccagcattaaactcatgcttttctaaacatgcgttgcccaggtctacctctgcatcataattttcactctgccttctgtctctatctattcctgagtgttcccagtacaggagtccaagataattgctctatctctgttgtatgctcattctatctattatttgtgtcattcagctggcattcctgactcttatcattacttaactcttcatgggtatttgtcttatctcttctactaggtcacttgcagaacaggtgctatatatactcttgtacatcccaaagatctctggaagatgctaaatacacagtagtgtgtggtaagatttattgagaatagatgcctgaatgattgactaggtattcttaatttgctttatacgatccatagactttggttccttataaagttaatgttaacattatgatgggatttatacttttatttcgagtgtgaggtctgtggcttagaagtcttaagatgaatattgtgattcctagtgatactatctttgcttggtttttataagcagagttttaaagtctttwcattaatggcccaggcaagttcatggttcatagtagtaaatgttggtgctgtattatgctttaaatcaatgtcttaataccatgattaggaaggggctacacaggtaacagcacaagcctttggagccagacagttgtgggttcaaatcctagaacctgcaactagtggctctgtggctttggggacttggctgtcttgaatgtgtttctgtaaaatggtaagaataactacctctatcacagaattgttgagatgatgaaatgacaaagtctacaagacactaatcacagtgcctgacagttattgctcaaaaatagttaatttaccactcacattatttaagaaaatataaatatcactttattggtttgtacaaagtcacatttatctttctgtagtttctttgcaaaacaggcaggtggatgaatctattcacaaagggggctctatccaaaataattttggcagtaggtgtcccaccaaaactcacatgctagggccactgtacaggtatgaaaaagccacctctactggtccagtagggtgttggacctgttccctgtggtgactgcagggccagcctgaattatgagagagatggtttattgtgggaggagactgtgatgtgacgaccttgaccacagttgctcctagaatcaggtagggttataatggctatggacaggcagagggcagctccatttagaacatcaaaataaatggtaagaaaaagtaataaaaggaagacactttggttcatgcccactcttgtttgttatgcttcctagcagatcagctgaatgagaatttaatttgttgtgaatactggcagcgtgctggggaaaaatggaatttacaaacgttttgaattaccgtgaagcttgtgaaattgtatgcactgctctgtttcatatgttttcatgggtgtgatgcctcgtttcaatagtgggagttgaggctgcaaatagtgggggttgaggctgccgtgagccggatttagaactctattgtattctaaaacatttaacagatttatctgagttttaacggacaaaaaacttcaacaagtatacagagaaaaatgtggaagataggatttgatatcaagtccaaaatgcccattcatggaaaaaaatgaagggacaatggaagtggtgagtggtgatactttcttcctttaatgtatccaagctattgctttcctttcctgacttccgaaaaccragtgcctggcaagaactgccaacgatttattgaaactacattttccttacccaccatagaaacaaatcatttctgtagtgggtaaattatacaaagcactagtgccttagcgactttaacggtttagactttcaaacttaatatttctaagttttgaacattataaatctctataaatctggattataaacaaactttccttgtctctgggttagatctgggtacaaaaatagaatccattttcttgcattttgcataggatctaaaattactctcctaaggttggagtttcctatttttctaaatcaagacaagaatagaggatatggaataaaaaggggtgattctaaactgagttcaaaagtcagtaattgagaatggtcatgaggcccgaagcaggaaagctggatttattttcttagaaagacttcctcattgcttccctaggagcaatgtaaatggccatctcacagataaatggtgagagaatcttatcaggcttctaacttgtcacttttcctggctccagtgcaagcattgataggtgacagttcatgagatagtaataaaaggcagcaggcattggtgaaagagacgctggagccagcatcagagctggagttaatccctggccccagtccacttcaagaaaatataattcaggtgagaagcaatgtgcctgctgtgcaaaagaacagtttcaagagatgcttcctaggtcttccctattaaaccctcgccataccctgatccatctatttagaaactctgaggttggcattacgttttggggcttggccaatctattggttaggaattgctaagaatagaccagaacacagtgcccaaacccttaccatactgaggtccaggatggggtcacaaaaggaacacaggcaggatttcttatcaaaacragctggccaaccatgaagtaggagtgagaggagggaaagacaggtgccaggtgatgcagaggtaagaaagtcaggcagctcagtccatttctctgtcctgagcgtcttcagagaaaggcagagagcaatactgctttttgaattatgtgactcagggcttcccaggtaactcactctagtctttaaaagaacaaaataaacaaaactgttcttgaggaaagcaaaggtttatgcagagaacctaataagaatctccagagtttgcatgtcacagaacaactgtttataagttacctttttcctccttatctgtgcctggggacttytctttcttgtctttttcctcttgttcctatttctgttcccttgctcctgcttgcttgcccatctttgcatttctttacacctggcagcaaccatactctttcttgatcctgcwaaggttaaacattgttagggccgaatttagaatttctctaatttaaaaaaaaattctaataaggcccagatttcaatcatggctgcaggtgagttgaagactataacatattctaaaatttgatttgcatggatataaatgtgtataaggatatatccacattacattcttgacaaaagtcattctaatgaattattgaaagaattaggtcaaataaggattgcatattgtgtaggcagatgcattttaaaatgaaatagtgacttttagaagtatctggtgactcttcaacaatacctggttttccaaacaaaattaawacaaaggctttctttcaaatgttctttatctcaatttcatttaatttcctaggagagttagtgatttgcctagcactttctgtttcgttgtttatcctaatatatgctcagttttctgtttaactagtttgttgttgttgcttttcttttccgacaagttttcagagyggaattcttagaaatgcttagtgaagctaccctatggcccattttaccaactatcagatctttccctgaagaaataacagtaaggaaaataggaaaatatttcctgtttcttctggaagaaggcagatatttattatgtattctgcttagtaatatcactcccttaagagactgagggcatggtctcaatttttcttaaacaagtcttgggcctgcttgatgtaacctttggggatttaacacgtcagccaatgagccacacaccacaaatctgtaggcacctgacactgaaaaacagctaagcatttatactgtacataaaactctgaatgtgctcttatgctttaaggactcttttaatccatagggtgtcttagctatgatagtggtctctgagccagtggatgattgcttctttttactactctttctccacaataattgcatgaatcggattgtcatgccataagcacaggaataggatacttaactgagaataatatctcaaatgacatttaaatgttttgctctgtgagattggattagcagatttactatttttttattttaaagctttttattatgttgtcrtattattgaataactaccttccatatggtccaataataattaagatgttggattgatagattgaatcagcaagaggcttaaagcaagtgaggcttaacctgttttggtagttttgatcacttttcttatgccatttaaatactattgaatgatttggaactggttgactgatattttccctgttttctgctatttactttcttctatttttttttttttttaaataacagtgattaaaagcaaaagtgacaaaatggacactggtaattcattcagtgtgatgagaatccatgaataggacccaagtttatttttcagctgtagccttttgggacagttatataaccactatgttcctggcccttcctcatgtctgcagcttctcaacctgctcctctcctatttgttctccacatgaaacttctcccacatctttcttcccaccactggactttgtgtaatttgtttcttctgctttggacattctttcctatccttattaccttccaaattcgtcatcagcaccacttgtctagcaatcgattgctgatctccctggctgcatctaatccacctatgataggatctcattacagactgcacttgtccttcatagcactgtggcagctgcagtttcaggtttgtttgcgtgaaccttggctaaagtatttcttcctactagactgtaagccaaatgraggcagaagtaggaatagtgtctgtttctggttccctagcatggattccagcacagagttttacatatttgttgaatgaataacataaatgaaygaataaacacagcaggtaaagaaatgtgtaatttttgtttgtttttaagagacagaaccttgtcagtctagtacttcacttggtcaaatacctcttttggtagaaaagaaaattatatagattggtatataccaggatgaattcagtttaaagagaaaacatgaaattcagtagaaatattctttaaattctaaacagagaaattgaaaygaagttatattcatactgcatgtgggtatagttttttcttacgtatatttatgtatacatgtttaaatataatacctttacttaaccacctactgtacacaggcaatcaactggatgttagagggaaaacaaatagctaatatctttgcataggtactgcagtaggtactgtcacatattttattacatttatttctataacagttcttttctttcaatatgactcagagagattaataatattccaaatatgacaaaacttgtaagaggttcaattgggaattgttcctttttgcagccctgtgaatacacctaatggtcctccaattatggaggcggtagttggccagagtttccagctgctgagctctgatattcatcactatgtttgtaccctggccatgctctctgagggctgttcacagacaatgactgagcacagcaggagttctaaggtacayttgttcctgagactcatggacccctctcattgacccctgtgacttgaggactcccaaatggctttattaaccttctttagaatgtgaattctaggaggctcccacccaaacgtccctcactgtctctgcatcagacttgcatctggtagctctgatacctttcctaccctgctcaaaatgcttacatgtttaatcctgtgttggcatctgattcttggagaatccagactaactcatcctttcatcaagaagcccctgagaagagaaggaaataaataacaacttagacataagttctttgctaagatccatgtcaagaaagatatttcctaggttttcttctagatttttaatagcctgaagtcttacgtttaactctttaatccatcttgagttaatttttgtgtgtggtgaaaagtaggggtccagtttcattatactgcctatggctagccagttatcccagcaccatttgttgaatgggggcgtcctttctcctttgcttatttttgttgaatttgttgaggatcagatggttgtagttatgtggctttatttctgggttctttgaaacaagcaaaaaccaaattactccattaaaaaatggacagagggcaagaacagacacttctcaaaagaggacttacaagatgccaacaaacatgaaaaaaaaagttcattgtcactaaacatcagagaaatgcaaatcaaaaccacaatgagacaccatctcacaccagtcagaatggctattattaaaaagtaaaaaaaaaacaaaaaacaaacaaacaaaaaaaccagatgctgttgaggctgcagagaaaaggaaatgcttatacactgttggtggcaatataaattagttcagccactgtggaaagcagtttggagatttcttaaagaacttaaagcagaactaccatttgaaccagcaatttcatgactgggtatatatacccaaaggtatcattctaccaaaaacatacgtgcactcctctgttcatcacagcactattcacaatagcaaaaacatgaaatcaacctaggtgtgcatccatggtgaattgggataaagaaaatgtggtaatatacatcgtgaaatactatgtagctataagaaacaatgaaattatgccctttgcagcattacggatgcagctggaggccattatcttaagtgaattaacacaggaacagaaaaccaaatatcagatgttctcacttacaagtgggagctaaacactgagtgtacatggacataaagatggcaacagtagacactgaggactgctagacagggaagggaaggaggggagtatgggctgaaaaactacctatggggactatgctcactgcctcagtgacaggaatatccacaccctagatgtcagcatcacacaatctacccatgtaacaaaccttcacgtgtaccacctgaatcaaaaataaaagttgaaattattattattattattattwtttttgagacggggtctcgttctgtcacccaggctagagtgcagtggcacaatctcggctcactgtaacctccacctttggggtttaagtgattctcctgcctcagcctcctgagtagctgggattacaggcacccgccaccatgcccagctaatttttgtatttttagtagagatggggtttcaccatgatggccaggctggttttgaactcctgagctcagacaatccacctgcctcggcctcccaaaatactagtattacaggtgtgagccactgaacccagcgaaaattatttttttgaaaaataacataaactctagaatcagaaaaatctcaatttgtgtcctgatgtttataattaatagctgtgtgaaattaagaaagtttttaacctctgtgagtcttgcttcctcatacataaaatgtggttaacaacacctgcagcatggataaaataagattatttatgcaaagagcaaaaacaaaaaataaattgcttctccaaataagcaaagatcatgaagattaggatttgggcattttaatggatgtttagttcccaggtggatagacattttaaaagtatgttacggagggttttgttataaaatcacctattttcattgggctataaaatgaatttggctgatagtgtttcaatagagaatatagtctcagaatttataccttgtgcagtgctaatatagataatactatagttgtgtgcaaaatttattggtcagaatatttttgtccagtaaagatgaagattgatttgactgagtcagaaatacttgcatgaaatttatcgtataaaattatgagatagtmacatagtcaaagaaaattatccttttaaactctggcatttatgattatttcaaaatccctaatagatgccagttattgatgagttctcytctctgacatttatctttctgtggttgttcaatgtaaagattccagaacagtacatgtacttcaacagcacttcattttgtaagtttgtcgcttttatctccaaattttgatgggaattctttgtccatatgtacttaatattagaaaaacatattgttgagtactttttttttttttttttttttttgagacagagtttcgctcttgttgcccaggctggagtgcagtggtgcgatctcagctcaccgcaacctccgcctcccaggtgcaagagattctcctgcgtcagcctcccgagtagctgggattacaggcacccaccaccatgcccatctaattttttgtgtgtttttagtagagacagggtttctccaggttggtcaggctggtctcgaactcccaacctcaggtgatcctccagccttagcctcccaaagtgctgggattacaggcatgagccaccgcgcccagcctaaatttctttgtataaagcagagtgatagcttaaatcagagaatacaaattacctgatgatgctctcctggtgtttatatgattttcttcaacataagatggtcagctttattcgccctctgctttctgccaatgagttttacagaagtaatttagctctctaaacaagcaatcaagcaaacaaacaaacaaacacatgaacaaaaccagcagagcaaaacaaaccagcaacaaagccctttttctaaaatgcaattcataatagttttattgaaatgtagaagtcagcagcttctgccttcagtccacagtgcatcaactggtttcccttgaacttttgcatagtggttttttagctctgtgtagactcctcaggacaatggtgagggtgttccaaacaaaagcacttctgactttgttgttgaatttaggtatgagaatctatggtcaaagggccctacaaagaaaaycataaacaaatgtgcagcaaaggaaaaaatttgaactgcwcatttacaataatggcttctgatacacttagtacctcttgagtgggagttaggcatcagtgtgtggagtaacaataggaataatcaatgaacagaggagagatggtgaaattagattaagcagaaaaacatggctaaagcttagaatgttcaccaatattatgaagtccaaaaattcttcaatttcccattgaagaatatgaaatttgttcacagcatttggggtgatactgaatttgactgaatagttaataagatggtaaagttagcacacaagtgagtatgtttgcaatatattttgcctttatttgtttttctcataggacaaaggaaattgaattatattagattgtgtaggataatgtatgctattgtaaattcccaagttttgcagtaaatttaacattacaataaaatattgtccattaatagccgtagcaaaacrtccgttggtatagtttactgcatcattgcgtttttgcaaatctgaagtggagaataggatagtaatgactagcatcagaaattgttgctaatttcctaatttgcataatgtatctctaacaaactggattgtcagtttataggagacaccaaatgttcatataatgaagtttaaaaaaaaattctcagctgaaacatggcctaggtgcttggccaagctgggtggtacgatgtttccttgggatactgccatggtaaatcctataaaaattktaaacccttttaattggaattatcaaatgttaacctgacagtagtatgttagaagtgaatatagtgttgtgaaatattagtagtcttggtttttaaatcaatattttatgattacaggtaagttaaagaaaaaagactaatatagcaacattgctttgaggtctatgtgtggtacatggttcctgacacttctaacatttctaaaatgccttgggttacactcagctattatacttggcagacaggatgaatgccaacacaaagagaagtttgactttattcaagatgatacacttagcctctcacacctctgtatgtacttgttctctaatctgcctccagaatcaatataaatgcttttattcatgccccaaataatctccaacctgaccccagtttgtctcctctactacttacctcctgcaccagccttctgattgttcttttattttatttattaatttaatttaatgtattgagacaaagtctcactctattacccaggctgcagtgcagtggcatgatcttggctcactgcaacctccrcctcccrggttcaagtgattctcatgtctcagcctcctgagtagctgggattacaggtgtgcaccaccacactgggctaatttttgtattttaatacagatgaggtttcaccatgttgttcaggctggtcttgaaaaacaagagcctcggcctcccaaagtgctgagttgcaggtgtgaccaccacacccagccctgattgttcttttaaattaactatatccggtctcatcacagccatgtagctcatgcagtttctcttgccatctcatccctgttctaatatttgaggacatgacaaaaaatataaatcaggcagaccataattatatagtgtttttattggcttatacagcacttaattgtttgagttaattgacactatttaaaaagtcagtatttgttacatgtcaaactagaattctagattctcttgaaaaatttggtaacactgtaggtaccttcctacccagcaatattcagctgactttgataggcatttgagtttgcaacctgtgaatttacattttgtctcttatttaaggcccatggtgtttcattttctccagaaaagtttttctgtttcttctagcattttaaaactcctatgagctcatcatctctaacttttatttagcttttagcactaatgcttcatagtgtcaagtgcattttgtgtgccattttgtctcctctatgctcayagtaagttttttgaaggtaggcactttgtctgattttttttttttttttgagacggagtctcattctgttgcccaagctggagtgcaatggtttgataytggctcactgcaacctctgccttctggrttcaggcgattctcctgcctcagcctcctgagtagctgggattacaggcacccacccctatgcctggctaatttttgtatttttagtagagatggggtttcaccatgttggccatgctggtctcgaactcaacctcaagtgatccacctgcctcggactcccaaagtgctgggattacaggcgtgaccaactgtgcctggccttgtttgactctttatgtcaacacacagagcccaggacagtgcagctctgctctgccagtgtttgtctattaattacagttttttttattttttttttaatttttgcgacagagttttgctcttgttgcacaggctggagtgcaatggcgcgatctcggttcactgcaacctctgcctcctgggtttcagcaattctccagcctcagcctccggagtaactgggattataggtgctagctaccacacccccatgcccggctatgttttgtatttttagtagagatggggttttaccatgttggtcagggtggtcttgaactcctgacctcaggtgatccacctgtctcagcctcccaaagtgctgggattacaggcatgagccaccatgcctggctaattatagttttatatagcaatcattattattatcataaatactcaaataccttcagtgtatctagtaggcccactccttaatgaaagtacatgctaatattaaaaacattcaaatttaaagcagaaaaatatttggcattttgcaattcttcctactaagttaatttttttttttttggtagtgccttggcttaatctgtaatggtaaaaagtttttgtgtggcagacacgtgaagagaatgacaattggaactattctttttaaatgtaaatgtgtatttgtacattgaaaaatattgattttaagagatatagtagactcatattgcatgttcagagtattttatttattttgttcattgatacttgctttttgttcccaataacgacatggtgaggcttgaacttagacgtgagagctattttttatttcagtctyggctagaagagcaatctacctcagaaaatagaggcgaggagtcaggtgctttatgttcttcctctctgtaccctcatcctctgaagccaaagttacactccataaaaataacacagaatgtgagagctaatagagcctcagtttatccttctttrtatctccccctggaatgtcctgggcagtgccttatttcccatttgcaaatgtgaggacaatatgcaattaagagcttcaaccttgtcattggtttggtgttagtcaattaataactttctgtgaattattcaatagaaacaaaataaaagcatgtccaccctgtggaacctcaggacagaaacccagaggagcatttacttaataacaaaatgctaatacacatggagtttttgagttgtttcagagagaaaacttgcatgctgaagataatgraaatgtatatagttattgtattattctgttttcacactgctgatgaagacatacctgagactgggtaatttataaagaaaaagatgtttaatggacccacagttccacgtggccagggaggcttcacaatcatgtgagaaggtgaaaggcacatcttacatggcagcagacaagagagaaaatgagagccaagggaaaggagaaaccccttataaaaccatcagatctcatgagacttattcaccaccatgagagcagtatgggggaaaccacctctatgattcaattatctctcatcaggttcctcccacaatatctgggaattatgggagctacratttaagatgagtatgggagaggacacagccaaaccatatcagtcatgttagttttcygtctatcagctattctttttctttttttatttttccttttcactagtgtttgagttaggataattttgctataaatgaaatttcatcatttaaacagttctgccatgggagtgccagaaaatttataatacctcgtggctcctacccaataccctacaattaccattcagtgtgagttcttggtagatrtgtacataacacattttatattttgtagagtcaaataaaatacgtgtttcaaatattaagtctcaattttgcaataaggtattcaaccagttgtcattaggtcaacattcattgtgtatccacaaaatagatgaggagacaattacttatttttgtaaaatggtcacaaaagttgcacaaaataaaagcctccaaaaagctagatgttgagcaattatgatgatgcgtaggcaacattctaagctctagtggaggatgcaaaggtgaagacctaatctctttcttcagagatctcacaatcaagggaagaagataaaaaacaaaagcagatcattgaaaacacagtcctataagtgctgaactgagtatcctcttggtatagaaggacaaggccctgtactgacaggcaggagtcctgaggttaggctgtgtcctgctgttaactagctttgtgactatgtgaagtaactgaactagctttgtgactatgtgaagtcagtcaaattcccaggacatcattttctcaaggtgtagtgttaggtggatatgacctagataacctttatatttattttaatttctttgatttttttgcatttctgtgattccatatttaggtataggcaattaagagtatagataagaatgtataaagctataaataaaattaacacattacaaatcaataatattaagggtaaaagcaaaacgtaaattttatttttcctaaaaccacctgaaaaaatgcatattacatattacttttattcaaatgttcaacttatggtgtattttaataatataccatctctatgcagaatcactgtcaaattttccccttaagaatataatcttctctttgatatctagtgatttgagctaaaaataaatattgttaaaatcaatactaaataatgtggatagctgaaaatgaaaaaggaaatatcttgtgtgaatacatcttctgtgattttttccattacgtttacatattttatataatataattgcatatggcaattatttgattacataaattgtgccaagagcataattaagtataattatgaaaatatgaaaattatatgcataaagtggctaattaaaatttatttcaaggaatcgagaatattcagcaagaaaaaacacattaatgaaacattgtggttgtgataaaagcacacatactcgaatttactgttcaggactgattctctgattatttactgacaaaatgctggcacctttatatttatgtctttttaacatgatgatagaaatacgtactctgaccgtatttctactatgtagcttgcataaaatatggtcaatgaaaatttgcctggagtaaaatgatacttccttttggaactgcatttacacacacacacacacacacacacacacgcacacacacacaccccatgcctgttaaatgatagcattcataaatgttagactcataaagaacattaacaatctacttcaatatctgtattttataagtatggaaaaatgatgtcttaagaggttaaatgatttttttggtgtcatcccaacagttgcataattgggaccctcaatccttttctctttccaatattttatggtttttctctaaaatatgccactctaactgctgaggagaaaaagcaaaacaatttcattatcctataaaatatctaaatgtatacaattccgtattttaatataacaatcatttttataacagacattttatattgcattttcatgggcataaaaagaatatatatgtattttaggttttctatgtatattgggaagctatttaatttatctaagtctacataaaatatctaaaagctacatctatgttaatgagcactctataacagaatttgagtatgagacgttctattgcagtgtttgcaatgttgcaaaatagaaactttttttttatagataatgaaaccaaaataaattatttcagatcaagatagaaaatagggatgactagctagagtcaaatttcaagttaaggttagcctacaaaatataattatcagaataatttctttagtgtatgttaatatgatgtcctagctcattttgttttgctataacagaagcccacagaccaggtaatttatacagaaaagaaatttacttctgatagttctggaggatgggagaactaatatcaaggtgctgtcctctgatgagggccttcttactatgtcattacatgggaaggtggaaggggaggagagtacaagagaaggtgagcaagagggggcaaaatttacattgataacaaactcactctcatgataactaactaattcccatggtaactaaccaactcctgtgataacaacattaatcctttgttcagagctctcctgacctaatcccattttattaggccccacctcccaacactgttgcattggacattaagtttccaacacatgatctttgggaaacatattccaaccatagcatatgagctatctgcctattagatctatataatctaaaaacaataatggcatagaaaatcatacacattaatcacatacttgaataaccttaatatgactcatgaaataagtaaagcagcttatgatttggtaggattttggtagaaattgacacaaaataaacagaaaagctgttaattacctcaatgccatttctacatatgactgaattctgtgataaactatattttgttaggtgctatatgaattatgaaatatttcttaccaactatgtgagatgacccccgtttctgaagaaatcttctatgtccacaccagatcactaggaggtctcctcctagtgacacaattagacaccctrttgctaaatttcactctcaacttctgactaacatgcctgattgcttattcaacctccctacttgcttttccagtacatttctcaaaataaaatgctctaaagctgaacttcaaattagccctgcaaatcagctcaagccattcccatctcagaaactgaaaactctattcctccagttttggcccaaggacaaaargcctgtgagataattttcaacttatttcatcttctccagctcctcatcagcaaatcctgttggctcaatcttcaaatatatatggactttcactaattttcactacatctaccactacctccctagtaaaagccacaaatttgtctcttgcctggattattgcaaagcttcttagctactctccctgattttatccctgtcccatcccactgcagtctgaccatgccatatagcggatgattttttaaatagtaagtagaacatactactcctaagcttctgtattagtcagggttcttcagagaaacagaactaataggatgaatacatatattatatattgtattatatatatatatgtgtgtgcgtgtgtgtgtgtgtgtgtgtgtgtgtaaagaattggctcatgtgattatggaggctaatttacaagaactgcaggtgagtcagcaagatggagtcccaagaaagtcaatgatgtccttccagtctgagtccaaaggtttaagaacaagaaaaatggatgtgtcattgcagtctcaaggatggctggcttgcagctcaggcagagctgatgtttcagtttgagttcaaaggcaggagaaagctactgtctcaattcacaggtagtcaggaggcaaaagttttccttactttgggaaagggcagacttttgttatttaagccttcaactgattggatatggcccacccaccttagggaagtcaatctgctttatgcaatctaccaattcaaatattaatctcggccagtaacccaccttcacagaaatgctcagaatgatatttgatcaaacagctgggaaccattgttctaatcacattaacacgtaaaattaaccatgtcagctccaaacttctcgaatttcatcttttactactgtcctccactccttttctgctccagtaattctgtctttcttgcttctcattttttcccagcacactttggtcttcaaactttgttagcttttttctctctctagaatagtcttctctttgataatgaccttcttgctaccttcaagtctctgttccatatcccctccacaaacaggcctttgttgaccatcattctagagtagtatcccctgccctagtcactctctgtatctattaatgtatgttatttttattcatacctcatatttttatctgacatacagtaaatcctcacttaacatyrctgataagttcttagaaactgtaactttaggcagcatacatataatgaaagccaattttatcacaaagctaattgatataaacaggagttaagattttaagcatatttctggtcacaaaaacatcaccaaacttctttttgtttttttctttttgagacagtgtctcgctctgttgcccaggttggagtgcagtggcgtgatctcagctcactgcaacctccacatcctggcttcaagtgattctcctgcctcagcctcccgagcagctgggactacagcatgtgccaccacacctggctaatttttgtatttttaatagtgacggtttttcaccatatcagtctggctgatcttgaactcctgacctcaggtcataagccttccttggcctcccaaagtgctgggattacaggtgtgacccacagtggctggctaacatcaccaaacttctaaagaaataacccacaccacttctaatattaaacattgaaatgaatgtgagatatacatacatttaagaaatattaaagaaacaagtaagataattatttacccaaattttggtgaatcagtgagtgatggtggtcatagtggtgggttaaatcaaggaataattgtctgaaaagtgaaaattgtaagaagcacctcctaccaccacacagctcaaaaacaaacaacaaatatgatgggctcagtaagcacttttgtgccacatcatttattattgtagggttgtatgattatcacataatttatgaatttttacaatatgtatccatctatccattcattcatttactcatttttcaacctgcttattctagttcagggtctgagatggctggagtgtcacccagcagctcaggcacaaggcaggaagcagcccaggacaggaccccattccattacatgcagggctcactcacacacacccatgctcattcatacggggacagttttaatatgtcagtgaaccgaatgtgcacagctttgggatgtgggggaaactggtgtacccagagaaaacacatgcagacatgggcagaacgtgcaaactccacacagacagtggccccagtgggaagttccttatcaatgttgtaacaaaacaatgttgaccaagaacaatattattcaaggatctactgtaattcctatttgtttattgttgtttttaatgcaagttcttttagggcagtgactgcctttattcatcatagcaccctcagtattcatcatagtatcctaacacagtgtctaggacattttattgtatgaataactttaaaggaatcatttgtatatgaatgtttaagaagacatgactgcaatgaattccctgagaccacatttgcagggtatccctggcctcccccatgagagaggagaaggctattaagtgaaccaagaaagataattagaatctgatcattgagttcttccctgggctatgaggtgggccatttatccagcttgaatggtttctgtgaaagcaacagatagggtttacartgtggttacattgaggcatatatgagtttgaatatttacaraaaatttattggagaggaaagctggatagatgcaatcctagattgtgcctataaaaatttcatgtactctcagtgtaaacaaataatttatataaccacaacaggaaaggattagagacagtttaatggttgtgattgtcttatgtatagcaaatactgcaatggcatagatactcataaaaaggtgagggccgcttatacacaggaacagagaaacattgcttagaaaacacaagcacctgagtagacacctgtcaaaacaagagccatgagggagactgctgctagcattttaatacccccattacttctgcygactgtagaatttgccatctgtttgttatatttttgaatgaggttggtccttacaagtgctgtcaatatattaagatttaataaggaagtcccaaaatccaggcctccatgttggaaataaactttgatatttttgtaggtttttcgatgtttttacaaagaagcaagtaatttttcttcttcgctattagatttcaagagaaatggcatttcttgattttggcaagaaattctgccagattatttctaaagtccattcaaattgtaagaagtcaattcttttagattatctctaaagtgccttcaaattctttttattttattttattattattatacttaaagttttagggtacatgtgcacaatgtgcaggttagttacatatgtatacatgtgcaatgctggtgtgctgcacccattaactcatcatttagcattaggtatatctcctaatgctatccctcccccctccccccaccccacaacagtccccagagtgtgatgttccctttcctgtgtccatgtgttctcattgttcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcartaaacatacgtgtgcatgtgtctttatagcagcatgatttatagtcgtttgggtatatacccagtaatgggatggctgggtcamatggtatttccagttctagatccctgaggaatctccacactgacttccacaatggttgaactagtttacagtcccaccaacagtgtaaaagtgttcctatttctccacatcctctccagcacctgttgtttcctgacattttaatgattgccattctaactggtatgagatgatatctcattgtggttttgatttgcatttytctgatggccagtgatggtragcattttttcatgtgttttttggctgcataartgtcttcttttgagaagtgtctgttcatgtccttcgcccactttttgatggggttgtttgtttttttcttgtaaatttgtttgagttcattgtagattctcgatattagccttttgtcagatgagtaggttgtgaaaattttctcctaktttgtaggttgccttttcgaaagtgccttcaaattctaagaagctatgggtcctttgggattttcttaatacacactcctcagtctccatattcctcagcatacttcaacattccctattatacatttgaatacaaaagtgtttttctgtaaaattattattaaatttaacatcataacaatgattgatgcatcaccccacaaaatgttattgtaggactattgaaacatgaaataactttttaaaagatctctatatatggggtctagataaaatacaatctggaatgcagtttttcaaaatggttgaactcaaagcagagcataagaaataagcaaaatcagagctgaactgaaagaaattgaggcgtgaaaaaccatacaaaagatcaacaaatccaggagtttattactcgaaagaatagataacataggccactagctatactaataaagaaaaaagaraggatatccaactaaacacaagcagaactgacaaagggacattaccgctgaccccacagaartacaaaarctgcaaatacctctatgaacacaagctagaaaacctagaagaaacggataaatttttggaaacatagaaactcctaagattgaaccagggagaaactgaatccctgaacagatcaataatgacctccaaaattgaatcattaacaaaaagcctaccaaccagaaaaagcccaggaccagatgaattcacagckgaattgtacccactgtatgtataaaaaagcgggtactattcctactaaaactgttccaaaatattgaggagaggagaatcctctctaattcattctatgagaccagcctcatcctggtaccaaaacctggcagagacacaacaacaaaaaaacttaaagccaatatccttgatgaacatagatgcaaaaatcttcaacaaaatactaggaaaccaaacccaacaacaaatcaaaaagctattcgaccatgatcaagcaggcattatccctgggatgcaaggttggttcaacatatgcaaatcaataaatgtgattcatcacataaacagagataaagacaaataccacaaaatcatctcagtagatgcagaaaaggcttttgatacaatttaacatcttttcatgttaaaaatcctcaataaactaggcattggaggaacatacttcaaaataataacagcccaaaaaaaatctacagccaacgtcatactgaatgggcaaaagctagaagcatttcccttgaaaactggaacaagacaaggatgccctgtctcaccactcatactcaacatagtactgaaagttctagccagaccagtcaggcaagagcaagaaattaaagacattcaaatagaaagagaggaagtccaactatccctgtttgcagacaatatgattctatatctagaaaatcccacagtgtcttctcagaagcttcttgatctgataaacaacttcagcagtttcaggatacaaaatcaacgtacaaaaatcactaacattactatacgccaacaagagccaagctgagaggcaaatcaagaatgaaattttgaattagtagccacaaaacaataaaatacctaggaatacagaaaaccacagaggcgaaagatatctacaataagaattaaaaaacacttattaaagaaatcaaagatgacataagcaaatggaaaaacatcctatgctcatgaataggaagaatcaatattgttaaaatggtcatacttcccaaagcaatttacggatttaatgctattcctatcaaactaccaaaaacattcttcacagaattacaaaaaactattttaaagttcatgtggaacaaaaaaaaaaaattagtccaaatagccaaggcagtactaagcataaagaacaaagctggaggcatcacattacctgatttcaaattataccacaaggctgcagtaacctaaacagcatggtactggtacaaaaacggtcacatagactaatgaaacagaatagagagcccagaaataaggctgcacacctacaaccatttgatctttgacaaaatgaacaaaaacaagcaatgaggtaaggactcccttaataaattgtgctagaataactggctagccatatgcagaagattgaaactggaccctttccttataccatttacaaaaagcaactcaagacggattaagacttaaatggaaaacttaaaactacaaaaaccctggctgattacctaggaaatgccattctgaacatagtccctggcaaaaattttcatgacaaaaatgccaaaagcaattgcaacaaaataaaaaattgacaaatgggacctaattaaactaaagagcttctgcacagcaaaagaaactattgaaagagtaaacagacaacctgcaggataggagaaaatattttcaggctttgcatctgacaaaagtctaatattcagaatctataaggaacttaaacaaatttataagcagaaaacaaccccataaaacatgggcaaaggacatgaacagacacttttcaaaagaagacatacatgcagccaacaagcatatgaagaaatgctcgacattactaatcattagagaattgcaaatcaaaaccacaatgtcttaccatctcataccagtcagaatggctattatttaaaaagtaaaaaaataacagttactggtgaggctgtagggaaaagggaatacttatacactgctgatgagaatttagttgagtcactgtgggaagtagtttggtgatttctcaagaaactaaaaacagaattaccatttaatccaacaatctcattattggttatatacccaagggaatataaattgttctaccataaagacacatgcacacattgcagcactattcacaatagcaaagacgtggaatcaacctaaacgcccatcagtggcagactggataaagaaaatgtggtacatatacaacatggaatactatgcagtcataaaagaaaatatcatgtcctttgccacaacatggttggagctagagaccattattctaaacaaactaacacaggaacagaaaaccaaataccacacgttctcacttacaggtgggaactaaacattacagacatacggacagaatgaaggagacaacagacaccagggtgtactctagggtggagggtgaggatttagaacctacctatctggtactatgcttattatctgggtgacaaaatgatctgtacaccaaacycctgaarcatgcaatttattcacataacaaacctgcatgtgtaccactgaactcaaaataaaagttaaaaaaatgaaaacaggtggttgaccactactttgatattattgataatattattgataaggctraagacatgtgttactagtcttgcacttacccttgcatgtgttggttcatgatgttaatttttaggcatagctgattacttactataacccttaagaacatgatgtgaacctttagctcttttaatgcaagatagcttttgaaaaagaaaacaaggatcaaaatataaatattttaattattgctacatggtacctatcttatattgtttttcatcttgtcactttgatctaatggggaatggtaataatatgagtcagtgatattattcaccattcaataaacatkgatttggccttgattgtgttgggtcctgtttggtgctaaatgggtctttggacaaacaggagactakgacagagaaaggccatctagaaaagtgacattcactagtgtagcagagtgaaaataactcaagttatgatcataaaatatattttgctggacttattacacttatcatattaattgtaacaacttgtatctagagcaatagtagctctcagctttgggtatgcttgagaaatccttgggaatcttttataaagtactatgcccaggctccacggatagagatcttgatttaattgttctgtggtaaagcctagttatgccacgatttacaaagatcgctagataattttaatgggcagtcccagttgaaaacactagctaactctccaactgctttagtttccaaatagttcctagtttcagaaactgctaaccttgtggtactttccatagtgagtgtgataacttcttacagcactatctaaaacttttagcctrttattcaatataatattgacacaataatagctattatttattagacatctataatgtgccagacattgtgttwtaaaatgtgcatatatatattttttatctttacaaggaccttgcaagttatgtaatatttctagacattagaagagacttagaggttawgtaaagtactctrgtatactcagccagtatccagggccataattctaacttatatctgtctgagtccaatgcttccttccagaccgcactatcttcgtgttctcatgctatgtctctagatttaactataacttgctccactttacacatccaagcctatggacaaaaaaaaaaaatgacattttcttctttacccacacacatctaccacattcttacctgtcatttgcatacctgtcagtttgtgaaatgcccttgtcagtcaatttaatttactcttcttaaccattttttaaggtacagctcaaatgcagcctcaccaataaattcctcctggatcttcccagttggaggtaatggcttctccctctgaccttccaaaatatcttatctgcacctctcttaggtgcactcagcattttttacctcaccgttatttgtacatatatatatatgattaatacttttacttgtttgtcgaatcctagagatcatagttatgtctgattcatctttttattctgtataacacttcacatagtacctagttcattatcaaggcagaaacatatttgccaaaggaatagtatgcagtgaatgaagaaagcataaacaatttgattaagatcacctaacaaatctgtacctgggacaggaaaagaactcarttgcacatgtaatgtgagatattcttcaaaacatgcctatttttggaaatatctcaattttgtgtgaaataatttgatccctaaatgtgtcaactttttaaagggattttatggatggtttgattttatatgcaagccaaggaagtaagtgaccaataaataagaaatgagggcatttctctgttcctggtcatttactttagcaactggaaagagartagaaaagtgcatttacatgcgatggtgtgggatgatagcataatcrcaaatggttaaatagcggctttttatttagaatctctgcttttcacgtttatgcaaaacaattgcacattcagtgcattcaggatgcacttagcagatctacarcttgtaatcattaagggaacactaatgcaygtagcatacttagtagaaattatgtacttttctcaatatctagaagaaacaatgctcagatagcctctaatagcaaagcagagagaaaaataaaatgattgcttgggatgtccttggtggttcggcagaatttttttgtcttaacatttgtttagaaagtcattctgattaccacaaagagtgattttattctgtttgctttagatatcaccacttcgtacttattagagattacacagtccagtgagttttttctgaccaatgggttgttactttcaggtcacatctggcatgtagtatcttgctcattggtttgtgttaaaattataacactaaatattgtggtggaaaatttgttttaagttagtgttattgaatttatgacttttaagttgagtatgtgcttgcatgttctgggaatatatataacttgaacgtagaatgttccaattgactaattgcacataaaagagagttatctggaattaatttttcattttgcaaagcttaattaatttgtatttccttctcagaaattatagataagaactttctttttctctaacgggccrgataataaatattttagcctttgtgagccatayaytctctgctgcaagtactgcatggcatgaaaccagccatagacaatagataaatgaaagagcatggccatggttcaataaaactttatttatggacaataaaatttgcgttgcatayagtgctcctgtatcataaaatagtatatttttaagttttattcaactctttaaaaatgtgaaaaccatttctagctcatgaaccatacaaaaacaggtggcaggccagatttggccatatggtcagccagacatggtcaaacataattggctgacctctgtcttaawctctaactatagctctcaaagctgctttttattttcttaagagaattatgactagtggtgaatttttgaaatgttacaagggatgaggagttaaattaacaaaaacattactgctaatgcaatgcttcaaaaacccagtgtgaagttttttttaattcataaaaacaaattttaccaatagcaggagtgtcttttattttaaaaatgagatttttatgtaaacttatgttttacagtactactacaagtattggtaaattgaaatgatcaatttcactattgagtatatgtgttagaaaatatgccacagtatattctgcaagattaatacattttaacattcttcatgcrtctccccagtgtttagcttatattatgtcactgcaaaggagatgataccattyaaatattgctatcagttcatgaataacaatatttatccttttgagaatattcaaatttttgttcctgtacctattgccttttgaaagactagttcttggcatttatgttttattcttgaatatatttctgaacacaagtatatattgctttcttttagatttgtacttcacaaagacctaatagtctagcactaacctaataacaaatatttgtataatcacagattgtaccatattgagaaatatgaggggtgtcagagaaatgtccttccatcagattgtttatattcaagttgatatccatgtcagccattgaatttcagtaataacatatgatatcaagaaatagtagaaggtacctgtaccataaaataaaatattatcaagtaccatactttttgcatgaccatttgaattgagcttttttatcataatgttcaattgaaccatttaaaatgtaaatgagtaagtttgcaaggaatcatttgacctttatcgtgacactgtattcctgggctccaccttggcttggaacctcatcctcattcctcagccagttgtcaagccatacttcatcccattgttgtctttgattcagatttcaactgcccagttgatcaagcatggggtgatggtcaagcacggagtgagacttgagcagtcagtaaatgtatctattgyactcattaattggtgtattagtacgttcttgcactgctataaaaaataacggagactgggtaatttataaagaaaagaggtttaactggctcatagttctgcaggctgtacaggaaacatggcactggacatctgctcggcttctgataaggccatgggaagattacaatcatgacagaaggcaaaggggaagctggcatatcacatggcgtgtgtgtgtgtgtgtgtgtgtgtatgtgagagaaagagagagagaggtgggtggggatgccacacacttaaacagccagatctcatgagaactcactatcatgagtagagcaccacgcggatggtgctaaaccattcaggagaaaccatccccctgatccaaccacatcccaccaggccccacctccgatactggagattataattcgacatgagatttgggaggggacaaatatccaaatatctatctatatcacttgacaattttaaaaaacagcgtttttcaagtttgtgagtcctatgtggttgaatgccaaattactgggccaagtagtaacagctgtgatttcaaaggaagcagaaggaaggcttcaaggtaggtggatatggatgcattcaaagagtgatgggcatttctggtgagatgagtgaagaaaatctcagaagaaaggatgctcataaagtgtttggggaacagtgaatggatgagcctaacttcacagagaggagggctcagataggcaataatagtaggagaggaaatcagaaaggatcttccaagccaggttatcagtgaaggttgtctttgccagggtgagaggagtctgggctttctttcacggggcattaaatgtcatgcaaagtttttggtagagagggtgatgatgaaaacagggtataatagtttagaaaaataatttaaaacccctgaaatggccttagaaagtgtgatttaactgattgattgttgctacaatggcaatgtatttctgttcattaatctgaaggaaatatcatgctacatttggaggcagaagatagaactgttggattcagagacttggtcacctgaaactaaatgagaaagcaagatttatttttgcaatggtctgagctccttaaaataaggcaagcttgataagattttaattttcagcttttattttaattaagtgtgctttcttatatttcacatactctacccagcttgaaaaaaaatggttgtcttattatttaagaatagtagtcaaaatacaatggtattaagaaactgatcaartaaaaaaatcatataggatacactaccacacacaagcayactcctaaatctgaggccacacaacactatgcattggttaacaaaacacatcctagcatgattaaggcatatagaatagcaaagctttttgccctataaaagggttcattaaaatttagattttttaaaaaagaaaaactctccaactcttaaatttgaagagtaaaatgaaagctgttaattctatacgtgtctctccccaccttcacaatcttatgtgtcccataggcacgtagcagttaggaatgcaagtataaacatgctatcagatattgcttatcttcattaaatttcagattcaaaactgatactctgtgaaataagataaaaatttaaaacaacagggaaacaggagaggatcttaccagatttttcatttttatttattcttttaaaaataactttggacaacatttcttcccctatattgttgtttttcttctttatttcttgattaactctttagttagaatagtagctaaatgcattttgcatagtttaggaatgcggaycatgtgtaaatttttacattgactttccccatgtgtctggtttgatttatattactcagtgcaaaaaaacatgctctcatatcttcaaatttccatacacagcttttactcatggctatgtaagaatgttgaaagtaaaaaaatttaagctttcaaaagatttcaaaatctacattcaataaatcttagcagtcatattagtttcctagggctgtagtaacaaagtactacaagcttggtggcttaagacaacagctatcttttcctctgagtttggaggccggaagtctgaaattaaggtatctgtaggaccatgcttcttctgacagttctaggaaagaattcttccttgaccctcyctagcttctggtggcttccggctctgcctccgactttacatggccttmttctctgtttctgtatgtctctctgtttcctctcctctgcttatgagtaaactagtcactggatttaggacccactccaatccagtatgacctcatctagattcttactttgattgattaaagctacaacacactatttctgaataaagtcacattctaatgttccaggttgacatgaattttggggcacactattcaatctactataccagcttgaaaatttttgacaccttattcaaatttaccaaaaaggaaacaaacataagggaacaacaagaaaaaatttaaaagcacattaacgatttgactaccatattataggatttgctacaattttattgcttttcctaatttactatttcctgatggcttgtcagcctgattatttctcagttactggaaaaatttgcatatcttgaacaaacaactagactccaccaaagcattacaaaagaaattacggtttttgaccttttctccccttaaatgaggtgttccattacaaatgcgtctgctttttgacttcttcacttgaaggtatgtaaatgtgtaatgctaaaataaataaaaagaacagatggcaggaccttaaagatgaaattagttttgtatccatctggaatctggggatggcttcattatttccttctaattcgttcattctttcctcaattttctggcaggggattttatgcacagttgtgcaatctaagtatcttagggtaataataaaatatgattcagttatgaaagaaaacctgaaaataattctgtggaactctaacagcactgttgtcattatagttacatttggtggttttccagaattaatattgcagcatagatactcctcaaggacacacgaaaatatctatttggtgtccaaggtgtttcaacctacctactgttctgatatgttaaatttcaaatgtatcttcagcaagtactaaattactgtacattaactttaacaatgtcaacatgttctattttattagcctgatgtgaattctgtataagctcataaggtgaaatatattttatctgcaagaatttggtgtttgttttcacagcagcatttttaaaacaatatttaagggccactgggagagtttgggwtatttccattggtaataatgcaaagtggactttaaattaggtcatgtctctgattctgtatttctcatttttcacragtgaacataagaaacaatgggaatgtgcccttcactgtcagacaagtgggaggatccagcgccctctgtctcatatcactaaaaccrtgtacagagcctgactagatcattcctgtttcaaattaaaagatgcttataggcaaacttgaacttgcctgggcataaaattaggtttktggctcattaaattatgtgtaactatctcaaaaaatcttgcctatatatgatttccattttgttattaccccaaagaagaaccacagttccctattgaaaatcattcacctaagtctaaactctttcatttggcttttaaatatatctaccctaatctcatccatgataatccgctgctgtttctctcatttttaccatccagatcctctgccatgttcttctccacatatagcatgttcatcctacacatcactctcgtttcctaccctaatctcagcttgtgttgcctccttacctgggttttctctccatctatctcatctattataacatagctcaagtctctctctaagacatttattctcagctatctcagttttcaataaattacattatctattaattcctaatacattttagaattgataaaatagtatgtggaaaagtgtgacataatggctttattattctctaattgttttacatttatacccttaccaactcaaaataaaatttatacatgcaggacatatgtactgagcactttttrtatctcctacagaatctggtaccattttgcactaaggtaaataaataagaaaattttaaatatatttgttattagacccagcattactataaggatttcacatatcctaatatattcttcacagccaacttctgagatgagyattattttaatgatgaggaattgaagcacttgggtaaagcaattcaaaggaactcaaaagatcaaacaacaaaactaccattcaaatgcaaacggtttggctacaaaggctatacttttagcatttatatacctcaagatagtagatggtcattgagtatttagttgactgacataaattaagatattctctctatatattcaaaatatagttggtcaccatgttttctgtataattttatttctggcttcctgtcaatttggaatgatagatatagccctgaaaagacttccagrcaatgtggcagagtaagttcacaccatgacaagaatgctgtgtttcaaatatagaaaatagagtcatataaaaagaaaacacaaaaactcatygctgctttcaaaaatgaaataacatctctatggacttgaaatagaacataaacataaaatgtyaggcaagaccaaagtcatcaactagtggggcacacttctgcaagcagcctagaaactggctcccttgtggatgtagggaattaaaatatttcatgcaagatggaccactagattcaagctcactattcaaagtcaaaagctgctgtaagaatctgttgtttgtgaatgggggaaaacatgattttgaaagctgagtggggactactgcttattgtaaactgctagctctgagagaagaaaacttaccaatagggatttcagaccaggactacaacaaagccactccctggctctgtaactggatttataatattcctggtatcacctcaggacagatactacaaatggctatgacctgatttgagactgacaggctactgaaggttggattggaggaagctacaaggtaaaattccagaaatccattcctaaaaagagagtcacagtattaacacttgaaaacaaatttatttcttttttttcatagctatactgaggtataactgacaaatgaaatttgtgtatatatatatacacacacacacacacatatggtatataatgtgatgttttgatatatgtatatattgtgaaatgattgtacaatcaaacatatctatcccctcattttgtgtgtgtgtgtgtgtgtgtgtgtgtgtggtgagaacatttacaatctgttctcttagcaaatttcaagtatacaatatgttattattaactatagtcaccacgctatacattagatctccaaaacttatttatcttgcttaattgaaactttatgcccattgataagcaactgtacatttatttcccccatcccttagcccctggcaaccatcactatactctgcttctatgagtttgactttttagattttacgtataagtgagatcatgcaatatttgtgtttctgggtctggtttatttcatttagcataatgtccgccaggttcatctctgttgcaaaaggcaggatttccctttttttttgagacagagtctcgctctgtcacccaggctggagtgcagtggcacaatctcggctccctgcaacctccgcctcccgggttcaagcgattctcttgccttgacctcccgagtagctgggactataggcacatgccaccatgcccggctaaatttgtgtatttttagtagagacagggtttcaccatgttggccaggctggtcacaaacttctgagctcaagtaatctgccagcttcggcctcccaaagtgctgggattactgacgtgagccaccgcttacagccaggatttcctttcctaaggttgaataatattttattgtgtgtgtacacctatatacatacatatatgtgtgtgtgtgtgtgtgtgtgtgtgtgtatgtatatatatatcacctttttaggtttttatttatttatttatttatttatttatttatttatttatttatttttttgagacagagttttgctgttgttacccaggctggagtgcaatggcgcgatctcggctcaccgcaacctctccctcccgggttcaagcgattctcctgcctcagcctcctgagtagctgggattacaggcgcctgtcaccacgccaggctaattttgtatttttagtagagatggggtttctccatgttcgtcaggctggtctcgaactcscgacctcaggtgatccacctgcctcggcctcccaaagtgctgggattacgggcgtgagccaccgcacccagcctatatatcacatttttatktatcagttttagtccattaccatatctttgccaacacttggtatcttttgcctttttgacaatagccattctaacaggtgtgaggtgatatctgctgtgcatttccctgatgactagtgatgttcagcccctttcatgtacctgttgggcacgtttatgtcttctgtggagaaatgtcgattcaggttatattcagtgcatacctttgttctttctttcttctcattgcctagtatgccatcctttatttctccatgtcagtgcaaagtctacccatttctcaaagcctctttcatgtcttatttcctaaagaaagtgtgttctctattgttggtataatttgtattcttccttacaaattgtttgtgatctttagacttgcatggtttgtggtcctacaaaataaatgtaaatattatcttatacctttacttgttctcattccacccctttctataccacccaacatgttcttcctatttgaaaccaggtttattataaatgaaatatatcaattagaaggaaggacacttaaccattcaaaaagttagggccatagtagagggttatctttaaacaaatattgcaaacaagtgtttgtgagagaatatcaatttagtccctgttctactaccagagagggggctattgcattgtaaatcatcaactctgtcatgtaatgtaatgaaaagaaacagcatgaaaatattctcactgacacacatggtttgattcatgaaactattttttcataactcttagattactgactgactccttaatataaatctttctgaagattccacaaaggactagctaatcactgagtgaagaagagcctttacatgagccaaattcccaagatttaaacaagaaatattacatgtatgtaaaaaccagtgacataaagacagtaatttgcaagcaaggtccaaggaactctggggatttcatagaatgccatgaggttaagttgttttcccagccattaattttacaagtctcaccaatcaataggctactctgttagcaaataatgactaatgctaaacagaaacatgaaaaggatacactactttcactcaggtattgactaagaataaccaaggaatagamcataccctgtaattgaactgcctaatgaatattatttggaaaaaccataaactactcaaaaagaacaagagtagtcattcggatttaagaaagtgcctaattcttttaaacagtgcaatctaagggtacacagtaaattcttatttagaagaaatctaatctaattagaagaatttatgcctaaattcaaacagtagtacttggaaatattactagccagctatacaagcttggtattttccgacaagaggcaaaacagggctctctggatccagacatttatagctataatagagatattattgttctccaataaatgccctattgggcatcaattatttgtcaaacaaagaaataaaagaaactggttactcttcatcttccgttagtgaatatagaatattttaggttctgtttctgaatgaaaatgctgataaatactgcactccctttctcaccaaatcaacgttccaaaarcaattcatgaaatgagaaaggaatgaaaaaaattgcctgaagacccggatggttgaaaagaatgagaaataaaagggtcatgtccttctctgttagtaagtaatttctgattctgaagttaggcatttgaaaaacatgcccaaattctcttctcctttggtttttgtgattctgcctcatcaagatgctttccctactctgtcaagttcctctgttgtctctttcctagatgactttctattcccttatggtcacattctttctgcacatcctcagaagtctgctctttcccatcaaagaaatccatttcatagcttaatctcatcatctgtttgagtgatgattcacaaagtacagtgcacccctggtgtttatcaggcacatctcacattttctgtcccatcttttgctcctgattcttatacctggatgcctttacacatatgcaaatgctttccagttgttcatctcaaactttgcctgcttgttaaagaaatatgcagtttgcctttggagtgacaggggtctgggwttgaatcctaagaactactgatcccctgtgatcgtgagcccgtaaacccccctgagcttggttttctcatttataaagtgaagatgtcaggttttggaccctctttcaatcccttcatgagctactgtattgtattccttgctttctgtttctctgccaatctacatccacgtccttttgcttacacagggtattgattttccracctctgtctctgtctagrggagagagttctggaaaatccttttggtctgtttagtctgggagagaagtacctgtacactaagtgactctttgctctggatttgactagcccctctttcatgaggtcttgttttggtgcaccttattttagccaagcgcttcctggtttgagtcagccatatcaaaatctcttagggcaggcagtgctcagggagccataattcagtctcttcaacctcagtgttttcatccctttcatggaagggtcatcttctctttcccttctaggtttctgaagagttaaccctgaatataacaatttcccaaatttctgatgcccttagctataatgcaaaaattatacttagaataaaatcacaacagtgatcctactacatttcaaactgccagttaggcctacaaaccaccccttcctcattaatcacacatcacttcatatatttatgtatcaccatgcccacctgcagcccttagtcagcaaaaccaattaagttcttctctacttgctttgtggctacataaccacactgaccagtttagatttcagcgaattttaattttccccatcttactttcctcttgggttactggcattgattcatcatgtgattctgttctcttctacttctcaatacgaggcagttaatctttcagattggtttcttcctgattcttcatgcctatttcttattcctgcctttcgttgtttttcctttttgtagtaattcttttcatctgattgtgtctatatmttccattacaatactaatatattatttgaaaggttgatgtgtagattaagaaagtagcagctgggcatgatgtcttacacctgtaatcccagcactttgggaggctgaggcaggaggattgcttgagccctgaggttcaagaccagcctgggcaacatagagagactgcatctctccaaaaaaaaagaaaaaaagaaaaacgaatttagccaggtttggtgtgcgtgctgtggtcccaactacttgggaaactgagttgggaggattgcttgagccaagaagttgaggctgcagtgagcagcctctgcactccagccttagtgacagagtgagaccctgtatcaggaaaaaagaaaaaaagtagcacatgggaaattctttcctgccacagaggtatagtctttcctacctttgaccctcataaatcattttttcatatccattttatggcagttgttagtatactttatatttgtttgtgtaagtgcttaattgtgttttcaaaaaatgtattacccatacattatactagcccatttatgaacctagcacttgttagcccttagtgcatgattattgatttgaaatgctttattcactcattacatagagaatgctttgattcaacaaaatacttctatgaatggttgcatagacagacttaattcataagtccccctgttttgctgagccatccctctactctgggaaataagggttgactacctaatgctatttttattgtaatcttgacatttgaaaccaatgaccaatatatcaacattcttataatttatttaatgcagctactttttccaaaataagttcatttaacataagcattgtcartcatccatttgaatgaattggaaggaaagctaattaaattgatgaatacttgttttagttttaatccctttaagaatatataaaaactgcaactattrtaactcctcagacactgtgtagtggagttttaattaatagataaggatgatctctaattagctcatcaaaatactttaaacagtatcaaccctacatatactgcagttacaccgtttgtaagtaaatagacacttctaaagcacttaaagaccagtttgcattcttaggagagtagaggtgccctcaacctttttcattatgtggttaatttatttattcatgcttctcttcttttaatagggaaaacaaggaaaaaaagcaatctaacataagtttgattatctcagtcaacattctgacccattccaaatcagtatagttcaaattaatgtggtttcctgaatatatatcatagaacaggtaacatacatgattgtagaatgacaaaattagaaagaaaccttcctttcagatcagttattctaatcatctcattttacagatgaggaagaaattgatttactctatagttcctatggttagtcacgggctaagccatgcttctctttggctattcataagtcttaattctgtgctttgtggaaacaaacaagcaacaaaataggacagagagagagagagaacaaatatgaaattgaagatgtatcttaakttttaaaaaagagaacagccttgactattattttgatatacagaccttgggaaattctacattgaaagcaaataaattagaatttcgaattcatgtattgaatgaaaatagggtactgttattctgcaaaagatatgacacatcactttcaagacttctttcactcatccaaccttgactaggtttcattttgtttctctgattttacaaagtttcaggtacatcaggtgctgagaatacaaagcaaataaaatataggtgatatgatacaggtttrcaaagggtgtaaatgcagtactgaggaaggacttccaacctataccgaggggtgtgtgtgtgtgtgtgtgtgtgtgtgtgtgtgtgtgwgagagagagagagagagagagagagagagagagagagatggcttcttggaagaagaaatrcaggatctaagtccttaagttaagggtaagccagagtctgcctgacattatccataatgtgaaggaaataacagttgaaaaaatattccatctaattcagtcagtctactctgatctgggatcatttgccccttgttgggcagtgagggcttcttgcatttcagcatgaacaataatattgcagccagaatgtgttttaagtaattctccttagcttctcaagtgggcatcacctggcctattcgggattagtttttgaagccacataaaatctttcaaattcagataacttgagggattttcattaccagagctaattaatgggtgaagacctaccaccccaaatcagatacttcaaacatctaaatttcacagacaactatgaatgggcagtgtagattcctggttagagctgatatcatcaaaagtcctggatttcactaaggagtaaagtgtataaattattaagacagaaaaacatgatcttgtgtttatttatatgtggattatatctgcctgttataatttgttctctttttctgtccatatgtctctttattttgattttccagtttgtgtttttccgaatgttcttttctgagatgtttgaggatattaggagattgacatctgaatattcatcctaagtgctttcacatttcacactttttgctgtgtgaatatcatggaagagttgtctatgtataattttctggggacattaagtactattttggattccagactagatagaacagataaaaatttttattattatgaagtttttgtgtctwtttgctttgataagagatttattggattgtatttcactaggttgcatggttagtaattctgtatacttttatgccttctctgtaaggtactcatattcatgtcatatgtcagctaagaactagaatttttgccatcctgtttttcattttctaggttatgatctttctttggtcacatttctgacagctaccccttctctcctttccaatcaccagtataaacccatagctcaaacatcatcaagtaggtaatcagcagtggtcactgacaaatgtcacagaataaagagaatcagatttgaaaggctcagctctaaaaagcaaaccaaggttcagcyactcatttaaaaccttctgtggccctttggcattatcacagaccattctatttgatactttcacaactttcaactattttaaatatcaaacttctctgttctttcagaacttactcttgattctgttttttttttataagtatgaatgtattggcatacatcgataacatagggtacaaaagtcttcgccaaagagaaacagaagggagaatgaaatagtgataggctttggggctacccaaggacttagagatcatcctgtccaacttcttataagcaccagcctgaaatagttcagtgattagtctgaggtaatagattagttactttttcctgctggttccagaatacagacttgcattttgctcagtgtttattcagcgaagtcttagtgcttctacatcaatgcattcaatgtaacaaaaatgtattaagtaggttctatgcaccaggaattgataatacagcagtgtaaaacacagcagctcagcacatttcctctcctagagaaccgtaaaggctagtcctgggggcaggtgggcaaatgtattatacatatgctgtccaagcctatgatagttatctctaactgatgaaggcattttatttatttatttatttgctgaatttagacktggcttcaccatcttccccaacatagctcttcaggcatccactatttatctttcagaattgtcaagtacattaaaacctatttatcatcaaagcactaatagttttcttaaagaattagcttctagaagacaaaataatgtaacagtagtactaataatagataacatttattattgttgtaggttctaaacacataattactgaagcaaaattgtttatacatgaatcatctaacattacctcagtgtgttctgaactgtggaaaacatggctttctatgatatccactgttgtgagtgctcctctgtaattgattaatggtctcactccctctccctagtctgtggttcttggcctgcttcctattctattaaatcatgcatcacaaaagactgcaacttttgagttttatcctagaatcataaacaaaccactcaggccttatttgcttgatagtttcttttgaaaaatgccttattgccctaggtgatgcagtgaatgagggagaagacgaataatgaagactcttcagatttagacctgtaccgtcactggggtttgaaatgagagaaaggaggaactcaggtgggtttgaaagctatgaatatggaagaatctgtagacagagacatggacaagtggcggcagagaattagggatatttatagtccttgatgactgtgcaatggtatgtacatggcatataataatatatatcttggaattcggttactatatgtcctcagtgggaccaccaaaaaagctaagttcttgggacataccttttcctaaatctttggaaaaggagagaaagagagaggcagaacaaatggaagcttaatgtgggctgctgacaggaaacccattttgcaaaactgcttcttcttgaatggcaattgaatcaactcactgttatcaagctttaagtgagtgrgtccttgcagttgccaaaattgaataggaaatgctttaattttgttctggctgtggtccaacaacaagagagacttctcaagtgtggaattacggagctgtgctgaatgactccaagtgaactctctgtaggttaagctcttcaggaaggggtcactgcttggtgatggcaagttggtgaaagggctggctgaaagcttgggaaatctggtgctggtaaacgatacatggacatgttatctttgtcccctagtaccagatgaaaatgtgggtcaacagtaactactttaattagtatgtagagaaaattgttgttcaaatggagtgtcacattatcttttgccaaaaggcttgtgatggttattctgttgttcgtagtggtgaaactttctgatgttgcttattcgataataatactggctgggattcaaggtaaggagactctcttgataagtaaatttaaggcaagagaatgtcttaaaggcaactgttttgctgatccactttttttttctctgcacattgatcaggaatttttttaccttcacaaagcaagtaagacctgaagcagatttcacttttacagtcaccttttgattattcaaaggctagttatccagtgtatgagtaaggattctgaccagaatttctgacaagactggatgattggccagttgtggcagcattaattgcattaaaaaaatgatacgtgggggtaaggaagatgtcatgatttcaccgaggcaacacagaagtttttacagaatacatagaattttatgcagaatagtttagtagaggttcaaatggaaaggaaagaggaatctgtttttttcctttcatcttttcttattggaacttatttaaaatttctgagtgtttcactctaagagcatgcattccatatttaaaaaggaactgggttattygctacatgccacatagtgggtttgtcacatttgatatctgaactcttcctcagatggaatcacttatattttactttaggagccccactgcaggactcgcctggtaatacagcttttatattttgccatttacttttatggtatcccgttttctagtggacagtctgctgccgaaaccattctcaaatcaagttctgagtgttggatactcaggataatggagctccatttggggaaatttactatgagttttattgtgagaaatggatcttcacatgactctcctgctaaagagtcagtgactcaccaaacaaggaagcagaattaagatggggcatctgtttgactcagcaaattcctactttcaggggactgtggaatttaaacagtgtgatgctgcaggttttgcacgtatcaagtccagagaaatgtggagtggctacagagctgcactggagctggctagcaaacatggactgtgtacacctctacctaactctcagctcagtgacatcatgttgtagcttaatatagatcatggttgaaatatttgctacagaattggcaaatgctacaaatcattgactactttttgttttcttcctggaaagccagttattaaacattyaccagcacaccagtggtccagtacctaaaaaattaatttaattgttttttttttctctagtacaggtgttgtcaaaatgtggtccttagatcagcagtatcagcatcacctaggagcttgttagaaatgcaaattatctggccccacccsctagcctactaaatcaccctcttggggtgggtctcaggattcccctttaacaagccctccctcctaggtgaatttgatgtatgctaaaatatgataatcactgctctaagaaagagctaggwgattgagggaggagaaactatgtttaattaactgtatcatgaccataattgaatgattaattacctcatacctgtcccattgtacttattaagctttcagagatacttcctccacagattgctaattatagcacccacagygggtggtggtgggggtgtgtcaaaagtatcacttccagggttcatagcagatggaaacacaccattcatcatccagtattaactttcttcatctgaaggcactgccaaagggcaagtgatatcagtaaatatgataacaggactactatatttttagctggcctaagagtcagaatcccctagagggtttgctaaactattgattgctgggcccsaggcctaaagtttcccattccttgggtctgactggggcctgagaatttgcatttctaaacaagttcccaggtgatgatcatgctgctggtccaggcgccacccttgaagacattgctctagaacatcttttgaattatctgctttggtgtgaattcagcttctcagctttttgttctctcttattacatttatcttgactgtaatttttctttaaggagggtacaggtcacatcatatagggcatgatttttaatgtgcaggaacctgctgagccctccatttactgtcaagaaattattcagagtcatactgcactttgtcatttgtcttccttgtcttactaagtttttacaggcttagtactttgctattgtgtcagatgaaactcagatgcttcctcactgcagtgtctatggccttatgattcatacctttaactgccatcagataattcaccaggttgaacagggtgtttccccttttctttgaatagaatttacttattttctttgaataggataacttaatgcacctgagttgcatctttgtcttattgtactctccacaacagaataagagctctttctagtgcatgaaaagcacagtttaaagtgtttagtggtttgaactgtggtctagggtgaaaagatttaaaagattttcacgagagctctagcaggccttgcatgccttgttgagctcaatcgggaaatctacaacttttttcatgaacgcttagaatgcagcatttgaatatgagtggttcatgctgttgactgtttcatttcttaaagtcatatcttcaaataacttgtgttctccgctaaattggattgcagagattttagattaagaccactcagtgactcaatagttgtgtaaccttgggtaggtcactgaatttgctgtatctcacttttctcatctataaaatggaaatgatggcatctgtactgtttatttcatataactattgtgaggatcacaatgatatctatgaaagtattttgtcaattctaaaatcctgtgtaactgtgaagtgttattgttaatgccccttgtaatactcagcacagtcaggatacacagtggacccttaggacgtaatatcttgcacatgtatgtgtgtagcagggtgtcttttatagatctgtgaaagccaacactcaaaacagcatctrattatctacttaatagctaacctgacaattgtatgtgagtacacataataggtacaaaagctggctattagctcgactgtagaaggcaggaaaagtgggggattggctgcagcccttaaaacctgtattggcattctctatctaggaaccagggagacataccaaggagctgagtgtgtcattgaaagaacatgggaacaatacaccctattgttggtctttgataaggtaccttcccaataacattttggcaagacaactaggctctttttcttgacagtaaaggcctacttactgggacaaagggcaggatgggtaaaagcttcttaggtattcaaaatagaaaaatagcaagctggtgtgtgtgtgtgtttacaatacttgaaacaggattcgtgaaatcctattagtccatcttgagaaaacacatggaagaggagcctttctctccctgttgggctctcttggtgttcagaaaattggatatgtagttcacttgagattttgtagtacagtactgaaactcatctcagtcatgtatttgacagctacctacactatccagatgaaataacataaaagtgttggagcaagtgtctaggaacacactacttcaatacgtattagcttgttgatggtgagtaagtcaatgarcttctctgaaacttagtttcctaatctacaaaacagaaataataaaccctgacttgtttactttctctgagtttcagatgaaataatgtgcataaaatactttgtcaactaaaaaacctcctagaaatgtaatattttgtttttaaatgcttattctataaggatttgcacgtagtcagtgcaattatgcttattatagagatataaacaagatagaaaaatgtggattggatgaaaaaatctttaggtggattcaatgcctactgaacagtcaatgaagtaggtcttgattcatgcattaagcctcctggcagactggctagcagcagctctgctctccctattcagtgtcctcactgtgacctgaatgaagacacacaagtcatgctctttagattcttcaatgattcagacctcagaggactacctagcaacatgaatggcagatccaaaattcaatttgatcttaaaaggcagaaacaatgatctgaaagcaccaagataaaatataacatggatataaataaaattcttcttttagagtaaaaataatctatcgcacaaattcaggaagggggtgaactgccttggaggaagttgatatgagaccatctggggtttttaggtgtctacaagctcaaatagaatgtgatgcatttgctttgaagaaaaaaaatttctgaatagaaaaatatggctgcttcctccagtgatctagtgctcagaaatctagctactgagttaggggattagagctctggtcctcactctgccaatgtctcackgtgtcaccttgctagggtcatttaatgtctcttagcttcagtttttctgacctttaaaatgagaagtttaggctgagttatttctggattgctactagctagaagaatctgtgactttgagttgggtcataaaaaaaccttttcttyttccttttttttttttgaaaattgatatatccacaactagtaggaagacaaactgattacaggagaataattgagaactaaaattataacgtgtatatctttttattttctcagtgattgtggcattaatttaattttgttggcttagtaaatggcctcctcaaaaacaatatatttttcaacttatttttcttaactggtgtgccttaagaactttttccggaacttcaaattttcccgtaactttcaggtacaaatcccagcagggtccatctggctcactttccttctaagacagataaattgagctgtgtgtgcttttacagtgcgtgatcttagatatctacatgagactttcaaaaattaaggccctgtctactgcttatagatatatacagggtctcagacctctctttgtaagaataacaatttatcatcaaaactatagagtcattttttctgcmaaaatgagtgtagtttcttcccaacttatagaaatattatgtctttgatatgaactttaattgagcagtgaattacttagtggtttgcagtgcttctgggtgttagaatgtgctgggtttttcaggatgagtggctgtgtacgtaggtattttgttcagtgtttcagagcacctgaccaaattcattcctttccttatgctatttgttgataaaggatttgctctatattccatacaattgaattccttgtcttctttaatctgcttgccttatcctcattagtttttgaaagcttgaactatgtcttaaattgaatgaattaatcagaatatctcatccctgaagatatcagataaaagagaattcatcatattaaagacattgtgctggaaaaatagtggattgttttcatgcttctctcccttcttccctctttccctttcctctctcctctgctttcctgcatctcatgctccttccccttttttttgtttcttctctgcacaactctttattgaattgctactgtgtgctaggtaggctgaggatttactgtctagtaaaatatccgctgctttcatggtgcttatagtctaggagaggaatcaaaccagtaaacaattgaagtgccaactggtagagagacagctcagtaatgaaagccagagaaagcatcccagaaaagatttcaaacctgagaggtaagggtggattaaaagttagtggagtgaaagcttggattgggcataggaaatgttctagacagagagcaagcgtatggtaaagtcttgagatgggaaaaagcatagcacaattaagaaatttgaaaagtcagaacgagtgaagcctggcacacaagggaagatgggccagaaatgggattgaaggatcacaagcttacaaaggccttactgcttatggatccaaagagcatcagagaatcactggggagtttaaagaaataaaataacatgatcaggttttcattttaaaaagaccattgtttttcctgcagattagagacttatttggaaggacataagattgattattgtagtagtccaggtgaaagaggatgatggtgatgcattggatcaggggagtattgaagaggctatttcatgggagtaaagctttggaatcattctttgtttcattttcaggtaactgtctttaaagctgtcatttaaaaacatataaaacaaaaattcttttttttcccttttttatgactttttgaggacataaaggttgcttaaagaagaaattagtaggccaggcgcggtggctcacgcctgtaatcccagcactttgggaggccgaggcaggcggatcacgaggtcaggagatagagaccatcctggctaacacggtgaaaccctgtctctactaaaaatacaaaaaattagccgggcgtgatggcgggcgcctgtagtcccagctactcgggaggctgaggcaggagaatggcgggaacccaggaggcggagcttgcggtgagccgagatcgcaccactgcactccagcctgggcaacagagctagactccgtctcaaaaaggaaaaacaaaaaaaaaaagagaaattagtagttgtgaggggttgaggtgtttagaatagaattctccatgctgcattggtttatgctgaagaaggagcacgagtagaagcagagtgggagctctgaatttaaaccccagttttgctagtaatgagctctgggactacaggtaaataacttaacctctgtcggtacttctttcaattctaatcttctaagattctatgagtgctcctgtaagaaaactctaggaaagaaaaaccttcaggtatttgtttgcattttaaatatcttaatactgttttaatccttattggtacacatatttaaattctagattcaacaagtgagaagctttgctaacagtatcgtaaatcagaaactacaaaagtattaatctggtattagaaatcaggctgtttttctatcttgcatacctgcttatagacatgagagattttgaggtctgtgaaatataagccagagaaacttaacctttgagaatggaaatctttagtggtgagacatgaggttaacacatagagtggtttccaaacttgggtccactagtagtgcccatttggtcacataaaaatcccctgtgggagggcgcctgtggtcccagctactctggaggctgaggcaggagaatggcgtgaacccgggaggcggagcttgcagggagccgagatcgcaccactgcactccagcctgggggacagagctagactccgtctcaacaacaacaacaacaacaacaacaacaaatcccctggggagcttgttaaaaatacacctccctggcctatcctcatagtttctgatcagtaggtggtggtgtaaggctaataggaatgggtgctgtagtctaaggcagtgtttcccaaagtgtggttcatgaaattgcactagtccttttttttttttttccaaaatgttaattgaaaaagtgtttagaggtaaaatatatttgagaaacactgtataatataatgtcttttttttttttgagacagagtctcactccatcacccaggctgaagtgcagtggtgtgaccttggctccctgcaacctctgcctcccgggtttaagcaattcttgtgcctcagcctccacagtagctgggattacaggtgtgtgccaccatggccggctaatttttgtacttttagtaaagagagatggggttttgccatgttggtcaggctggtctcactcctgacctaaagtgatctgcccacctcagcctcccaaagtgctggcattacaggtatgagccaccgcacccagcctataatgtcttttatagattaatgtattcgcatattacaaattctaagatatcctacatgaaagaaagagttaaactttattcctgtgttcctctgactcatttggccctgaaccacttttactggagtatctattaacagcccttagaacttgctttccataaagggagtttacaaggtgttgtaccagagacattttttctagctattgacatggagtggcccaaggatatccttcctttattgtttaagcaaagacacacctttgtggaattactgagggaacacagataaatactttggatgcaaaataggcaggtttattttgtcaacaagctacctggctgtcatgtgggttgtgtgtattgcattacatgcctcttcacatttactctacgtgaatggcacctccatacagctgtgcagtcatagtatgcaatctggcaagccctctgtggctgctctgtctgacctgtatgggggctgaccctgtaactctggtttcactagaatcagaaatcaatcttgtgaattatcttgggcagaytatgactctccaagtggtaggtccctaataatttgtctggaatagtgcagtaaaaaatagttgggttttaataaaatgatgaagctgtttccataagcaatacactaacacttaagcgttttaaaataagtgtatctttatttgctgtcctcagaagaagctgatattcatcattagatataccattggccaaaatgtggttccttcatcatttaccaacaatttcttaataaccacgtggcaagcaacatactgggcactggggaagcaaaggaaaaaagaatggtttctgcttttcaagtagaacagtttaagggaaattgccacgtacacagatggttataatacattgtggtaatagttaccatggaggtaagtgcaaggggcaattggagcataaagaataaagtacttaagttggcctaggggaattaggaaagatttcacagaaaaaactagtttggtttagtctggcttctgatttttcttctgaaaccctatgctgagtctgctattcagttaccaggagatagtctagattttgctgccttgcatatgctcacgtgcttttccaaaataaattgtgtttatgtaataatttttaccttttctcctcactcatcatttccatcttgatattcctttgaattatacccctcacaatagtgttagtttcagctgagtgttcacatttctggtacaagctaatagaatttttcatttgcttttgctttgcagatgttgaacacatggctcttaagcatggcattattcttataaggatgacaggcttcaaacattttgattagtacctcaattttacccacttctccattttgaagtcagcctgtgttttatatcatctcggtttcatctcttacaaagctctagtattcagaaaggcaatttctttctccacttttatgtctaccaagttactgtgagacttttagaaaggttttatagcttttactttcagaaatggaatactttacttaatttttcaaagagctcaaagacatacacctgtattgggaataaatacacattgcctgtttgcaatatcttgcatccatgtagcattttgtagtttgtattttacctgcatcatttttatgtaactctcacaatgccatttgaaatatgaggaaactggatcttagtgaggtttagtgagttattccagataatataactagtcatggttgagtcagtgacagaaccatgactcaaacagactctggtttccaattacgagactttttccactatattgcatagcaggacaatattactatgtgctgggtataaagggaagctgaatatgaagaagtagagtgtttggtaaggcaaaatcagaaattgaaagtatcattgttaatgatttgagtggaagagattgtgcagggcatgagagaaagcaagcaaattaataaacatgtctaatatgggaggtaagtatggtaaaggagggcaagaaggtggagctgatttggtgtttgatgaagcagcatcatagccagcaggacaagttaaaacaaaaggagtaaaaattgcaaaagaacacaagtcagcagtggaggaaaagaaagggggcttctgaatgcgggatggacgtggatagaaagctggccaaggagactgagactagtagatagcctgcagctggagcctgtgccaccttcattctgaggttgtggtctcttatgcaccagttctccatagccaaggttgatgctgcaggtgctggtcaaggagaaatgttcagtaaagatatagtcaatttttggaaaatcataagtaacttggtacagtacagccacacaagtcatgtcactgtctccagatgaaagagccaggctggaggctgggagtgggacagtaattggaaagtggttgaagggtttaggttaagtttatttaggtttctgtgaaaagccagataaaatgactactccatgacatataattggcattataccgtaagcagtgatctaatgtgttcattttctaaaactgcaatcactttgaagttaccaggatacaatcacagtgagagacagtttttcagtttttagtagattaatgagctaaaatatatatctcaaactacttaaaatcagagaatactcatactatttctcaagtactcatgtaatagttcaaacattaaatttgtttggagcttacttttggcttaaacctcagaaaataacacaaatctctattatcttacagtaattataataaataaatgtgtaaataaataataaattagaaaacaaacattctaggctgggcaacatggcaaacccccatccctattaaaatacacaaattagccagacgtgatggtgtgagcctgtagtcccagctactcaggaggctgaagtgaaaggatcacttgagcttgggaggttgaggctgcagtgaactgtgatcctaccactgcactctagcctgggcgacagggcaagaccatgtcgtaaacaaataaaaaaacacaaacaaaccraacattcaattacatagacatgtttagcaggtttattgctctaccattgacacagggtaaattgcacatactaaatgggtacaattttcgtaagattgacatatgtctrtcaaaaagaactgacaacaccatcaagaaacatactgaacacccctaaattttcctagtgcccttttgtaaccccttccttttgaaggagcaaatgaaagttcctttcactcctcccctaaaaatccattctaaatgacacttggataagaaggaattaggttgaccactataagcaattttatatatacatgttgaactaaaaaagtagacagtaggaattcagagaaggaagatttcaggagaatacaggagtgttttgaaacaattcttagggcctggggagcttgaattcaatctggaacaggcagaatgatttgggagagcattttggctttggggtaagggatgacaaagcgaagccagaaatgagggctccacaatcctgggacagtgagatgacttctttgacccraacagaggcagtgttctgatgacctgtagaaaaaaaagtttggctagcttgtggaagatcttaaatgaggctgagtgtaggtttaagataaaaaggaacaattgaagacttttgtttttaactacggaaagtgatttaattcattcatttattcattcattcaaaaggctaggtgcggtggttcatgcctatagtctcagcactttgggaggctgaggcgggtagatcacttgaggtcaggagttcgagaccagcctggccaacataaagcaaaactccatctctactaaaaataccaaaattagccgggtgtggtggcrcacagctataatcccagctacttgggaggctgaggcaggagaattgcttgaacccggaaggaggaggttgcagtgagctgagattgcaccaccacactccagcctgggcgacagagcacgactccatctcaaaaaaaawawatatatatatatgtatatatacatttttatttatataatatatattgtcatttatataaatatatatatcttaaaatatatatgtatttttaaaaaatatatgctattttacactatatgtcaagcattgttctaagtgcttatgaatgtgcttttaatatgtggccatttgtaagggcacactctggcctgtgtgtgagtgtgtgtgtaatttgtttttctaaataattttttttttttgaaaatttagatttacagaaaagttgcaggaatcttacaaagagttcttgtatacatttcacccagtttcccctattgttaacatctgatataactatggtaaatttgtcaaaattaagaaactggcattagcacattaatgttaaccaaactccacacttcatttggattttcttagtctttacctaatgccccttttctgtcccaggatcccgttatgggatttagtcaccacgtctccttaggttctttagacggcgatgacttctcaggctgtccttgtttttgatgaccttgatggttttgaagagtactggttaggtattttatagaacgtctttcaatttgggtttgtctgatgtttcccacatactgtctgcttttgaagaaacaaatggaagttccatccacaatttaaaagaaaaggtcattttattaattttatgcttggattatatagatctttaatcttttctgaacagtaagcctcatattcccctcaaatcatgttcaaggtacctatttccttacctattcattttgggtatcatacttaaccatttcagcctaccagggtttcctgtaaagaagtgctttcttttaaatgagtagagatttgaatgaccaattccaggaaatccttctgagatagccatcattcagtcacctgtgtacttattgcttcaataacagaggctaaaatgcttagctgtatcctagtccgtgacttgaatcagcacatggctttgcttgaatgttttataagtttctagctgctatatcacagattagtgcactggaatgacaaagtacagtcttagccgacacaggccactgtgccattttcttatatactctcaaaccctctcatgaattraaacacctaaagttgagcaaagacatgctgaatagaaccccatacatagtttctttaacatgacatttcttaaccattaagaaatggactctggcccactctctaggaaaaaaaaaaaaagagtatggcatatttatagggttcttctttctttgagacaaatgaaagaacattcacattttttcctttcttttccctttctatctgttacataaatttgaattcaatctgagctttaagacccttggagggaatatggtaactctccaatattttacccgtggatggtgtatgcttaggtttgattctggcccctctggttattagcagtgtgtcattgagtctgtcagttagcctgtcctaagccttgctattttgatccataaatttaggtaataatatctacttcctaaattcaatttgagaatcaattgggataaagcatataaagtgtccagcgcagtgtctagcacaaaactcactcaataaacattaactattgttattattgttatttttaatacttagtatgataaactaattaagaaaaaactggatgcattggccatgattctaataacagcagctgatgtttccgactctcctcactgccttgcatcctgctcagacattcctatgctcagtgtctccctgctccagcctccagctgcctgaccactagcccatcacaactctacattcatcctccttgtagaagaagaatggctgcttccacagttagtaaataggaaataattgtttaagaaatttttttttaattcacataaaacatctgtttgagttaggaaattaataacaaaaggattttgcattcagaattttgtcttggtgatgacatggaatttatgaacaaataaaattttaaagaatttcaggttttgttttactttctaaagaaaccagcttgagttaatgtctaccattggcattctctcagagtcactgctcagttctcaccaccagctaggaatgtggacaagytgttaatatatggattttccagactcctaaacacagttctgcattagttggaggctctgagagactggtctgggactgtgctactaccagaattgttgcaggccccctgccaggactcacaaatcccagctttgcagggtggtaattgtagttgtcttctcagtatgccgtaccatagagcctttcttgttctgtctgttacttcctcaattaaaaaacatagctttctttgtgctggcctgtggatcagatgtttcagagcagcaggaagaagataatcttacacctaaaaaaatgtaaaggttccttacttactgaatcaatcagcagcacctgctctgcccagycaaagtagcagtttcattcctggcaggtcttactagcagagggatagttcaagaatccttatccacaagtatttgtttgttctcttyccctttctctccataagaagtaaaagcagtaactttctttaataggatctgtgccctttcgttaaaaatagtgaagactgataatagtctactattgaaagtgtttaattacaggttactggaagtgtcgccagaactttatttcacatggcattgcagaattctaggacacataagtggtataacagagttttagaaagctgataatatgtataggagaatgggtgtrcttcattaattgtacttgtaaatattgaaaattaatgggtttccaaagaaaatattcctctgaaagtatccagaaaatcaggaatagtggttagtcacaactcttgtgccaatcctgattgatcagtagcggctccctgggacactgtgatgaggattctgaaggcccgttctaactccagttaagaatgccatgatcgattaacaatgcttgccgtggtcatggaacaaggaaatgacatcttatatattaaatatttgtcatccgtagaatcaccatttatgctaggccaaagcatgatgctataattatttatattgctaaaatatataatataaacatattacatactttatatattatatattgacataaatataaacktaatatttatgcataaattttacatataatatatgtaattttatataacataattatatactttatataatgtaaacartaatatattaataatgatgttgttaattacatagtatggaaaatttaaacagtgtgcttcaaaaaatattcaggacaaaatttaaattacagaaacaaatactctgctcatttatttgttcagccacaacttgtttagcaacttctgtgtgctccagtgctgtggatctagagctaaataaattcttgtgtctgtcttgaaggtgctttggttgactagagcaaatggtgtggaaaccgttgcaaagacttaataaatacgatgataaaagcgcatactagcagactgagtgttcacagaaaagaagaagcaattaaccctgtataagttcatgaggwatcttcaaagaggtgacaacatggtgtcattcctgtctctagaaataatgctaaacatttaggaatcatttgctcttatgactcaaaacaaccctgttgaaaatggatagtrctcttttgtatgtaataaagatcagtgggttaggttgctgctggttttctattattgcaaattgattcccctgtgaattttcagctgtggtgaattcttgaatacctggattcctcagtttatatctttcctaccacttttttcacatcaactcctattaaattccactgcttgttttatattgatctccgttgtccaaactgttatactcactgagatatttatagccagaatatgcccataaagacaagggacctgctggcaaagcattatacatttggaaataatttgacataccataccttgtatgggcttctgggttttcaaattggttaaactgtcaaatctatatctttctttgctttaaaatgtcaagcatatctaattacaatttttttcaaatacgtcataatcacaaaatttacaaggaaactatgtgcatgaatagacttagatgtttgtgtattgttgtctatggatatgagtacacatatgtacacaggtttaaatttgcttcaggtatatccataattaaatctctctaagaaatcacgtatgctgataatattttaaaacatgttgtagtggatggagactgactaataagttaatgatgatggaactgaggcaaaatataaaggggtgttttgtaaggaagactaacacttttgtatataccagagggagcttttgtccaatatttgaatttttatttttaagacttattatttctagaagactttttgtatataaattaaccttattttggtcataatcagaagttataaactagttttataaattttaaccacagattatgattttttctgattgtagaagtaatttaaaaatttgaaataggaaaccataccatagaaagtagaaaccactcatgatcccgtcaccaatatacaactaacatggacaattttttttttttttttttactttcacttcctttttggagtatgttaccatatacttttctctcagtcttttcagccattcagcaaatatttattaagcacctcataatgtccatgacatatgtatatatctgtgtatgtgtacatgcttgtcatttatttttacttgagctgtaattcatataccataaaattcatcacattaaattgtataattcagtagtttttaatatattcacaaaattgtgcagctatgatcattatctaatactagtatattttcgtcacctcaaaaaaaaaccctttaatcgttaccagtcacttcaatttcttaccctcacccccagcagccactaatccactttctgtactttataggtttgcctattctgggcatttctgtaaatagaaaacatagcttttgtgaccagcttctttcatttagcgtaatgttttcaargtttatccatgatgtgtagcagaaatcattatttcattccatttttatgatggaataatattatattgtatgaatatgctgtaatttttaattcactcatcaattaaagacatttgggttgtttccacttttttttttttttgctattatcactaatgctgctctgaacatttatgtacaagtttttgtgtgaactcattttcagttctctttggtacatacctaggaatagaattgctggatgagctggtaactatatgaataacattttgaggaattgccagactgttttccccagtggctgcacaattttacattcccatcagtgatgtgcaaggtttcccattttccacatcctggccaaccctttttatttctgtgttttaaattatagtcatattagtggttgtgaaatgatatgtcattgtggttttcatttgtgtttctctaatgacaattgatactgagtatctgtttgtattgaccatttgtatgtctagaaaaatgtttagtcaaatcctttgcctgtattttaattgggttattcttttaaatagttgagttgtaatattgctttatatattttgtatactagacccttatcagatatatgacatgcaaatattttttcttccattttgtgtgtttttttcaatttcttgattgggttctttgaagcacattttgaaaagtgcttcattttgatgaagtccagtatacctatttatttttcgctgctcgtacttttgatgtcatacctaagaaactattgactaatccaaagccaagaaatttatacttaatgttttcttataaatattttataatttcactagttacctttagatctttgattcgttttaagttagattttgtatatggggtaagatagagatccaacatcattcttttgcatgtggatatccagttgtcccagacccatttgttgaaaataatatttttcacatttgaattatcttggtactcttcyaaatatcaattgaccaaagatgtatgggtttatttttggactctccagtctattctattgatctatttgatccattatgccaatactactccaacctttttttttttttttttttttttaagacaagagtttccctctgttgcccaggctctggagtgcgatggtgcgatctcagctcattgcaacctctgcctccgtggctcaagagagtctcatgcctcagcctcctgagtagctgggattacaggcacgcactaccatgccctgctaatttttgtgtttttagtagagatggggtttcgccatgttggccaggctggtctcaaactcctggcctcaagtgatccgcctaccttggcctcccaaagtgctgggattacgatggtgagcctaacttttttctatgattgtcttgagtattccgagtcccttgcttttccatatgaatattatgatcaacttgccaatttctgaaaaaaacccacaaaacacagctggaattttgaaagggactgcattaaatttgtgaccaatttggatattgttgayatcatgagaatattaattcttccawtccattccccagaatgtctttccatttatttaaaacttcttcaggttatttcagtgatgttttgtaggcagtatgcaagtcttgaacttcytttgttaaatttgtttctattttactttttatgccattgtacgtggaattttaatttcatattcagactgttcaagtgtatagatatagagatgattttcacatattgatcttacatccygcaaccttgcagaatttattatcataaatagtttgtctgtattccttaggatttcctatatgcaaaattatttcattttaaagtaaagataacttcagttattttccaaagactacttttatttatttttcttgtctaattaccccagttagaattccagcacaatgttaagtcaaagtgatgagagtagacattcttgtcaggttcctgatcttagggaaagactttcagtgttcaccattaagtatgttctcagttgtgaggtttttgtagataccatttatcagattgagaaagtagtcttctattcctagactgctttttttttttttggttaataataaaagagcgttggattattttctgtgcctattatgatgatcatgtggttttggttcattattctattcatatagtttatkggatcgattgagtttcatatgttgaaacggtcttgccttcctggaatgaaatcccacttggtcatagtataagctttttgtgtgtttctggaaacagtttgctaatattttgttgatggtttttgtacttatattttaaaggatgtttatctgtagttttcttttttcatggkgtctttagttttagtgtcaatgtaatgctgrcctcaagaaataagttggaagttttttgtcctcttttcttttttggaattcttttgtgaagaattagtattaattttttgaatatttggmagaattgagcagtaaatttatctgatcctgagattttcttkgtcagtaattatttattaattcagtctcttcacttgttatagctttattcatttgcctrttgctccctgagtgtagctagtttctaggaattgtctgtttcgtataggttacctaatttgttggcatgtagttgttcatactattccttataatatttaaacattttctgttaagtcaatagtaatgtccatgctttcattcctgattttggtaatttgagaattctctcttttttgttrttggccagtctaactagaaatttgtcaattttgttatcttttcaaaggactaatttttggttttgttgacttttatctgtaggttttttatcctcttttatcatttatttctagtttaattattattatttttcttgatttgggtttagtttgctcttcttttgctaacttcttttttaaaaaatttggatgtgttttttgttttattttatttcagtagatttttgggaaacaggtggtgtttggttacatgaataagttctttcgtggtgatttctgagattttggtacatccatcacctgagcagtatacactgtaccctaagataaaatcttctgttattgatatgagatctcatttgttttctaacataagcatttacagttayggctgtccctttaagaactgctttaggtgcatcccataaattctggtatgttgtatttttgctttaatatatctcaaaatattttctaatgtctcttgatatttattcttgtccaactggcaatttacgattgttttaaatttccacatatttgtgaatttcccaatgtttcttctgttattgatttctaatttaattccatcatagatggaggacgtactttatattatttaaatccttttaagttaattgaggctttttcactgcctaacatatggtttattctggagaatgtttcatgtgaatttgggaagaatgtacaatctgcaatttttagatggagtgttctataaatatctattaggtgtagttggcttatagtgttgttcaagtcttctatttccttgtttctcttctgtttagttgttctattatttattagacatgaggtattaaagcctccaactggtattgttgaaatttctatttgttctttcaatactgtcagtttttcctcatgtgttctggggctctgtttgcatggtatttctttttctatccttttactttcattctattggtatctttgaatgtatatgtctcttttataaacagcatgttgtattattttwaaaaatccattagtcgatttttgccttttaattggagtgtttaacccatttacatttcatgtgaatactgataaggcagaatatacgtctaccaatttgatatttgttttctatgtcttacatattttgtgctcctccattcctccrttttactttgcttttttgtattaaatatgtattttctagtgtactgttataattttcttttactatattttsagagttatgtttatagtggttgccttggaaattacaattaacacattaaattatggaaatttaattcaaattaatagcaacttaattatagtagagcacaaaactttgctcctctatagattcattttcccccagtcctttgtgcatgcccgtcaacacgaattggtagttatcactttatgtacttgttttaaaacacaaaraaaattagttacaaacaaaaatatagctatactgtgtattatatttacttatgtagttaacttttactggtgctctttatttcttcatctgaattcaagttactgtcwtatgtccttttatttcagcctggaaattgccccttggtatttgctgtagggctagcaaccaattgtctcactttttcttttcctgagaatgtcatttctgcttcattttttgaaggatagttttgccacgtttcgattatgtggcagtttttaaattaattttagcagtttaaatatattatttccaaacttttatttacaagctttttggattgccttttttttgccctaacttatttaccacctcaatcaacaaagatggtatacctaggggaagacactgttcacgtgggctgacatttcaaatcatgtcaaataaggagaatatttgaatatgaaagattcgaatatttcaaatcatgtcaaataaagagaatatgaaagataagtcttcccaagaaccaccagacaagtcaaacaataatagttcttgaggaatggggctttgagggaactttagccccatccttcccctttggtggctgccaggctactgattctcaccagcgaagtgaattgtttgttttcaaggccgccacagaactggggatgaagggaggggatgggaataggaaaagttcatataccataaaatttgctgttcttactgaaattcaaccgtttttctagaacacacactccccagattttgatgcaagtctttgattaatttctagagttttgaaaaagttaattatgacgattttgctgtgttttatgagaagattcttggaggttcttattctaccattttaaagattttcatcatttcatttttgtatataaaatattaatttgggtgaaagtttaaaaaatgttggcgaatacggtgaaaccccgtctctactaaaaatacaaaaattagccaggcgtggtggcaggcgcctgtagtcccaactcctcgggaggctgaggcaagagaatcgcttgaacccaggaggtggaggttgcagtgagccaagattgtgccactgcactccagcctgggtgacagagcgagactccatctcaaaaaaaaaaaaaaaaaagaatgctaacttttatatgttacaaaagttcaaatatttgcttcagattttcatttgtctttaagctttatttatttatttatttaatttgagatagagtctctctgtcagctaggctggagtacagtggtgcgatctcagctcactgcaacctctgcctcccaggctcaagcaatactcccacctcagcccctcaaataactgggagtacgggtgcacgtgctagcacgcctggctaatttttgtatttttagtagagacaaggttttgccatattggccaggctagtctcaaactccttgacctcaagtgatctgcttgccttggcctcacaaagtgctgggattacaggtgtgatccactgcacccagctgagccactgcacccagcccgtctttttgcattttaaaatattgttaaatgaatgatatttatataaattcttcatcataggcttgacccctaaatgaaatgctaaaggaaatttctggttcttattaacttttcattctttcattctcagtctctagtttcctctgtcttgcaaatttctcaaaaattgatgtttcttttttttttttttttctttcctcctttactttaaacattcttctgggaataatgtcacccaccccagaggctttcactttccctaaattattactgcctctgacgtttctataccgggccccaatacctttcctgagcttttgccccatatatccagttgcctcaatggcaccatcatccactcagtctcttggtttagcaaccttataagtcatccttgagaattttccccatctaatttgtcttcagtcttattgaatatattttctagcagctctacaatctatactacacatctttgtctccartgtcactgccgtaatttaggcttccttcatttcacatgagagcttcttgtgtgagttttttgcctctacatttcacatttctctgtctctgtctcctttcaaacacacacacacacacacacacactcacacacacacacgcccttcccccaaatagtctttctctaaggcaaatctgattctgccccttccgactttatacttagaatcttttaaaaggtgatttttattttagaattcttttactctctctcatcagactatgatcccttcaagggcaggagccatgttttattaattttctagaaaaattcattcccagtacagtatttggaatacaatagaaacataattaacttttaattaacgaatgaccagtaatttccagaaaaattttattgaatttattaaataattacatatgaatttcttctttacagcaaagctattattttatgctgaatggaataattcattgagctgatttattaaagcagcattgtgagttaaactttcctaactctagtggaaaatcaggtggctgacaagcatgacttaaaacatagataccctatcatttcacaaattgagtagacgcctgttttcaccaaatgagacactgaaatgcttttagtgataatgaataggaggagaaaaagacacttgtatgttttattagacaagatcccaaagacgcagctgacaggataaaatgcagcaatttgagtgtggattttgcagagaaggctgtcttagattaagacataaaacatagatattacatgagcaagtctctcagaagataagcaaattgaatattccaaaactctgaacatgatgtacctgcaaacattttatcctttccccttctcattaagcaaacaaaatttgtaatagccagtctgcactttatgttctttgggtgagcagctacaaaactgaactatgaacaattataaggtgttaacagaacctactaattcaaggaacagacaaaaataactgctgcttgggtttcaacaaaatagtgagagaaaacaaaagttatgtaatattcaagaggatatgtacaactgatgattgatatccttattttgttacatcagtgagatgtatccagtgaaaaattgtggagataaaaaaattgtgataaatttgcagttatacatctagaatttctggactggcttttcatgcaaaccaktgttagtgatgaagaaagcaagccagagaaataaaaggactttcctgagatagcaagttggaaatataagctccttaataataataatacttaatatttttactgttcccaaaaatattctaagcactttttatgtactaacgtatttaattctcaccttatgaagtagatactacaattactctattttacaaggaggaaactgaggtatgtaaggttgaataacataccgaaagtcgtgaaattaataaattgtcaagctggaattcaaacttatacagcctaagccagttcataaatatttaaccattgtattatgttgcctttcactctctcttgcttaatgaattaggatttagcattattgtcatagmagaataccatgtaattgtatttgtgtcaacaaaataccagatttctatgagcactatttagcaatcaaaagtaagacatctttctaagatatgtttatatataatttatagatattttcctttcacagaactacaatctgactccctttatcctcaatgtattattgaatttagtactggcatggattttactccggtttcatttgccttattatccttggcaagttacttcatttctccacttaaactacttgttttattttagtaaggagagaattttcccatgttggtacatggtaaggctgactacagtgagataaagaaaaccaggagcacctgggacataaaactagatcatctcaataaagtaaagctgctacaagaggtaaattcatctcaggaagcaggagctcaaatgtgaatagtatggccactgaacatactcatgaatgaaaccgatagtatctcagaaacttaatacagagtcttggttatcttaatctaagataaatcttaaagtgctctgctatcagagatataaacaggcaatccgattcagaaggtctgtctgctagtagcagagtttcaatttcctcatcttaacatgggaatgacagtttctatcttgcttggttattgagagaattaaaaaatgtattaaagcgatcatgcacaattcctagcacatggtataaatttcagtggttctcaactgagagcgtttgtaaatgagtgagggcttttttggttattccaatgacctaggactagtattggatttttgtgagtgggagccagagacgctaaatgttctgctatgtccagactaattctatacagctaagaactcttccgttcaaactacctttactccatttcgaaacccactaggggaagctaaagaattatagtgattttattactatgcattctgccatatggattaaaattccttaaattcctcttgcgtagattcagaattggctcttcattccatgatctgtgattctatttcttttcctctcttccrctggcctctaagtgttgaagacaattgttctcttttgtttctcttctctaacctaaacatctaagttcctgcagctgtgttgctagtcctcccaggatctggaacatcttgaaaatcttatgtgcccttgttgtcagagccctcaccacactggttgccttatctagaatcattctaatttttcactgtttcttttaaaatgcacatcctgattttagtgcaagtatactacatggactagtgcttgcacagtatactgtgaacttactgttgactttgacctttagtttttaacttgcaaatcagcacctacattgataatttcaatttgygtttatctaaagttccactatatacactgaaacccaaytgagtctccacatggtacaatatactctgcttaatacctaggatgtagagatgaaatgaagacagggaggaagatgactaatataacagtctaagagtaactcattctatgagagtgggaatcaagagagatttcttggaaagaaggacacaagttctagtgaagaggcttgtggggagaaacacataggcaggaggctgattagctatgggatggaggtcatgggcaatgacagaggggcattgaagaccaccatgaatgtggagggcatgctaacatacttgctgttactacagcattcattggttacacagatcttacttatgagaaaacattgaagattttaagtaacaaaatattwtactcagtttctagctgaagtgttggagttattttaggggatgtgggagcaacatgggaaaccacaaacccaataagaaayctgtgggcaaagagatagagayattgagaacctaaaataagtcaatggatgggagatctgaaattgagagatgtttctgaagtggaatcagcagaatgtggggacagattggatgtggggttcacagaaaaagagtgatctaagatgacttcagtgttccagctggctggagggtgctatcttccagaaagctagggaatgtgggaaagaagtggctttagggatgtgggggaactaatgtgcttgccagaactactgctaagccagaacatcttcatactatattggtatatttagatgttggaactataactttcactcctctgcttaaaataggctatattctatggataggtaattcacaattaataatgtatcaatattattcattatactaaaagagaattttagagcaaaatcctataattgtagaaacagagacatgaaaaacatttgctaaaaatctgcaattcaatcccagcactttgagaggccgaggcgggtggatcacctggggtcaggggtttgagaccagcctggccaacatggtgaaaccccgtctctactaaaaatacaaaaattagccgggcatggtagcagttgcctgtaatcccagctactcatgaggctgagtcaggagaatctcttgaacccaggaggcggaggttgcagtgagctgagatcatgccattgtactccagcctggaggacaagggcgagactttgtctcaaaaaaaaaaaaaaaagaaatcagcaattctaggtaaaaacataaattaaatgggaatagaaaacattttcctaaatgtgccaaagaccgtctaactaatcaaaaccatcatataatattaagaaatactgaagattgatcctttaatataagacacaaatcaaggatgctttctatcagcgtgactattctatatcattcagcatttctagtgaatcacttaagtaaatggaataagctgtgcaaatattggaaaaaggaattaatcaccattacttaaaggtgattcaatggtaaatctaaacaattcaaatctgttaaaagaacaaaaatgaatattttgtgaggatcccagatacaagaaaaatacgttaaagtaaaaagttagtaatggaaaaaatccgttcatattagcaataaaaatatagaatacctaggaatacttttagtaaaaatgatgtaaaccgatattttaaaaattatttaatagataaaataaaaattaagtaactggaartaaatgctatgttcctagataagaagacttaatatcataatgatgtcatttcttgccagatagatgtatgtatttaataattccagtcaaattgcctgcttttgtttaaacacaatcacacataccacataatacaacaattttaaagttcatatagagaacaagtgtttgagaatttccaaatgatgtcagcaagctttaagaaagaagggttatgcaagttccaacaagaaaatgataacgacactgagagtcttcatataatacatagtcgtggaggtaaccaatgctgacaaccatctgctgtaacagcccaaggtataacattcatgctgcaagaaataatttggtttcaataaagcaacatcttctactaatttaaatatacacttgaagattcattttaaagttttgattatatttatcattggattttttcataattttaaatgaccagtaagcgaataagtcattccaaattttgatggccattaagtaaaataaggattattggaacacaagcactgagacactgtgataatggatctgataatcaaaatggctgctaagtaactattggattggtarcatatacagtgtggaaatgctgggcaaaggaatgactcatgtcctgagtgggacagaccagaatggcacgagatatcatcacacaatttaaaacttatgaattgttcatttttcacttgagattttcagaatactgttgaccttgagtaactgaatctttggaaagtaaaacctcagataaggggaactactgtatgtttaactttttgagtaactgccaaaccactcccgaaggtacagatgtaccattttgtatctacaccagcagtgtatcagagtctcaggtgctttacctacttgccaacactgagtatggtcagatatatctttttagcagtgtgcttttgctcactgaacacaatattccatgtgtggtctaaacaaaattgtccaattaaatttacaagacatacttgctaaatggtatgctctggtctaactactttgccagggacatatccttctttattgtaggtaatatacatctttggatgcagcttgagtaaaatggagttgacttcttagcagtcacagcacactgcttaaccacattgaacttactgtccaataaaatctctaggtctattctcttacatttttgccgatgagacctgccttttttatcctcagtttaagcgcttcatttcataaacatattatatttaatatacttcaaaagagaagttgcagtggcttatcatgagaactccaaatacaataaaataactaaattaagcatactgaggctagaaccaagcaagcaagagtggtgagatcacactaatagaaaacctagactaagggaatctcctgaaaatgagtttattgatagcccgagtcaaagtggattaaagaagttatatagctcttattaaaaaatgcaagaaagcttatcagatgatataaaaactcaagctttttttctaattcaactttctgaggaagaaacaggcctggggaagataactttttaactctgaattttgtattttaaaaatttttattttggaaaatagacccagagatctcactcatagtgagggaaaatagttttgagctaatagacactggtctaattactcaatttagttagacattagttttccaagtacaggtgttacccacacaacgggtgggttcagttgcttgtcaggtaacagtccaatgaccacaatcaaggaggatttaacaaggatattttattacttgcaacaaacgaagaggacaccagggatagttcccaaagtagtccctccttgaacaatggtggaaacagggcttttactgggttggttagctgaggttggagtaaaggccgtgctggcacagtcaccaatcatgcttcaacatacgtcacttatgtagaaaatggagaataaggtcctccctgtgcagagattttagtacagtagtgaggggagttcaccaaaattcatcatctcaggtatctctggatccaagcagttttggtatttctgaggctgaactttttttgaagcaggagctccaggtacaacagttaacaagtaggtaatttttcacagtgcgcacccaaaactcagagaaactgggttacacaggtacaaacttttggcctcatcattgataaacaccaacctaagacttccaaggtcagaatatactttgtaagtattcatgagaattatctttttgccctttctgcctacattgattagcgtttgtcattttgattagctttcatcctattctctgtgttttgcagtcacctctcatccatttacctgtgttttactggtttggtttctatcaacatagatgtctctctcaatttcctgaaatgtttatctataaactcgaagaagctatgattgtacaaaatacttgccgaatatatatatgtatgtttatrtacacataccacattgtgtatatatgtatacacacacacacacacacacacacacacacacacacacacatatatgccacattctctataaatatagatggatatatttccctctatattgatgaatatatttccatctatatttatagagaatgtggtctcaggaaagtcttagccttccattgagtatatctgcgtatggaatcctggcacagtgtttggtcctgtgagaaaagttacaatagtcaatttgggtcccttcacccactttcgttccttataaaataaaactttggtaagtaagccaaaacaatttttagcacaattttgagaaatctttctacaatatgcctcgtctttaagtgtacaacatagtacagtgattaaagcttggatttggttctgccactcaatgtgtgatctttaaagactcttatttatctctctaaacctcaatttcctcattgttatatggcactgatagaaatatcaactacctcttaggatttttgccattattaaatgagtatwcacacacacacacacacacacacacacacacacacaaacaccaatatctggcacacagtaaatactatgtgcttagacattattatttatatcatgctctaacttcagtatttaatgctttttaaatttcccttctctcttttgcttctttatttccctaaagcactcttataatcaaatagctatttatttgatagttcatcattgagcattttacgttactatattagaatgacctttttcccaactaattttccattttattgctttgaaatagttcaaattacccttatgaatagtatgagaggagtatcatctaatccattcaaattagaaaatgaaatgtaaatgtgaaagctgaaaaaacttccttggcactttgtatcacaggaacttgatcgataaatacttttctagctgctcacactgtccctgttacatttcattctctcagcctcctggtacaaaaacacagatgtgcatttcttttcctggaaaaataaatattataactctttcaaaacattatctcctgctgaggatgatgactatttaaaggaaccaactctttagaacctcagcttgtactttctgactgttatctggatctaatgattcctcttaaaatttgagcttacagatgaatctataaaagagatagcttgaattttctgagaaaaatagacatctcagaaaatccttccttatgtttttctcccccccataaattaccattattatttacttgtataatcaagaatacaattgaaggataatatatatatatatgtataaatatatatgtatatatatgtgtatatatatggaatctagagacagaaagtgaaaaaatcatgaacacataattaattcagtcttcaaacaaatgagatttttaactgaatattctttttcttttttttttaaagaataaaactgaacattagctgtgtcaggagtccctaagactgctcctaggtttgatgatttgcaaggaggactcacaggactcagcatatagttgtacacacggctatgatttattatagcaaagagacacaaagcaaactcagcaaagggaaaagatgaaagtgacaaagattagaagaatccagtctcaagcttccagaggtcatctcccagtggagtcatacaggacatgtttaattcctccagcaacaaattgtgacgacacgtgtgaaatgttatcaccagggaatcttggctgagcacagaagtccaaagtttctattgggagctaatcatgtaatcaccctctgctgagcacatacataagtcaggtaggaaaataggtattcaacataaagcatattatttgcacaaacatttaggcactgtgaactactcttatcaattggggaaaattttgtatcaatatagaaactgtttactcttcaagctcccaagttccagtcaagggccagccttgcaaacatgcctttataagaaaaggagcctcactcctgctmtgttaactcttttctaaacaggagctaaatagagccaatttctaactccataaaatctctaaaaattgagctttaatgacaactacaatgcaacgggattaggtctgaaaataactagggagagcaatatagattttatgttacaggtgtttaataaacgttcatctagtcagtacccctttagaaaaaatagtgccattatattctccaactagtattttaggaaaggaaggatcatcttttcactagtcttctcagagattgttcaaagaaaaaaggcaaaatraagtgtatattgtagacataaaaggcaaataagggacatgtggggtgcaggagagagggtttgaggtatcgttcttatcattaggaaagcagaacagagagtttttccagaagtgacactgagcaaggatacagatgcgcggatgtagggatgatgctggagttcactaatgaggcactggggcagctggagagaccagggccaatgtcacaaagccaaacgatttaataaacaaaataaaacaatatataaaacctagactaactgcttgaaacataaaaccagcaagttttgggttggtcaagtttcagtattctggaaaccagtttaagagcttgaaatatattatttctttttcagggggtgaaccacagacagataggtgtcatacacagagccaattatagtaggcagtattctggggaaaaacaataaactagacacctagtagaggtaaaaaaaatacacttttgtctgatcatattcacaaatgtcagtggcaacagatgaaaaccaaaaacaatacatgcacaccactgcttaaattaaaaaaaaaaaaaacaactggcatcttttaattgtaactgctttagtttgtatatcagtgtcataatgaaggcaaaaaattgttggcaagttaaatgcaatcattattcatgcctattttgtttttaaatggaagatttaagaggtagttaatcctacttagtgattaagagaatggattttggaatcagaaagagctgaaaattaaaagcttaaaattaactttattcagtacactagctttgtgattattgatgggcaataaacttctctatgcttcagttgctcatctgtaaaatggggattatggtgaaaattaaatgagatatttatgcaaggtgcttgtctctgcctgcaataagtgtctattcaataaatggttcatgttgttattgttgctttataggatctgtagctatggtctgtacccttaaggactatatatggtgagagacatgcaaataaactctcaaaatatacaatgtgtagtgataaatgctggtatgcagtgcagaattgaacagaggtgggaggtattaactttgcctgagagaaggaaggactttggaaaggaagtgaggtctctgcggagtctcagaaattcgaagtgagagttgtgtaggtggagaaagaggaaaaggacattccaagcaaacagaattcatgtgctaatgtaagtttggggaattgtaagtagttgatgacggcggattgtaaaatatgagagttagaggtaggaaaagagacacaaatccagaaccaaaccaaatggattaataattgccctgcctgaaaataaaaagtaaattatctattgtaagaagataaaaacgatgcaacacctttgcatttttgaaattgaaatatgtttaaattaaatgcagagatcttaaatgttacagtttgatgtgttttgaaaaatatgtacatgggtgtaactcatatttctaaaaaaaaatgaatatttccgatataccattaagttcactggggcccccttacagtcaaatcttatacaccacaacccctcagatgatcaaggttcagatttctttgaacataaatcagttttacccatttagagatttatctagatgtgtaagtcttctctcattgagaaaaagattttaaattcctccacattcgtggctatatcaatcgttggaacattttaataattggctagtattgttttgaatgaatatacagcaaatgtatccattctcatgctgaagggcatttgagggtttttttttttcggtttggggctattatgattcagatggctatgaatatttttgtacaattctttttgatatatattttaatattcttggacacatgctgggtagaattatctggctatacacatgtatttattcctgtaagaattgacaaatcttttttcaaagacgtggtaccatctaacactcccaccagcaatgtaagagagttccaaattgttccacatccttgccaacatttggtacggtcagtctttttaattttagccattctagtgggtgttgagatggtattcagttctgtaatgatatttgatgttgagtaatttttcatgtgtttattggtcatttgcatatcttctttttatggtttttatttgtcctattaatgtgttgaaagagtaagttatatattctgcttacaagtccattgttagatatatgcattgtgaataatatttctcaatttgtgtcatgcttattcatattcttatctttctataagtaatttaatttgtcatttttaagtagttctttatcatatccaaaaaatctttgccctctccaatactgtaaacatgttatgttttcttcaagaagctctttgctcctaggtgttacagttatggacagttttaaactaatttttgtttgtggtattaaaaagggactgaggttcatttaaaaaatatggttatctagtttttctagcaccacatattgaagacttattttttcctattaatttctctgaaggctttgtaaatatttattaaccatgtaaatatgaatctctttctggattatcttctctttcattgatgtacttatttatacttttgctaataggaaattttcttaattactgtagttttataggaagtcttgaaatcaggttctattattctttcactttattctcttttgagattcttttgtccatcctagattctttgcatttccacataaaattagaattggcttgtcaatttctgaaataaaagcctgctggattttaattgtgattgtaatgaatccattgagtaatcttggcagattggaaaacgtaacaatatttacattttcaatacatgcatagggcatagggatctatttatttgactgctttactttgtctcaaaaatatttcatagttttcagagtaaagttttaaactttttattacatttacctttgtgtattttataacttttgatgctgtttcaaatagcattatgtttaaattcaattatccatttgcttattggtgttgtataaaaatatamtttaatgttgaccttgcagcctatgatctggctaaacttactagttataatattttgaagattaatttcacatgattttactttgttgtctgtaaattccattatccgtttgcttatttttattatataaaaatataatttattgttgaacttgtagcctgtgatctggctaacttactagttataatactttgatgattaatttcacgtgattttattttgttgtctgtaaatcacgatgtgtgagacattttttctttgtactttatatttatttccccctaatatttttgccttgcctcattggattgactaagacctccagcttattattgaatagaggtgtggagaacaacttagtgctcctttctatattttttcagagattttgcataagattagtatgacttctttaaattttggatagaattaactagtggagccagttaagtctggaatttttttttgtatgtgaaagattatwttttgtttaggaatgtttttcatctgttttcataaataagacttacgatatcttttgttgttgtgttggtgccatttttgtcaagttttcttgaataggcttatgctagcaagtaggatgaatggggaagcttttccatttttatttgtttcagcaaataaaaatacttgtaagacaatgtataaatctacgtaggatkaaagttatgaaggacttaatgggggtaacttcaaaatctctttattcatgtctttatatagttcctatatagttgtagtttcctgattgttatctactttttaatgagaaaattgtgttatattcttgtagacatttttaaatttcaataccttcaaatttattaggaatatttgaaaatttctatattttatttatctcatcagtttcttttgccttattttgtttatgtatttttttcatagataagtgtctcaaatatttgcctgtttcattgttttttatctaaagaagtgttattgaatttttcaattctgctgccttgatttttaaagtattgctgtattttataaaacctataattccatggataaactagatcattaactgaaataccactaagaaagaaaataaaacactgccaaataagcatcttctaatcacttaggcttttgatattaatttatcaaaagagttcttttgagtaattgaacatattgtgttatcatttattagtgttgtatatataacaaagaggaaaatataagcagagtacatgggttaaattattactagaatgatttatattcaatctaaytcttctaaatgtctttttgatttgtacatgtgtttttgtatccaaattgtgctgtataccatcaaaaacactgatgattcaaccttacttaaagacctttgtttagtattttctataatgtgtgatatctagaactaattctctgaacttttatcttagaatgactttttctcttatttttgaaaggtattttctctggccattgaattcttggttggcaggattttttttttctttaagtactttaaaggtgttcaacatttatattattatttccataaaggtaattgtctttttctctggctgcttttaagattttatctttatcactgctttagaataattgcactagaatgttcttagttctgtttcctttgaatttatcctagttggggctcactgagatttttgaatctgtgtgctttttcctttcttcgggtgtggaaaattatcagccattatttcttcaaatattgctttcagtttcattttctctacactctccttttgggattcttattaaacttgtgttaaatgttttgaccgtgtcccacatttctctaatgcttktctctaccttcttccctctcctcaccacaatgcttcagtttaaatatttttcattgacttttcttcagatttactaattttttattcttctatgtccagtactgttagttctgtccaataataagttcttaacttcagatattctatttttcagttttaaaatatctatctcataaatgattaattctaattttctgtggaaatactgtatgttttcatacattttgtctctctattactcatttttattgaaatattaattacagctcttttgaagtccttgtccgttaacttcattatttagaaaatgtctgggcctatatgtattgtctattttagtttttattagtcacacttttatactcctttacatgactatttattttttattgtaagctattcacagtggatcatatattgtagaagctctggattgttttaatttcatttcaggagtgttgaggtttgttctgacagtgaattaagtcactggcagatcattttgattctgtcaaagcttgggttaggtcccatttgtaatttttaagccatgtggttttttcttttcctttttactctacatgcaaagaaagctctctcatagtttggtgtttaccaagaaacagtacatatatattactttgaattatactctctttacttgtatgctggccgaatcacccttcagttctatagatgatgacagattgatgcataaggtttatagaaaaattgtagttgtctagcaggtttttatctcatatgtcttttatctcatatatctcaataggactgaaatgttactttttacctctaccttggagacttgaacaggtaacgtacatggtgaaaagactccaatactcactatatactgatactagaatcattttttcatcacttcactaatcaaagtttacctgtatgcacctcaactcctagaattcaatgcactatttccaagttcttctcttttctacccattttttttttctgggatttggagtttccaattagatgtcgaaagaactaagattgatctgaattgagttatacagccatttacctaactaaaatagtggcattggcaataaactccagagtttcccaaacttccatcacttttacaccattttcacaatttttttccacctttaaacaccacctgtgctataatttgcctagtatctttctttacagaaactttaaatcaattaactttttttaagctatccttatcctattaatagttaataaatctaaacaggttaatagttctaaatatattaactgcaagatattgttataaatattagtaataatattgttatcaattttcaacttaaaatatgtttccatgggtattttagtaaacacttagaggagactgaataatatgtgttasctaaatgagatttggcacttctaagcttttgatcttcattgaatttcatctaaatcttcatttaattcatggagacttgagcaattttttaaagttccaacctgtaagtggatagctctgmtgagctaattgtaagacatatcatgaagaaagtagatagagtgtataatgaaaatagtctccttgtggtaagatattgtcaaaggccaatctggatgcatatatggagaaatttataataatttacaagggctttagtccctggtttattgacattatgaaattggaaggaatgttaaatgagataggaaataggaattcatcatattttacatgcccaaataattgttatgttaattttgagcttaacttgatttgtagactgaaaaaaaaattgactgaggaacaaccctgcctctgtctcttcaaatagagatgaaataagtaacctgaggtctagggcaaggacaatcacagacactttagagagagcaagctccaacctcggtttttaaaatgtagctctcctttaaaaacagcaaaatcacgtgcacagctactgacagtatcaatatgtgttactggctttgcaccaaattcgaagtcataatggcactgttcttttcaaccttcacctagggaaaaagttattaaggaggaacagaaaaagggacattgaatggttcttggttaaaccattggaaagcacttagtttcctttgttttgccatttattcatgcacaatagtgttagtatttaaatgtggggtttttttttttttttttcttacttttgaactcattgaggcagtgaactctatcttgtggggctgctagtgtggtggaaatgtaggattgccatcctgggaaccatagtttaagtaccacattggcatcaactagctgaaggtattttgcaccatgcaagtgttagttgatgtatttaaattattttccagatttaagaaatatgtactctctgtagtagacctttagttgggactgaggaattgggaataaacactgagaataaataaagaaaacataatcacttgaggcacttttgttgtcaacaaatcgacttctctttgcttttcagtaggaaaaaaaaaacaaatttacaagccctgcttattgtagttttcttcttgaaattgtgttaataggctctaaatgcaaagaataacttatgtgtttcaaggctagaaatataaactgaaagataattacgaaggataaaaataataataatgaaaaaccttcacagctcagaacatgtgtgtactaggctaaagcattgatattccgctggagtgatcactagatcatcttgctgagatcagttttagtttgttacatggcttataatttcagaagcttttgtgcttttggacacagctgaggtttatttcatatattcacttattgatttattcattatttgttaatacctacttggtctttctgactgctctcttttagatttgcattcatacaggcataatttattttgagcttatattgagtttcactttattgcactttggagatatggtggtttttacaaatcgaaggtttgtggaaatcctgcttcaggcaagtactattttttccaacagcataaactcgtttcatgcctctgtttcatattttggtaattcttttaatattttaaatttttaaattatttttatatctgttacagtggtctgtgatcagcgatcttttattttactattgttattgtcttagggggccacaaactgcacccatataagatgggtaaattaattgataagggtgtgtattctgactgctcttccaactggtgttccccaatctctgtccttctcctggaggcttgctgttccctgagacacagaaatactgaaattaggtcaattaataaccatgcagtggcctttaagtgttcaagtgaaaggaggagtaaaacatctgtttctttaaatcaaaagctagaaatgatgaagcttagtggggataacatatcaaaagccaagacaggccaaacgctaggcctttttcaccagttagccaagttgtgcatgcaaaggaaatgttcttgtaggaactcttccagttctgctccagtgaacacatgaatgatgagaaagcaaaacaaccttattgctgatatgaggacagttttagaggtctggctaaaagatcaaaccagccacaacattcccataagctaaagcctaatctactgcaaggccctaactgtctgattttatgaaagctgagaaatgtgaggatgctgcggaagaaaagttggaaggtagcaaaagttggttcatgaggtctaaggaaagaagccagcttcataacatgaaaatgccaggtgaagcagcaagtgctaatgtagaaggtgcagcaagttatccagaagataatagctaagatcgttgatgaagyagttacacttaacaacatattttcaatgtagacaaaatagtctcatggaagaagacgccttctaggactttcatagctaaagaggagtagtcaatgcctggcttcaaatcttcaaaggacaagctcactctgttgttggtggctagagcagctggtgactttaagttgaaaccagtgctcgtttaccattccaaaaatcctagggccctgaagaattatgctaagcctactctgcctgtattctgtaaatggaacaacaaagcctagatgacagcaaatgtgtttatgttgccgtttactgaacattttaagctcactattgacacctgaagctcagaaaaggattccttttcaaattattactgttaacaaagcatctagtcacccaagaactctgttagagatttacaaggtgatgaatgttgttttcatgcctggtaacacaacatccattctgtaacccatggatcaaggagtaattttgaatttcaagtcttactatttaataaatatatttcataaggctataactaccatggataataactctggtcatctgggcaaagttaattgaaaactttctggaatggattcactattttagatgccattaagaacattcatgattcatgagaggaggtcaaaatatcmacattatattaggcatttggaagaagttgattccaaacctcatggatgagttcaagggcttcaagacttcaatggtgaaagtaactgaggatgtggtggaaatagcaagaaaactagaattagaagtagagcctgaagatgtgactgaattataacaatcttaggataaaactttgacagatgaggagttgcttctcatgaatgaacaaaggaagttgttttgtgagatgcaatcgagtcctggtggagatgctttgaacactgtggaaatgacaaaaaaggatttagaatgtcttacaacactgattggtaaagcagacacatggtttgagaggattgactccagttctgaaagatgttctaccgctagtaaaaaactctcaaatatctacagggaactctttcttgaaaggaagagtcaattgatgcaggagacttcctagttatcttatattcagaagctgctatggccacccaaccttcagcaaccaccaccctgatcagtcagcagccatcaacattgaggcaagaccctccatcagcaaaaaaggttttgacttgctgaaggctcatatggctgttagcattttttagcaataaatatgtttaaattaaggtatgtacattttttagatataatgctgttgcacacttaagagactatagtgtggtagagtgctgttgcatacttaagaggctaaagtattgtgtaaacttaacttttatatgcattgagaaaccaaaaaacccatgtgacttgctttattgcagtatttcttttactgtgttggtatggaactgaacccgaatatctttgaggtattcctgtacttgatttttatctatgacattttcccaacttgttaygtaaaggatggtggttgtttaaggccccacatttgaagcatcttactcgagttttgtggggcttatttacattttgaattttcttttcatgttgcctctgtgtctgtctaaaccatgccctagttctgctttaaccagccttttcaggatctatttctggccaggtaatttaatcttaaatgcttagtattaaaacgtactagtctgtaattaagtggaagcctcagcagaaggtgagkgggaaagtttgaattcagtgactcaaaattccaaatttgcttgtgtattgctatatttgtgactaatagctaatgagaaaaccaagctgatataattccagtatggagaaaggccaagggtgtgatcccagtacaaggaataaatagaattgttctttatgtagttgcagaattatgactgtactgacacaacaatgcagcagatatcataagtctatttaagagacatctcaataacagctcaagttaaaaaaaagttacaataaaatgtttaaaaatacttataaacatttcaaatacatagtgtatagtaaagtgtaatgaatgtgaactccaccacttatgaaaacattgtaatttatctgactataaaggtaaataataatawtcaatttcagagtggctactaaactagataaaatacctatacagaggaatagcatagttcctggtgtataatagatactggacaagtaggtaaatattatttagacaagtttactttaagcaaaaaaaaaatattggaagccagtttcatggtaggaatttcaggatataaagttgcagtggctcatgcctgtaatcctaacagtttgggaggccgaggtgggcagatcacttgagcccagaagttcagcatcagcctggcaacatagcacaagcccatctctataaaaaatagaaaaaaattttctgggtgtggtgatgtgcacctgtagtcccagctactcaggaggctaaggtgggaggatcacctgcacctgggaaggtcgaggctgcagtgagctgtgatcattgcactccagtctgggtgacagagtgaagactctgtcttaaaacaacaaacaagaaaatgaaacaaaaacctactccccccaaaacctcattacacctgtggattaccattggacatccaacacaaatagattacaaacctaattctcatagccctatcattacctagctatttaattttggtaagtttctgacttagtttcaacatttataaaacaaagtgatttctgtwcatatttattaagatttttttgtctcccatactttactggccaataaaaagccataattgaaaacacttcaacatctctgtaaacttctagagaagatgattacctaaatagagtggcttttaatcaaacttctgtccagacctagrtgatgaggcaatctttagaagttygttttagaatactataattactcctgataatatcatctctgattttgcctaatattacagctactactccagcatagattttgatattttaaaaacagaaagtttgtacatgttgccaagtggtaattgacttttgattcttggcattcacaacattaagtggattgtatagagttgtgtgccagaactcaaagccaaaagcaaaagaacagaaaatgctgggtatctgaacagtgttggatttagattggagtattccacttactctacatccttgctactcaaactgtggtctgtgtacctgctgtgtgagtaccacctgggagcttgtgggtgatagagaattttaggccccacctagacataaataattagaatctacattttaacaagctcttctaggagattcttatgcaaattaagatttgagaaataatactctaggacacttaaaaaatatgctttatctgaattattgatgctgaatcacaaatggaaaataatgaaatacgaggaatattagtagacatcatgacgatagttgttcttacaaataattgttaacttcaaatgtcttttctaacctcaagacaggaccaaatgtagattacccattttcagaaaaaaaatgattcttttacaaggtaaatgttaaaggaggttatatttttttagagagtaagatattttaaatcagcatgtggcatattaaagctattcatgcaaatgatgaaatattttctgtaggtaaatgtgtcatcatgacttataatttatgagtctttaaaaattattttacaaaatagttctatagaagtggtgtttttcctcatatgatgttatatcttttcagtgaaatattatacactttgcagttgtacaagttatatgtatacggattatagtgcataagtatagtatataacccaacgatatagaaatgagctttgataagacagtatctttcacaaactactgctaactctgacgagaaaaccttgattgtaaggaggcctatctaaaaatcctcagtattyttataaaaacaagtaattaattcactaactgattcagtacttaattatgaaggcttctgagtgtctggcatatgccacatgctgggggtgaggagagcagtgaataaaagcagatttattcctyttccctgctagtattttcatatctattgggggagagatgcattaatcaattaattacaaaaaatgagtttatcattacaagctgtgttaagcatttgtaagtgctgagtttgggaaggctttctggcagaagtggcattggaattgagattggaagaatgagtaggaaataaccaggataagaatataggaggtaaagaatgggaaaataattccaaattgagggatcagtatgaccagagccctgtggagaagaagggaatgacatgtttaactatctggaaagccataatggttggaacacaaagagtaaagagaagaggtggcttgagatggagctggagagatggttaggcagaggccagatcatacaggagctttaggatgtgttaaggatttgactccctgtttaaaatccttcaaagggaacccgttaaggggttttaaatggagttttaaacagaggagcatattgtaaacagagggattttaaacaaatgggtatcacacaaagagaaattctaattgtttatttgtttattttaagatcacactggctgtagagtgggggctaggacattaacttgaacactgggagggtaaaaagtaacaggtaggccaattagggaataatgagagtaatttaagcaataaagaattgaggtaatggcgatggtaaaggtaaaagtgaatggattctagaagtaaataagaggttttgatgtacaattggagggataagcaggagtttgggcaacttctagattttgggcttatggcacttcacggctgacagtgaggggatccacgttttggtgggaaggtcatgagtttggtttggacatgaagatattctttggtccaaattctgttaggacgattaaaatatgtggttggaatgaccaatcctgtatcctaagatgagaataatatactcatataataagattagttatggcataccacaaaaatataattaccagtaattaatggggccattgaaagcattcagtaaaatgatgtttatagactacttagtccaggccttggcacattataagtaaaccattaacatttgatattattgttgtttatattattgatactctttagcctttgtctctcatattctctgcaacatattggctacacctttacttgttaattgagaaacggtttttttgagacagagtcttgttctgtcgcccagactggagtgcagtggtgcaatctcggctcactgttatctcggctcactgcaacctctgcctcaagcgattctccttcctcagtctcccgagtagctgggattacagatgtgcaccaccacgcctggtaatttttgtattttttagtagagacagggtttcaccatgttgaccaggctggtcttgaactcctgacctcaggygatccacccgcctgggcaccccaaagtgctggcattacaatcatgagccaccacacccagccagaaataatatttttatctgttagctttctttaacttgagtatttttagtctatagagtcatagtcctggagatagggaattttcttttcattgagacacctcttaattgaggcacaatgtttataaagagcaccccgttatgccttgcatgtcctctgtgtcatttttaatatattttcccttcactcctccatcagcaattgctcagcgagagtactgctgagctaacattcagtatcctgccctacctgaacactgatttcttaaatacatacttttctatggatgatactcaaatagatcctatcttgctgcccttagctcccaaatgccccttgtccatgcaggggagtgctggtgctcaggcacttctgcacttctgtttgttaaacattttgaatatcactatccccacgtcacattactatttaactacttcatacacaatatccgcctatactcacatggaaaatattctattaattacagtacctagaacccacaagaatcaatatcttctgttcttccacaagttattatatataaaaaaagatcttggtcaaatggagtatatgtgtacattgatttagcaggagtaacagtaatttcatgaatttggtaaattttcgtgaatttagatgtcattaatctatgcatcttggctttcatttcttttgataagaacaaaggtggccgcgcacagtggctcacacctgtaatcccagcactttgggaggctgaggcgggtggattatctgtggtcaggagttcaagaccagcctggccaacatggtgaaaccctgtctctaacaaaaatacaaaaattagccgggcgtggtgatgcatgcctgtaatcccagctactcgggaggctgtcaggagaagcacttgaacccaggaggcagaggttgcagtgagccgagatcgcaccactgcactccagcctcagcgagaagagtgagacttaaaaaacaacaacaaaacaaacaaataaacaaaaaaaagrtttagtaagcagataaatagagcaaaaatatgttttatttataaaatggcaggagaaaaatatttgttcatgtacttgtaacacttgtaacaatgcacttgttattataacaaaagatcttactaaattaaaactgtgcttattagacacgattcttcctatttaataaagtgccttaaaaaatccatcaagtacctatctcccaatctgcaattattatggatccccaaatgtcatgtctgtggttgtataatctagattctcaccaggttgactggcacccccttaaaccagatgcaagaaagtcaagtttcattttataatgtatatgagtgagtgtgaaagggccctgagtaaactatttgagcctgttccttcagtgctcgccagtatggttcttcaatgcagtacttgtatttctctgttcttttttttttaacctgtaatgttcttgctgcataatgttaaatctatattttatgtcccatgatttctagctagttcatttagctctgtttccctggggttgatggaaggaggagttaatatcctcagctttctaacaacagacattgaaaaagatcacgcttgtctcgaatgttactggctctctgagccacactgcaagaaatattacaggcaacaaatagtttcattttcaatttagacacccattatttgatgtttacaggccattcctaattctgagtccagaatttatggtttgttctggcgattatcatcacagcaatctcctgcaactgggctgtgcttcatcgggagctttgtgctgctgtatcagtcctccctggcgcctggaactgatatatagcaccctgtccaaatcaccctgctcagagaggcttagtttatggctctccaaatgcccatcttttctgatgggtatgtcagtttgcacccactcagtgagggggaacgttgacccttgggaaggagggtggtggtcattaaagaaataaaagtctaacacttaagattctgaacccctctgaatcaaactagatgatatcattgattaagtgaaatttactgagttttgttcagtgctaattaataatgaaacatagatgtttcctagtttgacttgtaaacctaagatgaagaatagcatatatatttattgaaaacatggtaaaatagtggtagtaacagctttggatacataagtgtgtttcaaatggttattttatagattctttttgcatagacagtatttagttctgtctctcagatacatgggtgttctccaggctctgttcaataacattaattacagtttactgaattactttagaaatctctgcacattgattgtagaagaatcactcactaaatctgcatttttgcaaggatgtggtgaaacatgtatctattataagtcctgtaaccagaatgatacttcattttaaatcttgctggttgaaatgaaaacaagaatatcttttgctaccaatttctaccgacttctgtgcgttagttgtggcttgtcacttgcccctcctccccttcgaactacaggaactagaactaacaaaactagacaaggggataggtcttggtcataaaggggcttgctactccttcctccctacattaaagacaacttatttagcacttcccggagaggaaggagagacagaggcagaaggagaaagagaaaagcccaatagagataaagctgtgaataagtcgtctccaacttctgtccaacctcaccccctaagtaagttgtgctacccagacagaccagcgaaccagggggtattactctaataatattttctcttatagagtaaaataaaaatgctctttcctgtagggaaataccaccgagaggcaatgaacaccaccaatagtaacatttagtacatagtgatcagatctgatcgagacatcaacacatctgtttctacacgccatcttacagaagaggaaactgagacccacagaaactgtgtratttgcttaagttcacacatctaggaagtggaaaagttaggagtaggaatcgcctctcctctgactcactaagtagaggttttaattttttctccacatcagtattttgcaggaaaaaaggaacttagaaagatgtacttggaattagtcttaggaatatcactttgaatagagaaggattttctttgaagttgcattgtgaattttaaatttgcatcatcctgtgatcagggctctgagtaagtctgagacagcgctgtagagttggactttgcccttaggttgtcctccttttcatgcccttctttccacttaactgacttgaacaccactgtcaggcctgccctctaagaatggtcaatattctacatatttcttaacaaactctcttctttctactgtattttcccccaataatgcatatttcatatgtgggatgtttccaaggtagcttttggaatttaaaactaaaataactaagatgtttaaaaaacaggtaaaatgaagttattatatttttgtttcttgtctcattgattttatacagttgggtaaattattcccttcaccctggctgaaaagtcaatcaatggccaaacttttctagttaccttcagtcttttgtgccagtccctctcttctaatcaataactagaatataactgtcaaaacttataccttgatttcaaytgggctgattttccacagcttagacctattgtaggtaggaaaccagcagttgaaagagaacttarttgctttttattattkttctccccttttctggggtagaagcaagaggaggaaggagagctgaagggaacataaaagttatttctagctctcaggtttctgaaggctgacttttcccataaacttgctgtatcagttagggtcccagcaagagaaaaaaaaacagtgccccaagctggtaatttgaggagagtatattaaagggcctatttatatagctatgaacaaggcttgagggactcaataagggatagagcaagaccctaggcctgcaactacagggagctctgcccactcccaggcctgtaggatcaaggggagggagtgggtcatagaacaagacagggtggctgtaggaagaagacttctgccaggagttgtggtcttcagtagacagacacaaccaacttacagcaactacctggaatggcaacaagaaaataaatctttcaaccctactctcctcctccctgcctatcccttgctttgcacaagctcacctgaaaacatggaacaatttttgtgatatctgggggttgggggaagagagtgtggtgaaaaaaggtgatgagtggatccaaaggggcaaatggaaaaaatctggcacagataaaatattagccaggattctacagataaacagaacgaataggatacatatataagaggagatttattatgggaattggcttatgtgattataaaggtgaggaagtatcatgatctgctgtgtgcaagctggagaacttgggaagccaatggtataattcagtccccatctgagggccagagaaccaggggagccaatggtgtaactcccagtccaaggccaaaggcttagtacaaggttaaggggtgagggagggtgctggcataagtcctgatgtctgaaagcctgcgaaccaggagagctctgagggcaggagaagatgcatgtcacagctggagaagagagagcaaaattgtccttcctctgtctttttgttctacccagcccctcaacagattagatgatgcctgttcaccttggtggaggcattttgttctttactgggtctacttatccagatgcgaattttattctgaaaacagcttcagaaatacccagaaataatgttttaccagttacctaggtatcttttaacccaatcaagttgatgtcacaggtgattttgagggttccttggaggtctgcatctgacctgcagttcacttaatgtgagtgatatcttcttctgcagctgactgcttatttatgaaatccagatgtttctataactccttgtagcttttctctattttactgatctaggcaatagccttggacaaaacaaacaaacaaaaaaacaaggtgaccccagaccagctgtctttagcataaggcccatatctggaccatgaaaaatgctcaaatgttrgaattcattcacatctttttckgcttattcatcagcaagtagccgacctcctttcactagttagatttcttgggagagagttcacaagtgtccactgaatctcagctgccagggactttgcttttaaatgttccattgaagtgtctctttctagactatggagtgagaaagtagggaggagaatgggaattccagattctttatataaatcctctccaataaaccttccctaatctccacatgttttgacctttatacctttattatggatgtgaggttttattcagagccaagtagtggtttttgattatttcttttgaaaatcattatcttggtctggcacagaaatgaggaatgccctatatgtatttagttaaagctaaarttttttaatgaaataaagaagaatggaaattttcaaatattagatggagattttcaaatattagaatctggcaatggaagaaaaaagggagagactatctttgagtagaagccactggtacctctcaagtaatgccatatagatctgtatttcttctgacagtatataagttagatcctgtttatgagatttttaaaaatttaagatgtctgcacaaatcaagtttcataacaaataatattttcaataggctaagaggactgctataaaagaatatatttatgcatcctattgtaaagaaaattattacctactaatttatcttgaaggaaaaatttttatatgccaagtttctttaaagtggaggctttaatttaactttctcacatgctttagaatatgaaactcttcacgttatgaaccttgaaagtgctaatttaggaaagaaatgatagaaaatatttatgttaatcagcaaagaatacatccattgtattcttattttatggtgttaaaaataaacatgtctkcaagacacagattacagttcactgkgaaagtgaaaacaataaccagaatcgtggaagtctatctgttctaagtttcatagactttccatagccatatgtaaaggctatggaaatactttgacagtctattattcaaacgccataaaacccactgttggctgaagtttgacatactgagtattattaaactatgaaaacctggcttgggaaacagagtaggaattagacttaagaaactggaggaatggcagacaataaaatttttacaagatcagtggttttctgattctctatctccaaaaacatggtggagacagaaaaattgccagaaaatggtgattctatttaaaagcgggaaaataatttatttggtctatgtgtgtaatgctatgtcattgcttattagactctggtagtggttctgaatattgtagacaaagtcgttgccatatgagctcacaggagctcacagtgtgatcgacagcataaaatattgcatttctccacgttcgtacagacgcttttatattagcatcacagctgctttcttcaggggtaggcacttttctaaggctggctgctgggtcaggcatcacaaaaccaaaaggatttctagaatgagtcagatcttactccagatcctctgatggtgactcagtaaaaaagttttggaattaaaatatcagtaaagacataatgtgcaatttaatcattaattgatattgaaggatttataaactttggcctagatatctatatttcagatatatgattgactcttcatggaaacacctttaaaagacaaagtcatagtttatattgatacctgtgagtaacatcttcagaaaaatgatttgattttctttttgtagtgcaaacccatgaatgtttatttcatgtttggtgaatatcggttaaaattctgtattctggcgtgagtatctttggtctgagaacacaggcaacaagctggagtgtagtgttctcagtacttaattagttrtttactagactagataccaacagagaactctaatgccacacactgttagagttcagaggaaccctaaagatcatttagtgtaatggcctccttttatgcatgctaaggacatttgagacaggacaagagaggtgattcatcctagttaaggtcaaccagagagcttattttagaaaccccattttctgattcacaggttagatttttatcctcataccaagtttatattgtactacttataggtaataataacagcagtctttgaataaaaacactgatttaataaaatatttaataactaataggatagatattatttttgttaaaaatacaaacactcaatgtattaataatatagcttgaatattacttattagaagtatggttaacaattcttcatttattcattttacccacatccattaattgagtttcaggtgttrtagtagatacaaatgacagatttaagaagtgtcagtgtaraagatgaggcagagtataaataaaagataacaaaagtctcacagatatagtggaaatatatgaagagattaatgaaagaacaaatgagatgatttgtaactttaaatttttatagcaaaattgaggagggtcagaaaaggtgatacagagaatgagacaattgagctgagtctcagattatgaattaagaattttcctgttgaacaagaagagatgggggcattccaggacaaggctggtgtttgaaaaagcacagggaaatcagccagttggtttagttcaagaaacccaagtgtgacattggtaacaccaatgatatgtctaataataactgctaacatttcttgaacccttcctatttgccagctttgtataccctttatccttttattccttataacaactttgtaatatagattttatattatctccactttatgggcaaagaaactaagactttgaggattaagtcacttgttcaaagacataaagctgtcaggtgatggagctgattagaatacaatttcaactggctccacaaacttatattctgctcattatattttataaatacttttataaagcttacataacagatatattgagtttaagttacagtggcttcaagttgtcatggtatggtggcttaagtctgagatgggacacggttctacctgacacacaatttactgtgtgtcctccagaggcaggacatttaaatttactgaacctcagtgtcttcacatacaaatgtgtgtagagttattgtgaacagcagttgagacagtacgtgtaaagtacttattatatgtggtagacatttgacacaatgttgtttccctctcactgacttccagacataccccagcaggcatctacatggggatggcatcttactttcccaaacaatacaaaagtttaagacatttgtagtcttcatcctacttcctctgttagctaaatcattctattcttatatggttaatttttaaaaacctcatttcaaaactcagagttaatttttggcttgttttagttgtattttcacattatagaccttatttctgacagatcatttagcatgccccatcaggtgtcttcctgatacgccattcagtacagtggtattctagaaggagagatttcatttttctttcttatacttgtctgtttgtgtgtctttcatgcctgwaaaatgtagactagaatctgtgcctgtgctatgtgctaagcataaactatttttcaagcaatttctttagagaagaactaagtttaagggtatcatatttcatcttttaccattaaaaggaaaatgcatcattttaaaaggttgaataaaatggcacacatttacaaaacaaaaataaaacataacaataacaacaacaaaaacaacaacaaaaaacattttcctgctgtttgaattccacacagggctcctctgcactgattttcatttgactatgaattagataaatttttatttgctttaaacctcatctcttagtgtttgaggcttcataatttatagggtgagcatcatggccttcctatttcaaacgtctccttttattttcagcttcgtattacacacacatgttttgacatattttcaatggctgtttatgcaagaaattgtgcaataaaagtaacatattattctacaattcttccttttagagaacatggccctttcatagaattttaaagttaraaaggaatatagaaacaatttaggrcaaatattcattttatgggtttggaaattaaggcccagaaacgtaatgggatctgccaaaaccttatccagtcttctatttctctatttatttaacaaataactgttgagcccctactatgtgcaaagcactgtgctagatcctttgagggacaaaatatatgtaagatatttttatatttcaaggatcataccatctagtgagaaagacacattcaggtaagtaattaagcataggacaaatactaatgaaatgagctctttatgagcccttcagcagttcccaggctgaaatcatcatccttgtgttgacctggctttctccttgaaatgacaatttcagttcacaactccatcatctagccagctgtcactgctggaaaccaggacatcagtctagattgttctctttccttcacctgccagcatctgccagtcatcctcctacccaggttacccatatagagtccttaagtctgtggtttttctttatcctgactgccattgcattagtttcaacactgttcatctctctgtggactattactgtgaccatttaatgcttctatttctgcttgtcatctcctcaaatccattgtgcagactccacagccggtttgatataatggactgattgtatcattcattttcttaacttctatgactcccagttgtctatagggttaagctcatttcttggcatagcaaagacctccaggatcaggcctctcctaacacttttactaataaccaaataatctttaaggacctttacctttgctcaggctatacctgtccctgataagctttttctcttctcttcacctggctgacttttatatatcctgtaatactcaattgttacctactcaagaatgcttccttcatcattattgagagtgctgctctcatcaatccatgtgttatcctaggtacctctataaactactgtgtttatgtctatcactagatttgtgcacctgaaaggcagcgactagttcttagcatggtgtcccgcatatagtagatgataaagatttgttgactatgttgacctatttattaaaccaagtgttataaaagaagtataagaactataagaaagtatcatggaagagagtaattaattgcaaatgagaagatcaacaaaggctctatgtaaaatttagtaactgagttataccttgaaagaggtccataaccaggccaggtgcagtggcttatgcctgtaatcccagcactgggaggccaaggcaggaggatcacctgaggtcaggagttcaagaccagcctggctgacatggtgaaaacccacctctactaaaagtacaaaaaaaaaaataagccaggcatggtggtaggcacctgtaatcccagctactcaggaggctaaggcaggagaatcacttgaacccaggaggcataggttgcagtgagccgagatggcactactgcactctagcctgggcaacagaacaaaacatttggaaagaaagaaagagaaagaaaagaaagaaggaaggaaggaaggagtccataacaagaaaagtaagagacaagaaatgaaaagagaggtatttatactagcagagttcttgagttgtaatcatattgcagagaatagaaaagacccattaaggtgtcttattagtggtttagtaaatacagaagtagattatatgaggctttgaacacaatgatcaagactttgttcttaatttcatcagtagggatacagtgaagggttttagagcaaaggagggacataattagaccttatgtttctccactagggagtaagcactttgagggttgggattttttggttgtctatttcttatttactattttattttatttatttttatttaaatgttttttgatatggagtcttgctctgttgccaggctggagtgcagtggcgcaatctcggctcactgcaacttccgcctcctgggttcaagcaattctcctgccttagcctcgcaagtagttgggattacagatatgcgccaccatgcccagctaattcttgtatgtttagtaaagatggtgtttcaccatgttggccaggctggtcttgaactcctgacctcaggtgatccacctgccttggcctcacaaaatgctgggattacaggctgagccaccgcactcggcccagaatttttttttttaataaagtctttcttggcagtttgtttacagatgaagaatgtgactgctttccctatacagtgctgacctgtgccatgtgagtgtctatctgcctgacactccactgtaagtggtcccttttccattagcagggatttgctgacttaataatggcttctgtcaaggatttctttaaggagcagtctcttttctgagcactcgggatataggcaggttctgactgttatctgcagttgtgttttaatatcctgccatttccatctcttgtctcagaacacagaattcacctttagtccgagctcattgatgatttgttaaggctttgaaaaaagaaggaatgagggcctttaagcaggacggggctatttctccttgccttatttatttttatgctatgcaaaaggaataaagaggcataaaatggcttgactgaagccaaataaatctagataaatagagcaaggatccaataaaaagccggaggtgaaaaagtagaaaggtgattgtggttggggataggggatcaagggagaaaaaagcaagaagggagacctttaaacttcctgtcatgatagggactgtttattattgcctagacaatgaaatgtctttgacccagtgaaacattttaaactagggttaagctctgggtagaaattagggaataatttttatagttcctattgaatctctttgtgctgtcacctcctgtcatcctttatttaaagtttggtatgcttctgctgctagctctgagaaagctgacattttttagttgttctgatgaatcacaccacagaagctagcgggtttttacagccaacacaacaggagtctcccatattattcctgatactgtgtgtgtgtgtgtgtgtgtgtgcatgtgtgtgtgtgtgtgtgtgtgtgtgtgtgtgtgtgtaggaggtctctttgtctgtcccacttctgcctcttttttattatctctgctttcatgaagtggaaagcgatacaaccaagagcaaacactgcatgaagctagagaataagggctgggttctttaggtaaaattataaactgtctgagagctcattgtgtatctgtttatgccattgtcctgtatagtcatgagttagctcttcataattccccactgctagcatagagaatgctgagtaggagctgtgaaggtagccacaactttcatctgtgtaattgctgccattgctctgatatccagaatgttattagtgctcatagaaataacctaaccaaatctctcctatttcccttttcttacttctctcttccctagacacagtttccatggtgtacacattccacaatctctttataagaaactaaaacatggtaaagacttactggccttctactgtgtcttcctataggaggcagctgaacatatgtggtgccaatttttggctgtcacagtgcgccagatttggtattgaatttagcagacctgggtccacgaatgccagatatcttgcagtgtatcgaatgatctccaatgatggccatttttcacactttaaatatcagtaacactgctgttgggaaaatataggttgacctgagtttgaggtagataccagcaacctcagctcatagagaactttagctgtgccttgagagctaaatgctaaaatctcctccagagtctctagaatgacaccttcctggaaaacagtaggcctctaatcaaactatgttgtgttttgaattaaattgctcatttatagtctagtcaactctatttgrtaagtcctatgtaagttactatcaggaatagaaaaaaaattgagatatatttgccaatatcaggattctaacagtatcataagggggatgcacataaataaaatgattatattgraaaacactcaaaatgctgttggaaaaaggaaaagtgagactttacttttgagcagggttgttggaagaactccctgtagaaaccagtgaggagtagataggacttcagtaggtgttttagaagatgatctctgaaatcaaaggtacattacatgtaagaactggggagaagagacagaaaattataggaatattgctactgtaaaggagagtatatagcagtacataagagtaaaaaagtaggttaggacagagtatagagagtttttaaatttcttgttagggagtccactgcagggtatgggtttatgcatgagtttagtcattggggaaagtgtcagacatgcttcctcgtggtttatacttggcctcagtgtcctttttcattgagttcgtgctgtaacccccttcagttatcagctgcttaaacttgccttcctgattttcaaggtcttctctcaagatcccttttcagtttattaatttaaacagcagcaattttcctagaggtgaatcacataatgatttttccaatctcttttatgtgagatatcactgcaaaaagtatgattagatttaatcyagttgtcttgcacaaaaataatatgtagaaaataccaaccaaggtgactctctatgtgcttaatagcctaaagatttaggttaaggatataacagagagctgttctgctcaaagaataaaaaggtgttgcacaaattatcttaaagagccaaaaacagcgtccagttcttacttaaaacaatttgttcttggaatattgtcagctaaaattgtggtcaacttttgcaaattgtatgaatttgcactgcatactttatttagtgtttagcaaaattccaatatggctctgcataacttacacaatacaccatggaaatgactttagaaactcccacagaagttgacaaattgggcatctaatgcttttaagctaattgcctgcttagtgatttaagatttgacttgttaaaaatgaagatcagagtttcatgaagataatgctctgcctattgtcacactgaatacaacctaactccgtatcggaaatattacagaagcataaagatgaaaataatgtgagctttaatcaccattctacttagtcttaagtgaaatgctcatgaatcatatataatatagcagttttgaaacctattcttgaatttcaagctgttattttcaggaaatttagaaagcaaattgctaagtgataaagattaattgataccattgcttatgtcgttttttcttctttgcaggctggaaaaaaagaaaggagtaataccctgaatattgctttagacaacatgtgtaagaagacaagagaccttcgcagacaggtgagggaagagagagatatggagtcagaaacataggggctaaatgaaactgttattcattgcaggcatatttgtttcttgttttgttcctttcaaattaatttagaacaggaaaaaaaagagtaaatatatactttccacatttatatattcatacctcaaatgttttttgtggcaaatacaaagcagagaaagaatgtgtgccttatcagacagaattacattcaaattctggttctgttctcatcagttgtgagatcttgggcacatatttcagctctctgagctgctttgaacctatacaatgaaattaataatatgcaatagggctgtgaggaatcaataaaatgcatgtaagtgcctgacccatagcaagtttttagggaatgttgatcaattgattgtattacatcagagttcatcatccaaatgcttaaatccaaatgattaactagtaagtaattcagagaccctacccattcctccttccattttttttcatgatacttcaaaaattagtttttgtaaaagttaagccttctttttaaccttaagtcatcaggaacatgggattagaaagaatttcattaaacaatttataagtctagtatgatgccacaagttaaacatttttccagaaataggaagacttagctattttcaaagacatttgctcttcattcctttcctctgttcaataaccagagttctttctcatgcagaactttcacttggtcatcattaactcatcaaaagggagaaaaagcttttcaactatgaacttttaatgcaatgtattatsgtagtttaatggcaagatttagtaaaatggctaagcaatcttttaatttggacgtagatttggaaatggaataaatagagatctccagccagttaataatagctgcataaaaacataatgttgaagtctgtgaaaatctcagtttctcaactttatgcccttaatgtgaattctgtttctaccatttacacttgtaatcatggaatgtaagagtcagaaggaacttagcacaacctgtcttacgatgcaaatgagaaagcaggtcagtgtggtgaggtgacctgcctaagaggatggggcaccgagtcagaacctgtaccaggactcagaaatttatatcctcagagcgatcctcccctttcgtggaatgatccctattctccatcgtcttcaggatttctaccccatctgcttcacctaggactcagaaaagttgtctctatgagctctcaatgattgtgtctctcgttcgtgtcttttccctctatattgccttcaacaacattatgcataaagagctaatctacatttatacttctaaaggttttagaattattatttttctaaataaagtcaagaaaatgcaattacttgtgtgtggaattaccagatttagcaaataaaagcacaaggcacccagttaaatttgaatttcagattaacaacaaacatggtttagtataattatgtcccaaatattgtatggtacatacttatatttaaaaagttgttcatctgaaattcaaatgtaaccgagcatcttgtattttatattgcaatcctacttgtatttccacctcactaccatcagtgagatatagaaatagcattggggattactaatactattcttcatagtaagaagatactcccatcttgtagaaaactgctgtgctctgaaggtattaacattctgtatggtttcacaggttaacatctccattgtttcaattttctatcagtgtttaacaaaccaccacaaacagtagcaaccatatttgcatctcacgatgtcttgggttggctgggcgtcagcggggccattttctgtaccgttttcacttgtggttttccacatagtggcagtcaaatggcaactgtggctagatttgggacttgatgtttggaacctcagtgcttcttcctgttccctctctcgatacggtgcctaatgttttagggcctctccatgtggcttcaatctctagcagggtagcctagatctctttcatgctgtttcaagttgccaagaaaagggagacggaagctgacaagcattcttagtgccttagctccaaagtcagagaatgctatttcctctataatctgtaagtaaaaaacagtcaaaaaccctgtcccagttcaataggagtaggcagaagttctgtctgttgtaggagaagtggtatgtgtgtacaggaatggatggaattgttagaagctgtctttgaacacctccatgatcttccgttttgatgaagttagttgctatgattctttctcattatcctcacttaccctccccctagtactttatttttcatcctgatgtttacatttttggtagaagtcacagttaattaaaacagcaatataagttatctctacttcttgttcttaagaagtttatccaacagttgttgtaagcatctcacatatagttcttctcacaggaaagagaaagcactgcccttaaaatgtttttctttggagtatttaatgttcatcgtttgctttagaactggttttatcttttaaaactttttttagtaaaaaataagcagagcccatcttcctgcccattcatccttatcccctttcttaaccatggcctttctatcagtaatgcagaaacatttcagcttcagttcagagggtgattggatttcttccaagaggaatgacagagattgcttagaaatatctaaggagaagcaaattatagatttgaggacatcaagatggaatgttctaggaggcgagagtatttatttgtttcaatcttcttcctctgtgactttcttgcctgttttactagagaacaaagacaaatgttcttggcatggtgttctaggttctctgtgatttggccctgacttaatccccattattcttaatgttccttttccttcagctctccttcgcagtgttgtgtcctcctcatcacaccaacacattaacctgttttcttttctctctctctctttttttttttttgtttgagacagagtctcactgtaccgcccaggctggagtgcagtggtgtgatctcggctcgttgcaacctccgcctcccaggttcaggcgattctcctgcctcagcctcctaagtagctgggattacagatgcatgccaccacaccctgctacttttttatatttttagtagagatggggtttcaccatgttggccaggctggtctcgaactcctgaccttgtgatctgcccacctcggcctcccaaagtgctgggattacaggtgtgagccaccaggcctggcccacattaacctgttttctgatgaaagaatctacttgttatttaccagaatttgcatcacttcccgctcaaatacacttgcatctttgtacatatgacttgtacgcttgatgccttccccactcactctccttacacacaaccccaactcataagcaactaaattccagagtagtgtaaatgctattgcttccatgaaacctttgctgttttcaccagctggaatggacctttttcttcctggaacacttacagcatgtgcatattacagcaatgattatattcttctatttttttcttttgtaatgagttttcttcccactgaattttaagtccttataatgatagctatgacaacatctctcatttactaaatgctttgcaaagctctctaccaagcatattcattacattattaatttttattcctaaaacaataaataatgccatggtattgttatctttgtcccccaaaatgagttaacatagcaaacatcacccagctacgtgatagagacacagttctagcccaggtccatccaaccccagcccatatgtgtaatcaccacaccaggggctagggattatggcctattcactttcagaacctcccagtgcctaatacactgattttaccatcatatattattttctttattatttgttttaaatgcctttttaaagttaaattttcttctttctttagcctctttttccgtcattcatttgaaaactgtatacctattgcaactctctcagtaaaaggaggaagactttttaaacattctttactttataaaaaaatttaagcaacaaatatatcttatttctagtttactatacatactaaaatatatttgatttcactaaaggcaggctaaaatttgtatttgtgtatattaagaaaaatgtcttttatttcataaatatcaaagtaaagatgaagtatgtcaaatgggattttggtaaaaacagacaaaacaaaaacttgattaattctttagttgctgagtttctgaattgttaggtccatctctcttccatgttgcatagtaccagttcaccactcagaaaaaaatatgtaggcttttatacctcctggtcatcatcctcatcatcaaataacattatgtatccacaagagacaagtttcactaaacttgcatagtacatacacagtgaaataattattagtacatttaattccaagctttgaaaatcacattttgctatttgatttaaattaaaatggcttttaatttaaaatatttattaaaatttaaatactgtttattaaaatttaatacaatattttaacataaaatattttagtctaaatgtgtttttctgtttccctgaagatgattcctttctgaaacactttctcccctttccattccccttcccatcacaatttcattctttctgttcctttatttggtgggaatggtggggcttttttagacttttcacatagggctttcactttgggcttcaattgtagtgatatatattattttgagatcccaaaccacttacatcagtaggaaatagaaaaattgatgtctcaaagccttttattaaactgtagtgagaaaagatgaaaagcacctcagtttggttttgttctaacatctttcatgcctggccacaaacaggtatttattgaaagtatgtatctgtaattcctattggcctcccactaacttcagattttagtgctttggcttccatttctgtattggcatattgcattcttctttaaactttttgtatatcacccaactgaaaggaatgcattgtgccactgggcaggaaaataatatggaaataaataagatagaggctactttgctattatatgtaggtatatatgactatacaatttaatgaaaacaattccatatgaatatgccagaacatataatgaaaattgcttagcataacattctagtcctttcacatcttgtccctacctacatttctagtcctgtctcataataattcctcttttacagtgagtataattcagggcatggcagaacaaaacccagtgatgtacagagccaaggtagtagagtataattagcaatgagtagtttacataagacattggagtctcttacttggtgcatgatcaaacaacattaataccagacaaaggtacctgtttagatgggttttcctgaaagcagtgactaaaactaggaccttagtgcaggtcatttatttaggaggtgattcctggaagcaagtgttatagaacatgaaaagcgaggcagggaaagaggaaatgatatgctattgagattgctgctgtaggcaatgagagcttgaggatctctgagaataacagaatgtttcccagaattgtctgactaatggatggaggctaggaattttatgcagtagtttctatccccataggttgagggtttcccccagtggtgtggatgctgaagaacttccaggcagtgtttatgctgggttgagaatttcacagagacttggaacaggccctgagatagaataacaaagagacacaaggaaggcacacaagaagcatggaatgtcttcagaggacatggaactgttccccccagcaaaagctgaaatcagagatagatccagaggatgagatataaggcaccaaaagtctataatgtagttcataatagtgaaggtaaaggatcaggaaccagcaagttagacagggactggtgagaatattgtgggttggttgaattagttacactttgttttttgcatgggttaagatgatttcagtgggagagatacctccctgcatctgaccatgtgctagctcctaaaggtttcattcacatccagctcaagtcactgatttctgggcatttccttctgtcatgggacgaaaagatgacaaaagttggcacaatgtgagacaatagttctttttcacctgttattcttgctttggcaataaatcaatatgtatttccagcaaagcaaaggggagtaataagactttttggctatagttgcagatgggaaattatagtgaagtctttatatgaaaaacagkcactctttaaacatatatctcagagtagtaaataccaagtcttgcttcttcatgtcacaatcaaattattaaaaacagaagtttatactcactgtctttactgccttatctctcattcactcttcaaaccatagcaataggactcttcagcccacttttccactgaaactgctcttaccaagtttatcaataacctcttagtattcaagcccaagggacaagtctcattccttttttttaatttaatttatctttaaaatttgactctaatttttttttgctgtcagtctctaagtttttctttattgtaatgtttaatgtattattgtaatattcactcttctactagattataagggatcatgaatttccatcttaacatttccttcaatacctttctcttggtagaaaggtgaggaaatggtttccagaaatatttactgaattgaatgaaatcatttacacagaagagaagatttmacaagtccatgatgggaatattatagttatgtttggtaggataactacatttgaagagcattaacaaagagatatatttgaaagtttgtcttttagttgtgggtaatttgtctctttgtttcttggctattatctcagtctctttttaggccctactctttaatcatgactcctgtaaatgatagtgtttcctaagaggtcctctgtgggtctcctcactctatatggtctcatccacactctccgcttgagttagttcccatatgctggcccttcatggcatatctctagtgtagatttcatctgagctttccttctacatgtctcaattagaatgaaagaagaaaagaataatctacatgtcctaattatgaatgaaagaagaaaagaataaaggggaggataatcattaaaaaatgcccccactctgagaaattagaaggaatctctacttttctcttcagtatctgaaacttacacaacctgtagttcccagctcaaataaattcrtgaccttatgcctgacttccctggtgtacttcctatagacagcaaacacattattcattcagttaaggtctcccctttgccttgtaaccccttrgcactctatactttgtcctaataagtgctcagtaaatattagttgccactagtaatttgcctttctgcatactaagcagaatccttccttggggatcttcctgaagcctttcttaaattgttgatagtcagaaaatttcacaatgcttctgagcaagctcactattttgggcagagatatttttcttccagaaacctgtaattattatggatttattattctatgatcattatagaagacagtactttctatgtagctctatcattcagctctcccaaaatgtattactattcattcccaagtaatctaaaactaaactaagtgtctattcgtttaaaaaaatactctaaaatgtaactttgacagaaaaattacatttttctgtctgacagctatttatctgttttattgtacagaggttattgaactatatgaaggtcttgactcaaaaacctttgggcccatttatagtcattgacattgttaatgaaacatttcaggatattatgattttttttttttttttgtcggggggagtggatggagtctcactctgttgcctgggctagaatgcagtggtgcgatctcagctcactgcaacctcctcctcctgggttcaagtgattttcctgcctcagccacccaagtagctgggagtacaggtgcctgccactatgcccaactaatttttttatttttagtagagacggggttttaccatgttggccaggctgttctcgaactcctgacctcgtgattcgcctgccttggcctcccaaagtgctgggattacaggcatgagccactgtgcctggcccgatattatgatctttaaagactygatattatataaacacaatgaattaatttttcagtgcagttttaaatctcagaaaatatctgctgactagagtaattgcctaattgtcattaataagcttacatgtaatctaattgaaaagaactaattgtagcagaatgttatagttgtttaataatttaaagtgtgagggcaagaacaatgaatgcaaatggggaaaattggacatcaaactcatttattattcttcttgctctattaatctgttatcaactggcataatcggtgatctaacttggcttaattactatgaagtctacaatttagctaatcaaaatttatcatcagttcctccaacaaggtagaaaacattctataatttgtaattataaaaatacaagatgtacaatattatgtgtacacactcataaatattctaataacacaatttctttgagcaaaaaagaaagtattaccatttttaatctgacttccaggttaaatacaacttaagaaaaattacttttgagaggaaaggaaatattgctagatgattttttctttttgcctggatattttgttttttagtttcttaagggacattcttgtatatctttaagtattgtgattttaggaattgtgcaaaaatgaaaaatgagttgtgtaactactgagattgtaagaaaaggaaacacagtgaactatttcctggaaaaaaaaaacctgaatttttcatttcttctcagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtaagcatgctagaactgtaactcactaaagtccaggagaatgaggctcccattctccatttatggttgaattgtacctaaataaaaacttttgacaccgtgttacaaatacagcagagtctggccaaagtaatatgaaggtgtatatgtccgattgtatagatcactccacattggcttgtcttattttttaaacgcatattttattagagcttcacaaaggaactggctaaatgcagaatactttgatttatccttacaaatattttcttcccattctgacttaaaagtatcaaatactctatcacatattattttattatttctctgccatctttttgtagctgcattactctgtcagcctttcaagtcatatttaactatgtagcatgactacagaacaagaatataggaatatacagggtagagatatccaggaataagtaagtaggggtagtgaactggctcatgtccccacaggggcaaaagaagaccataaaactattattccctctgcttggaaactagagacatgggaatgcaccatgatttttggaacaggatagcatattgctgaaggagctgtgaagtgctgatagcttcccaggagagagataatagaacttactgtattatggatgtcaataacacaagtatatttaagagacagcctgaatggaggaatttctaatacaaataagatgacagtattcacaaggccacaaaccagtggcaagaagtgggaaatgttatctactagatccatagatctcagatgatattcagtatggctcatactcatcagcatggctgcaccagttgttcattgctggtgtctactctggttgtcagtggccatgccatatgggttattaaatgttttgactgccacaccttcctataccagtcatgaattctgtggtgaaatatgtttttacggcccaaatgcttgtaaatagtctgtctaataatcagcacgtgaattagaatcacaccattcaatataacatctactgaaaaagagaactttcctaacatctttaacgtggatccayggggaggaggtttccaatgcagctagcatttgcgctataaactctctttctggatctcaatctccagaactagaagatgaaaggagtggatgaatgcatgattgctacaatttttgtagcccaaagccgttccacctccaactttgaaatcttctttgaatttcccaagaactctgttagatatggcaagtgttacaatttcaattggccttagatgtaaataaagatatataacccaaaccaagctaattagagttggagctaatttccaggttattaaactaaatgagagkttgactcaaaaacctttgggcctcttcatagtcattgacattgttaatgaaacatttcaggataatttttaattaattgaattatttattatttatctgcttttatttattccttcgtctacacattccagaaagatttattaactgtagacaccaaagaatgttaaaagtaaggcgggaagaaatgggaacaggttgtaaaagacataactaagcacagtccctgacagtcataaaagtgttatctaaaaatgtgttctctaagctgaagacacaccaaattatgaaaacaacttctttttatgaaatcctctgaaagcaaaacttggtttatgctgacaaaattgaattcctcttcctatttctcagtttagttttttgatgaagaagggtgccttggtcgaacaattctcagaaaataagtactatctatagctcctcttggaaaatttacattcttgaaaaatcctgaagcaaagagacctctttaatttagtttaaacaaattaaatcagcttatctctctttctttcatggcacattactaagacactaccttcgaggaacacttgggaatgctaccttataccaaatgatggtttactgttatgtagacacagctctaagaatttgttttaaagttcaagaattttggaaattctgcattccatgtgaattttgaaagaataaaatcttttggaattatgaactattgggagactgaaactggatctcatttaactcgacatgtttccttaacacattataatgagattatacgaggtttggggtgatatttgagttctggttttcactctggtaatgcttagaagttttggtctaagtcactttcatttctgatgagcttttagtatataacaaaccatcctgaaatttaaagcaactatttgttatctctcactaatctatgggttgactgggaagagctgggcaatttttgcttaaggtttctcgtgtgattgctgtcacatactggcagggaatggagcctgccaaaggttggcctagtccggacatgctaaatggcatattcacatgactggaagtgcgttaactgtcagttgggggcttagctgtggttgtcgactggtgcatcaatacatggcttcttcatgtagcttcagcttttcacagcatggtggttgggttctgagatgagaagtcccaaatgcaagcaagaattaggaagctgcagttgtcatttgtattctattggtcaaaccaattacagagactgcccagacacaggaaaagggagcagtgagactacatttctcaatagaaggaatagcaaagtatttgtggtcactactcttctcagggtttcatttgctttatctataaagtgaaagttagacaggataatatctaaggtcattccaagtttcttaaattctatgatgtaacaatttttttttcaactgagagacttacagacttatagattcctataacaggagaaaataaaaatgatttttaggcatactgcttgcacactaggttgtttctctctctctctttctctctttctctctctctccctctctctctctgtgtgtgtgtgtgtgtgtgtgtgtgtgtgtgtgtttatctcatgaagaagaaaaagtactgcatttatctcccagaaaaatctgtttttgaaaggatcttcctaaccaaagcaacagagaaaatcatcagtaatttactacaaacattgagacacaagtgtctatgatagactcgtggaaaataggagagcctaaatatatcagttttagaggacaatatgagttctccttgtatagactatttaccaatcccctacttccttgctccctaccaccccaccccacagacatgcacatacactcatcttattcccaagttgggcaatttgacatagcacggcagaaagtcttacattctaaatgactttgagaaaaagctattatcaacatgtctttgttttgatacctcaaccatgtttgtcagagaaatctaaaatcagtgaacatgttgaagtaagacttaaatgagaaaaaagcccatatttaaagatttctatcaagtctttgaagaaaacctccacactgttaaaggaactctttaaataatggttaacgtgtaacttttacaaaaagatagtaaaaagtaggactaaacacaaagcagaaaatgaaatattaaaaaagtatgtgggtaataatttgaaaaacaagaagttctggggaattcaaaaaaacaaacrggaatgaggaggacagtggccgaagaatttggtctgaacatgcctgttccttggtggtgacacatctgaggtgtcccgctatactaataatacaggaggagacctcagatgtgtcaccacatctattattgtagtttactataaaatgatcatgggtaatgatggttataaaaccctggatagtgccagtaactggagaatctagatctttgtggctaattttatcttagttatgctgagctgagtacctattatgcaaacttttcctactttgagcatccagttactctgtgttcttggatccacagaaccacagtggggaaggataagaagtcgtcaggagtattttaaaagtcatcttcacatagtgattagcaatgaatgacaaatgtgttcaattaatgacaaatgtgttcatatcctccccagtactttgatctcaccttgttggtgatttagggcaccgttatctctactggcttctgccaataaaatctattgaacaggaagataaaaatatgaaatttagcttaaaaataaaaatattcattagttctagagaggattattgctttgaggctcctctgatagcaaagtctatacagctcatgcccaataaatccacattgaatgaaggaaaacattcatagtaccaattaattttaatttctttttctttctaaaatattgactttgtgaatgctagtaactggacttgaaatatatgtctgagctcagttataaagcagagaagctccctactctactgcatataagtacttaaaattaattattcacagtgattttagtaaatgccattaccattaattatcaaaagcagactctatagactctgttccagagctccctcataaaaagtttctgacaattcaataacatctttcaagccctttgctatatcagagatatagtttctaaccttaaagtggtactataactattattcggaagaatgccattacattcaataaatgcattatttattattaaaaaggctattatgattaaatggctatcacttaatatttctctaaaatcaattttgaaaaatttcactctttttttgaattatatttgttttctgcaagtcaattcatgctgagcactacaatcactaccaacgaaaacagtgaaatctccagttaccctatggattttatcgtattagttattaaatatgacagtattaatgatctaggccgaaatttttctataaattaaagaattttctctatgtggaaagccaggtttgtcggtgctttgacttactcatcaaaaattcatctatctttatgtaccttattttagtaagtttcatgggagcctttcatcagaaaggaaaaagtgggtggacatttaattataatacttccctaccacctacaaagctgattgttcccactcgcaaaatggtgagccctatttagcaaagccccagtgccaagacagaaggctttagaggggactcttgcagtttgcaagaagtgctgattgctatgagctctgctaatttctttgctttttgacagaatgctgttcaagtttcacacattgctttaattggtcatctgttatcaaataaggatatgtttgattataaataaatacagcttttccagtccccttccattcttccttcttctttccctcaaaaaaatataaaagaaaaagaacaaacccatacttaacacttgtacacaaaccaacaactgttctaagtgagcatcttggcagctctcctgttttggtagggaagggatgctataggcgggaatgctttacttatgtagaacagagcacaccggtgtgactgcccactcccttggttataaactgctcagcatcttagtccttttactgttaaaaagatgtggctgaacatgacctttaaaagcctaaccaaatgcacggtgagttcctttccatgttgtagtgatttctttataaattttccacttacggtctttggaatataagaaaagggtaatgattcatttatagaaaagtaagagccttcccacaatcaagtatagatattttcaaatggaatgttagtgtcttagaattcggagaaaagagaaaattatatgggattatagtagtttgggaatttggcaagaagtaaacaataagctgaaccttgaaaactaggcaggcattggaattgaaaaacaaacaaacaaacaaaaaactccaagtagagataacagcatgaataaaggtacagtgctcattcctgtgttccaggaatactgtagaaaggaaatctagataggtaagttggcaggagcatgagatgggatagaggcagytgaacagccttaaatatttgattatcaggctgcacgggttagacttcctcttgtatagctggcagtaacatatctggagaactgtggtagcttctcaccaggaaagggactaaagggaagtcatatttcagtagagcctgcgtgtggactattttgcatctgaatacaaaaatttctaacctttaacaattgattctaatctcacaaacatagattgcatttaaaataaactgcatttaaacctaacttattatcatacataaaagagagagaatagaactagttttaataatgaacttgaaacagaaaagcaagtgccccaggacttaacagcactaggttaaggctggccaataggaattgaaagaaattacatgtatagttttaaattttctaggatccacactaaaaagagtaaaaaactaaacaggtaaactggttttaatatgtttcatttaattcaatataccccaaacactataatttcaatataatcaatataaaagccattaatgagatattttatatttctttttatgctaagacttaaaatttgggatgtattttatatttgaagcccatcttaatctaccctggccacattttaagtgctcaatagccacatggctggtggccagatatcagacagtgcagttctaggtagataatgagcaagttgagagcagaagtgtctttattcattaatttaatacatatgtctttaaagcctattgtgaccatatactgtgctggaccctggacatactgtctagaacctttgtttttgtttcttagtctgacatttagtaagtgcagtgttcaataaatgttgaatgaattattgaataaacgaacatctattaaccccatagaaaatcttgaaatgtggacaacaacgtgatttattgagtaaagtatgaaatatggagacagacttgggtttgaatcctggctaggtgttcttaggaaaaacacttgatatctcttatatctgccttgtaaaagaagtgttccactgcaacctgaagcaagtaggatccaatgaatacgaacacattaaagtaccaaatgccacacagtgtggacatcatcgttcaggaaacatttgtcttccctttcttctctaaatgtttttttcaaaaatcttgcctgaaaagagatcacctgaatcttcagatagctctgacaagcggtgacattttccttttgaaaatttcacttcataaggtaattttcaaatgtatatgttgttggacccttgtatccaactttcaatttcagatagaattgtttttcagcaacattaacaggtcaaaagttgtcatgtgcaaaattctctgctaaaattatgtacccaaagttcttttgttgtcgtttgtttgtttgtttgtttgagacaagtctcaccctctgtcacccaggctggagtgcagtgacgtgatctaggctcayggcaacctctgcctcctggattcaagagattctcctgcctcagtctcccaagtagctgggattacaggtgcctgccaccacgcatggctaatttttgtatttttagtagagatgaggtttcactatgttggccaggctggtctcaaactcctgacttcaggtgatctgcctgcctcaacttcccaaagtgctgagattacaggcgtgagccaccatgcccggcccaaagttttgatatacaattaattggtgggtgaaacttctctgaacttgaaaacttccccagattgacctccaacatggtatttggtcaagaggtaacaagcaaacatgctaactgacaactagctgaagaataatcccagtcttgaaaccaaactttgttttaatcatcagcctgatcatgcactttggggatgatctgttctttttaatcaattcactattccactcaattaaacacaagcataatgagtccctacgacgtgctctttagggcttatatatactgaaccctgctggttaaagcctcattccatttttgtcttttgtgttttaaaatgaatgagttctactcccatgctgaagtgcttttaacaaatcactaaattttggaattcagtttcattatctataaatggaagatgtgagattaaaataattttctccattcctggcattgaaagttctaaaaaccaaaggggagagttcttttatttgtttcatrcatgtaggtaatttgatggtgaatggaagaggctagttaaccagacatactgcaggagtggttattttatggcttttataggatgaaaataactttaaaaataataaaaagaaaagaaaagggaagaaaataaaggaaaataaaatatttagtaatctgtgccaaaatcatgcaaaatactttacactcattacctcattatatcaatgctcacaatgatggagataaatactattattaccattttgctgataaggaaaccctagctgagagaaattaagcaactcacttaagatcacacagctaatatatggaaaagtagatatcagctcagttctatcaatgccagagattaaagggataaaggtagcataataaatttaaaagtagaaagtgagcccaagttttatatgtttaattatttaaatgaagagaggagaaacctttctgaacgcttttggacaagagacctgctattgagtacatcaggctgcaaaaattctgagttgattagatttcttcttattccaccttccttaattagagaagcagagagctgggaagcccacacttctgcctgtaaaatctgcatgcagtcattctttctaactcttaagtaactgcttagctattgcttagcgattagcccaggacacaagacctaagaaaatcagtcatcttcttctaatgagaaagtacaagtagtccatttgtaagttgattggaaccattttgtcttttaaccagtgctatgtatactagttagcttccttacttaatcctcaataggctattgagttcctaatagaagtatagactcgaagggcattttgttatgaatattcttcctaatctaaaatgcatttagagttgccactccctatcactcagccccctcycagccctaaggtggagacagaaaattcaaatgcttacagtaggttaccaagaagtaatgagtgaaagaaagggctcaggagcatgaggctgtgctgaaataatgagtatacactcagtctaaaggggttggcctctactcgtccccagtcaattattgctgtgcatgaatgcaggcctagtgttgacagacattcacatttctcaaaagaactaagaaatatggatttcaatgtaaaagcctgtttgttttgaaatgtagagagctgaatcaatttaaagcaaaattaaagcaaaaacacaatcccatcacttatgacaatacataatgccaagaatcactagttttgcaatttctgctctagggtcaagttttgaaaagacaaggctcaacaaggtggatttttgttaaagatgtctataagatctagaggacgttattttggtgagaatcaggtattgcaactatctagtaaaatacaggaagggaacttgatttagggaagtgggttcctcccagctttctttcctgtagtgatttatcttgaattaggaggtgaattgaagtggattagagaaacacagaggagatcagctgtttccccttatctcctctgctgcttgcaagcaatgttagggtaggggtcaggagagaggaagggggaccttgcaaaggattattcatgtgtatgttagacctagttaaatctgtagctgtgtatacccagaaagtccctttcatgagaaaattaactaggcttggtgatttctgcaagatagaaatgttagatttgatgctttttaagaaatgctcccatcactaaaaaacaaagtcaaatttactctgaattgcgttgatcgctttgtcttaagtataagcaacttgaagagatttgagttttcaaaatcactttgacatttttatgaaattatatatggcgttccaatataaaagtgaaacatccttagagagtttcactttggtgctttgaatcagcctagtgactgtgtactgcaaatgatctctcttcctgtcctcctcttttttcactctaatgtcttcctctcattattttattccagctattggtctagtcagatcattgtgtcaaaggagaattatctatgttgctttaaatttttcttagctagcaatatgatgtttaaagtttgcattatgcttgcaaaagggcaaatgttcttcaaataaatttaaaaataaaacagaagcactgctggtgctagagattcaatcacaatcagaagaaatatactctacctctttgaatcctagcatttaggaggagctaaataaaagtaaatggcaattgtgtatggttgtaattactgggtcytatgggaacttatatgcagattgaattagtttaggattaaacattccaattttgagaagtgggcttctaaactatgaactaaagagaatttgggggttaaaagttgaattaggaaaaggagatgagaatagagggaaagtttagagacagaaggactggcaacgtttagactgaggaatgagtatagatttctatctgtaaataaatatttgtttctcttgtagacacccagaagcggatttactgagtcatatggcacatgcattcccactaacaatgtataagaattccagttgctccacacccttgccaatatttcgtattgataatttttgtgtgtgttctgttttccatttttaatatgtatgtaatattatctcataatgcttcaacttgcatttccctaattacaaatgatatcaatgatcttttttgagatatctattatcgagatataagtcatgttttatacaattcactcatttcgattgtttccaatattccacagagttgtgcaactatcactacaatcaattttaaaacattttttctatctccctgaaactaggtaactattaatctactattaatctatcaaactattaatctactttcaagccctactttctatctctacacattttcttattctggacattaaatataaaggaaccatacaatatgtggtctttatgacttgtttttcacttggcataatgttttcaaggttcacctatgtgtagcatgcatcagtacttcattccggcttatgcccagttctgatgtatactgttgtgtactgcatttcattctctgttcatatgttggtgaacatctgggtcatttctgcttttttgggtgttatgaataattctgatgaacatgtatatgcaagtttgtgtgtagatatactgtttcatttctcttgggtatatatgtaggagtggcatttctgggtttcggtcatatgataactctatgtttaacagttagagaaaccattaagctgtttttcagtggtgccaggctctaccattttacattctcatctgcagtgtatgaaggcttcaattctctacatgccaacagttgttactatttgcctttgattatagccatcatcgtgggggtgaagtggcttttctctatattttcctgttggctaatgatgttgaatagcttgtcatgtgcttattgttcatctgtatacctttttaatagaaatatctatttggatcctttgcccatttttatgaattcttgatgtaacccccttatcagatatatgattcgcaaaatttttcttccatgctgtgggttctcttttcccttttttgatggtattctctgaagcatgaaggttttacattttgattaaatgcagcttatctatttttttcttttgtcatttgtgcatttggtttcatttataagaagtcattgcctaatccaagttcataaagatttatttttatattttcttccatgagttttatacttttagctctcacacttaggtgtttgatctattttcagttattttttgtacatggtgttaggtaagagtccaatttcattcttttgcatgtagattcccatttattccagctcatttcttgaaaagacaattatttttcaattacattgctataaataaatcaactataaatgtgagggtttatttcaagattcaattctattccactgatctatatgtcaacctttatgccagtaccactctatcttgattactttatctttgtagtaagatttaaaaccagaaagtatgaatcctccagtatcgttcttctttccattaaggttgtttggcttttataggtcccttgtatttctatatgaatcttaggataaacttgtaatttattcaatgacaatctgaaatcttgatagggattgcattgaatctgtagatcagtttgggagtatttccatcttaacaatattatgtcttctgatccatgaacacgagttgtctttctacttatttagatctcctttaatttttttcaacaatgttttgtagttttcagtctgcacttatttcattaaatttattcagtaaattttattatcaataaattttattctatttgatgctattgtaaatggaattatttcttaattycattttcagatttttttattgcagtgtattgaaatataatttgttatttgtgtgtgtgtgtatatatatatwtwttttcttttttttttgagatggagtttcattctttttgccgaggctagagtgcaatggtgcaatctcggctcactgaaacttctgcctcccaggttcaagcgattctcctgcctcagcctcccgagtagctgggattacgggtgcccaccaccacgcctggctaattttgtgtttttcgtagagacagggtttcaccatgttggccagactggttttgaactcctgacctcaggtgacctgcccacttcagcctcccaaagtgctgggattacaggtatgagtcaccgtgcctggcctgttatttgtatattaattttgaatcttgcaaccttgctgaactttttagctctaattgttgctgtgtgaatgtgtgttccatgaaagggctgtatatacaaagcatcctccaaaggctaacagtgaagaaagcaaagagtgaggcagacaaatctagattataggaaaatagtgatttattgggagaacttacaaatggaagcatgtcttacacagctgcaagataggtagatctctgcaccacaacccccttagtccaggcttgaattggggaaaaagtatatgtgctccagaaggaatgagtaggtagctatgggcctcatagcctatgatgtatgcaacaccatcaagggttgttttggaggaaagggaaaacttacagtgaacaggtatttctatataaaaagtaatacatcagctagacatcttggaggcattcctagacttagggttagtcaggagtcacatggcagattagcatttaaatagagtcactcttgttcatacagtgtgtgtgtgtgtgcgtgtgtgtgtgtgtcttccttaggattttctatatacaagatcatgtcatctgagaatatagctatacttcttcctttctgaagtggatatcttttattttattttcaagccctattttcttattttgtattgtttaaaagttgtttatgtatttagaatgcaagttttttattatttatgggatttataaatatgttctctatttctatggcttgtttttctratctcttcagagtatcttgtccatggcagaacatttaatttcaatgaaatcaaacttattaaatttactatatatggattatgcttttatgacttagataagaaacttttgcctaatccagaattatgaagactttcttctatgtttctctggaagtctgataattttagggtttgcattaattattgtatattagttaattagtggtgtgaaataaagggtcaaagtttacttatttattacatatggatgtctaattgtttcagcgttatttgctgaaaagattatcatttgtctattaaatcatgtttgtacctttgtgaaatatctattggcctatatgtgtgggtatgtctctggtctctgtgttctgtttcattgatctatgtgtctaccgtttattcaagattgtctttaaaactgtaactttatagtaagttatgaaatcaggtgttgtcagtcctctttctttttctttaagaaaattggtttggctactctatttctttagcttttccatgtaaattttagtataagcctatcagtacctacacaactattgttaagattaagatagaaatcatattgaatcgttatattagtttaaaaaggattgagatcttaacagtattgagttctccaatccacaaacatggtatatctctccaattattcaggcctcctttgattttttaaatcaatgttttgcagtttttagcattcaaacatttttaattgccaaaaaatttgccacctatttttatactacataaatccattgtaagctttttaacttattttgttagtttatgggtttttcttttttgtgtgtagtacacttaaaagaaattttaggaaagttgcccattaaattaactgatttgatgtataaactaatttaagtaagaaatgtgatgctgcttttaaaatcaaaacttgttagaaccttggaaggcagtatagtctaatgtagtaggaaagagcatagagtgaaacaaatactgatttcaataccatgtgaatctgagcaacttagcccatcattctctcattaggaagatgaagacaatgtctatggacagcacacctattcatttattgggacaatccaatgaggtagtacaaataatattacaataaatataaacctaaaaagtcctaggttgggaaaaagaaataaaactgtcttcgtttgtagatgacatgattgtctatgtcaaaaatccaaagcattgactaaaaaactctttctggaactaataaatgattgtagaaaggttgcagaatatatgattaatatacaaaagtcaattgctttcctatatactagcaacaaacaagtggacaagtggaaattttttttttcaagatagtctcactctgtcacccaggttgcagtgcagtggcacaatctaggctcactgcaacctctgcctcccgggttcaagcgattcttctgcctcagccttctgagtaggtgggattacaggcatgcaccaccatgcctggctaatttttgtatttttagcagagacggggtttcaccatattggccaggctggtcttgaactcctgaccttgtgatccgcccgccttggcctcccaaagtgctgggattatagacatgagccaccacgcccagcctggaattttaaattaaaaacatattatcatttacaccttaacaccctcaaaaatgaaatacttaggtataaatttaaattgaggaaaactacaaacctctgatgaaagatattttaaaagtctaaataaatggagatactccatatttgtggacaggaaaactcagtattgtcaaacatgtcacttcttcacaactttatagattcaatgcaatctcaatacaaatcctagcaagttattttgtggacattgacaaattacttctaaagtttatataaacaggtaaaagacacagaatagccaactcaatattgaaagagaagtacaacattggaggactgacattacctgccttcaggccttattgtaaagctrtaatgattgaaccagtatggtatttgaacaaaaaaggtaaatagataaatagtatagaatagagagcatagaaatagacccacataaagacagtcaaccaacatttgacaaaggagcaaaagcattacaatggagaaaagatagtttttcagaaatgatgctgaaacaactggacatccaaatgtggaaaaatgaatctttacacatccccagcaccctgctcaaaaattaactcaaaatgggtcatagacttaaatgtaaactgcaaaaccataacacttttagaagataacataggagaaaatctagatgattttgagaatggcaacaactttttagatacaacatcaaagtcatgatcaatgaaggaaacaattgatatgctggatttcattaaaataaaaacaatctgttctgcaaaagataatatgaagagaataagaaaacaaagccacacacatgaataatatatttgaaatacatagattccataaaagactattatcatccaaaatgtacaaagtactcttaaaactcaacaataagaaaacaaccaaactgaaaaatgaactgaaggcctaaacaaatctctaaccaaagaagatatacggatgtccaataagcatatgaaaagatgttcaacatcatatatcattggggaattgccaactaaaacaacaagatactattacacatctaataaaatggccaaaatccaagatactggcaataccaagtgttggtgaggatgccgagcaagaagcattgtcattcattgctggtgggaatgcaattgctggtggtacagccactttggaagacagtttggcagtttcttacaaaactaaacatactgttaccataagacccagcaatcacactccttgatatttacccaagggatttgaaaacttatgtccacactagaacctccacatggatgttcatagaagctttattcataattgccaaaacatgaaagcaatcaagatgtccttcagtaggtgaakgaataaataaaccggggtatatccagacaatgggaatattactcaacacaaaaaaatgagctaccaagccatgaaaagacatggaagaaactgaaatgcatagttactaagtgaaaaaagccaatctgaaaggatacatcctatctgattccacaatatgacatttggaaaagacaaagctatgtggacagtaaaagattagtggttgccaggggatagtgaagagggagaggtgaggaggtagagcacagaagatttttagggcagtgaaactgttttgtaggatactgcaacggtggatacatgttattattgtcaatccgcatgcaatgtacaacaccaggagaatatctttctttctttctttccttttcttttttttttttttttttttttttttgagttggagtttccctgtgttgcccaggctggagtgcagcggcacaatcttggctcactgcaacctctgcctcccgggttcaagtgattctcctgtctcagcctcccaagtagctgggactacaggtgacagctgggactacatggtgactacctgccaacatggctggctaattttgtatttttttttttttggaagagatggggtttcactatgttggccaggtagtcttgaactcctgatctcaggtgatccgcccgccttggcctcccaaagtgctgggattacaggtgtgagccaccgtgcccaacctaggagaaaatctttatgtaaactatggactttgggtgataatgaagtgtcagtgttcatcgattgtaacaaatgcaccgctgtggtgcaggatatagacagaggggtatattgtctgtgtgtgaggacaggggtgtatgggaactctctgtactttctgcttaatttttgagcacctaaaattgctctaaaaataaactgaattaattaattattttattaattgttaattggtttattcatttaacaaatctcaggtaaaatgaacatctggtgggataaaagaaatgctgagacaatgtcccatttaaaaatgtcttttattcatgaaaattttaatttatctctgatcaacagttaaataatatgatttaagcatttttgtttaaacatagaaactccaggatattaattatataggagctgcagtacatctgtcagctataaaatatacctaggaaagcagccacaagaggacagtcacactcaaattagcagatttatctgatttcaaaaatggaacaatttttaactacattggcaaggagcagaacagaaacatgaaagcagtagtataatttttaaaaaaggtaaccttgaagtcagtgaaaatgtctgcggaattgctttttcaacacagagacacacaaatggatctcacatttttgttttcagaactttgaaggttattaatctccagattcgaacgttttttgtaatcaaactttttcaatttccaaagcccctttgcagttagattccctcgtataggtttggcatgagatggtgctgatacctttgatgccagagtcgatgagctctgtggtaaggactgacagcaggaagcacagacaccagctttctttaagaaatggactgtcactgtcaattctgctgtgtagagaagtctggactcttgtcagtatgaatctcccatttgacctatgagttggtgccagtggagaaaaaaatcccctcactgtggacgtaattgtattatttttatgattgttataaaccttttttagaaagcaagaggaagataaatgaggaaaagcatagggatcacccaggatttatctatttctttgcttgtttctaggataccttccttcctaagaactggagcagaacagcccacaccagagtagttattcatcacaggcccaggtgactctgcttttggagtcctgttttctaaatcccccagtatatgaaaaccacattyccatgaccaacccacatgtaatttctggaatttgtggtcagtcttagacattttctgcggggagctaagaaagattagatctgagttatgactggaaggtagctaagtgacgtgcataggtcagttttccataattcaatttatgttcagaaaattcacagctataaagctacctgctgcattaaaacaggattgtagtgatgcagtgagagtgtgacctgcaggcagttttaccggagctagacaggtctcaagatttccatggttgtgatcattatttaaaggcagacttcctactcacaagtgtggctgctattaaccatttagtcttgaagaatttcaaatttatttattattttcctaagagtaggaaggagttattttgaccttgttaacagactgagtgccttttctatccaagatatgaacacacagtaaaaaattaaaaagcattaaggcccgagacaatatatactttctaagcttgtaagcaacatttaagtgaaataaagtcaaaacatttgaattaggttctattcctggctctgtcacttgactttggctattatgcctttgtataaaatacatttcaccagcattttatttctgttatgcttttaatctccattatattgatgaaaagacttttttttttctcttggaaaacatcttgacattactgactaaaaatctataaagtatgccatgaataatccctactaattactaatcgcagttccatgacactgcattcctttgtgcacatgtgtgtgcacgcacacacacacacacacacacacactgcatccatttttggcaacatagaaaaggaatatttttaaagttgtgagtgcagacattttaggattgactcttattgggagaaaaatagttgtgcaaaatttgatacttatggggagtcaagggactctcaccttcatctctctctctctctaccacaatttttgtgtagagagacatagaaggtatccacttatagttacctattgtagtgagtgaacctctttgtgattccatttcctcaaatgcagaatggggacaataccactttacagagtagttgtgaagataaaatgacatagctaatgtgtgaggacttagaaaaggaaaaaaaatgctatgcaaataatacttgtagtaatattaatagctatcctgtgtaaatgcttttgcatgccagactatgttacaggctttatctcagttagatattatttgccaaattttatagaatgttaagaatggtgaatcagctttttgacatcacactgttagaagatagtagagctagaatttgtacctaggtctaaactaggtctaaatggattcaaagtccataatcttttgttttctattatacctttcataaaatatttgtctttgtcttcactaataatttttaccttgaaatttgttttcctaatattatctagtattatttrttagcatttgctcccaatggcaaaaccractttgttacgtctgattggaccgaagacagccagagagatggaaaagcttaacagaccttctagtttgcatttctttttcatttggcaaacaagaaaattaaggaacatgccgatggcatatagttagttggtggaaggttaactgactaccagatatctcaattgtaaataccattaatatgacttattatctaatgccttatcatggataatattgtgtgtcttttcttcccagctatgttatcagcacttaaaataatggctgtctgtgggccgggcgctgtggctcacgcctgtaatcccagcactttgggaggccaaggcaggcggatcacgaggtcaggagatcgagaccatcctggctaacacagtgaaactccatctctactaaaaatacaaaaaaaaaaaaaaaaatagcgaggtgtggtgatgtgcgcctgtagtcccagctactcaggaggctgaggcaggagaatggtgtaaacccaggaggtggagcttgcagtgagccgagatcacaccactgcactccagcctgggcgacacagtgagactctgtctcaaaaaaaaaaaaaaaaaaaaggctgtctgcattatataccattagatcctccatgtatgggacatatagtagccattctacaattaattaaatgatttaataaatgcagacacttatggagcacatcctttgtcagcaggcctggcttttaagggatggtgagcagaaactttagtcctttagatattctgcacaccttgacaatgtatttttaaatggtagagttaataccagcagataagcttgttctttggtgtgatttttaccaagtttactgtttgaccttggccaatcacagaataactaaatatgaggtaatctggactttttacatcaagttttaaaatatttagaacctatgtggttacttctgcatatgccaaacttgaacaggcattacacttgaagctaacaaataagatgttaacatgatgcagtgtaaagagagctccagaccttgtttgactgaaaactaagaatgtgatgacagcatggtggatgagagctgagaagcgctgggggtggagctggctgtgaacaggtgactgagtttgtgccaatccatataaaataatgaacccacggtcttgaattgtgactcttagcttttaaagagcttttgtgttagtgtagttaaaacaatttagcaccttgaaatcaagtaagatatttcaaaggtcattaaacaatcatttttgggtgctgacttctgaaatattttattacaatttattcctcaacataaaaaccctagaactcctaaagatatagtgattatacctcagattcaggagtttcatttattcatacacaaaagaggcttaattacactgattatttttctctatgccatttggtaagcattttattttaggggtatggattagacaataatccttataaaacagtatttgagattttaaactaagcaaattagccaattatataataacattatcctgaaataaagtcaaatatttaaaatataaatgcaaggcaaacaacttttctctactaacctctaagaagccagtgatcattagatactrtctagaaataggtgatatggagcactggaaatagagttgtcctgaatcacaagacaggacaaccccaatgtcctaaccccaatgctctcattaactagttgagtgatcttgacaaaatgttaaccttttcattaaaaatatggaagttgatgatctataaggtgcttctaacactaaaacaaaaacaaaacttaattctttgatccaaattagaatgtcatgtgcaaaagacatagagtccttaattatttgaagaaacagtatttttggccaattcaaaggaataaaaactatactaagaagagctaaatagacaagcaaaccttaacaaattgatcatatcagttcttggtgcatgaagattatttgtaaaacctaaaaagtgatccaaagtttcctttttcagcatggattcggatcattttagaagctcataggtctgagagcgtgcatttgctctgtcatagtagtcagtttcttgcagactaaagccctgccacctgcagtttacattcattcttccctctttctgcttttcctcctcttcctccttctttcctttttttttttttttttttttgagatggaatctcactgtgtcaccaggctggagtgcagtggcactatctcagctcactgcaacctctgattccctggttcaagtgattctcctgcctcagcctcccaagtagctgggaccacaggcacacgccactgtgcccagctaatttttgtatttttggcagagaygggatttcaccatgttgaccaggatggtctccatctcttgacctagtgatccacccgccttggccttccaaagtgctgggattacagtcatgagccaccacacccgacctcctcctccttctttctatggatctcatttctactctttctgaatgcattcttcctatacagttttcccctttatgaataactagaagtacctcacaccagacatgttacaatccaattaggtggattatagttttccttaaagcagaaataggcaagtcaggtctgttcaagaatatactctagtatctccccaaaatggstttagagtatctcagataaacccagataaagtctcatattttcagaaaatatttgcaatatctcatattaagggttaatttacatataagtaaatgtctatatctaggtaaaaagtcatatgctgatgactttattaattttatttgcagagggtaaatttgtacgatcttttcctctaattctaagggtttttcctctttagagattaggtactattctgtatctacatggatacaatgatgcctgttcaccttttagatgtctgaaagaatattacaagtttatccctgtaaaatacatgtatcttacatgtctattataatcagccagtggggaggtgtttggggtcagccagtcatgttggtgctcctgtgatcataccaagaaggtaaatgcattctcggtttgtgtgttggaaaatcttggatcttatgtccaatacataatttaaatgtataccactttactccatatcaatgaaaataagttagagctttggtctttcaggttgttattcaaaaaaaatcatgtataaacggtagaaaaccaggggcagaggaaatgatgtaaaatataaacctactatctgagcagtatagttaaaaggtaagatgtttacatattaaaatattccatcaccagagatactgactcatgagcaggtaaaaatgtcaaacaaataaacagaaattgagaacaccagaagaggacgctttgtcttgataattagatatcttcctaatgtatgagagaatcctggtgtattgggtgaaattcacccccgatatttcacataagttcttttctgtattccctaagtgtcagccrgtctgagaaataaagggacagagtacaaaagagataaattttaaagctgggtgtccgggggagacatcmtgtcggcaggttctgtgatgccccctgagccgtaaaaccagcaagtttttattagtgattttcaaaaggggagggagtgtatgaatagggtatgggtcacagagatcacatgcttcacaaggtaataagatatcacaaggcaaatggaggcagggcaagatcacaggaccacaggacctgggcgaaattaaaattgataatgaagtttcgggcatgcattgtcattgataacatcttatcaggagacagggtttgagagcagacaactggtctgaccaaaatttattaggcgggaatttcctgatcctaataagcctgggagcgctatgggagaccagggcttatttcatcccacagctacgaccataaaagacagccatccccaaagcggccatttcagaggcttcccctcagggacacattgtctttctcagggacgttccttgctgagaaaaagaattcagcgatatttctcccatttgcttttgaaagaggagaaatatgcctctgttccgcctggctcaccggcagtcagagtttgaggttctctctcttgttccctgaacattgctgttatcctgttcttttttcaaggtgcccagatttcatattgttcaaacacacatgctctacaaacaatttgtgcagttaacacaatcatcacagggtcctgaggcgacatacatcctcctcagcttaygaagatgacgggattaagagactaaagtaaagacaggcataggaaatcacaagggtattgaytggggaagtgataagtgcccatgaaatcttcacaatttatgttcagagattgcagtaaggacaggtgtaagaaattataaaagtrttaatttggggaactaataaatgtccatgaaatcttcacaatttatgttcttctgccatggcttcagccagtccctccattcggggtccctgacttcccgcaatgctagtgaatgtgcagtagaacccagcaaaggccaaacactcatccaacctgttgtagaggaggaatccatgcattgtgtagtgaattgtattagtttatcctgaaggtctcttcmgctctgaaaatctgaatttgtgttttcccagccgtcagtttagatgacttgtaaattgaaattacccatctyggcccagccttatataaattgctctgtgaggcctcccctcactcttgctggtatcagacgttttcttccatggtactcacaaagtactttggtaatgtctttagactttgtattttgacttacctgccccctatgcaatgatacatctgtgttttcctggccttgggaatttgcttgtatcatctcttcccttccacctagccattgatccactatcataacccagaaaaagccttctttactttcagttcaagtgccagaagacttcctttatctgcaccagaaggcattgctttcacttctgaaatctactaagatatcatttaaaaaatctaatcataatttatctttgattatagcagtagcctccaaacctaatatgcataagaatcacctaaaggattttataaaatagtgtatttggaatggttgtttaaacaaaaattctgtttcactaggtgattccatgaatctgcatttccaacaaatccacaagtgatacctatgatgttcatggaccacgcttttagaacagtggcacagtctagattgtaagcttttcaaagttcaaggcaagattgcttttcctctccatattatgtatcagcttcaaagagatatttcagcttcaaaatcccttgctctaggaagtgttctatgaatgaagggttaaacaaggtcaagtggaatttaatcatacttatcttctaactcatgaaactaccatagtgataattttgtaatggcagaaagagaggcaagtcaattgcaaaaggagcttctgtttgtgtctgtgagaataataatacatttgaaaaagaaacagcattttcacacagagaaaagcaaactgtagaaagcaaaagagaaatgaacagagcttattttattccacttaaatggaactgccatgtgctggaaaatctaaatttgttaattccaaagagaattaggaaaaagggactaattcaatgcatgaaagaaaaataatttgacaaaattgaatattacagtgtaatcacataaaggtagtctgaaaatgtctgtctgtggagttgaaacataaaatcttctaaacctagggagcataaaccccagagcctcacagatgctgtgccagtgtgggacttctgtgtttattatattttgcatcgtcattcagaaactgttcttacaatagccccagcctaatttctttcattattaaagtacatggtggtattcttgctgattgagtaaagtctcaccatgtctggtcactcttagggaaacaactttcaagatattaacaggactaaaacattaataccattttctttttaataaagtcccccrctcttgtttaataactcaaagcaacaaagagaaagagaaacacagtgacccacaattctgcactcaagacatgattccccaaatgatctgaatctggccagccaggaacaaacacctttcctactccattcccacgttatcttgcacgtgcttaatgttgtctcaggagggctttgttcttcatgttttaatacacacagccagaaattagaatttttctttgtataaactttagcaagtctctcagatatatatgtatacacatatgtatatattttatgtatatgtttgtgtctacacacacacacacaaacacacaamtgtactttccccaatcagacttagctcaatttttgtattaggaaatttttatttaatcccccactaaaaacaagtttattccagatataatggccagtacgttacaaattagtcttaacaatgtacytttaatggttctattagacaatgaaacacatttcatttccaactagcttttaaatagctatctatatataagataatcttaaaaagaaatctaatagtaaaatgcataaataatgtaaataaatatatataaacataacatattttaactaaatcactagctgtggatgcttaattcacctttccttacatgctcgtgggatagctgtgaaaatacacactgatataaagttaaaaaatatttcaatctgtgattgagctcccttggaagaattgctgtaagttagggattctgaaatttggtgcccagagcagcagcatcagcatcacctgggacttgttggaaatgcaaattatcaggatccaccacagtcctattaaattagacggtctgggagtgtgacagcaatctgttttgttttgtttttacaagtcctccaggtgattctgatggacactaaagtttgagaaccattgctctaaatacagtagagatggaatggatccagaagtgattagaatgggtgggagatgtctttcattcatccccactctggatcttttgttcagagatttataatctctgtatatatctagagaatttagtgataatcccaggtctatgggtgactgagatgactgaaatttattttgtatcctcctccacatccccctcacacatcactatctttcttcctctattctggagattgcaacttccatacagcatgtttagaggtgaaaagggttgggaaaaccacacaacacatttataaagcaaattataagtagaactgtaaaataccagtagtgcgggaaatagaagaaaataatttcaggctgcttaaaattatccagaaataaatacacctactttactgcaaggattagggaaacaggagatgatacaatctcacttaatctgggtttcattgacaagatcagaaaaggaatatctggatgtacacagggaaatagtgatggagattaaaatgaatacatacacttatttacatgaaacgtgtatatgggtaaagatccccttgttcaaatcgatgaagaccaaactctttctacagaaagagctaacataagaaaaatttgatgtcctaacattgcaaacagaagtaattattttagaaacatattttttctagaatgtatatttgctttttcaataaagaaccagaaaagacaaattcactacagaagagattaaagatgatacaaagttgtcatttgcagagatgcagcttgtgagcataaaaaatatgggatgagaaggaaaattagaaagaatacatcaaactgataaaagtattcattggaggtggtaaaaacagaatcagctaactatgaaatgcagtcagtgacttaaagaacaactttgaaaagtacattaagaatgcagatcaatcaaaaacataatagatatcaaggaaagaaaacaaagatgcaatttgtagatagctgacaatccttgggaattaagccaaaacaaactgaccaaaaagaataatcaaagtcataataaaacagctattatagaactaataagattttggctttgtaagtttaaaaggatcactatgtttcatggaaagctggtgaaaaagacctatgcctagaatatactgttagatttttaaaatgtcaataacaaagtcatatccttcagtgcagggaagagaaggatgttacttaaaagcacaaattttggccgggcgcgatggctcatgcctgtaatcccagcactttgggaggccaaggcgggcagatcacaaggtcacgagatcgagactatcctggccaacatggtgaaaccccatgtctactaaaaatacaaaaattagctaggtgtggtggcacatgcctgtaatcccagctactcaggagttgaggcaggagaatcacttgaaccaggcagtcagaggttgcggtgagccatgatcacaccagtgcactcgagcctggygacagagcgagactccatctcaaaaaaaaaaaaaagtacaacttttaagttagattcaaagtttgcaccataataaatgctagaagaagtcacttatatggagtctcacagggaaaaaaattgcatttcaatatttataaatgtagccatgttgtcatttctatgtgaagacattcttgaaattgtaaaggattcaaaacatatatcattgatgaatcatttttgaataatcctacttgaaaatatgctccaataaaatgaaaaatgagaatgcggcaactaagaactagagaattaaataacatatatacagtggtgtgggcatgattccagttcaacataaagatttttaaaaacttttgcaacactrgccacggaatattttgcaaatgttaaaaaaattcccagagaataaatatatgaaaagtttggccattaaacagtcataatcaacaactgtatcctcaaaatatcttgtcaaatactgaaaatttaagtgaactagaaataaaaaattattttacactagtgtgtgttgggggatgaaacatgcacaggccaatgtttttgtatttttcataaatttgttaatcagaggaaatggtttaagaatgcrcttaaaaatttaggaggatatgaatgttttggttttgtatcactgaagaaaattaaagcacacagtgcagagataaagtgaatcttaccagtcatcataatcaaggcacatagatttatatcccaaattaaattcaaatattcagattaagtttaaaacatttaaagtgttattaaaaatcaaatgtttttcaactatttaccaaaacagtaatgtgattttaaaatatcacattgtaagccatataagcaacctaaatctatttgaaaactcaaaaattgtaagaccacatctctctgaaaacactgcaagaatgctgtaaacgaataatacggattaaatgataaaagcacacagatagaaattttaaaatatatattgtaaatatatattaggtcaaataggaaataataactataatttcatacttttagaatgttttaacataaaattattaaatttttggcccatttacaaagctgtacacagtggcataattttagccttattattaataaacaggtaagatggagcataaagaaggggttcaatttatwatgatagaaagaataatgtaaaattgtattagttgcctgggyrcggcrgatcactcctgtaatctcagcacattgggaggccgaggcaggcagattgcctcagctcaggagttcgagaccagcctgggcaacatggtgaaacccagtctccactaaaattaaaaaaaaaaaaaattagccgggtgtggcggcgtgcgcctgtagtcccagctactygggaggctgaggcaggagaattgcttgaacccgggaggcggaagttgcagtgagtcaagatggcaccactgcactccagcctgggcgacagggcgagactcagtctaaaaaaaaaaaaagtattcgtcacttttcactaggtcttcctccatgacagtacagaatctcaatggctgtaataaatgtttgtttcccagcacgttgaataagagaggctgggtcgttgttgggcgctgtggctcaactgcactctgcaggttggactgatgtctgctttatgcatttttctatttctgggatgctgactgaaggatcagccgccaaatgggaagcatgttcccaaggcaagggtaagaacacaagacacgtggagagggacacatggaatgctccataaagcccctatttggatgtgacacaacttcttttctacctaaatgttattaaagcaactctcatggtcaggcctaggtcagtggagccaaggaatttactctgcccacagtgaaccatggcaagagtgagagctaaggaagaattgtgaagaaataacaatttcttctataatatcctcttcaattaaaaaagtagaagaaaatggaggaaagacaatgatggagataaaagcaagaatttatttattagaagaaaggtatcagaagagttgataasttaatcaactctggttatttcaaacaaaacaagactgacccatagtgaatcaaatagtaagagtaaatatatataaagttataaatgttataaattaaaatggaaatatattaagaataactttttaaaataaggaaatattatgtaaaattaaatcttagtatgtttgaaggtctcagaagccatttttctgagaaaatatacactacctaaattgagccagaaaataaaaacattcttaatgtaccattagtcrtgagtagtatcaaaatgttagttacctctaaataagaatttggtcccaaagtatttagggtttttaaaagaattattcctatgctatagaatttgttgtaagacatgcaaaagtatggaaagctaccaattgatttattttccccaaaaattctataattattaccttataaaaagcctgacaaagataacaaaaaggtaataattatagaattttttattatagatagcaaaattcaatattaaggtgaatcaagaaagcatttagaaaactttcactgttgcctagtctgttatacagaataacttactttaataatatataataaaaaatattrttttatcaataaaagataaaaaagatatttaatcaaaaaatgctgacaatattgaacatcttatctataaaacaaattcataagaactttttgcaaagctagccactgaatatattgcaaatgccttaaaaaagattccgtaatgtaataaaatttcttttttttttttttttgaaacagtcttcctttttttgagacagtgttgcccaggctggagtgcagtggcacagtctcagctcactgcaacctccacctctcgagttcaagagattctcctgcctcagcctcctgagtagctggaattacaggcgcctgccaccacgcccggctaattttttgtatttttagtagagacagagtttcaccatgttggccaggctggtctcgaactcctgaccttgtgatccacccgccttggcctcccagagcactgggattacaggtgtgagccaccatgcctggctgtaataaaattcataatgtaatgcacttttttacatttaaagtcagagttttatataactaatcatttctggctttaaatgtaaaaatagttctccaccagcaccaccaacaaaatacttttgagaaatttagaaataaaaaggtattttcttaacatgctgaaaaatatcaatattatattaacaactaatagttcagattcccattattattattattttatatagttctggaagtttggcttctgtgataagagtggaaataaggaagataattactggagaagaaaaacaacttaaaaggtgttgtttagattatatgtttagagagagagaagaaaagagagagaagwaaattaaccatttttggaatgagtaataaaattcaataagtaaaagaagtttctttaaaaagtcaatatttttttttaaggaatgatgagaattatgtggagctttgagacaaataccatggaaatttatcagaagtgaaaaataagaattgaataaaaaatattggttaacatcttgatataagaaatacatcacaattagttatataaaacttgtactttttggtaaaacatgtcataaataaaattaaaactaattatatctgggaaaatatttgcaataaatgtggccaatataaagttyatatttttaatatgtacagcactcttagaaattgttttttaaagattacctaatagttttatcatggtttattttacacacaataagccattgaaaagaaacctcaaagataggcaaaaaaatttaacaacatcttaatagaaaatagatgtaaagaagcttttcacaaatcaccatactttagttacaaatacagagaaaatcttaggcatgtaatcattttcctaactcattagaaaattatatatacatctgagtaagctgtggattatgtatatacctgagtgaggttaagtaagcattttttttagatggagtataatttgtttcaatcttttggaaaagccctttaacaatacaaattaaacaaataaaaaatatatacatatatatttgtgtgtgttcrtgtatacatatatactttaaaataaaaacatacatatttattctttgactcaacacttctcctaggaaagtgttatctgaaaagttgatcatcttaattataatctgcaatgaagaaaacaataagaaaaatcataatatgttataaattaaggaatatgcttccactaaatgttttatgaaaagtttgcattaamacttagcacaaatttaaaaaacaatataattacaacttttttttctactacacacaagagagwtaaagagatgaaattcgaaagaaaattttaaaaatgttagcagtttttgctttggcaaagaaagaagatatttgttttttcttcttttttttctaaattttctttaaagaacatatcttacttgaatataataaaggagaatatattttaaaaaggtatgacttgaccaggtgtggtggctgacacttgtaatcctagcactttgggaggctgaggcaggagggtcacttgagatcaggaattcaagaccagccwgttcaacatggtgaaacctcgtctctactaaaaatccaaaaatcagctgggcgcggtggctggtgcctgtaatcccagctactcaggaggctgaggcatgagaatcacttgaacctgggaggtggaggttgcagtgagctgagatcatgtcgctgcactccagcctgggtaacagaatgagaatctgtttctttaaaaaaaaaagaaaaggtatgactttgtttaggggataatgtttggctgtgtccccacccaaatcccatcttgaattgtattttccataatccccatgggtcatgggagggacccagtgggagttaattgaatcttgggggcagttacccccatgctcctgttctcgtaatagtgactgaattctcacgagatctgatggttttataaagagcttttccctctttgcttggtacttctccttcctgccaccacgtgaagaaggacctgtttgcttctccttccaccatcattgtaagttttctaggcctcctcagccatgctgaactgtgagtcgattaaacctcttttctttataaatgaaccagtctcgagaatgtcgttattaccagtgtgagaacagactaatcagggtacaaagccaagtggatggcttttccaaggagaacactctgtagtgctaaattagaaggaaattgttcctccttggctaaaactatctttatgtcaatttacagagagagagaggtctagatttttctctgttttgtttgcccacctccaagctcacagtaggctgctcagtgtatttcctgaataaatgaataaacacctagtctagctgactcaaatctgtaggatatgttgcatgggcaacctctccaagccctttactggcatagcaaaggaagagaataacctgggcaaattgagtcaattatttcccctaaagttaaatctagatgttacaaacagctgttatgaactttatttaaatttaatctggtagcagtgtttttgttactattagtttgagcataagagctaattttctgaacttttcaaatcactttgaagggaagattttctcttttttaccaaaaactgttacatttaaggtcatgtcctgtgaattctagccaggcaggaaagctcagagctcaggagctattcattagtattctttagtttggaatgtcatccggaaactccactttcctaatataaattaacctcaataaaccattgttggtagcaaagtgttaaatatgttcacttttccccctttcccatagcaaaagcatgtgcaatacaccatgataaagtgattggataattattgttttagctagggaaagtgaaatttatgttttactctgcttcagaaagctatgttaaaaatttctcatcaaaatgttttctcaatattcatataaatttgaagagttttgcaaaacaaaaatgtggttgtaggtccttagctattaacagctttgcagcagtttacagataaaatggaaatgagagacttacgtgccagagttatgcttaaatttccgaggaaagaaggaagtagrgaagacacaaaaagaaggaagggagggagggaaggagggaataaagaaaaagcatgccactgggaaagtcacccatattggctgaagtttgctttgacttaaatgtgctaattgaactaagccaaaatgtcttgtctcccaattcattagcaatattgtaattaaaagagcacctccagttctagagggtaatgacctttttaattgaacttggggattcagattgctgttgaatartagtgaatttaaatgctcaattcaaatgccaaattttcttctggtaaatgtacaattaggaatcaaatrtgaattcccctagcaatttgctcctgtttttatatatggccttccttggatttcagaggaagactgaatctattgaacaatttattgtgtatttggcccttgactgatccacaataattatccaaaagaaatgttgtcacataattggaaaatacttaaattttataaaatattaccttaaaacaatcactttgtactttcctagggcttcttgttatctctatgattagataaacatgcatttttgcatagttttagtcagagtagtttttagggtcaaatgctaaactactgaaacaaataaagtaagattcaatagctcagacaagatagaagtgtatttttctcacataacarttgcaaatgagtattctgggttagcagtgccttccttccacatagtcactcaaggtcttattctggtagtgcctctgccttattcaccatgtgatataaaagatcactctggtttttattattccagctcataggaagagatcaggggaatgtgaaaagacaggactggtctttttttaaattttaagttcaggggtacatgtgcaaaatgtataggtttgttacatagataaacatgtgtcatggtagtttgctgcacagatcatctcatcatctaggtagtaagcccagaatccattaactgttcttcttgatgcactccctgtccccaccccatgccgacaggctccagtgtgtgttgttccctccaacaatgtgtccatgtgttctcatcattcagctcccacttataagtgagaacatgcagtgtttagttttctattccttcgttagtttgctgagcataatggctttcaactccatccatgtccctgcaaatgacatgatctcattcctttttatggctgcatagtattccatggtgtatgtgtatcacattttctttatccagtctatcattaacaggcatttaggttgattccatgtctttgttattgtgactcatgctgcaatgaatatatgaatacatgtatctttataatagaatgatcttttttttttttttttcagacagagtatcgctctgtcacccaggctggagtgcagtggcacaatctcggcttactgcaagctctgcctcctgggttcacgccattcacctgcctcagcctccccagtagctgggactacaggcacctgccaccacgcctggctaattttttttgtatttttagtagagacagggtttcaccgcattagccaggatggtctcgatctcctgacctcgtgatccgcccgcctcagcctcccaaagtgctgggattacaggcatgagccaccacgcctggcctataatagaatgattttaaaattttttaaatttccttaggttttgggggaacacatggtgtttggttacatgagtaagttcttttgtggtgtttttgtgagatgttggtgcactcatcacccaagcaatatacactgtatccaatttgtagtcttttatccctcgcccccttccaccctttcccctgagtccccaaagttcactgtataattcttatgcctttgcatcctcatagcttagctcccrcttataagtgagaacatacaatgtttggttttccattcctgagttacttcacttagaataatgatctccaattccatccacattgctgtgaacataatagaataatttatatttctttgggtatatacccagtaatgggattgctgggtcaaatggcatttctgcctctagatctttgaggaattgccacactgtcttccgcaattgttgaactaatttgcactctcacctgcagtgtaaaaatattcctttttctccgtaacctcgccagcatctgttgttttttgactttttaatagctattctgactggcatgagatggtatttctttgtggttttgatttgcatttctctaatgatcagtgatgttgagctgtttttcatatgtttgttggctccatgtatgtcttcttttgacaaatgtctgttcatgtccactttttatagcactggtacaagaacagacctgtaaaccaatggaacagaatagataactcagaaataagaccacacacttacaaccatctaatcttagacaaacttgacaaaaacaagtaatggggaaaggactccttatttaataaatcatgctgagagtgctggctagtcataggcagaaaattgaagctggacaccttccttataccatatacaaaaattaactcaagatctattaaaaacttaaataaggctggatgccatggctcatgcctgtaatcttagcattttgggaggcccaggtgggcagatcacttgaggtcaggagttcgagatcagcctggcaaacatggtgaaaccctgtctctactaaaaatacaaaaattagctgggcatggttgcacacacctataattccagctattcgagagccagaggcacaagaatcacttaacgcgggaaacagaagttgcaatgacagaggttgcaccactgcactccagcctgggtgacggagtgagactctgccaaaaataaaaataaaaataaaaaaggrcttaaatgaaaaacccaaaactgtaatataaaaacgctagaagaaaattaggcaataccattcaggacataggcayggggcaaagatttcatgatgaaaacacccaaagcaattgcattaaaagcaaaaattgacaaatgagatctaagtaaaccgaagagcttctacacagcaaaataaactatcatcagagtaaacagataacctatagaatgggagaaagtttttacaatctatccatctgacaaaggtctaatatccagagtgtacagggaacttaaatgtacaagaaaaatacagggctggtcttacaggtatcagtgtcacacattatttctgcttaccttctcctgaaattagccacatgattccttccaactacaggctagactgggaaatgtagtgtttctggtagccacttgcaaaagctacacatctgttactagtaatgaaggaaaaactggattttatggatagctaaggactttgttaatatgtatgtgcaatattgtcttctttctcatgtaacattatttcataaacaatacgcccttcatttagtgagggatatgatgtaagcgtcctactacttttaattccaaaatttcgtcacattaataaagttttaaattaaaaatgtggctttttataccctaaataaatccacaaacatctcctttatcacatttgaattaaaacctttacatttgtgtataaaaccttacaccataatctactaaattttattaaaaatattccctattacttgatgtgcatttgttcctagacaactgggctattggtttgacaaattattttctaacgtactgtaaatttttctgatatacagtggatgagttcacaacattagttaaagctactgctgaattcaacattccactcattaatttactaaaacttctgtttttagctgtgtgctacttctctattagatttatcctaccagttgaatttttaaaggaataacttctccaaaagaaatattgctttaattattaatatcaaagaatgggacaactgggttattgtatatgatcattatcatagtatcctctgaaagtgtataactaacctatacatctggcaaagaaagatgttcttgtttaatgaaatatgatctgcattgagttttaccaatattatttattttttccccttgactagtttaaaagagtaataaactatatactttaatagggagctagactaatttttcaaatattagtcaatttttacctactcttgtagatataactgttgctattcttgatattttttcctaggcaaacttttttttaatgtttgtatcacaagatcttcagatttagagttgaaaggaatcctgaaagtaatctaattttaattctgaagcttgactttcctcttttgtattcttccaagtggttatttagcctttgcmtaaacaatttctagcataggaaaattattgtctcccataacactcaattccatctttgaacatctttgacatatgactgttagaattagttcttgttacacatctatgaaatttaaagcattatgctggtgcttttaaacatgttctcttaggtaatccttgtatcagccttattgttgacatgatttatagtttggaaaaataagctcaaagaggttttatatttagggtcacattgctacttgattgaaggtgaaattttctgctggatttatcagatcttatgtccatgcttttttcaataagaagaattgtctttacttacatatgaaacaaatctgtcttcccaacaggctactgggctactggttttcaaacatacagtggatgagttcacrgcatgagttaaacatcagttactctatgtttaaagttcttcctggcaacaactcttgaaatatttgaagtcagccctcatgtattccatatgctccctcttctctgaggtgaattttatagtcccttcaaatggttacttttagctcttaccttgtctgagccattcttgtctaaatgctttccagtttattttttggtaataccactccaagtgatgttcaaaatagaatgtagtattgttggattggccagactagccaactgtaacatgagattaccatctcaattgttataggaactttattaatgtagtcctattgaattagcttagcaaaccacgttgtagcattcatttctgttaagattggcatataattttatgtattaataagttggcgagatattggctttacattttgaattatatcatacttattctttctaatttcctgttttatcctttgaaaggaacccatgaaattctttggccactctgayttttgtgtcctgaaatttccatgtcattgcaatgaaaaagaatcaaagtatggctgcactaaaaggagagtatttctaaaatataaagcactttgcaaaagcactcaacatacattatgtcgagctcttataactacattataatgtsggtattaacatacatattttactcattacaatttagtaatttgttcaagaccataaagaaagaagtttagaggagatgaatccacccataccgcttttgtttttcctgcaatgtcataatgatattgataagtatatgttatcctaaaggactaattaatcagaaatagattataaaaaagacttagtgatatctctagtattaggccaacttccaagggtcttatgcaacacttgtgctaaaagtgagaggggtgaaaatcattgtgttacaatatctgaracaaatatgcctgtgatttgtgaaacaagtgaggtttcctttccatatccaagtttggaccattgcttcatgcatccaaaaccagatagatcaacattacattatcatgtacttcgtatagctcaaacatatttgaatcttcatatctgccacggtgaacaactgtccgtctgggaagatttcaaaggtggagtaactgggcaatgttgttataccagtgtagaattgctagtggatatttactcttgattctaagttgacagagggcattaaagctctactttacagcactttagcaatgatacatgggtttattgtgttcatcaacttcatttactggaaaatcagatacctggtcttaacctccttgactctgcttaaaggtaaaccccttaattttttcttccccacatcagcaatccaggtctataggagatggtttgtaaatgagttgtagtctctacaaacaaggcaaagatcacctaaagcatattagtgctagatctcttaatatttctttctccagatttttagatcttaagatagaaaatagcctayagttggcccttagtatctatgggttccatatccatgtatttaaccaactacagatgaaaaatgtggttaggtctatagtagttgtgtgtgtactgaacatgtacaaacttttcctttcttgtcattattccctatacaatgcagagtacaataacaactattttgcatarcacatacattgagttataaattataagtaatctaggtatgatttaaagtaaataggaggrtgtgcataggttttgtgcatatactacatcattttatatcagagacttcagcatccatgaattttggtgtccatgggggtcctggaaccagtccccactttgaaacagagtaatgactgtatatttcttcaaatccctttacaatactgagaacagtgctcaggatatggtaggttacatatacacatatttgttgwttacaggtttaactttctaatttattggtctcagaagtagtgagataaaatattgaaacaatgatgatgcaaattagccaaaaggtgatagcgattttcacacataattttaacttctctttccaaagtatgttgagagtttttgtcctaaatgtatatagtgtcaacacatacatatatacacaaattattcaatgaagcttttaaatttcgagatgatatccccttatcacttagcacatttcttctcactgtcaaytggtgtgtgctaagggaatgcaaattaactgtattattaatttaagtaagacataattagtaaggtaaatcttctgccaaaaaccacataacacattccagggccaaatatraatgagctatgattagcctgctgttcctctttattagttcagattaatggcgtattccctgtgggcataaagatgcacaaccatgtgttttctaagggtcttaggaccatttgttaactgcaatgggaacttcacatctcactatcttgtgaggacttcctggtatttaatcaatgtgagaaaggaggacaagtatcaattgattaaaaagcatgaatagggtttgtaagcagaacatttaatgagctaactaaatttctctaccagtcaatagcaaacatgggctcccttcatgcaagtacttcatcgtttcttctcctgcttggtaccattatccagactgtgaatagcattgttgtcagagagcactttcagaaacattcttgrctagaggaaacacagggagtagcaatccattaatgaagcagatttayatcgattaattacattccacttcctctgttcaggcctgtagcacagctccaggaggggaaaaaatatgatgaaagaaagagaaaagctctcaaattaaattttcaagtctgatttatgagactcctctgaaaatctagttttttctaatttcaattatttgtttctctgcttccctgacraggctgttctaacactgcctggattttggcttgttgcctgcctcattcctttcttggcttgttctcattacagcacttttgcctggtaggagtgaagacccttgaaactgggaatccagactatatagagcaaaacctattgctggcaatgggcagttaagagacaacacaggctattaactgatgctgttgttttctggtagccattgagggacactgcatgtgtgccattattcacaatcagggtcaccattctagtccctgctgggattcatttttatcaagaacaagtaagtaagatgactatagaatgtgctgtgcagtgaactggcatttaggattttttttgatgaccttagtccttcctaattgtgttttgtggctataaggccaagtgatttaggcctgtatgtgtgcacaagggtacaatttagagtgttaactgtagtgctattgcttccattcgtagaggattgtaggatttagaaaaatgggcccttgggtaggatggtagcagcatcctccattaatagccataaaagttaggaatacttcaacaacatttcaaaagataaaaatgagaaaacatatgttactagaaacaactatcatgtatctcatagcctgcataaagagagagacattaccagctaattttatattcaaataattataaagttgtggtctgcagagtcagctcctttctctcccctcctctcccttttctttattctttcttgctaggcaggagcagggtaaaaagaaaatccataaaaaccaacaaggtggctaagaagctagaatgatagagcagaaaagacttctttcctgaatgatagagcagaaaagacttcatttctgaatgatagagcagaaaaggccagaatcaccgggcctcacactgtgattggacggaagggacactgactttcctggaatctcttgagtcccaatcctaaacaaggactgtcatgccaagtctctgtctactcaagagccacacttcccccgcccacccccgccacaaccccaggacagatctgattcttattactctacagttgcttgaaacttcttataagtttacagttgtgcctatgagcaaagacttaaaatgaagacagtcctagagaagtaccctcaggaatacactgttgatgtcagagctttagaaccacaaatttggttggagggtcaatggaaaaagtgaacacagatgcagagtgtaaaagcaagtattaaaagtgtgtttctgtgtgtggtggggtggggggagggagttgataaacctgactttgtatggaagaaatcacatttggcctgagtctcccagtggatgtcacttcttttaacttgtaggtttacttacactcaggaaaatctattctctcaaattkcctgggmagctagcaccaattctctgtttatgaaaacatcaaccacagtttagcattttttttttttttttgagacagggtctcgctctgtcgtccagtctaggctcactgcaagctccgcctcccaggttcacatccttctcctgcctcagcctcctcagtagctgggactacaggcacctgccaccacgcccggctaattttttgtatttttagtagagacggggtttcaccatgttagccatgatggtcttgatctcctgacctcgtgatccacccgcctcagcctcccaaagtgctgggattacaggcatgagccaccgcacccggcctttagcattttaattgaaagaaaagacagctgataaatacaacctggttatactataataccctctaagtgctataatatgcttcttctctcagtttcctaatgtcactcatgatccatgctcttgaaactgcatgacataatgtcaggaacattgagtttggagtagaatatctgtgttgcaccacttatggtttttaaaggttttttycctcctaatctgtaaaatgggtatgacagcatgaggattaacagtgatgcccaaaaagtgcctatcacagtgcttgaccttactgggrattcartaagtaagagcaggtattacatttgttgctattgttttgttattaacagtagcgatgaagagccctctcgttgctcccaccttctgtttttatggtctcccaaacattccccagcagggcagcctctcttgctcccttctggctgatgtattttcttagcaacccagaatattcatcattcttaccaggcaactggatgaagttcctctctggtttgcctggttatcacagctttctcagctgagccttcagtgaggaatcatggtccttctttagaacactagtttccaaattttagaattatttatgcccattagtaaaatgatgttgaggctatactcctaataaatgtttctttatttataaataatacatatgcactactatactaataagtaaaacaaagaaattttataaaaattagaatggaaatgttacattcagttgttttcttatrtgttgtcatggctcatcttgcacaccttctggggtgcacagcttgaaaagctttgctcragaggtttatcatgtttttgtaaattagactgtcttgcccataaccaagtacctcagtcatcttccagaaaatgccttccacacccttgggtctctttccgtgaggaaatcccatagcctctccctgcagtatctgaactctcactctagccctcatgctggccctctaacccagtgcttctgaattttgtctgtacgtgtgattcacctggggaccagtccaaaaagtctgtggccccatctcaaaccaattaaataaaaatatttgtgggtctgccccgaggctgtgaagggcctcttttgtttagcccagtgagctgttggactggagtaggaaacatttaccataggtcctgatcaacactcccattctgggaagttggggcctcagaggctactggagagcaggtctttttgttttcttttcttttcttttctttttttgagacagagtctctctctgtcacccaggctggagtgcagtggcgcgatctcggctcactgcaacctctgcctccgagttcaagcaattctcctgcctcagcctcccaagtagctcagattacaggtgcccaccatcacgcccagctatttttttgtatttttagtagagatgggggttcaccatgttggccaggcagatctcgaactcctgacctcaggtgatccacccgcctgagtctcccaaagtgcttgaattataggcgtgagccactgtgcctggcctagagcagatctcctttgcctaccttccttctgttttcctcagtcacattagagagagaagggtcttcctctaaatcccattctggagaaggcggttttgtccaggaccagccaaacctgcacggcaatggccctatcaacttgttgcaaatgaaaggatgagttgaccttatctttctaaagttgaagttttgctttgctctccagctgtttataaagcaagcttgggagtcaaccaaatagagtggatgattggcaggaggaagggaggaaggcataaaaggtgactgccttcaccttcttaccttcaaatagcccttctatttatctcttttctctcttcttctctctttcatttttttttaactgaaggtgagataacgagagagaaggtctttccaatattttccttagcatcgtgagacatctcaaatcagagtgaaataaacatttaattacctggagtgcatgggatagggtattcttctttaagctagtatttatatttgtatgtatgcattcatacatgtaagttaggaaytgcttaaccatcaggaaaaggttttccttccactttacccttttctttcacttgctactttgtcccccattgtgaaaaagctttctaaaagcctgagtccatattcccgcctgagaggtgagttgaaatgcaggcatctagattaatatcaaattatactggtgcctagctgctaccattgaggccaaaaaacatatctcccctctcccacagcaaagtccctctctgccaactcaagaagatctctgggaggcatatatttgcataggaacaaagtgactcaaatatgtttctctgacttcctcacaatggtctcttgcccacaaaccatataaggccactgtaggcatgctgctgcaggtatattctgagatgatcgtgcttctggttaccctggtctctgcaatacttctggtcatagcagtttttctggggtggtacccttgatgccccatgtgcagaagctgctacacagtggatactgtgtactggattctggatactggatcaaagagtatttactgcaggctgatactaaaattgtttgctcattagtttgttgaaataattaagtatatcttttgctcctaaaatgtagaacacatgttatcagatgttaacttagggtcagaaagttcaagtgtaacatatgtggtcataatggcacagacagacaaataaacacttaatataaatcagatactctgtatgtgtctattgatacaccgacattgtactagagacactattaaaaacactattaagacatagattttataatcaagagtcttagaatctgatcaagaaggcagacccacaagaaaacgataaaaatgcaatgaaataaacattgaaaatagaggaaaaacaaagttcgtaagatcacaggacacttaaattggcttgaggaatcaaagtgcaaagatctttgcacagcatatttggagaacattgagtgatttgatacactgaagtcaaagtataagtgcagaacggatagcgcagatcatggaagacggtagtacctrgaaagcaatgtaaattaatgactttccaccacacacagactttctatgttactttagtggtaaatgtgttgcacaaaaagggaaaataaagttatttgaaatgattttaacaaacaattgtcagygacataacaattgtcaaatcaattgttaaaatggtgttaatcaattgttatgtgattttcatttaacaagtattcattgatcacctgctatgacaagcacwgtttttggcctttggggtacatcggtgaacaaaatgaatgaaaatcactgtcctcacaaagcttacattctctttattataagtttattttattatattattaatgatatttacattatattattatatttaattatwatattacagttttattataaatttatttaccataaattactacatatacaaacatgtattgctgcacagtttcatatataatggggagcatactgtattttttggacaatttaagaaatattcagtgttaattttgagtaaaatagctcttttgcctctttttccttaaaatttaattctaagatttgactccactgtagtcaattaacaatggagaactattaagaaattacatgcagatgaaataatatttgcattttgggaagaggacgcaagcagtggagttgtttgataggtgatgcctgagactraygccgggggaactcattaggctgccattgtgtaaaaaataatgcagtaaaataggacaataaggcaattgcaacatttaggattattgagacagagagaaagagtttagaatcattcctaggattctgcgttagataatgctatgatgagtaacagaaaaaaaaaaaggttaatacaggtgaaagtacttttatatcccttcatttcacattcacagaaactataaaagtttggtgccaatgtagctgtacaacttgttggcttttgtttttcttcataactttaaaagaycttttggttctgtctgtaatatataatcatgccttaaagctgattacaattttcactgttaaaaggattcacactttggctaccttttcatttattactcacaaccacacactgggttcataagggcagaggtagaagccatggctgagtagccagagaatctagagctgctgtcagcaaattgaatcgtcagcattctcaaggaaatcacctgctggcttattaaagttaattgcttgcaggtatcaagttccttagccagagctatcaaagtcgctgtgagagaggtgattaagactgtgctgggagcttggcaaagctggatgagtaccatctcatggggtgtcttagcttcagggagactgcttcctacgtccacattgtttgattctttctccttgctcttccaccatcccctactcctgtccccaccacatgccarcttatccaggtaatgtgttaattttgattctctaacctttgacagacatgtattgaacgtttatttccagcctcaaaaagcgctgtgataacacagcctctgcacacaaggaacttccagtctagaataggagacagactttgaaacctatgattatratactatgccataaattctagaaaccgtggtttgtccaacgtgctatcagaaggtataaagataaggtatatagtacatatatatgtttacattttctttatctscctttggggactgggataaaagaagatggaattatttacctgtrtcagtcggggtcctccaaaaggaattggcttacatggcgggggctggcaggtctgaaatctatcgcgtaggttttatataaactcaggcaagagttgatgttgcaatattagatctgaaatttgtagggcaggttggcaggctggaaactcaggcaggatttctatgttagtcttaaggcagaatcccttcttatgggggatacctcagttttctgtttwtttttttttctgtttttatcttttgcttttatggcttccaacttactgggtgaagcccacctacattatcaagggtaaactctttaattaaagtcarttgattaagaaatgctcaccacgtctgtaaaataccttcacagaaacatttagataaatatttgaccagayagctaggcaccaaagcctgaccaagtttttttgctttgatagaccaaagtcgggtgacgcactgcaaatgtatagaagttccaactccaagatatattgaaattattccctaggatagcaccttaaaactcaaccttactcctagggtaaagccatcaaacacctaggtagtgccatgcttagatccaggaaagaaaggtctttgtcctgggccccatgcattagagggccccacatatgacaaaaacacaaacataaatgcctctgttgcctcaattctggcctacagcactggctcagtgcaatctgtaactctaaacattcactctcgtggttaatattactcgggctaccggaaaattcttctccacaatttttcttacatcctagtagcaaaaagataacaaagctcaaatgccatgaacatttgcagtttgaactgctgtcaayatgagagatgaacatcttattttgcagcaggtgggtggggtgggctaggatttgagcactatagagaaaatatacataaattattttcaaattcttccttgtggaatgaacgcaccaaatcattgcagaatcgaggattgttttcctgggtagagctgaacatccattttcttgtatctgttcatgtttcattggtagatttgaaagtccagacaaattagcataacatttgtacacgataagtatattttggattattaaataaatcatagtactcctacatttgtctatatgtagggttagagaaaataagtatgaagtgtgctaccaattcttcatattggcaagcaaatggatagtggatgctcaatgttaaatgagacaaaattaaatgagaaaatgtcagctttaatgaaatattctgaaattaaaatgtgatattccttatatgcatttcagtttttgacttaatagataatttgaatatttaagaattatgaaaaaaataattttatttttgtttttatatttaatttttaatgaaatatatttgaattttctaacttcaatacaatttcattttattttaaatcctttggctcatccctgtcaagaaattaaaaatcttgaccatagcaatataattttgatgaaataaagaggagaaatataaattttatggaacacatrtgtgtttatgaattaagctggtttcattttattacttacctaaacattgctatctcatcaagagaatgcccaggtatgctatcaaatattgcactgaatatctttgatattttgccagcttttagttatctaaaaactattgccttacataatacttttcatttgtcattaaaaattatatatttaaggcagcacaatgatagaacatattttattaaagtttcttagtttttaaataacttttaaatatttaaatgtggtatgtaggcctccctttctactattgctttgggtcctgcatatctaggagtgggcttaccaataaacaattgagacaacatctaggagggggcattaacatccttaaggagccataactattccaagagatggatgacaatctttaacttgtgaactaggggtgggaggatgtgaggtgggataagcagtgccctttmtattttttcctatgcctccttgcccagtaaacagactttctttccttttaaagagctggaggtataaaaatttaatttgggaaaattatgtaggtggacctggaagaagtggaataggctgtaagtaagttattgaaattagccctcagaaatcattctgaaaaaggggacatttgagcttgatctggaaagatgaatggaacccctccaggtggatgaattgtgtgtgggaagaggtgcactaggaaaaggcaaaaaggcagaaaaagcaggttgcttcacaatatttcaaaacatttatatgactaaaacactgggtgggaaggaggaagtggaaagagaagggctgaaatatgagaacagaaagggtattacacgtcttcccaagaacttggcttttatccttcagaagagactcattaaagaagttttaagcaagcaaatgacatgattggttttgccttttaaaaatatgactttagaaccttggttttcaaattttaaaatgcatgataatcactyggagggcttgttgaaacacagatggctgggccccacctccagagcttctgactcagtagttctggggtggaacccaagagtttgcatttctaacaactcctgagtgatgtgatgctgctgatacgggaaccatactttaagaagcactgctcaaaaaagcagaggtggatggtgaatggtttagaaagatgaatctacagaaagtagacaagataggggattactgcaacaaagcagggaaaaataaagggagttttatggaagcagtgatgaagggtctaaataagagttttgagaaacagtacctaactgaatttgcaaggtctggataaggaagacacaagtgttgaggataactgtgtatctggcttgcttgtttttgaatgtatgaaagagcccargtctgtaatctagagaaagagagaaagagaatggatttccattttaattgtagtcattggcgtaaaggtgcaatttaattgaatatcatgcaacaactggattactgaactttgggtgtgctgaaccaaagaagagggaaagttatttacttacagaatatactagctccattaggaaaagtttgaggtaaatatagttaatatgctaatgttatttatcaataacagtcaatacaccatcacgattcgatcattttgggtgtggtctcctctttggagagtgcctcaagcctttaacttaattactctcttacaaggtagatctgttcagaatgggtatttttacttmattatattctatcatgtgattttctctgtagtatgtccttatactttaaaatattattttaggcttagtaaaattaatattactctctttaacaggcagcaggatgcatgttcacccttaatgtttgaatgaaccagggcaagagtataaatgaaggtgtctccttccatatgttgaaatatgtaaatatatgaaagttataagccaagccaaaaattaaatgggatattactggagggttttattgggaggagtgacttgagttttaaatgctgattcagatatgattcgagaatagaatataggtggacaaggcttgtatgaggaagattctgggttactctgagttcagtccagacataacagcragaatgagactctgtggtggacctggaagatgccagaacagtttttattgctgtactgtgacagtgttgccaggatataatctattagtagggaaccagcaacccaacactgtgaattgagcttccaactctaggtgacattttcattaatttctttaattaagatctttattgctcacactgtggacaaaaaccaaacaacaaaaaaaggcctgccaggaaccacactctaaaacayttaaaataccaatctgctaaatactgtcatataaaagagatccctggttagagttactttgggaaccaaaactgaaaaggaatgaagccacagtgattaggagagatgggaagtgaggcaattgcaggaaccaaggtgagggccctgctattgaatattgccagaggaagaaatgatttgaaaagattttggaactcatttctgtctgttgagaaggagaataagatatgggcgggcacaggcattagagagacccagatcatagcagcctgctagctttgtggttctcgagcctcctgtgtggaactaaagctctgttaccttgagggtttcagagagaggttagagaagtccctagagcataagaggaccccttacttaaggtcttagtatactagtaacacagaagcacccagctttcccagaactaccagagacactaccttgagagtggttcccagatgttaagtaaagacataggaaataagtataggcatatgaataattctatgctcaccacagttgttactgtcatgtagacacattataaaggtatgagcttatttgtggtgtagtctagcataggtagctgaatgtgagacgtcttttctatttgtatcagaggaaatgtaaaacaaaatcattcagcatgaaaaagtgttgctcaattttcagcaaggttttcttatgctactatagagctccaaaggaaagaaacacactctgstgtgccatagcgttagtaagccaatgaaagttgatggtatattcaaatgtctcttgctgtgtgtgtgwgwgagagagagagagrgagagagagtgagagcgattaagagagagactgatttgacatttattaataacttctccatattttatattcagaaaaaactgctaatcagtttcagctaaagttaaaccattcctaaaatggtgactaactaccttcttgaataatatcgaaatatcagaaccagctgatttgggataacagctctttgggacaataaattcttactcaatatgcaggctacatgtttgcctatcatttaattcctccctctttactcatcaagaattttaaaatcctgtattctaaactgcctaggggaaataactgatataattttgaagtacatatttttggatattccctgtctttattgtgaatctcagcttgtatcacawgtttattatttagcatttgagcatctgcagagaacttagcaccatccttccctttcyaagatttgcagcacatatgtggctaataaatacgaagctggatgatataaacaactccattggctctgtttcagctctaccactgttggaccttgacaagagagcattaggaaaatttgtttttggtgtaaaggaggttcttgctaggttttgcctagcaaaaatgggagcagtcagaaaagatggctggggcctaggcttggggaaggcaaaaagaaagagtaaaaacttcagccaaatattctaaatagtaaaaacacaagaaaggtaagaacttttgaaagtaaggtttgggtatagtggctcacttctgtaatcccagcactttgagaggccgagacgagcagatcaccaaggtcaggagttcgagaccatcctggtgagaccaggatttcgagaccagacatggtgaaaccctgtctctactaaaatttacaaaaaattagccaagtgtggtggcacacgcctataatcccagctactcaggaggctgagacaggagaatcacttgaacccgggaggtgaagtttgcagtgagccaagatcacgccattgcactccagcctggatgacagagtgagactctgtctcaagaaaacaaaaaaagaaaaaagaaaagcccaccaagttatcctaacttatgttgttgaatgggtaaagaagcaacacagagaagcacaaggaagacaaaagcagactgaataatgggacatatgaatgagggacacctaggaagatacattattagagagttcaagtacttaaattcatatatttcatgatatatagctgttttttaatgtttcaattaaaatttctgaaatttctgaagctaaaggtcatgatgagtttatgttctttatcttgctgaagtttcttacttttttttttttttttttgtttcttgttcacggtgaaaggctgaaaaagtttcttgaagagactaattgtgtattccaggtcctgtattgcttgactattgcagaatacatgttctaacaaatcagtttgagatttgtgtcaattggtagaaaataggattatgttcactcaccaaaaatgtatttgagagtaggtttccacactgcctacctcaggtggctaactctgaatcttttgatctataactagaagaaaaaactgcataaactgctaacacatttttaaagattctacagcaaggcatggatgaaattagtagtatatttaaaagatgttttatagatagaaagtgctaaatgaataaagaggtggtattatttgcaacatacctgatgcaaacagaattacaaaactgtaattgtaacaagcgcatgacaaagttttaagatttgtttcaatgttgaattataaatatctcagagtttaattctttcctcaaactrtatttaaaattactacttttaatatatcttaaatatatttgaatatatgtctagaatatatattatcacagagataactttaggaaaaaaattattaaagagatttatatataattatgaatgctttaggagccacatattaatttttctaaattcaactaagcttatcattgtgaagaaatctttatttcttcattatcacaaagataggctaattcttcattatcacaaagataatgaaattatcttcattaaagataatttcgtgtactctaaacaatctaggccattccatcattctagcagtggagcatatcattaatgatagataaaagttgagaaaccaaatgttctatcagttagaaaaatattttctcaaaagggaaaagcccaacttttgggttagctagtgtcttgactcttttaaatttcattcatgattataaatagttttaaatattttaaataagcatcaaccatgtgattgcccttatagaagagtaaggaaaccttgaagaaatgattctgctgtgaccttgagatgcctgcagaaaaagaagtggaatgtgtgaagacaccatcttccacactggatttgccagtgactgctgttgccctaaacacatcttttcatgtttctggatctcaattctcacatctgtttatgagagtgtttgccagatggcttctaagaaccctttcagtttcaacattctatgtcgctacaattggccttgatctcaaaggatggacacattgacacatccaatttatttttatgagtattttattagggtcaaaagcaacgtatagtgttattagtttctttcttaatttctaatagcatttcaaatatcataattgtatatttcttactacaacagcgaaatttacacattagggttctgatttggttaaagaatgtttgggaggctcataatcagccatgtttgttggtattgtacatattcacacctcttaatatgtacttcatgttttacaagcccaaggggtcttaaagagtgggcattgaaatgaccgtgtgtcacctacrtataagaasaaatatactagttgatctcatttcaattsttgtttgtaataaacaacaccaacttttaatataattcatacttttgtaatcaatataagtgagtgaagaagtaataaggaataagtatttttgtttaatggtagtcataaacccargtattcaaaaaatagaggttttttctcgaaataatttctgttttgagacagaatggcaaaaactaaaccttagccatttggcagytctctaatttatggggctttccatattgccaagggatgacgacctttatgcttccatttcatctgacatttgctgagactcattatcctttctagtcattcacccatgcaagttgctactgaatcaatacttgttcctatctacaagtcctatctcagctatgtcaaggccccttttggaagatgggattcattttcctgtgccacatccaagcacaggaaattccgtggactgttttaggtccatctaaggagacacagagccctgaaacagacacagagcaagccattctaccctgaaatcttatttccctatattttaggttttctcaagtttatataaggttgtgtataaggttctgctgctgtgtttatgaatttggtctagaggaattcaggccttggagagtgcaaatgccagatccttcctggtctttacggggcctagacgttttcacactaaaagcttctagtgtatatcacttggtgaggtgataagtatagaataaaagctcactggagttgatgaaaagagaaaatacaagatagaaaaatggaaaagaaaaaacggttgatatttcaaaattattatcccaccacacaatgattaactctctataaatggcatctatttccatggtagtggtgaattccctggataaggaagcagaggctgagactagtcagtgaaaccttacaaccttacgagggatttcagcattgcctaggtggtgagacatgatcaactttgaggtctcttttggctctaaattcagtgatactcagtaaaaatattatttgagagagctatatctttcctgaaatttcatgacagctctctggcctcttgttatgggctgaattgtatctcttccttcctcctcctcattcatatgttgaagccctaactcctagcaccttccttggaatgagagtgcatttggagatagggtcctacaaggggtaattgagacaaaatgagacttctaggatgggactttacctaacatgactagtgtccttgtaagaagagaatatttgggcacacagaaattccaggaatgtgtgttagttcagaggaaaggccatgcgaagacagagcaagaaggccgccacccgcaagcaaagacaagaggtctcagaagaaactagacctgccaacaccttgattttggacttttagccgctagaactaggagaaaataaatttatgttgtttaagctacatccagtcagtggtgtttttttttttttggcagcattggcaagccaaaaaagctctgtatgatagtcacatctagaccttgtacactatgctccccaggaaaggctcttgccagagttgatgtgttttatagttagtggcaagaattatttttaatacatgcttgggattttcccatttctataaagtttatttgtacgttttatagttcttcagaaaagagaaatcagctaagaccctagattgagtgactttaacattatgacaaatgaaacaattgattgatatttcctaccaattatgactgaatgcaccagaacactttgtcctaagtaaatctataatacattttgaaaaggtttaagtggatttcaaaactgctwgataatagcttttttctaaggagatacgatatgaagacttggaaagtgttgtctgtagttattgtttacatccatagtagttgcctggttagttaacaccagctgacacatgaaatatggttttgaaataggtagcttgcttttctaccaccttgtcacttattatccatgtatttccacccaagaaattggtactctgagttagtttcttttctattaatattaaatgaagtgtttctattaaatctctagtccaaggatgtaatcttaaggatacttggcactcccaacatgttagaatcaataggaaagacatttatggattcctacaattaagatgagcagccagggaataattcaggaaatcttatttaatttctaccttgctagatactatatatgatacacagagtgtaagaggragccctgccctcaaagattttaygatccagttgctaagacaaaaaaaaaattaaaatgtaattattacaaaagactgtaaaagtggccatacctaaaatgcactgtggccatcgttgcctagatattaattttataagctgttctttctctatacattgtgcacaaagtgggtgtaggctaaatcaatatgaatgcagcttttatagatattaataagattatctaatagtaaatttttctaactgaagtttgttttactgattgaaaaataccttcccaatatttttatcttggaactctaaaataaagaaggaatttttaaagggtggcttattttttatttaaacatcattaaatgcttaaattggacacattagtattcttactattttaaacattctcttctgtctttctagtattgatatctttcataatcttcttgtgtgtctcttatattctctgctaattctgttaactgtacacattatagtgttttgcaatgtctctttcctaataatgtttttgtattttcagtcttggttctccttcctacaaatttcacactttattctaccgaaacactctctcattactgtggcttcaaatatttttttccttatggtgtagacatttacagacaaactgaaacttctcttttatttaagctgttgtgaccccctcccccttttcatatggactgcatggcaggaagaactatgtatgcatttattcctcataattcagtattaatttttagggtaaaggattatctttctaccaktgttatcaggaagacaatagcctaaaaagcaagctgacattytccttcctgtttccatcagtttaaacaacagattatttttaaccattcttatttaactgattgaggcagtaatggcttctgtgtgtttttttaatccactgctgtttggtgtgtttatgtacacagtcaataatatgctcagaaatgagagaaattgctgtctttggagacagaaaatgttcattcagaagatgggctaaaagtgggccttgcaagacttgcataggaagagtagtggggccatatggtccaattaaaaaaaaaaaaagataagctaycttttgacaacaatgagtagattaattgmatgaaagctgcatttaagagcgagtataaatatttgttgaatggaaggaaagaagaaaaggaagaatgaatggatgaaggatggaaggagacagagtgatgccaagggaggacaactggtttatttggatagactgaagaatttccattgttttttgtaggcagtagtaaacctggggatgttcttgtttctactgcacactgatgatgtatgaaatactgttctagaggctgaagaggtttaccacaataatttaaaatgtcataacatgaagtacagtcagggactgatagcagagggaggataatacactacttgagtaaagatttaactgagaagatgtattttctataaagtgatgtcaaagatgactggcttgaaaatacttgtgtctaggagaattgtgttgcttaggattagaagggatgcctgctttatggagaaaaatgaatatttctgtttcaaacaagaggtaggaagatatagttgggctagaaatgaataaagcctaagacaaaaatcagtgtaaccatgggtagcatttagtacaaccagtattcttaaaaggatcaaaaaagaacatgataaaaagtaaaagtgcaaatagaataaaagaagataatttgttaaggaagggatattatgcttccaaaaaaagatggagtattaaacaaacacacaattatatttagagatgtcaacacctcaatctcaataattgatagaacattcaaaccaaaatattagttaaggatgtagatgacttaaacggcatcattatcaatttaatccagctaacatttatatcttcccacaaagaaaatttgaagcccagatggcttcactgatgaattctaccaaacatttaagtaagaaatagtacctattaccaagtatatacaattatttttcaaaaaattgagcagagaaactacttcccaactcgttctctgaggctaacactatcctgatgctaaaaccaaagacattataaaaaattagtaaatatatggatcgatatgaatatagatacaaaaatttatttttaaaatgtgggcaaatctaattcaatgtatctaaaagcttaacatatcctaatgaaatacgatttatcctaagaatactaggttagttaacattaaaacaaatcaatgtaaggttaccatagtaacaaattaaaaaagaaaaccatatgattatcccaacagacaaaaatatgaccaaattcaactaaagtaaaaactgggaatggaaagaaacttcttcaacttgataagaggggtctataaaatgcaaacatcattagagcagaaagactggatactttaagatcaagaataagacaaggatattcactcttaccacttctgttcagcattataccagatgctatagccagtgcactaaggaaagcaataaatgaatgaatgaatgaatgaacaaatgacatccagattggaaaggaagaagtaaaactttacagatgacatgagatcatttatgtagaaaatatgatggaatctactagtacaggttgagcattgctaatgtgaaaatccaagatgctttttggaacacctacataataccacaagtggaaaattctatacatgacttcatgtgactggtgtagtcaaaaaacaggctctgagcacacagtttattcagcatccctaaggggaagaagaccctcccagaccccttcagctatgaaatatatctttcttaagtacccagattcctccacccccactatgcaggcacactcataaagggtaataaaatggcatgtatgcaggccaaacacaccaatggcaggtttccaataatgtgtcacatggggccaagacctacatgcattactgtgtttttattttcttattatctgctctatggtgtaaagattattaaaaatattaaaaactcctgcagttccctctgtgatatcagtattgggtaacagtgataagaaaaagaagcatttatgtttctctacagcacagaaagtcaaactgttgaagaagaagaaactggacagtggcggaagttgaaatgttctatggaagagtatagtgttgactaccatatatgacctgaagaaacagaaggataaactgttgaagttttatactgaaagtgatgaatagaagtcaatgaaaaatagaaaaacaccgtatacagctaacaataaaaatattgattgtgtatttaaatagtggatccattaccattgcagtgaacacttgtcacttaatggaatacgaatcgggagacaagcaaagatctataatgaggaaatgaatattgaagggaaccatgagtactcaacaggctggctgcagaaaattaagaaaaactatgatattacatttttaaagatttgtagtgataaagcatcttctggtcatgtagtagtggaaaaattcattgacaaatttgccagagtcattgctgatgaaaatctgatgccagaactagtctataatgctaatgaaacatcactgttttggtactgttgccccagaaagacactgacaaaagctaatgaggtagcccctacaaaaattaaggattccaaggacaataactgtgctggcatgtgctaatgcagcaggcatacaaaagtataaacttgttctgaaaagcaaaagcttgcatcctcactgttttcaaggagtgaatttctcagcagtccactattatgttaacaaaaaggtatggatcaccacggacatattttctgattggtttcacaaacatttataccagaggctcaaggttactgcaaggaagctggattggatgacaactgttagatttttgttattccttgacaacatttctgctcatccttcagctgaaattttcatcaaaaataatgcttatgccatatacttttccccaaatgtgacttcattaattcagtcatgtgaccaaggtatccttagattgatgaagagtaaatataaaaacactttcttgaacatcatgccagcaccagtgaagagaggtgtgggtgtggaaggtttctagaaggagtttagcatgaarggtgctgtttatgccattgctaacacttggaacgcagtgactaaagacacagtagtacactcctggcacaacctcttgcctgtgactatattaagtgatcttgatgaacaaggtagtgactttgaagaattctgtgggccaactgagaaaaaaagatggtgtctgacctccttacatacacaaaaaatataatttcagagtctttccctaggctagcagaagtaaatatcaaagaacttgattatttttaacatcaataatgagattccaattcytcattgaccratggggaaatagtccagatggttttgaatcaagttgattgtgataatagtgatgattaaaatgacattgttaacactgaagaaaaagttcctatggataaggtaaaaatgtgtgacgggcttattgaaggactacagcactgtacatttataacagcacaagaaatcatgtcagtttataaagccaaagagagacgaygacaacgacgacgacgatggctactactactactactactactactactactactwcttttcttttttttttttttttttttgaggtggagtttcactcttgttgcccaggctagagtgccggtggcatgatctcggctcactgcaaccaccaccttccaagttcaagtgattctcctgcctcagcctcctgagtagctgggattacaggcacccaccaccatgcccggctaattttttgtatttttagtagagatggggtttcaccatgttggtcaggctagtctcgaactcctgacctcaggtgatccacccatgctcatgcctgtaatcccaaagggagacttctaagacaaaaaccattgttaatgaggcaagatgactctgaaggaaacatttttaaaagccatccacaaaatgcctcttcatccctagaggactcacttcctggtccttcaactgttttgattttttttttctctcacctaaaaaaaaatcagcacacagtaacctattaatcaaaacacagcatcataggtggagactgaaagcctgccattgttggttgttgctgatgttcaacagctgttacgggaattctggtgatgctgctgtgctgcttagttaccctggacacatttgttttttttttactgtgtaaatggcatgccatattttttacagataagtacttatgggtaaataagttaagaaaattgttgcttatcagtagcttataagttcaaaatcaagaatgattgtgatgccaaacaaccacagatggctcatatgggtggccgagatgttgacacttgccttctgatgatttaaaatayacaattttttcattaacaaaattattaaaatattatataatgttgccttcagtctatgggtataaggtgcatataaaacataaatgaattttgtatttagacgtgggtcccatctccaagatatctcattatgtatatgcaaacattccaaaattaaaaaacaaaatcagaaacacttctgattccaagtgtattggatagggttattcaacctctactacttactagaactcaaaacttagctttgcaaggtttcaggatataagatccgtatacaaacatcagtagtatttacatgtatcattaagagtaattgaaattagttgaaatagtaaaaccttttacaataatatcaataatatgaaatatgtctataaaaaattaacaagacttgtacacaaaatgtataaaacagtgccaagagaaattaaggaagacctaaataaatgcagattatgatgttaaactgtacagtgttgaaactgyaacagtgttaaagtggtcttctcttctcctcaattgatctgtagatttaatggagtccagatcaaaatcccaacattcatttggctagtaattgaaaaactgtttctgaaacttatatgcaaaggacctagaatagtcaaaacaactttgataaaaggcaaaatttggggactaagactgmctgatttcaaaactcattataaaactatggttatcaagatagtgtagtgttaaaggaaactcagaaaaatagatcaatagaaatgactagagtccataaagatctacatggatgtagacaactgatrctcaaccaaagttcaaaggcaattcagtgggcaaaggataatcatttcaacaaatggtgctggaacaactggttattaatataaaaaattcaatcaataacctcctaccaaaaatttatcaaattgtacactcacttgaaatgtrggatgtttattttatgtcaattttaactcaataaagctgttaaaaatagtaggaaagtatgagagagaaaggaaaaaagggacgaaatgtaaaatgctatttattggctacaccatgtgctatataagcagattatattactttcttccgatgtgagaatatacagctcctgctatagaataaaattatgtattctagatcacaggaacaaattagcaaaatactgttcctaatttttaatgctcattttgcaaggtgcaaaactgcaaggcacatcttacaaaatgaacaatttagggcataacttcactcttataattaatttagaatgatggacatacttaaatagcatttttcacaaaaatggaaaaattctaaaattaatgtggaattacaaagaccatgaatagccaaaacaatcttgagaaagaaaaataaagttggaggtatgacattccctaatgtcaagttatactacaaagtaatagtaaccaaacactatgttactggcataaaaacagatgcatggaccaatggaacagaataaaaagcccagaaataaacccaagtttataaagtcaaccaattttcagcaaggctaccaagaagacacgatggagagagggtagtatcttcaataactggtgttgcgaaaactggatatccacaggcaaagagtgaaactggacccttatctacaccatatataaaaattaagtcaaaatgaattaaatacctaaccataagagttgaaactctaaaactactggaagaaaacaagggaaaaacttcttgatattgtccttcataatgatattttggacatcacaccaaaagcacaggcactgaaagcaaaattaaacaagtgggactataaaaagcttttgtataacaaaacaatcatcagaataaaaagacaaactataggttggaaaaaatgtttgcaaactatctgacaaggagttaataatctctaaaataaataagaaactcacacaatagcaaaaaacaaaacaaaaaaaaaccaagtaacttgatttaaaaaaaatgaccaaagtgggccagctgtggtggctcacacctgtaatcccagcactttgggaggccaaggcaggcrgatcacctgaggtcgggagttcgagaccagcctgaccaacatggagaaaccccatctctactaaaaatacaaaattagccagggtggtggcacawgcctgtaatcccagctactcggggggctgaggcaggagaatcgcttgaacctaggaggcaaaggttgtgagctgagatcatgactttgcactccagcctgggcaacaagagcaaaactccatctcaaaaaaaaaaaaaggtaaatatcattgagtactcatagttattaaaatatgcatatgtatgtgcatacccatgtatatgtgcacwtgtgcatatgtgtatgtatttataaaaaaaatgaccaaagtacttgaatagacatttttctaaacaagacataaaaatagccaacgggtatatgaaaaggtgctcaaygtcactaatgagagaaatgcaaatcaaaccaaaatgagatatcacctcacacctattaagatggctgttatttaaaaaaaaagaaaaaaagaaaaacaccaagagataacaagtgttggcgagagtgtgaagaaaagggaaccctggtacaatgttgctgataatggaaattggtacagttatgaaaaaatgtatggagcttcctcaaaaaattaaaaatagaactaccatatgatccaacaatcccttttctgggtatatatccagaggaaatgaaatcagcaccttgaaaatatatctgcactcctacattcattgcaaccttagccacartatacaagatatggaatcaacctaaatgtctgttccagtgaatggagaaggttgaaatacagatatgaaatacagatgtgattgtttatgtgtatctgtgtgtatgtgtaaaggtacatatatatagacatacacaaatataaagtatgaaatgtatattctgctactcaggccagtcttgttactttttatttgatttcagaacaaaaggaattttttaaatgatccggtagaataataatacttttgttagtgtcctcatatcttgatattctcagatattaggacattgctygaagcataaatcttgatgagtttcttggatgttttgtttcatctcttgtgctttttctttttagctaatgtaatcatagatttaatgtaatagccctatctctaagttgctgtcccccacgttttatctctcagtratataggctttagggcctgatatcagtacagagctatttattagttcaggatttcattttgtcataagattttgcatcttacgtgaactattttttgcatttctggacgatttcttctattacttcaatattatcttgtgagtgtgatacacttgtgttactgatgaggattrtgaatcttaagcaggagtctgcccactccacaaccatatgaaataccacttaacatttttttgkaatcagtgccacaggccctttaaagctcatttctgataccacctgcaggtattttgggtaagtgatagatggaaggaataagcgcacacacattgtaagattgaattcagctcctgcctacattttccaagaatgtagtctcatcagaagtggaatgtccatgtgaagaggagcagatgcatgatttctcagaataactgcttgtggcacacactaagaaaaatgcttcaccagatatggaaagctcaattcttgctaggtcactttgctttcttgcatgaaacttacatctggaagattttatattaagaacatatgtgcatctgtttaagggaatgtttacatttactgagttctggttcttgaagcaaactctcagcaagacccattatggcatgggtaaaaaggcagagcttgtttccatacatctctgaaaggaaatattccgttttcagatttttttcttgttcagaaggcctgtttccttggaatggcagtcagaatagtcacctgaaacccaacaatgagttatgttctaaaagaataaatggttcagggagatgaaaacattgttttgagaccaccattggcctgagtcagtgtagcaatgcttatgaggcgattggaaccaaagakaatatgctagcacagtttatacactatatctctcttatgcagctttagtttattgctcacgatactcattcacgaatccttgaaaattgcttcaaagaggtagtcttaggacaatgttttttcatgtactgggaatgcaacttaaaaaaagtgtaataagttttaatttatacccattttgaaattcatagacgagcacattgagcatttttaaagcttgtgatcatctgaagtattgcaattccaaactgtcaactctgtaaggtactattttttgccatttgtcctaaaactactcctttggtgtagtttatgatgtagtttttcagtgattggtgaataaacctatattttaatatatatacacacatatacatacatatataatccatatattttgtgtatcagtgtttgtgtatataaatttttttcccaaagtttattggaggtttgtatgtgtgcgtgtgtatacygtgtgtttgcttttcctaggatttattcttctagactccaatacaatttccccaaatctccatttgtctaaggaaggtaagttttgctttctgatagatatctatatatcyatatatatatagatatatctgatatatatacacacataaatacacatatgtatatatacatatatatttctataataaaagtaataaargtggtaaaagattaaatttcttctaagaggaagattttcttgtttccttttttaaaagcagtgaatgaaatctgagattctccaggtatattttgtggatgggcagttgcttcctaacaattccacctaggcatcttgggagatagagcgttcaaaaattactgagaaatttgtagtttaattgacctaagcagagagaaatctggcccatagagaacattttattttattttatttatgtatttctttctttcttcagagacagtatctcactctgtggcatgattagagctcactgccgcctcaacctcctgggatcatgtgatcctcttgcctcagcctcctgagtagctgggactacaggcgcacaccaccatgcttggataattctttaatttttttttttaatagagacagagtttcactttattgcccaggctgatcttgaactcctgacctcaaatgatcctcctgcctgggcctcccaaagtgttgggattacaggcatgagccactgcatctgccccagaaatattttagatgattaagaggctttcttatttcaactggaattagcaatatttttttcctcataactatttactttgcctagaggaatatgcctaaaatttcacttggtgatgggatcatagcagggaataatctaacagttgggagaataagttagttcactttaaaggcattctcatatttactacattattatgtaccaagaggtgtttatgacatattatttaaatacatattgccagcttgaaggtttaaatcgtggatagtctataatgagataatgttttcagttttgtatctcctcatgtgagtatacgcctatcaggaaggctggaaaatgatgaagtaaatagcatctctttattttaaaatgaaagaaaccagtttctgaaacactgatgacatctaaaaaacggttagaaaattcacaaaatattactctttgcacttaaagatgaagttaaattcatataactattggtttttctgctaaaagtgtgatttatattttgataaagtcatttgctttgctgtacctgacatttcaaatatgttgcatacctgttagtaatcctcaggtcattgttcagaggtgcccatactttatgtaagtgagaatgccataccaactccttaatgacttgaacttctggcaaagatgctgttctattttggmatatggatacctgaaaactagttagaaaaatacatttttattgccccccccccttacgtctctttcacccaatttttagatgggctaagttgtctccattagttttggaccatacaaaaagaccccaggattttcaatgcagtgggtctcttgagaattggaaacttctgctgtttcatgctaaaaattagtcatgaatttttaagcaggaatctagcttctaaggtcagatggcccaataacaatattaaagaaatatttttatttttgtcttcttgtatcttcctgtctcaacaaacctgtaacaggatcacttctttccttgcaacaacttctgggaatgacttttattgtgaatatagaacaattttcaaccaactactaggctgctgggagaagctgtgtctatttctatgtgtatcacagagggtattcgaggataataatagattctacacattgtgctagcaatgtgaatattacatatactttctcatttcatttaagtttaaacctctcattttccctgggaagtagaaatttctatttccattttagaagtgagggagctaaggtccaagtttcagtggagagaaaactaaggctccatgttgcccaaagaaacaaatacttcctattgagcagagcccagatttgcctgactccaaagattcccagccttgcttgttttatttcccagccatggtgtctgggagtcaggaggcaaacatgcctgtacctgcatttcccttttggggaggactaaatgatgtatcagctttacatagcaatctatttaatgtgcatctttgaaaaggaaaagaaatcccttgaaatatctctggcattatttcaatgacattgaagtgtcagaacattttgggataacaaagtggtcaattcctttaggtgccatcgagctttcagcagttgtatattttatagttagtaaatagccaaatgtatttctttgcctctgttcaaaatgaaatcaccttaatgaagaaatcttatactgaaacaatctgggcacattaataataaatgaattctgaaagaaatttagtataatttctgaggaggcacaagaggaaataccaaatttaaaaatggcattttccatttgtataagtggaataagtaataacagtaataaaaatgtattcttccactattgttctcagctgccattgtgcttttctgtttgtgatcccttggaattcacagatgtagattatggtatgctattgtttgatggcagaggcaaattatggcctgcgagcacctaatctacctgttttcgtatatcctgcaatctatgaattatttttacatatttttaaaagttagaaaaaaattaaaatgagttagggaggattccctctttttctattgattggaatagtttcagaaggaatgataccagttcctccttgtacctctggtagaattcggctgtgaatccgtcaggtcctggactctttttggttggtaagctattgattattgccacaatttcagagcctgttattggtgtattcagagattcaacttcttcttggtttcgtcttgggagggcgtatgtgtcgaggaatttatccatttcttctagattttctagtttatttgcatagaggtgtttgtagtattctctgatggtagtttgtatttctgtgggatcggtggtgatatcccctttatcattttttattgtgtctatttgattcttctctcttttcttctttattagtcttgctagcggtctatcaattttgttgatcctctcaaaaaaccagctcctggattcattaattttttgaagggtactttgtgtctctatttccttcagttctgctctgattttagttatttcttgccttctgctagcttttgaatgtgtttgctcttgctttcctagttcttttaattgtggtgttagggtgtcaattttggatgtttcctgctttctcttgtgggcatttagtgctataaatttccctctacacactgctttgaatgtgtcccagagattctggtatgttgtgtctttgttctcgttggtttcaaagaacatctttatttctgtcttcattttgttatgtacccagtagtcattcaggagcaggttgttcagtttccatgtagttgagtggttttgagtgagtttcttaatcctgagttctagtttgattgcactgtggtctgagagacagtttgttataatttatgttcttttatatttgctgaggaaagctttacttccaactatgtggtcaattttggaataggtgtggtgtggtgctgaaaagaatgtatattctgttgatttggggtgaagagttctgtagatgtctattaggtccgcttggtgcagaactgagttcaattcctgggtatccttgttaactttctgtctcgttgatctgtctaatgttgacagtggggtgttaaagtctctcattattattgtgtgggagtctaagtctcgttgtaggtcactcaggacttgctttatgaatctgggtgctcctrtattgggtgcatatatatttaggatagttagctcttcttgttgaattgatccctttaccattatgtaatggccttctttgtctcttttgatctttgttggtttcaagtctgttttatcagagactaggattgcaacccctgcctttttttgttttccatttgcttgatagatcttcctccatccttttattttgagcctatgtgtgtctctgcgtgtgagatgggtttcctgaatacagcacattgatgggtcttgactttatccagtttgccagtctgtgtcttttaattggagcatstagtccatttwcatttaaagttaatagtgttatgtgtgaatttgatcctatcattgtgatgttagctggttattttgctcgttagttgatgcagtttcttcctagcctcgatggtgtttaaaatttggcatgcttttgcagtggctggtaccggttgttkctttccacgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaatccttttctttaagaatgttgaatattggcccccactctcttctggcttgtagagtttctgccaagagatctgctgttagtctgatggtcttcyctttgtgggtaacccgacctttctctctggctgcccttaacattttttccttcatttcaactttggtgaatctgacaattatgtgtcttggagttgctcttctcgaggagtgtctttgtggtgtcctctgtatttcctgaatctgaatgttggcctgccttgctagattggggaagttcttctggataatatcctgcagagtgktttccaacttggttccattctccccgtcactttcaggtacaccaatcrgaygtasatttggtcttttcacatagtcccatatttcttggaggctttgttcgtttctttttgttcttttttctctaaacttcccttcttgcttcatttcattcatttcatcttccattgctgataccctttcttccagttgatcacatcggctctgaggcttctgcattcttcacgtagttctcaagccttggctttcagctccatcagctcctttaagcacttctctttattggttcttgtggttatacattcatctaaatttttttcaaagttttcaacttctttgcctttggtttgaatttcctcctgtagctcggagtagtttgatcatctgaagccttcttctctcaactcgtcaaagtcattctctgtccagctttgttccattgctggtgaggaactgcattcctttggaggaggagaggcgctctgctttttagagtttccagtttttcttccttttatttttccctgtctttgtggttttatctacttttggtctttgatgatggcgatgtacagatgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcggatttttgtgaaccgcgaatgctgctgtctgatcgttcctctggaagttttgtctcagaggagtacccagccgtgtgaggtgtcagtctgcctctactgggggatgcctccctcttaggcttctcaggggtcaggggtcagggacccacttgaggaggcagtctgcccattctcagatctccagctgcgagctgggataaccactgctctcttcagagctgtcagagagggacatttaagtctgcagaggttactgctgtctctttgtttgtctgtgccctgcccccagaggtggagcctacagaggcaggcaggcctccttgagctgtggtgggctccacctagttcgagcttcccggatgctttgtttacctaagcaagcctgggcaatggtgggtgcccctcccccagcctcgctgctgcctcgcagtttgatctcagtctgctgtgccagcaatgagtgagactccatgggcgtaggaccctgcgagccatgtgtgggatataatctcctggtgcgccgttttttaagcccatcagaaaagcgcagtattagggtgggagtgacccgattttccaggtgccgtctgtcacccctttctttgactaggaaagggaactccctgaccccttgcgcttcctgagtgaggcaatgccttgccctgcttcagctcatgcacggtgcactgcacccactgtcctgcgtccactgtctggcactccctagtgagatgaacctggtacctcagatggaaatgcagaaatcacccgtcttctgcatcgatcactctgggagctgtagaccggagctgttcctattcggccatcttggctggagaggatgtggagaaataggaacacttttacgctgttggtgggactgcaaactagttcaaccattgtggaagtcagtgtggcaattcctcagggatctggaactagaaataccatttgacccagccatcccattactgggtacatacccaaaggactataaatcatgctgctataaagacacatgcacatgtatgtttattgcggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgggaatcattctcagtaaactatcgcaagaacaaaaaaccaaacaccgcatattctcactcataggtgggaattgaacgatgagaacacgtggacacaggaaggggaacatcacactctggggactgttgtggggtggggggacgggggagggatagcattaggagatatacctaatgctaaatgacgagttaatgggtgcagcacaccagcatggcacatgtatacatatgtaactaacctgcatattgtgcacatttaccctaaaacttaaagtataataataataaaaaaagaaaaaaattaaaagacgtgacatataaaaataatgtaaaattcaaatttaagtatctgtaaataaaattatattagaattcagtctgcacccaagtccttcccatgatctatttctagagccaccattgatgaaccttcattcaacatatacccaaatacacacatatacatgcatactcccagttacacacctcttattctttatttttgagggatactttattaagctttaagactcctgtgtctaatttcccttttccaaatttctctgggcctaatactcatcagctttgtccttttgttctctgcagtttcattgctatcctctttgttctattttcagaaatttcccaaaatattaaaacaagtgtggagaaagcagatctgtagcattttgccttctctgtgtcttttctatcttgtttgtgggactagatcacaagtattaggaatactgtgaaatcccagctgcactgagttattttcttctcattttccccctctctcccttgtagtcttactgcattctcctttattggtcttctcattacttttcaatatcagcagttactgtcttgttattttattgaatccacttgttatttatgatttagaagattattggactcctcattaaggagtgaggcarcattcaatattattaatatgtcaaagagctttgagatatcaaaattgtctatttaaatgtctccaaggactcttgggctactagaaaactgaccataatattttaatatgatataattaatatcacctctttaaattttcttttgttcatgttaatagcaagtgactcttaacaaataattgggattgttccaaaagtttgtttaagccacatttgcataaatatgattatgacatggtaaaatatttgaaataaaggcaatacaaggcaatttctcaggaattaatagttttctttgattacctaattttggagagagctttatgggacaactgtccaggccaacaaactcattaaaaggacctaggccatttgttgaaagtcttgatacycagttctgcttcaattcagtatgtttcaaaaaaaatttttataccactgcttactctgcctatttcagaagcagctctaaccttcattcccyctctgccctaagtgtctcaggcttgccccaagttctcctaattttggatgattaatggattcattgattcattgattcatggatacacacacgtgcacacwtacacacacaggagatttcaataataattgattcactgctgtatgtcaagtattcttctaggtatttgggggtattaaaataggcatttggtccctgctctttttttttttttttttgagatggagtcttgctctgtggcccaggctggggcaatcttggctcactgcaagctccacctcccaggttcacgccattctcctgcctcagcctcctcagtagctgggattacaggcgcccgccaccacgcccggctaatttttttttgtattttttagtagagacgggtttcaccatgttagccaggatggtctcgatctcctgacctcgtgatccacctgcctcaacctcccaaagtgctgggattacaggcgtgagccaccgcgcccggccggtctctgctcttatggggctttaattttagaaaataaagttagtaaagtcaaacaataaatgaacaaaaaatcttctgctgaggtgaagaaaataaagcagtctagctgatagaaagtaactggtgaattggctactgtagatagtgtcagagaagatgtcactctgaggaagtgacatcattcgttctttgacctaactgaggagaaggactagttacgggaatgttgggggctgagggtggcagaacattccaggaaagaggaacaacccatgcaaaaatccggtgggatgaaaacaagcatggcgactttgaggtctgcaagaaggctggtgtgactagaaaatcatgagggcaaatgggtaataataaaggacataggcaggggaaacatttggattttattctaaaacctaagggaagttcttgattgcttttgatcagaagggtgatgtgattttatgacacagtggacatgatctttttattttcttcacggaaatacttgagtcatcttttatactctcctgccatgtaaatcctgtttccttctagccttgtctaccagggaagaagtcaaaatgcaagggtaggaatcttcttttagatttcatatatttttactttaattctaccatatattttttatttctaggatcttttaccctsaaaacagcttctcatttggtgtttgacacaatctctcttcctttcttcttccaagctcagcaaatctaaaawcttcaacacaattaagtaagttatcctacaaactctatagtataattgacctcaatatcatttttttyctcaataaattatggaatatatgaaatgcctcccaaaagaaaatattatctttcattagaatatagagtctagaagataatcaccgtcttccatatgttctgaatcctgaaatctgacttaagtggtatgtgtgtgtgtgtgtgtgtgtatgtgtgtgtgtgtgtgtgtatatatatatatatgaatcaatacaggtgataaggaccagagtttttaaggtgagaaaaaaaggtagaagaaagaattcagaacagttcatatcctgcttggccctctcctcaggcttcttcattttatcacctgtttgtaattcatcctacaattattttactatgtcttgtttatttattctagggatttacttagtagtataaggtatatattagtaaacaaaacaaagatttctaaagttatggagcttatattctaacagaataggggaaaatattatttacaggtatttcttaaaatgctcttatcatattaggatgggtatgtaccaatgaaattcgctgagaagaaatgggaggcatcaagaagacaaagaaggagccttcaatatcaaggtcttttgtaattttcttggtgaaggacaacatatatatcttgagtgtttccactttgaaatttatcaccttttttgcctccttcttgcatcatttatgtatatatttttccattctttttgccatattattatatagataggaaatgaatgtaccctttttcccttcttcttagttggtacatactcatttggtacatacatatttcttttaattctatattcattacattgtaccaaacaatacatatttattgggaacctattaagtataaagtatgtcatttatatcaaagatatcatcaagttctttgagcttaaagttttttattgattttaatataggatataatactctgtaatttaaaaaattatctttaattcagttggtactaattatgttgtgacaaaaaaacaaaaaacaacaacaactcaaactaaagcaaatcacagagatttattggtttgttcttcatgaaatttcagtcttcatacaggtattttttcagggattcaaatgatattgaccttatttggkttctctctctcagctctgctttttactatattggtttaatactcaaaatatttattgtattttcctgttgcttcaagaacattctttccatttacctcatctctggtcccaggagaagacatgtcattcatgccacttaaatctgtgtatcctatttctatgtctgcaatcattgcttcaaagagaggcctatagcctgatcaaagcaaactagaaagaagcagacttttgctaggacagtagagagaagaaaagaaaaacagcttcttatttatttattgctgaaatttgaaaatgggaaaaaatatatattttttgagacagggtctcactctgtcacccaggcagaggtgcagtagtgcaatcacagctcactgcagcctcaacctgcaagactcaattgatcctcctacctcagcctcccaaggagctgggctgacaggtgtgtcattakgctcagctagttttcatatttttttgtagagatggggtttcgccatgttgcccaggctgctgaagagtattcttggagcaatagggaattactacatatacctcaagaattaaataaacatagcatgaggcagagctgagatatatagaaaaaacaaatactgaggatgccatttgagtccctggagcaggatccgcatgctgactgaatttgtgtggaagacaagccaatcaattcctgtaytggygtaagctagtttgagttggttcttgtcataacataaactgtgcatatggaaataaagatacaaaaattatgagtgttatataagtagatcaaatgattttaaactcaaagtcttataaaactatgaaaatttagagttgggagggattttgtgcatctctatatctaatcccctctatttatcatcaagaaaatgaagaatcagtgaagttgaataatttaacatctcagaaagtgccaagatgaggagacaaacctaagtgtcgtggcttctagccctctgcttcttccaggaccccacactttaattctggtaaagagagaagcctacagatacataaaaattgttcatggtcattttaaatatcttgtttacagtggcaaactttttaaaaaaaatatagttcttggcctggcgcagtggctcacgcctgtaatcccagcactttgggaggccgaggtgggcggatcacgaggtcaggagatcgagaccatcctggctaacatggtgaaaccctgtctctactaaaaatacaaaaagttagccgggcgtggtggcgggtgcctgtagtcccagctacttgggaggctgaggcaggagaatggcgagaacccgggaggtggagcttacagtgaaccgagatagcgccactgcactccagcctgggsgaaagagcaagactccatctcaaaaaaaaaaaaaaaaaaaaaaaaaaatatatatatatatatatatatatwyacacacacmtatatatacacacgtatatatatatacatatatatacgtatatatacacacatatatacgtatatatacacacatatatacgtatatatatacacatatatatacacgtatatatatatacacgtatatatatatgtgtgtatatatatatacgtgtatatatatatagttcttctaagaatgccttatagcttgctttggttttcatctgaatattttctattattcattttcttttagaaaccttccatttttataggtagcaaatgcaataattcacaccaatagcttgcaaaatttgaactattagccatgatagaagatctatgaattgcatattggttatagttttttttcacttatttttaaaataaatgccaacaaagacaataagataattttttagaatcatcacgtttattcctacataattactaataaataggagttcatcttcatccacatatatagtaaggacttctccggtgccaacattctattttcagcatcaatagcatatgtagcctctagaatcatgcacgtgtttttaattttatcttggacttccaagaaatgtttataagtaacattcttaagagagaaagacctcctaaatctatgtcctacaaatactttatcagaaaaatttaatatactcacagagttttatcacttctcctgagaagtttaaggagacagcttgtttttttggccttcattataagaaagcagttaaatgttaattaattgaagaaaaagactgctgaaaaagaaagcactaagcctattatagaaatgaatcttatttttctgccaagtgctttataattaaaaggaaactcagtagaaaagaagcttaagcaataacagtaatattaataaaatactgatttttagaaaattgcttttatgctaagaatgattaggtcccattttaccccataatatacttctcagatgattttagtttagcacgtgtattctcaagcttggtattattgaatctcagctagataattctctattgtggagggctaccctgtgcattatagtatatgtagcagtatccttggactccactttctagatgccagtagcaccacacttcccctgtggtgacaagccagataaccccaatatccctgacaaaatttatcctccttcccctccccaactgagaactgctggtttagaaattgaaaaagtgggacagaattacagagaggtcaacttattgtaaattagataattagtcattgacacacctacttttaggagccatgtctcacacctccagcccctgaaataaactttaccattgaccaaaatcccatcttttttgtatacatcaggtcattgtgtaggttcaattgcaaagcattgatgccttttcttgtctatcctacctttgcaattttgctgggggttttgtctgattattgtggccttttggggtatcctacatccccctgcctacctcacacttcccatctttcttcaaaccagcccaaaatacaaaatgattgcttttgtttagattggctgtcattcaagattttgccaagtgtgacaatttagcagttccctcaaacttgaatgagtcgtacttgaaagggaaaatatgctctcatagtgtgatgcttattaaacagtattaaagctttgattgagcattcccatggtgatgacttgcatagcacattactgcattaatgtaagtatttttgcctgtcaaacattaaatatggataagatctgcagtgtcatttggttcacttygctactactgaagcattgcttctccataatacatgctggcccactgttcccagtccaatttaaactataagtaatgatggtgtatttctacttcctttgggaaagcattacraagtttaatttactgtttcctaacaacttgtaatagtatcagtagttaatgttctagaattttgatagtgaaactttctgctagtctactttcttcctcaaaggtgaacattttaatatcataagaaggtttttcatacatcccagctttattcccaaagactatagaatacttctaaagtttggctatttctagtccaccacaatcttttcccacacacagttgtttgaatatatttgacagtctaatacttgatagcacctactacttcaaagcacacactggtatcaccttacttgatttttataagatcattttggggataggcaggccagtatccaagctttatttgacgggtggatatatgaaagctcataggggttaaataattgtcctcagtcactaacatttatgtacaactttaagatctggcaatgattgagccacactcattgcatttgctccacaacctgtgaaatgaggagggcaggtatgagtattatcatgacctccattttccagaaaagaaaactgaggcacagaaaagtgaagtgacagagcaaatgcttgttggccctcaatttaggtcttttgactcacatttaaatgtattctttaatgttgcttttctttgttttgtttgtataattatttacctcttccttttgttattgaaagggcttcaccatgaaatatacccatataacaaacctgtacatgtaccccctgaatctaaaataaaacctgaaaaagaaaaaagaaagaaaacagaaataaaaaaaaaaaagaaagcctccacctagaaaatgaggattttactggaattcacagataataaaatacagtgattgagagaatctcctgagaaaataatttgctcaatttgatttgttgtttgtgtaccaaacatgtagtattagattaattcttgctctctatgtctgtcttttttctcagtggtccttccatccgtattttcatctgtagccatccaggtcagttttgaggagatggcctctatgtttgtgttgcattaattcttatacaacaagatttctttattttcttttaatttttacctttaattcttattattgtgcattgtataacccccagatgaaaagattaattggttyggggaaagctcaagaaatactagtcttgacagagtctgaggtcattccaaagctctcccaacacagaaaatgagacagaccctcttagattttacacatttcacgaagtcttatatcacaagtgggaaaatagataattctggaggaatttgtatcaaagctgaaaagctgacatattatttgaaacttaataggatcaaacctccttccagcacagttagggattgggctcttgcaggtgctactgacactcactacaaaggacctgacacgcccacaggttgctagctgcagtggccttgtactagtatgctgctatgctactgtggagaaaattgccattttgactgtgatcaaaacacaattcttttggctatcaaacatccagcaataaatttccattaaaatccaagctctgtaaagccttcttcaggggaaataaacacaaacccccaaaaaggtatcttgtatacatgaaaagaaaaaatcagttttaggttaaaatcagtcttagaggaataggaaaagaggaaatttttaaagaaacccctgaggttcctcttccaaatattggcaaacattcaatcttatttagaatgttgcrttgcctagcaaaatgaaggatatagtacatcrtatccttattaaatcttgtagcagctaatatggtaaaagtccttttgctacaagagcctaaggtgattgaagagggaggtagtaaccaaccactttatttaggccaggactccgatattgttttgttttgttttttaatatggtttgctggataaattcattttcagaccacctattccaatctgattttttaagagccagtaaaggtatgctagattttattttctaaaatataccctcctattttgaatctaatgagctgtttccagtttggatccccaggtatattctgtgaggttgttggaattttgagctgccaaacttaggaccaagtgagttgaagcagttgttgaatggtgactccagcacattgatggcagaatgagtcagggtaatatgcagtcrctccccaaagtcctattctagaggaccagaaacaatttctctcttacataatgaacaaatggstaattcttctagaaagcactcttatgacatatttcaaacatcacatcacatccgatacatcagtcaataaatatgcatccaaatgcttttctccagccatggcacaaactgtttcatcagtgaaattccacaaagtttatgtagacactggagatcacctctgtgccatatacacagcttatgcaacatttaaggctacrtatgatctcagtccccaagagttgtatttgccaagagtagagataagaaaaaattccttcaatgctctcctgtctacstttttagcttcctctctcatcattctctctgccttattattatcattgttgccatgctaaattgcttatatttctttgcataccaagctcattcttaccttggtagctttgttcatgctacgtatccatctgtttggaagtgtttctattcctaccctgtctcccatcttgtctgaatcattcctaagtatcctttaagactcagtccttcatgactttagttcagaaaattattgactattgaaggaacaaatgaatgcatcttgaagaaagttgtggacattaaatagtggaaaggcagatgtggacataccagtctagtttgggagataaaatacatcccatatcccaagtattatagatgaatacctgaaggaaatgttgctgttcattcatacataccaatccacatgggctgtccacataaatgacagaattttgccattcttcttcctttgaattgcctttcctctactcttctttgttattatactatcaccttacattgatggatataataattgtgtaagtattattttttattcactatggggatgtgattaagaataaggctcactggccaggtgtggtggctgatgtctgtaatcccagcaccttgggaggctgaggcaggaggatcacgaggtcaggagattgagaccatcctggctaacacagtgaaaccccatctctastaaaacaaacaaacaaacaaaaaaacaaaaaacaaaaaaaaaacattagtcgggcatggtggcatgtgcttgtagtcccagctactcaggaggctaggctaaggcaggacaatcgcttgaacccgggaggtggaggttgcagtgagccgagatcaagcyactgcactccagcctggtgacagagaatccgtgtcaaaaaaaagatactgctcaccattaatatggtgaatgctyttcttatgaggaccttcaggagaaatttttctcagctcacagtaacataaataattctgttttggagaaattggtttacttttattgtatgagtattaaatatgtaacttgcgatttcrtcaccctttgcattgytgcttgaaagtgtagtgtcagagtgtgatccagagatcagtaaatggtatcaagtagtttgcatgttgtgtgtaagtcacagtccaactttatcttcattgctgtacctcattggccctttagcttatttttcccacttatgtttttatttagtaaaaaagagtatatttttgtacaatgcctattaaggaaaacatacaggtgataaaaatgaagaatacttctggggtaaaatcaaatttattggagtggaatgaagttcctcaggcaaggcatgctgaagtaatcacacccatctsaagccttcagttactgttgatcaacttattttctctagtccagacccaacttctaactacagactcctgtttctacctcccaacagacttctccatataaacattctgcagacaccttgaatttaacttatttaaatctgaattcttgtttgttacactctcatcttgtatttacacgagtgtttttctctttcagggaatgaaatcaccaatctcccaattgctgaagctagtatcctcaaaatcattcatcattcattcattcatttgtccatgattcatagccagtaattctgccttcttggtgtgcttcaaatctgtctcagattgaaatggcttcgcattcctgtctgctactgacttagtctaggatttcrtgatttctcatttgaattattagatgaacaccttggcactaccagatccaccctgctcaccacctagatatcctacatcatgctgctagagtgwtcttttaaaaacaaaacattgaccrtattacacccttacttaaaaccttttaatgagtcaccagtgtgctcaggatgaatccagaatccttagggaaatatacaagaagcttcatgacctggtggtccctccttctccagcctttaaacattactttacatgcgctgctctcccagattctttgcctttctcccaccaaacacataaaactgacacacttgcgtgcacacacacacacactctcatacacatgtttttccccccttagttaattagaacactcttgatgaaagaggagtcgactctttggaaagaatgtacttctagaccaaatatgtagcaataaaggaagggaagaactgcaagtaatagttcagtgagctgactaagcctctttaatattacagccagatcaccagatagtcatgactcaagaaatagccccaaaagtgttcttctaagaagtcttatgtgacccttcctgtctaactttgacttttgtcattgccccttctgcattccctgttgtgattcttcatataacatacttataaacattgaattgctctagacaacttaagggcaggggccatatatgtatatatgtgtatgcatgtgtgcatgtgtgtgtgtatgtgacagggaccaaataattataattttatcctcttctatttgtaagtgcttaatagataagctttgagtacccaataaatgcagtaaggatcttgaaaagactgcaggtagggaataggggaaaggctagtaaaggctttctgagtcaggataattatgagagcacaaaagcatagatgagggaactagyaggtcagggagcagatggcctaggttctagtggtaagtagtcctacaggctttccctcrtttttatccttgttgttcagggaacataaataatcaccagtgacaagggaaagcatattttgttgtcattgtcattattatttacaatctttcattgcatttcaaggaagatggacctttagattgagttccgtttatagtgctgaatgcaatggcaagtgagattgtatggttttggcaggaggagttgaggcagaatggacatagggatrtctgttttttacatagaaagttttaagattatagctggaaggraycttagamtagttgtactcaaagtttgacctatggtccagttctggtcagtccattacaatgacccaagttgataggaagattttaaaatcttttgtattagtctattctcacactgctaataaagacataccagagaccgggtaatttrtaaaggaaagaagtttaatggaccttataaaggaaagaggttccacatggctggggaggcttataatcatggcagaagggaaatgagaagcaaaagcacatcttacatggcagcaggtaagagagcttgtgtaggggaactcccctttataaaaccatcaaatctcatgagacttattcactatcatgaaaacagcatgggaaagctccgcccacatgattcaattacctcccattgggtccttcccatgacatgtgggaattatgggtgctacaattcaagatgagatttgggtggggacacagccataccatatcatctttatagcaacttgaaggagtatttttatatctattgagtctgattaaaaaaaaaagtgggcttctattttgtatacaattattttttatttcatttttgtatgatttttaaaaggaggtggttcatagcagattggaaattacaaagtgctagttcttcactacagatagttagagaagcactcctttagtgtgtatgtttttttagtaacacttaaataatatgctgaacaatttctcctataatttgagtttcctgccagatcctctgaagctcctatgtcaccccagaataagggttcctgatctggctcaaaccagtcatttacaaacaggaaaccaatgctagagaagtcaagtaatctatccacaataccatagtaaagtagaacccaacttagtttccttccattcaactaaactaatgtatttcttcctacttccaaataccccatttctgaccactcagtaccaccagaatgtggcttgggtttctgcttatcaagatttgtaacatactagactgtgccgtgagactttgagggagattcacctgctctgcccacttgtttaagatgacatgcaacacatttatgacattgtagaaaaatgaaggcatgtgggccagcctgtgctgccagaatgtttattaactattgactctaaactccattcttgctgtagcttgcttttttgaataaatcatctcttgactgaatattttatttgtataaattacctttaatttcaaatagatcctggtggtagtacatggaaaatatggcattactaacaaatgtgttttattttgttttcatcctcctgagtcctaggaccatagctggttgtgagagggagaaagagagagaggcaggctatgagaaatggtttctctgaagtttgaagtctgatgtaggagaaaatctgcagtcacaaatgaaagtatcccaggcagagagagggtacctttggctttcctgtcatgcgtgattgatgctttccctttatcactctagctcatgtatcctagaatttttttctctcttgctrccacagtcataattaatgattaaggtacagtaactagcataacacctggctattaatttcaggaagtagattggggtgcatagcatttgacctcacagacgctcaggaggagtctgtacagcttccttcactgcataaagttgaataccttttcctatcccagcagccattttgacagcctgcctacacagaacaagccagtctaacctctttctctgtcaccgtttttttttttcccccagtccatttcacaacctggaaggaataagataaattgcagttgtgtgtgtgtgtgtgtgtgttttaaaggttttaactctaacatgtagaaattcccattatttatgttaacagaaaataaatcctccgttgtacaaaagctttcttccaatgatttagacatgactggttttatgtaaacaatagctctgagaccttgcacctctctttggtccttttgattttatatagtcaggttgcaacttctgtgtttccagattcaaattcctgggtggcatagcctttgctttctccagatagtatctcccaaatattctgtcatagccacagggattgaaatcttattttcatgtattaggctgaagataatataattaagaaggcaaatagtaacccaaacagtcacataatggtatctgtgccaataaaaatgattcaggctggatgtctcttttgagttgttcacataaccactcttgaccataagcacagaaattttgagatgaactaaaagtaaatcttactaattaagtggccagaggttggagaaagtaggaaaataacatagttctcaatttaattaaattcagattgcaagtaattttaatcatgttgacagctatttactttgcatcattttagctaaataagcaacttaacatgacattacatagaatctgttcctcgactaactcaactgccataaaaataatgaatattttggttattttcaagatccaaaatataatttccagctttaggatgggaagttaaaccaactcattttttttcttcccttcatatcttaaccccatgaaaatgactaaagaagcacaaaatgagcaaaaaggtatgtagcaatactagaaaataggaagggtaacatcaagcaagcatactctttcagtaatttatttaaaaagaaaaaaaaaagcagcagcagatggatcgggtttaatcaaggagctgacaatggcttttgttttgctcaatataaaccaggtaaggaagccctgagaggcaagtagacagyctytccagcagaaaactgtgggaatcttatgcttgggaagctgtagcgttgtttaacccccatttgaaagagtgggaatgtcagagagaatcacacaakaggccctctaggatttattagagctctgcagagagaagatrgctgaaatatttgccctggtgcttcttccacttggtgtcatcggcattctaaatgcagttggagcttttcctacccactttaactttgctttttctctttgaaacagatgtatcaggttcatttccagcatatgcacctgggaataaatcaacctttctgttcctctttatgccctgaacacagcaatttcatgacatcaaaggtggcctaagcagagggagcccgtatcaaccactaggatgggcaatctaacgctgaacgcatacatatgaacagataataaagtattacccgtcattggagagaatagggakaaagctgggaattagaacaaatgaaatatagatattacaggtagacaaaagataatgatttagaattctaattgatgtcctcattgatatttgggaggttttttttttcttcactctgtaaaagagcaaacacactgctatgcaaaggagyaatagggtaatattactgaagattattgcacattatctctatgtggtgagaaaactgagrcatagttaatataccttgcccaaggtaaaatagctaggaaagtgctaacccaaggctctagaaagacctacattcagtgcccataaccttaattacactatacactgaataccaaggacttagaaactgaaaagaagatgaccattgttttgaagaaataataaaagaacaacaacaaaaaaacccaaaagcaaataaaaacccttactaggacaagaaaagagcacaacagctatcaataaaaatcagaagcaaacccaaggagttatcccatatgtcagattttaaaagaagaagttagaaaatctcagcaaatattagagaatcttggcactaacacccaatacataaatcttataagaatagatggaattgattgaggagaaacaatagtcacaggagaagatactctcttgagctaaagacttgaggcttcagaccaaaaaaaaaattaacaagtgctgagttagtatagtgataatgaaagaaggctcacatctagatattattgtgagatttctaaatttcaataataaaaagaaaaacctatacacttcctggtagaatgtaaaaatgtttacaaaggcaagaatcaaattggcattgaacttctaatctgacactctaaatttgccagacagtgtgctcagaaagttcttgatacaagcaaaaataaaaataaaaataaaaactcctgtttattttattcagatgtcttttgatgtttctttgaaatgatgaatataataaggtccatatctaatcttcattgcctttaagattatgtagtatatcctttgacgatgtggctgtatttggtatatctaatcataggaatttaattattcataaattggaagcttaaatatatcattttccaccagtaaagatattcttaataaacaagtgtctaggagttttgtatcttaaactaaaagaaaaatttcagtattggagcaagcctggtgtattaaagtgttattttatttgtggtcattacttttacaatgttgtaatgtagacgatttcttttgtttggaaacataacatagaaccacttacaatttagcaacacttaatgaatcttttactcttttcccaatattttttagctacatcaacttcaaagtcaagtttataatttcattaatgtatgtaatatgtctatatggtgatttaacgaacaaaaatctttaacaaagagataagcatgatggaatacataaacaaaggtggtatgcaatctgactaaagtggtgytaaatggtgataaattctgttttcaaatatttttcatgctatttgttatcagctgtggacatttaatgcctcattagcaatagattgaatcagtactttagaatctatccttggcagtagtaaatgcccattatattcaattataatacatgctgatgtggaaagaagttgaaatagaaatggaatttaaggcccagatctggatttgcaactaacatccatatggctttgagaaaattattcaaatatttagaagaataaaataattttattatatattaaaattttcttctaagcctaaaattctgagaccctcagaatatagactgcatgaaagaaggctgatcaatcttaagagctttttggatctaaactgctactccttaaggagctcttctaaactttcttgagcttaaattgaaaatagtttaactcagttgattatacagcacttggtattaagatagtgggtgttgctcgggtgggtggagaaaagcagatgtgatggagggtctctgtgggtatgtggaagtaaagaggtaatttacgtctcctctcccaccataaccaaataccttgtaggaaccagagacactgtgttatttttccatagctttcctttgagtgtctgttttaataaaactgtgagtgacaatgtcgtaaaaaagtcttaaggaaattttgatacataacccccaaagcattgatagcacctcaactttgacatctcatggtaccattttcatcttttttccctamtttttattactttcaataggaaagtggctttcttgttcaatttaaatcagtgagtcaaaaggaaggatggcttggggttgctagtgtttgtttgcaagactgtgaactccgtaagagcagaaaatcttataattttaaaattcaactctttatatcttcttcacacagagcctataactttgttaggtactcactattatttttttgataaaaaatgaatgaccaaggtgaatggccaggatgagggatatatcgatagcatctttgtagcggtgaaaacatagctagccagtaggagtacagagctaattgctggagttctgtagggagtcttcagccccttcctccattctctctgttgatcagctgacttgactacaggtcagttctactgaggccaaggctgtttgcctctatatcctaatgctgacaggtttgaagagttgaggtctcagtttgtcagtctagggcctaacattggacatcacttcaagaataataaccagcatttatttagtccataccaactatgaaacatttacatgactttacatgtatttacttgtatgtattatcctattttatcctcacagcaaccctgggagtgatgtgtactactcttatccccgttttacagaaggaagctgaggcatagagaggctgaataatttgcctcaagccattcagataaagtgacaaatgggactgaaatctaggtagtctgacttcagagtcctgtgatcttaatcatttccttttactacctggtttatcagctgaatatatgtaactgtgtgaaactcatgttgccactcatgtggaggtcagtaactaaaaacattttcattacaattattataactatttagggtttaacaagaaaagtaacagaaaattcaaaagtactttaaaatcggccattttcattctttcaaatatgttctgattccacaataagcaaattcacagcaagaatttggagcattagaattattttttaatttaactgagtatcttcatttaattggtatttttaaaaattggttttctctttcttgggtaatgcataaatcttcaaaggagtaacctaatgcactccaattcaaatattaaaaaaatgatttcaatagatggttttcagcaattgtacaaaattaatatggatcaaatagcttttgtratattgttattgygtcatattttaactataaaaatgcaattaatgctcttatarcatattttatggggttaatttccagaagaattacagttaaactaatgtttctctagtaaatacttaggaataattgaatttgcartttggttcttaatttatactgataattgcttcctacaaaaagacatctctaattgtaatcaaakaatatcctctctcctttgtttaaacagcttctcccaagaaatccaagtcctgttttaaaacacaaaacaactcaaacaaaagcattcttaatggaaacttctaatagaaaagctttatcattagccatgaagttatccacttgagtaatcaaatamtatttaagaatgcttcatttagagaaatgttatgtttcatagactgagaaatataaatcaaactgccaatttctggttggcaggtctgtttgaatctggtgggcacaccctgtggtagacagaattcagatgtctctgcaagattcccattcctggttataatcaaatgctaacctaggtaatgttttgaaggaattttgaatatgaaactaatattactaatcattgacgtttaaagaaaaaggagattagcctagattatccaggtgagatcaatrtaatcacatgaaccctttaagggcagaatcggagaacagaaaaatcagtcggtgaggggagcctagaagagaagaggtagaaggggaggttagaaggatttaaaatgtgagaaggacacagcctattgttgctgcctttaagatggaggaaggggacsctgagccaaggaaagtgattgatctctggaagttaagaaccatccctggagaagagccccaaggaaattgagatgtcagttctatggtagcatggaattgaattcagccactgaccttggcgtggaagtactttctttgctcagaccttcaaataagagcccaggctggccagcaacttgatttggaccttttagaccccaggaatcagctgaacccagccagatttctgacctatagaactgagaacaaatacatttatgttgtggtaggctgttgggtttgtggtaatttgttatggcaacaatagtgaactaatgcgtatcccccccatagtggacatattactctcataatatgttgccataactgtcagaaataattgaaagaagaccttaaagaatgtttagggaaagggagatttctataccatgaatctcaaatgttccttgtttaattttttttcaattctccatattggatgagctttgatttagaagacatctcaaaatttattctatttttcatgcaattgtttttatccccccttcctctcctcaccctcactgcctcactgtgttgctgacagcatttatgaacctcagcattctgtacctctcagggctgtaagattgcagcagaataaactctatttaattaactatacattgacaatattttaaagatgaatcctctctttacctcctcaatagattttatcaaagcttggaaaattcatgctcaaggggactgctatatgcagagccctctgtgaaaggagtgttcctgtcccatcctccacccagtgttccctttccttaactgaaaacagctaccagaaaagaggagctgtgggtaaacatggcagttgaatggcaaaatggaaactttagattattttttaactttagatttctttttctttttttctttttttttgacaaaagtctcgctctgtcacccaggctggagtacagtggtgtgatctcggctcactgcaacctctgcctcccggttcaagtgattctcgtgcctcagcctccagagtagctgggactacaggcacatgccaccatgcctggctaattttgtatttttagtagagatggggtttcaccatgttggccaggatggtctcgaactcctgacctcaagtgatccatcagcctcggcctcccaaagttctgggattacaaacgtgagccaccacgctcgggcaactttagatttcttttaacatgatctgctatgacacacaacttattataatatgaaatattttagctatacaaaaaggccttgagaataatgaatgaacacctgtgttaacaccaagcatacagcatattgtaaaaataattgaggcttaattcgttctccgccctctctcagattatttaatatgttatttcaagtaattgaattatattagagatttagaatattggaacatatatattcagtatatggataatatccaagatataaaaatataccaccatcaaatagcacacaaatggctcatttagataatttggtaatccagtttttatccaagtagtcattgtgtttttaatgtagtcaaaatgtctaatttgggaactttgcacaatgagatatatatatatagaatatatatgtgagatattttattatttatttatttttgagacagggtctgactctgtcgcccaggctggagtgcagtggtgccatctcagctcactgcaacctccaccgcccaggtttaagygattctcatgcctcagcctcccaaatagctgggattacagacgtgcaccaccacmcccggttaatttttgtgttattagtagagacgggttttgccatgttggccaggctggtctcaaacttctggcctcaagtgatccgcccacctcggcctcccaaagtgctgggattatagacatgaaccaccgcacccggccaatatattttatatataagattatatatctttgaatatatatgtgtatgtatgtatatatgtggatgtgtatcacacacacacacacacacacacacacacacacacatatgagagttgagaaaaaagttttaggaacccatcctgataagtatatgtgctttcaaatgattttaatttgtgaaaatggaaacaggctcctcattctaaagaaacatgaccttgtaatcctactttttgcagacatatttcccttttatgtttccyattatattcccctatatagtttccttttccatcatcagttcttaatttccttattacttagcaaaaacgctatttcttagtgatawattagtaaattgagtgttggaaagaaactcttttaatatacccttattagaagaaagcatttaactcttttaatacacccttattagaagcaagcatttaaaacaatctgtaaacctgggctagggtgtgagtgaatgattcatgatcctttcatcaatctgatttgatagtgagtagtttgttattagtaaatcaaacaatttatttttatcatcttctgtgatactttaatgggcagctgtgggcactataagagtatatgcttcaaccctgggagtttataatcttttttgaaaagttaaggcatatgcccatgaaaacaaacagagcaagagccaactagatgtaactgacaaatactgttatagggagaaatgcagtcaatagaatatttaagctgtgctgggaagagatgtctgtacagactactaaaaagaacctcttaagtatagataaattgaagaagtaatgagagtgagccagcacagaattattaaagaaaaacaaaagactaaatcttgcttctttattcacttggcttactaggctgttagaaagtatactagagccaggcaatctggatttctgtgagacacttgacattctttctcagagtgtacaaataaaaaaaaatagaaaactatggattttatgtaaggaaatgtacagttagtaacattaatacctcgatgaagaaatgttagtcaaaacatactgctgatactttaacacaaaatggaaaagttgtgtgcgggacaatattctcagctctgttctcttaacgttgtttctgcaaattactggcatgagcaatcaagatgataggagataaaatttgcaaataatcagagcttcagaaaataatgaatgtattacattccaaaatatctggacaggcgggaatagataaaacctaacaagggcaattttatcagaaataaatttaactttgtgctcttatagtaacaaaattaggcaaaaaaaaaattactactcttcaaaaacaaaccaatcatctaaccaaccaaacacactggaaacctcgcggtagtgaaaatacctttcaacagttgtacaagtaggttagatagatagttttaaggattgtgcttgactataaactcaataggggttaatagtatgattctctgataaaatagctaatgtgctagtgtgatcttaggctatatcactgtttcacagcctttttttaaaaaaaactattatccctttaaggagtccctaaaaatgtttttttctgatcacttccccaatgaaatttgaataccacagatatttaagtacataacayatctgttaatgtactttatgtacattatatgtgctttatacattaaaaaagtaagttttttttccccaagaaccagttttcagcctcttgggggtgatatcactcctgttgagcayttatgggctttatttaatagagaatattctagaaagaagaaagaaaaattctgttcttagcagtccttacaataatgtgtttaattctgaataccacattttaagacatatttcaaaacctaatggcatataaaggagagcaattaggatggcacaacatgaagaaattttaaaggcaagcaatggttattctggggaaaatgcaaaaaaggtgtccttattatacctatgttcaagtatataagagactcttatatgacaaaagtgatcaattttttaacagttgctttaggaaaacattttagctaaatattataagttatttaatccaaagtatccaaagatggaacaggctgcttcattaggagttttgttactaaagtacttgaccctgtggtggggaccatggtagaaaaaagtcaaaccctgaatggacaggatgattttagcatctctttcattcctgaaattccgtaataccaggcagcaaatgaattgaatcttgaaggagaagacagagttagatgtgctcagaggatctcatactccaaagtagacagtctggcttaggaaaatacatgggagtcaaggcaaacgaacttggcttctactgtctgctctgtccagaattccctgtttggccccaactggttaccaacatccaggggcctgttttctcgcctgcaatgtgttggacttatattagattgtgtttatcttttctagttctagaaagctaagattctgtgactcaatgatttatagtaggaaaacttcgttcctattgtctaaccttccccaccagctcaagcaattcacaaagtacttataartcataaaccagctgttttggcccttgagttgtaatatgtgacaaaaatatcattttttggaaagtgtaatctctgagaatagtttagaaaggtgaagggaaaaaatttataaaacaaaagaggtgttttatgattaaaaagaagttatgatcatataaaartattgctagtcaggaatttctgacactgtcatctctccacagctgargatctttcagacttttagaacatcaggcctttaaatcctcaatggacaaatgtggccttactggcctatgctggcattgaaacagatgggtcggggaagttagacaatgtttataagaatccatcaattgactttttcagactcatgattgggtaaagattctcagatatttatgttgtttaaatctaagcctatacaaagaatgtctgaaataaaaaagaatacaaagacagagataaaattgtgtgacttttgcatttgcaggaatcattattgaaattacagcatgcaaagggctttactatgtaaaataccaaaagagttgttgcttttgttgttattattatgtgttgacttgatttctttgactgattcacatcctgaagggtctggcagaaatccaatgctttttatcctccatgaaccaattcttacacccattttagtccaattttgttcatgtttttctcctctgagctgaaatgagctgaagtaagcttcattaactgaaaaggcagaaaatttatatgaaatagtagaaattggggaagctgggagagggcaccatgatatgatggcaagagaagaccttgtgttggcagtgtgaccttgggtaagtcacttaacctgtctgacctgttttcttacttgttatacagagtaactacattggcccagccaatcttttttacataattttttatccgctctgtgtatttgtattaaatcactgggagagtctttacaaaacagagatgtctgggtcctatccagtttgtaggaaggtctggatctctgtttttttttttttttttttttaattttttcagctgactcatattcagccagggtggatgagcaaagctttataatattgtcgtaaggacaaaattgaataatattatcaaaggatcctgaaaggcattatttcaatgagcatttcccagtgagaaatatcagtgagagagatttttttcccatgggatttttcttcctagcaacatcagcttctgggctgaatgctatgttctgctccctaccaggaagagtaggagagacggaacatacctagatgaktccagtcagttaatagtcatgtttctagatttcaggcttgtcgtagtcatggcaccaaagataatgagcctgtatctgtcatttcccaaagggcctgacaaggctcacaactactaggctagcttcatccaaccccacaactagatcagaggccaagatcttctcttctctgcatggagatgggaccaatattcatgaaggtctctgccagtaacttacatacagagctccaaacgtttcctaaaattattccttttatggttggtaaatttagggtcttcaagctgtgctcaattatgtgacttagttagtgctataaatctgattgacactttttaaaaaaactatttgagatgtgacagggcaagagtatcaggagctttcattttattattcaatgtcaaccctataaatatttatataaaagtgtctgggggagattaaacttctgataagtattcagcaggacacagaataaagattaatcttttgtataaaagattaaccttttgtatatgataaaaaattaatataaaatataaaattagtacagaagacatttggcaggagagatataggctgaatttgtatgttgaaatggctacagaggttctaatcttatattaagggaaacaaaagaataactggcaaaaaattttactctttaaggtgacaaaggagagaaaatataagtaatagcagtctttgtccaactagaaaaaattctttggagactaatgctaatttaaaaaggagaaaactatgtttaattcacagtgtaacaattttataagattttataagtatgcagaagtttctgcattctaaaggacaatcttttcttaattttgctctaggtattcactggttacaagactttaacttggtgtacagaactgaactctgattaactttttagagttatgttctgattgattcagtgattctttcaacactagcaatagaaaacaagagataaaaatctcagtcttcttagaagttagtttccagtagagtgggagagaaaggcagcaaactggagagatacaaaataaytgcttttattcatttgtaatgtgtcaggtggtcttaagcctaggtgaaaagcaaagtgggaaaggcataattgggttactggtgaggatttttttttttttttttgtaaaaggcaaaaacctttttaagtggacatttttgcatagaagtaagaaactaagtgagaaagtcatgaaaatatcctggacaaatttggaggacgatggtcccaaagagtgggaagagtaaattctgaggtatgtgaaagggacataaggggaacggtgcattggtttgggagttgatggtcatgactggggaggggccagcttttaggccattgtaaggacattgttaattattctgaaaaaagggggaatcattagaggttttagatggagaagtaacatgatctgaccttttaacagatcattctggctgttgtgtagagaatagattatagtaagataagactggtactttattataatagctctaggaaactcatacagcaattaaggtgaggacgaagaatgtgccattggattcagctccyggargtcagtggtaaattagacagaagcaatttcagtgaagaagggtcaaaatcttgactggagtgggttcaagggaggaaagaccatagaatgaattgaaagtagtaagtaggtaaacattttaagcaggatttatgtgaaggaggaaacaaataaatgaaattatacttgaaggtagatatgagaccaaaggaggcatttttctccttcctttcctttccctgttttttccctcctcccctccttctctctctctctctcagatgaaaatattgctacatgattgaatgctgatggaaataatctattagagaagataaagttgaggatcttgaaggagggaagcagacaacaattgtagtagaaatacccctaagaggcaaaaggagatgggatctggtgcttaagaggaaggattggccttaggactgagacagaaaggacagaggaagraaggccatgggcatagactgagagagtgaatagatgttgagaaagtaagtagaagagctcttccagttgcttctatttgttaatgaaaggggaagaaagtgtacctgcaaaaacaaaagaaaatggtagggttgttgcatatttaagaggtgaagaaaagttaggagatggtcatctaggacagtagggaagttccagcaaaatgtagtaggattgcaggtgtatgctaaacgccctcttaaagttagtgattatgaattcagagagaccagtaagcaaattgtatatgttttgtcattgcaagaatgtatgtcttaattaattgattaatgttgttaaggataccaatgtctccattgttttaagaaaagttaatttagcagcagaattttagtagaatgtattttccccatgaattagacttgccagataaaatagagaagactctgttagatttgaattttagataaacaacaattcgtttttaagcatatgttttctagtttctaaagttcttggatttaacaactgcaaatgtagaggtcacttgcggcatccagaactttttaattttataatgtgtatggatggtgagcagtgcaccagtttttgaaccagactttttgaagctgcatgaaatttttacaaactaactgtgagctgaattgtaattccaccatacgttgattcgactgtttaacattttcactaaaaattaataagaaatgttgaggcayttaaatctcttaccttgctgcttttgccatctctctgggaacatttaccctgttggcagactctcagcaattttacattaatctcttcrgtgataaagcctgcatyaacaaccttcaggctaataaaagttagccttccagcaatagtggcyaaggtgtacattgtacatagttgttggttttttattttgtttttgttttgttttgttttggtgcacttaaaaccctggagaccaagaggggatatgagagtagagatcaatgctttatacctcaagacttacttcttctgccttatgaarttatttttaactaatataaatgttttaagaggtttaaaaagaaaatgacatttgatatgggttggctgtgtcctcaccaaaatctcarcttgaattgtatctcccagaatccccacgtgttgtgggagggatttgaatcatagggggcggtctttcccatgctattctcgtgatagcgaatmagtmtcacaagaaccgatgggtttatcaggggtttgtctcttgccaccaccatttaagaagtgccttttgcctcccgccatgattctgaggcctcccagccatgtggaactataaatccaattaaacttctttttcttcccagtctcagacatgtttttatcagcagtatgaaaatggactaatataatattagattctaaaattggcagaatgaaaatagtgatatgaatggtctaacatgactgatctaattgtttagtatcaaaaaatatatatttcagttggtttatgaataataattatagstataatttattcagtatttactaygtacgaggcactgtactgagcacttaatataccaaactctaacaaaaacacactaagaactcattaattcacttaaccaatattagttgccataggccttgggaaaatattgaataaaagatacagaaatccctgatcccatggagctcacatttcaataggcaaaagtcaataaataaggaataaatatattagatggtgataagtgctttggagagaaaataaagcaggaaatggggatatgggataatgagagtagagatcaattttaaatagggaagtgaaggaagacttctctgagtttgagcaaaaacctgaaaagaattaaagaagtgatacatattatcagctgaggagaaatcattctagggagaagaaataacaagttaaaattcctgggcaaaaagcataccttctatgttgaaggaatttatgataaattttgtatgcattcatactttcttatcagggaccttttgtaaccaaccacatatttatgagatgacaagttggtcactgatttttgcaaggctcaatcccataactttgtctctctagcacaactctaagaactacagcagtatgaaggttgtccctaaagaaatatggatgtcccacctaaccttagagttatcacaagttaagaggttggaggcatatcacaaattaggctatcttatctgcctcatggatcaaaaamcagtgagttaaaagactatcaagtaatattttagtgatctcacagaagaaccacactggcatcttgaggtacacaagtagaaatagagcaaagcccctttctccattcttttagtcaatgagcagtcaccagttgtatgagcaaatgggcaggtaagatcttggaacccrtgtgcataggttaattcmctattctctcttagaatgaggaataggctgggcacagtggctcatgcttgtaataccggcaatttgggagactaaggcagaaggatcttttaagaccaggagtttgagaccatcctgagcaacttagtgagaccctgtcactatgaaaaagaaaaaaaacccaggaatattgtcaatattgtcataatgatattttgactcctagatcctagaagtactttattttcattaaatctcctagggtcttagtctatttgggctgctataaaacaataccataaagtgggtagcttataaacagcggaagtttatttcttacagttctggaggttgggaagtctaagatcaaagctcgggcagatttgatgtctggtgagggcccactttctggttcatagataatactttctaactgtgtcctcacatggcagaagagataaacatgctcccttgggacctctttcwtaaagccactaatcccattcatgagggctctgctctcattaaccatccacctcccaaaggtcccatctcctaataccatcaccttggaggttaggatttaaacatatgaatatttgtaaaaaaacaagcattcagaccatagcagctccactttcggcatttaaatattccttgtaagtacacaataggtctttctaagtcttttctcacaacaacctgttagaaaatataatagaagcaaagatctcagttacaaaactgarctccttctaaataaaactttagctccttctaaaaatctttgtatggttctcttcctcacttatacaggtctctactcaaagttacctcctcagagagaccttctctctccatctaaatacctagtcagtttctatcttattatagtgcttcattttttatttgagcattgtatatctgaagttaaattgaactacacgtatgtgtgtgtgtgtgtgtgtgtgtgtgtgtgtgtgttttcttaattattttttgtctccctaactaaaatgtaaagttcataaggtatggaaaattttcttgttcaatgatatagtcccagttcttagaagagtttcaggtatatcataagcatttaataaatattcattcagtgaatacatgttgaatgagtgaataaatgaatgaatatgactgagaagaaaaaaactgctgggtatggtggctcacacctgtaatcccaacattttgggaagctgaagcggggggatcccttgaggagtttgagaccagcctggtcaacatgacaaaaccctgtctctactaaaattacaaaacttagccaggtgtggtcgtgggtgcctgtagtcccagctactcaggtggctgaggtgtgaggatcgcttgaacccgtgaggcacaggttgcagtcaactgagatcaggccactgcactccaacctgggcaacagagtgagaccctgtctccaaaaaatattttagaaaagagagagaaggccaggctgcaggcagatgatcaggctaccttccatttgtcacacctcttcttttttccgctttttacttcttttgtgtttgcatgcaaactctccaatgctggcacttaacggtagcctcactcattggctttgtcaaaawtatgtgataacacagaacattgacctcctctcttatattttcactgaggcagaataattcccccactgagttgttcaggaattttaaaaggtaatttattctctcatatctttttagttacataatcttgattatcacatcacttaaatttttatttatttatttcttaattgctcattccagaaatagtgtctcataaaaacaagattttagagctggaaaggattttagagagtatccaatctagctcttcattttcaaatgaagaaatgaatgcagagagagagagggagggggagagagagagagagagaaagagagagagagaattttctagtcattgacaagtgatggaaatcagactcaagcccaggtctcccagacaagttactagagtactagagttaggtgaaagttgtgaaaacaataacaaccaaaacaataaagtagcaatgtttctctccctgttcatcagacagaccaaattgaaagggacacacatctccatgataagtatccacatctccatctttgttttacactatagctactcactgccaaaattgctgattgggtttgcttccaacaatcagcaaaaaaagtacaaggacttaagtgtaaatatttcagctgtgatatttccatgttcgatttccctctcaaaattcttaataaccagggtttaattgcacgactgccttcccatacgrtagctttgtaataatttgaagcaaaaagtaaaactatctgattttcaggtaagaaaattgcagaatttattttaaacaatatttagtgactaagattgctgcatgttattgaaaaatgggtrgaaatctattctcaattaataaaataaaaattataaagcagcagacatgcagtagtttacaaagatgaaagtgtgcaagtacattgctyagtaatatagggtctgatttgggagaaattgcaaagatgacagctgttgaagaagacaaatcaaggagagaagtgcctgaaataaagagtcaggaatttgtcatttgcttcagattggatggtgtaagctttaccgtacatattagtggcagcatgtgatgcctatggatcataatgaattgggatgtgtgttgtttttaactgtggcatcctaacattctacacaaacaggtaaacaaacaataccacattgaagaacaggagcaagaacacagtaaggttgctataagattaaagaacgagagctgctttataaagaaaggctctctaaggcaagtcaggatcaaaacttaaaatttgctatctaaaacctgtagagaatattaatcttttcaataaattgggcagccaaatcaagattacaatgtcaaataaaatatggcatgaaccttcttttrgcatcaggtccaagtagagaccatcttaacttcttaacatgtagcttcctcgtgccattctcttaagagagagagaaaataaaatcttctcattaaaactggcactgcatcagaaacactgacctctactcagagaaaaacttcaaattttcttatttgagctctttgcatgaaagtgcaagagtatgaagtgtggggacatatggattatcttttaaaagytttaacaatgacaattttggcaggaaacagctttacaattgtcagaagaatattttttcttactcttgggaaggggctacattgcaaaaaacaaaaacaaaaacaaaaaacaacaacaaaaagcactctctcctttcctctctcttcccccaacatctgaatttattatagccctggaagcaattgaaagcccaggtctagcagtcctggcaaagcattatgtcttatctgttatatccaaatattgtcatgacatggatccaagtgcttcatgtatctgccaacatgcttactctggggagaaaataaaaaagtaaatgtttattggggttaataaaatgcacactagaggcagactttcagtgttagaatgggtgttgaactttacataaactagcaagtcctctctcacctatgtataaagtccttcctaacatccctttctgggctcaaactccttggtcactggaacttcactttctgaagctgctccttctacttcacctgtatttctcatggctacaaaaatcattctttccagatgaaatctacttcattgcagcttctgcatattagttttagttttgctccctgaagaaacataatgtaaaactctaattccttttccatatagcaactacttaagtattgaagcaatcgttatttgctgctgcctgtcttatttaggcaaaatatcctcaattatctaattcttccttatattgcagagatcctttgctgtcctgctcacttttctctggacatgcattggattcactgtttaaaactctgcactttgtagctggttgaccttgggaaaattactcaacttctttgtgctgtggttttctcattagaacactgaaaataataacactatttactggccgtgtactaaaatttatgtaaaacatttaaacagaagattcagtaagtactcaataaacgtttactactacttcttctrttattcctatgacagatatgagccacgtcttccatattgaatctgcttttctgtaagtcccaacatttcggtggatggaattgagcctgaagttacttaatacttgtatatactttctgccatttacctatcactgctcctaaaattgtgtacttatccaacttaagatgagttttgagrcttcaatgctctttgrcaattcttctgtaattcctagttatctccctcagtgtctctgcagtgctttcacccgcttcaccctctcaaacctaaaatcctgccattccttccttactatcagaattgtcctcctactttgctgagaaaattgaagccactagactagagatgcatccttatcctatcaccagacttttaatcatactgcattcattcyatgttttcttcctttctgcccattatactggaatattccctcctggcagggcaaagcatgagtgaatctttccacctgtcttgcttctatcccagataccttgttgtattttaataattataatttctcatttgtttagcatcaccatctttctctcttatagattctcttcatcagaagtaaaatgttcacatttctgtcgtcttaaaawaataactatctgttaaggtttagtactagattgtatatatgttacttttcaaaaaagaaacrtgaaaaatctttttaattgtgcaaatatctttaaagaggtaactattctaatttctactttctaaaccttaagtaattttttaaatgacaaataaaattgtgtttatttatcatgtaccacatgatgttttaaaatatgtatacattgtggaaaggctgaatccagataattaacatgcattacttcacatagttaacatttttttgtggtaagaacacaaaatactttctaagcaattttcaggaatacagttctattaactccactcacygggttgtacaatagatctcttgaacatgttcatcttatccagctgcaatgttgtatcctttgaccattatttccccaactccaccccatcccacagcccatgttaaccactgttccactctttgcttctatgatttcaacctttttagatttcacatgtaagttagatcatgtggtaaagcctgtcttatttcacttactaatgtccctcaggtggatccatgtcatctcaaatgacaggatttccttcttatttaagaccaaatggtattttattgtgtgtatatgccatattttctttagccattcatatgttgacaaacatttagtttgattccatattttggctattgtgaataatgctgtgaggaacatgggaatgcaggcaatctctttgacatactaatttcataccatttggacatatatccagaagtgagattacaagatcatattgtagtggtattttcaaaattttctgaaaaacctctatattattttccatatggctgtactaatttccattcccaccaggagtgtacaagagttccctttcctccacatcctctccaatacttatctttggtccttttgataatagccattgtaacaggtataaggtgatatagctcattgcagttttaatttacatttccttaatggttagtgaagttgaacagtttttcatatacatgttggccagtgtgcatgacttctttggagaaatgtttattcagatattttgcctatttttttaattgggttatttgggtwtttttctattgaggagtttcacatacatttttggtattaactccttatcagatatatggtttacaatattttcttccattccataggttgtctcttcactctgttaattatttccttggctgtgaagaaactttttagcataatgtaatcccatttgtctattttcacttttgttgccttttcttttgagatcatatccaaaaaatcattgcccagacttatgtcatggagattttcctctatgttttcttctagcagttttacagtttcaggtattgcttgatttacatctttaatccattttgagttgatttttacatatggtgtgtgaaaagggtctaatttcatcttctgcatgtagatatccattttccycaacaaaatttattgaagagacttatcttttccacattttctattcttggcaccctcatcagagattagttgatcatatatacatgggttcatttttggactgtctattccattccattggtctttgtgtacgtttttatgccagtaccacactgttttgattactayagctttgtagtatattttgaaatyggagaatgtgatacctctgattgtgttattttggctcaagattgctttggctattcagcatcttttgtgcttgcatatgaattttaggattttttttctattgctatgaaaagtgacattggcattttaatacagattacattgaatatgtagattgcttggaataatacagacattttaaacaatataaactcttttaatcattgaacatgggataactctacttgtgtcttcttcaatttcttttatcaatgtatcagagttttcaatccacaggtcttttacctcgtttaaatttatttctgcgtattttattgcttttgtagctattataaatgggatagttttcttgatttcttttttggagagtttgttgttagtctgtagaaatactactgatttttgtatgttgatgttgtatcctgcaactttctgaatgtatcagttttaagagtagtttagtgaggtcactaattttttctatttataagatcatgtgatctgcaaagaggggcaatttgacttcctcttttccaatctggatgccatttatttttcttttgcctaattgctctggctgggacttacagcactttagttagacagaaccgaaaagaacgggaatccttgtcttattcctaatcttagaggcatccagtatgatattagccatggatttgtcatatatggaatttactgtgttaaggtatgttccttgtatatctaattttttgataatttttattgcaaaaggatattgaattttgttaaatgcttttttcatccatggacatgatcatatttttctgtcctttattctgttaatgtggtgtatcacatttctagattagcttatattcaaccatacctgcatctctggaataaatcctacttgatcatgataaatgttcctttaaatatactgatgaatttggtttgctagtattttgttgaggatatttgtatctatgttcaccaggaatattggcatgtaattttatttttttgtagtgtccttttatggatttggtatggtggtaatgctaacctcatgaaattagtttggaagtatttcttcttcaatgtttttcagaagagtttgagaaggattggaattaattcttctttaaatgtttgataaaattaagcagtgaagccatctggtcctgggttttctttgattggagactttttattactgatttaatcttcttactcattatgagtttgtttggattttctctttcttttgattcaatctgggtgggtgatatctctagaaatttacccatttcttctaggttattcaattattgaaatataattattcataatagtgtcttatactcttttgcattactgtggtatcagttgtaatgtcccctccttcattcataatgttatttgagtctttctcttttttattagtctacttaaagatttgtccattttgattaacttccaaaaagccacttttgttgattttttttctatcattttctcagtcactatttcatttatttctgctctgatttttattatttcctttcttctgctaactttgggcttagttttttttttttttttttttttagttccttgaggtgtaacatttgtttatttgggatcttcctttttattatgggtgtctattgctataaacttctatcttagaactgcttttgctgcatctcattgagaggtgacaacgtgctagcagcccttgctcgctctcggtgcctccttggccttggcatctactctggccaccatttgaggagccttttagccgttgcactgtgggagcccctctctgggctggccgaggcaggagccggctccctttccttgtggggaggtgtagagggagaggcgcgggtgggaaccggccaatgcgggttctgggtgggcgtgggcttggctggccccgcactcggagccgcaggccagcacagcaggccccgagcagtgaggggcttagcacccgggccagcaggtgcagagggtgcgctgggtcccccagcagtgccggccggcgggcactgcgctggaattctctcagggcctcagccgtctcccagcagggcagggcttgggacccttagcctgccatgcaggagcactgccccccaacccccctccccacgcaaggcccgagcctccccgatgggcgctgcccccttctctgcggygcccagtcccattgaccccccaagggctgaggagtgcggcacttggtgtgggactggcaggcagctcagcccagggatcctgcacgtgatccactagaggaagccagctgggctcctgagtcaggtggggacttggagaacttttttgtctagctggaggattgtatatgcacccaatcagcactctgcttctagctcagggtttgtggatgcaccaatcagcactccatatctagctaatctggtggggacttggagaacttttatgtctagctagaggattttaaatgcaccaatcagcactctgtgtctagctaaasgattgtaaacacactgatcagcactctttgtctagctcamggtttgtaaatgtaccaatcagtgctctgtgtctagctaatctagtggggacttccagaacttttgtgtctagctaaaggattgtaaatgcaccaatcagcaccctgtgaaaacagaccaatcagctctctgtaaaatgggccaatcaacaggatgtgggtggggtcagataagggaataaaaggaggctgcccgagccagcggtggcaacgtgttggggtttccttccaggctgtggaagccttgttctttgtggaagctttgggtctgctttgggtctgcaccgcctttatgagctgtaacactcactgtgaaggtctgcagcttcactcctgaagccagcgagaccacaaacccaccaggagggatgaacaactctggacgggaggaaggaacaactccagatgcgccgcctttaagagctgtgacactcaccaggaaggtctgcagcttcattcctgaagccagcgagaccacgaacccaccagaaggaataaactctggacacatctgaacatctgaaggaatgaactccggacacaccatctttaaaaactgtaacattcatcgtgagggtccgcggcttcattcttgaagtcagcgagaccaagaacccaccaattccggacacatcatgagttttgctgttttgtgtctctcttttcacttatctcaaaatagtttttaatttctcttttactttcttctttgattcgttggttgttaaagagcatattgtttaagtttcatatatttgtgaagtttttgaaatttttccagttaactgatttctaatttcttaccattatgatcagaaaaaatacttaatatgattacatcttttcaaatttgttaagacttgttttgccaatatttctgtgctacacccgggttctgtaatctcccacatgggttcttaagctcttgtgaatgacctaacatatgatctaccctgaagaatgttctgtgtgtgtttgagaaaaaagtatattctgctgctgcttaatgggaatgttctgtatatgtctgttgggtctatttggtctaaagtgtagttttaatctgatgtttacttattgatattttttctggataattttttcattgctgaaagtgggatatttgagtcccctgctattgagaccaggagtgctaatctggtgttggggcctgaggcctgggactgcatgggatgttttagcttccggcttgtctgaaacctggggtaagcctgaagcccgagtctgtggggcttaacctggaggctgggtcccaaggtgctggcctgtgtcaggcctggtcctgggtcaggcttatgcctacatctgtgatgtctggttctgaccaagggccagggctggtagggcttgcctgatactggggctgttcccgagcctagggctgctggggtcagcctggcagtggggcaggcccagagattgagtctattgagcaggcatggatcccagggctgtgggagctatcctagaatccaggtgggcctggaagcttagtctgcaggtatcagcctggagtctggggccataggtgcctgcgtgaagttgggttttgctggagcaggcccagtgttgggttccacagtaagtttggtgctcactttccttcccgtaagggttgggtattgctgctgtctgtgtccgtgctgtatacagtttgtgaagcggcttcacaggtgatttaaaactgtccttcttacctttatcagtgtgtctttcttatttctgtgctccactcagcttctgtaatctctcacatggtttctttagctcttgtgaacttttgtttgtgcatggatatttgttcaaattaatgtttctctgtggggataagcactggaaagttctcttccaccatctttataaaccttttctaattcttatttctactttttattttacctcccatctactccttaattcactctaatcaaacttcagtcgcattctccactgaaatcattgcaatgtttgcaagtattgttcaatcattcctcctttaaacactcttttcttctggmacctattatgccacactctcctgattttccttctacctctctggccatttcctatgaatctactttgtgggtgtttttctactgcctatgttagcgttcctttaaattctgccctaggtattcttctcctaaagagaattctacacaccctcccagaacaagcttatctatttctttgccttaacaacccagctatatgcagatggatctcaaatacacatctcccatctgtaatgatttttctcctgaatttccaacctgtrtataaacyactaygtaatatatatacccaaaaatcagcatatctaaaggagaacttctgtcctcatctaattccrctgccacgcctgtacttttttctccattacctctcgatgaattgtatttatgttcatctggtttcccaaacaaaagtctgggaatcatctttgatttttttacaatcattttttcttgtatgtagctagaatatttcttataatgtgcaaatcttaatttgtcaatgttcttcagaaaacattttagtgtctccccattactgtttgtatraattaaggatcacttgtccccggtctttaggtaggattcgcatattcgactcttttttagagatcatggctacaattcatagctatcttgggcaaattccttctgtgtaatggcatatgaatcattaagtcttaagatggtatggaactccatgacattaatttttttctttttgatgtttgtttaatcctcttaaaaacactcattcaccatggcgggccagagtgatttcccgcagagtgattttcctaatgcccttttgatgggcatcagccgctgtgggcaacacagggtcccttaccccaaaccagtggaatcagaatccctggggaagggacacaagtggaaggcttttgtaaragttcttctggtgatgctaatgagctgtcagggtttaaaacctctggttgagagctgttaggccaatggaggatacataaaagcagggycaatgggatggaaacatggaagttaacagacagggaggaatcatatcaaagataatattctttcaaactttgtagtgttaggtgctccaaatttttatagggggcttgcatctttgggaatggctagggagggttcaacttaagctctccaaacaatctataggcagtttatctctttacttttgctctgagctcattatcattccagcactgaatttcttttttgatagcatatgcttctcttttcttcttcttttcaaaaacatatataaagagttctttttggctgggcacggtggctcacgcctgtaatcccagtacttggggagaccaaggcgggtggatcacgaggtcagaagatcgagaccatcctggctaacaaggtgaaatgccctctctactaaaaatacaaaaaaaaaaaaaatttagctgggcgtggtggcaggtgcctgtagtcccagctactcgggaggctgaggcaggagaatggcctgaacccaggaggcggagcttgcagtgagccaaggtcacaccactgcactccagcctaggcgacagagcaagactctgtctcaagaaaaaaaaaaaaaagagtaatttttataactctctatctctgctattcttcaaaattacttaaatgttaactacattgtgaagacttttgtagtcttcttttccccaaatatagttaattaataactccagcctgcctgttcccaaagtattttaaacaattacctagtcatagttactttcctgtattttgattttttggtttgcatatcactttttcactctggactatgggaccctgaaagcaagaagctcataataaattaatgatggaatgattagatgaacagatgatatatactttgactctcctggcttgtagtgtatgaaccctttagatgttaatttttggttttacaatgtccattcattcttttaccaaacatgattgagcacaacttgtgtgttaaggcctgtgcgaggcacttatttcwtctgaattttgtccatttacatataagcttctcatggagtctgaggtgcagccgcattctttttctttttttttttcttttttgcttgagatcacagaattattattgatagccttcaaaccctctcaaagtgtcagaataagaggtcattaattatacccatttttctctgaagtttttggaatctagcatggccacatatctgggctactataaactaaaatttacaaggtaattttgttcagagtttccactacttcagtcacaaatgcttttagattggttagcacaggattagaagagcactcctcttgtgactgcttttccatctgaacaagacttgccaaggatgctgtatgttgatgggaatcccagtgagtgaatgatggaagctcaggttgctgctctgtactgctttggttctaattgtggagtctctatcagggaagcctcatcacttttctcaatcttgcctggcaatttagagtataccttaataacataatgtattttcatctctctttcacctttaaaagtatgtggttttagcagattaccracaaaagatgtmtgtatttccatacagacatgtctttattgacagtcttctactccctaccccttccacttgccccaaaaaaggtcagcactattataataaaattgacacttctattgctgtgactgagttattgttttgctcccataacattctgtgatgactacatagttaaagttaactctttgtgctataatctcattttttgtttctgtcccatccgttgtgctggaatgctgatgcctatccacacgtccgcatgtatggttcaagtggatattctattttttcacatcaatttttttcatattgtattagtttattagtcttcctccaatgccagaactttatctgcctttgctctgttatcctagaacatttctgtttctttctttaatttcattatagttcccaaaaggatttatatgcaatttcttcaaaatcctggcaagtttttggaaatataaatgcatgtggtctaaatttacaatgaatagcaaaaatagttaaataataaaaagaggtaaataaagtgggraaaagtactctacctgatattaagttttacactatagctgcaataatcaaagtggtgtgacattgccagagcatagacacatagatcaatggaacagaatagggcagcgatccccaacctttttgggaccagggaccagtttcatggaagacaatttttccacggatagtgagtggaggcaggggtgttttcaagatgaaactgtgccacctcagatcatcaggcattagattctcataaaggacgtgcaacctagatttcttgcatgtgctgttcacaatagggttggagctcgtatgagaatctaatgccaccgctgatctgacagaaggcaaagatcaggcagtaaagttcactcaccaatcctgctgtgtggcttggttgctgataggccacagactggtagttgtctgtggcccaggggttggggagccctggaataggggacccataaatatccccacacaaaaatctgtatattcaacacatttttgacaaagatgcaaaaccaatttaatagaagaaagacagcattttccacaaatggtgttggagcaatttgacacctataggcagcaaaatgagttccgaacgaagtctcacactgtacacaaaaataaactcaaaatggatcagagacaaaggtaaaatattaaaaaattataatataaatacaaaaygtttagaacaaaataggaaaaaatattcgggatctagggctaggcagagtycttgataccacaatcatgaagtgtgaatttaaaaaattgatgaattagacttcatcaaaatgtaaaatgctaactttgtgaaarccatgtgagaataaaattacaagctaaagaatgggagaacayatttgtattgtacatatataccatggaatactactcagcaataaaaaggaataaactgttgataaacaccttaggttgaataaatctccaagaattatgttatgaaaaaaatcccaaaagattacatactatataattccacttataaaacattttgaaataataaaatttagaaatggggaatagttagtggttgtgtgggggcactgagctagcaggaggatgtgggattttgaaggagggagatggatatagttataaaaaggcaacatgaatactcttgtggtgtgggaactgttcaacatcttgactgcggtggtgaatccatgaacctacacaggtgacaaaattgtatagacttattgcacacccacccataccacactaagaaaaattaatacaagtaaaactggagaaaaataagatcagtgagttatatcagtgtcaagaccctgaaaatatagtcttacaaaatgttaccacagggggatgatgtggtaacattttgtaagacggggataaagtttgcaagggatgtctctatattatttcttacaactgcatgtgaatttgtaattatctcaataaagaacccaactaaaatttatttcagacatttacatagtgtctaatatattgtgtatgtgtgtatatmtatatataaacatatatatatatatacatatttgggggggatctgggggtttggatcaagtaagagacttggtctcaaaatatatatatgtaaaatataaaatacayatgtaaaatatactatatgtaaaatatatataatatatgtaaagtattattttatatatatatatakakagagagagasagacagacagacagacagacagacagacagacagagagaccaagtctcttattccgtcactcaggctagtgtgcagtagcatgatcatggcttactgaagcctcaacctcccaagctcaaccaatcctcccaccttaaccccgccaagtagctaggactacaggcatgtgccaccatgcctggctaatttttgtattttttgcagagacgggggcttgtcatattgcccaggctggtctcgaactcccaggctcaagtgatctgcctgtcttggtctctgaaagtgctgggattataggcatgagcctccatgcctggcctattttgtcagcacaccattatattgctgttttctttttgtggcacagctgaaatgttctctactagagctgttacacatcttgtactttcttctttgtgtaaaacttatttgaatgaatcatgatttggaaataaaataaatatttggaaatagaaaaatatacctaacaaaggtagaatgaagagaagggatatgtcttttataaaatggtcaattttgaatttgtgaggacagatacaaatacttgtaattgttaatgaagtgaattagtaaccttcggtttgcagcagagaaagcttagaataaagtagttgttgaacccctttatgtgttacaacagatgaaaaatagagcaagggaccatggggaattatcaatgagttataaaagaagatgattgatgtttatgctagatacctatttcatcagaatagttggggttagtaatgatattaactctactagaaataagaagatgcccttaagtagtcttccatttagagcttatgatgccaatatagctatgctcacaaagatttcagkttctaaaataaatgttgacagggagtagattttattaaggaatgaagattttaagtagattaatarcatgcttccagtcacaaacatggtcttcagttacccagcagagccaagttgctattttcatgtacaagatacattgaattcagatcagtatacaattaaataagaaaatattttctacttggaaataaaatttggtttaaaggataatgtggactcctgattgctgttgacaagatttacaagtttagattgtaaattatgtgataattgttttaagtcactaaactgtgtgatgatttgttattctctgttagctagctggagcacctacatttaagtttgttataatctgatctttgttatcatctgacctctctgtatctatctccatcatctatctatatatgtgtatctatgtatctatctagctctctccctttcaaggctttcctttacatggaagatttgaaaaggtctttttagtggtctgcttaaagagttggtctagaaacaggtactttcacaataatcgctagaacttgtctggaaatgcccctaggattctaaagcagagccttcaacagttaagatgttgactttttcatgttaaagaagaaatcctgcaaggatgtcactgcaaaaataataaattaagtacttaatggtatgctaataaagttttctttgccccttattctctaatttatgtacacaaaagcttattggtaactgtaggcttttaaaatatttggagaatgtttattatatatatatatttttgaaaatggcgggcatttatatttagtaccttgtttggaaatatttctagccaagggaatagtaaagctctggtaaacacacaggtgcttgtatagcagttatagtacactgaataacagtgataggttaaacacattgtatcaaattgaaaagtggagatatgccaatgacagatatcttggcagcggttcatactctgcaacactcacacaactggtgtgtagggtgagtaattttctacctgacctgctgattttctgtgaatatattcaagtactgtttaaatgacctagtcatgttttctgggtggagggaatgtaagatttgatatcaggttttgtgtgtgtgtgtgtgtgtgtgtgtgtttgtgtgtgtgtgtgtgtgtgtgtattttaaagaaatatcaacattttaattgcagaattttctgaagaaaatgagaatttcaattatctattatttcaggctgtggcagtttaactttcatatgagaagttagggatagatgagcctgacccaaagaacatctggaagtaagctaatttctcgacctttgtttcgttttatccacatatcatggcattgaattgtgactatctgctgcctgtttatctataatggttcttttgcacagaagaaggcaacaggctcagataagttctgtattctcaaaccttaccttagaattgccatttttatggttgtattcataatttcaaatgtgttctgctgtagctttgggttttttgttttgtttttcatttacagagtccctagcaaggaatgagaagcctgctggctataagacatattttgcatacattttgaagtacttttaacaaggagacagcaaagcagaccattatttgctagatgcagttacaactgcttggactcatgaacaattccagggcaggggtcctggattctaacacctgacaaactaatattaagagatgtttctctctcaatgaaagttttttatcacaatgaaaaagagcagtaagcacatattaaatatgttttaaataaaggaataaacttgtcttcagtttccaagttaaactatatttcaaaagatcaaataacaaagataacacacagctgttcctgtcatctaatggtgcataataaatcatcccaaaatgtggtgacttaagacaacaatcatttattatctcttatagtttctgtgggttaggagcagtcacaagcccttacccagattcaatggaaagagtgtagacccattttagggagattatgtgggttgagacataatattagtctggccatttttagaaaatgcaatatgctacaacatggaaatttctttttctacaaagaagtgtcacaagattggtggcttcaytggctatatgtagttatatctatgtgtgttggaatttatatctttaaatttaatatggcataaaaagcatttctcaacaacttcatttttcaaaggaattattgcaatgactataattttccttcctaaggataggccataacttaacacttatatgacagtttcatttttttgctgttataaacaacactctactacatatatacatatacttctagatagagtggttccttaattgtatcacttgggattgcatttggctgcaaataacaatcaatttaaaaatgatttttgtttttttctcccatgtcaaaaagttgaggggttggtgattgctagcatgcgttcatttgctcaatgatgtttccaaggatcttttggatgcttggtatgtttgttcgcttttatctttatagttttaagattatgtctgccctcttggtattttgtctgcatcccagwtgggaggagaacaaaggggaaaaagtcaaaggaatatattctagtgaatcttgactactaatggtggggggaaaaattcttccctggggaactgtgcctaatctcattggcacatggttcagcctagcaataaaggagaccgaaaaaatgagtattctgtttgctgggtattatgattttcttaagttggctccccgtaagtatactttgatacggatagttctatcctgaagatttactggggagtaatcttcagagataagcctgtaatgaagggagaaaggtagaattgggtagaagcagcagctgacttacaatgaatgtggttgcaactgaaaccttacctgaactcttagggactctggagctcaggtgacctttcagaattgtcacatgtagaggcaagggacctatgcctttgtaatcccaactcactccatcattaattgtgagcttcccctgggaagagacattgccttggggaaggtagtttcctacaacctaggacagttcctagtgaacgactatgccatgagtggtyratagcagttatccccagcagctgaaagatggatgtatccaatatgaagaggagatatggccagagctctgtgatatgcaatagaggggagaaaagacacaggaaagaggagttgagagtaggcattgggtgagtttatctgccacactgaaaatgtgtattttgtgtatttactcttttgtatttaacagtgttttccaaaacttttaattaagcacatattccttttgaaataataagatttctgaacacttaaagtaaaatatatctgcatgtatgtagctatacagacagagagagagagagaggtgcacagttcatccgtagtataattgtagaagagaaacaagtcttttttttaaacttacctagggatttaaaatgactacagtaatgaattaaaagtgacatatatgaagtaaaatctttgacttggtaaatttattcatgttattttagctttacatgcatacttatttaaacataaaaggacacacagtattagaatgattcttgttacagattatgtctttttaaggtagttatgaactcccaaagcacagtgttgcatagtgacttctaaataaatacttcaagttttatctttttactggagaatatgaaagagtggagagttagaaggatttaaagttatattwttgagtcatactctaaaatatgtgatgtgtttccactaactggacatatttgaggggaccacaaatatgaatccctttgggttagtcatcttcatggaagatgagtaaaatataagataacagtaaataaagttcattctgtctggattccaatacctatactgccatttctccttttttcaaatcatactgcttcctatattcatagcrcaacctctacttcatcagcacctgctaacagagcaaggataaatacgaatactttattggacccactaataaaaatggccactgtaactaggatgcagatcttgaaataataaaatgtttttttcaaaactatcttaaatactcactgtaactcataatatttaactggagaagmaattataattgatttctttttctatggttcaactaatgtaccatagcmtttgaggcttttccctcatgaatttgtggctcccaaaacagtgatttcaggtacacttactgcattatagcaaaatattctattcaatttactaaacgtagatataaaactagcccctggctcacagactctatttccaaagcaacaggaaatgaattattcaccaacagagaaatatatttttatttctctgcacataaatatatgtttaaagtgcaaagattaaaaaaaacatattgtttgttatgttttatttaccacagagacagtgatgtgaaaaaggcagaatgagaggaaaagtatgagggattttgtattctacaagatgggataactagtgggaagggaaagaaactatgtgacaagaataacgaatgggcgggggagaaaagagaaaagaatgatagttcagagcccagaaatcaacaaaggtaggtcaactgtgattcctggagataccagaaagtaccagctgtgatcacagcagtacattgattatgtagagactgaattcagtttcagagaagggaagatgatggtgtgggccttgaaaaaagaggatgtggaagatgaatggaggaagacagcagggactggcattagtctatttatgggaaaagaaagagcaacagattttagcctattaatttcaagtgaatagattaagcctattaatatcaattgaatataattgcctgcccccgcccagaagtccacttctagagttggggcggcggaggggtgggcggcggcgggaggatattatattcaattaaagtccgcttctagaggatgcagggaaaatacattcatttgaaattaataggctaaatagaatgtgctgggaaagaggaaatcacgaattgcacttgagttgccagcaacccttagagatgtctgaaaagcaaatttaaaaacaagtcacttgcaggaacagtttccagttcttaataagataattcagaatttgagacaaaatcatgaacaaagattgcaagagggattttgctaagctaaaaacccttgcagagaacgcctagaatggcattgcttagatttaagctttttcttggaaatgtgagaagtgrcgcagctgacagtcttgtcttgttcttccagtggtggaaggtgataatgagccatcagggtccaaagggtaggctgttagggaagagaaacattgtgcctggacaaacagcataatcagccctcaagtaatccagccatggttgtggttttatgcagggatggcagctgcccattagtgttaattaaccaacaaggtgtgggtgtgctttccaaagactggcagccaggggcaggagggatccatagtagtcagaggctgaaggtgagggtaggactctaacttctgtgatgaaaaatgaactgggcttttattggcattctctgtttctggctactgagcatccaggacgctttgtactctgtgtcccaagggggaggtgctcattaaggttaccatctcataggtgagaaagctcagcctctgccctcaagagctggggaaggaagcaacctgtctcctgacttctggaacaaaacggcatacactgagcaaagccagaatgctgtgggatttctttcttcagaggctgagcctgacaacggtttgaaaggctccaggtgcagtgcaagcaagccagccttctgaaacagggtcaaaaactggactagttgatggcaaatgccctccaactcctgtgactcagactcagagcctttgagcaatgctggtgagaatccaggcctggctggtgcaaccatgtagtgccatgtggctgatgtgcatggagctaccttgaatgcagcattgctttcttgaattttgatttaagtttcatgttacttgacataagaattgaaaacaactaaatacataggaagtattgtaataaggatagaaataaaataacatgcaatgtaactttcagtatttgcaataacagttttcattagaccattcactatttcttaaagagaatttgtatttaaacgaaacatttctgatttatccaaaaatcttctgttactgggatttattaatattaaaacttctatgttttctatcaacacatttttatatgacagtcttatttttagagttttattaaacaattcaattgatatatagaaattgtctttctttaagactttttaaaactatccagctaacattttttaaagcttcactgcgttatctccttattatgaagcccatcagcatttagtgttttactcgtttagcatagtatacactgtcatttaaatgttttcattattaatagctctaaatgttttgtgtatttacatctaaatctctcatttattgaagcatggcaactactttttccccatcttctcttctttttctttcagtgcctggaacatgcctgatagataataaatatttgtggattttgttgttgtctttaggcctctgtaaagagatcaatcataaataagtatagagaagacaacgtgaaaaatattttatttgcaatgttgggttaaatgtattcaacagaagctttaagaacccactgcttgcaatatcttagaaccaaaaagaggagtaagatggtttctgtcttcaaggatttcacaatttaaccttgtgcaaatagaattmatatgttggtttgctctaattatggaaggttagtatacaagatcccttcttactcctccctcctcccttctagaactactaggaaccataaataatatatatttaaaaaaattactaagattacactgcaagtgtcttatcctatcctctagtaatggccactactcacagtatgtgtccagtatttcagtgtgctgtagaggtacaggggtagttaagattaaacctgtaatagcttatgcccctgctaacgttaaagggcctaaatattttattttcttttaattctatattacataattagctatacttcatttttatcatataattaaatgcagaacacattcaaggagccctcctgagattcagggacccaagaatgaggggatatgaaatcatagtatttaataatagtacatgcacatatttgtaaattttgctcggacttcatatatacatacacaaatgtgcttgcctctcttccactccacacacacacacacacacacacacacacacacacacacacacacagtgttcttccaatttgtttcactcattatcggcaatttatactcagagacaaggggctttctctgggattataattatggtaaatttcaaagcttctttgcctatttccttcaaagtcataataaatagatgcctacaggaaaaaaatagtttcacagattattgttatgatgtcttcgaagatagaagttgccagatgattgattgcctactgtcattctactaagagacccgttcttttgtgaaagtaaggaatgaatctgggtgtgtatttcgtgattagttagggaatcaggtgatattgatggtctcatccacatccaggaagtttacacaattgcaattcaattaactttgtcctatgcaacaccttctgttcccatgatagcatttgaacagtgcaatatgtacaaaacatgttgattcagaaatagactcactgaaaactttatattggttttaatatattgtatctctctttaagaaaatcccttctctttctgccatgtgagaaatcaggtcactggtcataaaattgctttgaaatttgacagcaatttcaatgataatgaaagctaattatagcattgttttgacatctaccctttccacaatgatcctattaataaacacttattagacctgcatgcttcatatttattcttgacctcagtgacaacaaagaataacactagtttaggaaacaacacttaatcctgtctttaatttatagtttagatttgtttcatctctttggtacttcaatatattttatttggtactgtttattatattaaatttactaggcaggtgacacatacttttatcctttgagtggtgattctgaggtgaataatagcttaatttagagagggaccttgaataaactatctagctggttttaccattataatttacatcacacagcaatatgaggtgtgtgtgtccatttacagttatatattgttccaaactaaaagggaaatatatttggcaaaatgggactcttagagcagtctacattgcagacttcaatttgagctatgtaacatatatttctcataatttattggaagcaataatactgtaacagccaaatatgtttgagtttgtgtgtatgtgtgttttcatctcaattgcttcttttgtgatggcacattctgacgcagcatactgatacctctttttcagaacaatgttgacatatgtccacttagacaaatgaatattttcatctttaatgacttatttgagagggacaagaatttcagacacaaatttgaatagaattggaggtgtgagtaagataggaaaaaggaagaaatgtaggaccatgttataattattcaatcataagaatcattaccttatatctgctgcagacacacacacacacacacacacacacacacacacacacaccatgcacagagtacctttccaaacatgttgaatttaaattcattattaagatcaatattggctggtatgattttgtcattgataagaagctttaattgacttgtttttgtgccattatttgacattaagacaaggtaaaaccagtgccttgtttccctactgtgaattctcaatcatttttgtgaatcatcattttaaatataacagcatatgagaccatgaaaactattttctgcttagcagcatttttttctatgtaatcattatatatgtgtattttctggaaaccttatttataaatggttctgtatcttcaggcttcgcaataagtgtcatgattaatacaattttcttgattggtattaaaaattcacatacaggtatagataggttttattctcttcaaaatgattcatttttattataataagccaaattataaattattaagaatatagaaaaggaaagttgaaattaccttgattttcactcctcagagatcatcacaattgccattttggggaggatcattttggatatcacatttccatatgcatacacaaaaccttaccatctttcataaatgagattattacacatgctgttttacttgtcattggtgtgttccatatacaccaatacatataggactatttcatcaatcgcgtttttttgtaaattagaaaactaatttcactgttaatatagtgaaaaatatacttggaaaaacttcagtcgatatagaaacatagtcaaaaggggatacttctcttcatagcaatagtaatcctaccttctctcccatatataactcaaattaacagtaggaattatcactgtggacattatactttgcatttatacataattttaagtaaataatttttttttttgagayggagtcttgctctgttgcccaggctggagtgcagtggcaggatctcggctcactgcaagctctgccttctgggttcacgccattctcctgccttagcctcccaagtagctgggactacaagtgcccgccaccaaacccggctaattttttgtatttttagtagagacggggtttcaccatgttagccaggatggtcttgatctcctgacctcgtgatctgcccgccttggcctcccaaagtgctgggattacaggcgtgagccactgcacctggtcatgtaagtaaataattttaaatagaatcatgttttccattctgcagtatctcacttaaaattatatacttgagatattttacagcagcataacattttattttttttacagaatcataatattacataatttattctccactgttaaatatttagattcattttcgcttttacaaataaagttttcacgtggctgtgagtctgttcacatatgcaagtatttctgaatgacagattccattaaattgaattgctacagttctgaacattttaaattttcgtaggtgaaactaaattgctctctgaaaagttggccatttaccttccagttgtatccccatattctcagcagtattggataatatcaaaaactttttacatatttctgatctgatgagcaaaaaccgtgattttcttgcttagttgaatatcctgcttagtaagagctagactgagaatcttttcatgtatttattagtcatatttcatatgtaaagtctctatttaaatattttgtccatttttaatggccttttttccttattgatacttaggagctatttatacctgtggataataatttttattatcaaatataaaaacaaagttttgcctatcttttgtattttaactttattttcaatattttgacatttaaaattttttatgtagtaatatattctagcctttttacataattgcacttttctcctgaaagtagagagcaggaaattgggccatcaccaatattttttaccattaccctgaaaaacactaaatttttgtgtttttaattactggcacataatacttttcttcattcttttttttttttttttttttgagatggagtttcattcttgtcacccaggctggaatgcaatgaagtgatctcggctcacttcaacctctgcctcccaggttcaagcgattctcctgcctcggcctcccaagtagctgggattacaggcatgcgccaccaagcccggctaatttttgtattttttagtagagatggggttgcaccgtgttggccaggctggtctcaaactcttgacctcaggagattcacccacctcagcctcccaaagtgccgggattacagacgtgagccaccgtacccagcccattccccatttttataaaayttatttgccagcctttcatatattcttccagatgcacattaaaatttacctaagttcagtatagctctatamatttaatagacaaattttatgagagataacattatattttgcaatactgagtttttccatccaggaatctgatatttctcactattcattccattctctttttatatcattaagtaaaatttaatacatrtatagatatgcacacatatctataattgtgcttatttcaatagatatatactgctatgaaatttataatatttagttgctataataacaaattttgtcatgaaaacttttawaatatatagaaaaatatattattcatctcacattcattctgcatgaagaagtgttacygaatactcaatagtaataacagttttcagataatcttgttttccctaggtagacaattttgagacctgggaataaatatagttatttgttaacaatatttgcatctattgcttttttttattcatttagatttactagaaccttgagtaaaatattgattaacctcacttatagtgggaatgcttatcttaatcttgaattttgagcatgacacttgctggaaatttctggattttgtttgagattaagaattattcttcctattcatagattgctaaggttttgagtttgttttttagtgtagttttgctttgctttaatcagaataggcataaacctgtcatcaatgctttttaaaaatctattgatatccagttcaaaaaggaatttcagtattagatctctcagtcatgagtcatttgttcattctgggaataaacaacattgtcttgctttattattattttttattacacagttgaattaaattggctaatatttcatctacaaattcatgtttaaattaataggaacrttgcctgatagctcttctcctttgtctaatttctgtctaattttgttatcagttacataagcagtaaaacaaaattattgaaatggaaagaggtctagaaatgaagtcaatctgttcctcatcttatagatggatgaccaaagacagagaggtaaagcaaaactaatatcagagaccggattgtgtgattgaggattcataaaatttgggaagcagcttgagatgcaaagttcaagagaatatgaatttcctaagtaataatttgtctccatgtaacactcttactacagtcatctctatgaagttcacctacctctatcttcttrtagtatttggagacagagttttagtttttgatcctttcacgtgtccctttaaatagattgtgcttgttgggattcactttcattgattttgacttctatcatttccctgacagttcccagcccacataataggtgcataatcaatatttgttagttgatgaaattgtttccctgcaatttgctatgtgcttttacagcacagttatattagttaaatattctacagarcccataattcataatcatttcttattactaccaagggaagcagagcagcgctgcttcactaggagaaagagaagggctgacttgttagccagaggtcattyggtgccaacatggggagatcacagctctttctgcaattatcagaagcagagcatatattacattctgaaatagacaatgaagctcttggatttgtcgatggaagttactgtgcctctttccatctgccacacttgccaacatttggcatccagcttgggccctttaagagttactttacttgattaaaaataaataaattaaaagctaaattgggacctattcartagttccatatttgatatcttaagtgaaggtaaaacttgaaagaagctgccccccaagccttgttaaggatgatggccagactagaagaaaaacaagtacttttcttgaaagtccagttgtctaagcctttgtagaatattgaaaatgaatttcaaaggaaaaatttcattcctctttatttcttgtcctgaatttctgctgctgactcctcccttaaaacccatttttcttctatttgtcatctcatgttcatcaagaagatgatacattctcaagcatactgattcaggcattcatgcattcattcacyccccaaagaactatttatagactgtctactgtgtgtcaggtactggcactgtaggctgaatgatgagcaaatacaggggtggtccctgcttttataaatctggggaaatgtatgctaatcaaataatcttcccagtgaacatataattataaactgagaatcatgctctgaaggaaaaatctgacttaggtgggcagaagtttcaggtattctgtgtggaggtggaggacagtgttggtgaaaaactttccaaggaattacttttgagcagagatctgatggatagcagttaagcaagtataagtggtgtgaaggtggctgtgaaaagggaggaagagagcattccagccaacagagaacagtatgtacagatgttttctggcagaagcaagcattgatacataaaagtacattgatatagctgaagcaaagagagaacaagaactacacatgatgactctcaggccagactgcaagacgtagtagggatgggggtatgatgtggggatggaaaggtgatgatgggggaaccaaatttgcatctgaaaaaatttgttggctgcaatgtgaacatattgtagagaaagaacatttgctgacaacaaaagctaaaactggaaacaagaataaaataaataaaactgatcaaaatcttaactagggtagaggacagcaaaaatataggttggtgcaaaagtaattgcagtttctgccattgcaaaaaccacaatcacttttgcaccaacctaatacatgatttgagatattactgagaggtaaaatgttttaaaatggatagatgggagaatgagagagtgagtattatccaggcgacctgtagctctctgccttgagtcataagactcatggggttactttacctcatacacagtcctctgttcatgtcagactagtttaaccatcatcatttgacttgaacactctaggaatgattagcatggttgtctctgtggctgaactggatattttcagggataacttacttgacctctcagcagttgatatatgatatcatcctcttgaaaccttttcttctcctggtctccatgacatcacagtattgtgggcaacctttcttatctctggccactttttstaagtctcattgaaggagtaacctcatgtttctgcctaataaatattaatatcttatatacctccaagaactytttctcctcacataatcatatctaattaccatcaataaactagtaacttcttaattaatatctctactgtagaccccctcttaactacacatctaactatatgtagtttatgtcttcttatgtatctcagtggcaactcaaactcaaagtatctgattcaactcttgctatctcctaccaacctgaagaacttctagtgttccatctatcagtgatttggctagtgactttgtagttttgctacttactactgtgtccaaggggcatagacaccatttttccttcttcatgcttcttcacaagcttttatgaactgccatttatttctaaattcagaaagaagcccaagtctcctttgccaatacaagttaaaaataaataacacatttcagctagattatttccacacccatattcaaagtttttctctgtttatttgtatctttgctacagatttgtctaatcttgatgtttccaatgaatatacacagtcagactgaaatccactcggggcagttaagtttaataacctaaggactttcttttctcaggtgtttccccccataacctaaagcaataattcttacctttatattcatayggtacagaattaggatcatttttattaggaaggagtggaagaaaggacacagcttccaacgaacaaattaagttgtacacaggactttaaaaaatagaattcaccaaatgtgttaatttcagacacaatagacaataatttatattaacaatgattcagttccagatagagataaattattatttttatttatttacatagatgaaatgctattttcggggtatttaacttgatgggaaaatatttttaaaagaatatatcatcgtctttaccctcaagcagctcaccatctgatagatacataaatgagtttagagagaaggagaattcgctataatgcgagagtgtgggaagataaagatatggatcctgggcatctgaaaagagtttgtggaagagacaatatttgatccaggccttgaagtataggtatgattttcaaagagtatgtgaggggtggttttcaaacagaatgagcagcttgctgaaagataaactcaaaaatgataaattattttcttcaagaattagatgttctcttgtacctgatatgtaacatgttctaatagacattgaagaattagatcgtcaaaggaagacacttatctgtatgtgcaggaactgatatgactgtctccttccttacatttgttcctaacactaggacatgcaggctgactaaacccagaggcaggcatttaatgagaagttgcctttcacagaaataattatggttatacattaccagctttcaactttgttgaaagtatccatctgagattagtacattcttagggtataagtttctggctcagtacttactaagaatcgtggttctctggttgtatgcaaaggaaaataaatttggcttacttaaaaagaaaataaagactttatggaagacataaggtaatgcacataaatcagaatgaaagaaggctaagattcgacagaacaaagagtgattcagggctgtaggtggcactagtaagtaagggatatgcccaggctagacctaggggaggaccaggatccttgattgacagtcgtaccaagactttacaccactaggttagaaaaagaactgttctccgagggaaatcagtgttattaccaaagggaggaatggattttggatggaaggccagaatatcccctayacttgattttcttattttaatttttagccttttctctatttctcaagtagaagtttaagtcattatttcttgcctctaatgtgtgaagctttctattaaacttcctacgctawcccacacatgttcaggtcattcttttttagactttcacctcagtacatttatcttcgggaaagactgtctattcaaacacatgaaaattaaccaaaatcctagtatgtatctgtgtgttgtcatgtgtgtattgttgttgttgttgttgttgttgtgtgtgtgtatgtgttggagatgggggaggtggtatatcagaatcacctgggagaacttttaaaaaatctaattatacagtccttacacctctgtcttccatgcgtatacacacttaatgtatcagaatatcttgacagaagggaattggacttttctttttaatagctatttactggtgattctattactcttaccatctctcttatcccacaagttgaggactattgatttggattttttgtaggccccattttatttccattattgaatatatttgccattctgtattctagaacaagtaggagaaatttgttgagagaaatatttcatctccttataaagaagaacttcataacttgtgtaactttgtaactttgggctgtcctgcaatgggactagactgccctggaagacaataaattatctgcctctggaagtatttacacaagagttgcatgaccaattgccagatgggaaaatgcatgaaaatgagacagtgacctttctcccccattgagagctaggagacgtggtgacatgatattacaattaactatatgaacaatatataaacaatgaatgtgtgacaatgaaaatctcagcaaacatcaaggtttgcttcgtgttctggagagatcatattacaggtaaatacctgtgtgggaacttcttggtgacagactgaatgatatgtgataagcagctgtccaaatagtgtactcattcctaacaatgatttcatttcagttttctaagatgactgagaacactaccagtgcccctgagatttcagataaaacttaatactagaacgttaaaacataccatgctctgatattcaatttatttaaaatagaatatctttaccagattagaacaaagtaatgatgaaaagcagacttaacctatagtatggtagatcttttttaaagggtcattgaraaaattttccatctcaaaatatctgtttcattgcygtccctggctctaccactggtgactcatycttttgtttcaagcctgatcatcctcctgaccttgatagagagtgagggacagaactagcctaggtgtcaggattctacaaggccaggctccacaacagggaatttctcacctgaaaccatgggttagggagtgaaggatactatgttctctgctgagtgaaagaaaagactcaaagtccagcaaatggaaatcatgacagaaacatactaactagtatacagaactggaactaggggtcagtgccatggcacatggctgtaatcctagcactttgggagactgaggcagatggattgcttgaggtcaggaggtcaaaaccagcttagccaacatggcgaaaccccgtctctacaaaaaatacaaaaattagccaggtgtggtggtgcgcacctgtagtcccagctacttgaggggctgtggtgggaggatcatttgagcccaggaggtggaggttgcagtgagcctagatcgagccactgcactccagcctgggcgacctagtgagacttggtctctaaataaataagtaaataaaatgaacttgaactaggaaccagaaggaagggaacaaacattaacatgattgttcagctgaggaattgtctggctaggcattctcatctacartgttttttagagcccaaatagggcaataaggtcagccatgtttaaagggcctagaatataccatacattttagagggcagaaggaatggtgggaaggaaagagctgcaagagagggatgctaataaaaaacttcactctcctctcataacaagacacatatccctgtttgaagacttcttgtttgtttttaaattattacaatattggtaattattttaaggatgtaatttaatctttcataaaaatgaaagaacattttgtcccaggtttttcttttcaataaatgtgtaaatttaaataactaccttttgtcccatttatttaagataakttagattctgctttttgtagacttggttaaggatgtagcaaaataccaataaaaagtctggtcaatcatttcaatgccagaatgcttttcaagactttcttcagggtagcaaaaaggacatacacatattgctagttaatagtcgccctgccattggttggtttgagtatgtttcatccccctgcttaattttgttttcttatttatacaatataagattagagagtggggttaaatgtcacaaaatggtgacctgtgaactaaagtaagccaacagactgttagtttggctaagacattgagtttttcctttcatttctctcgttttaatgaatgcctttcagtagggcatacataatcattttgtctggggacccacaaccccagcctactactgagttcaatctagactcaatgtttgtatcccatcccctgcatggctcttgaaagcatttgagtttgtggctcttgggtcagacatattgttaaatttctttaggctcctaaggctttaattctacaaaacctctgagagtatgaaatttctttttttcttttctttttctttccattagttgagagatagattaaatggaaggcaattcatacatggtgarggccaccaggcttcagactctccccatacattatctcgtttaattctcaaagcatcccagtgaggtcatcattatcatactcattttatargtgacaaaacaaggtcaaataatttaatatcttgctcatratcagaagcttattaactgtaggaaytgggttcaaacccaaatctgtttgtctccaaaaactcccgatatccttgtttccctcagtgagcagaaacattctacagagatcttatgaataccaacaaagctttgcccacattttgcgcagatacacaaaggatatcaaatgtccaaatatctaaaactatttttacagaacatcttatttgcaggctgtattctttgaccagcagggaattacatttctactgttcttgggaacatacttgactaaagagccatgcagaatttaggaagaatcatcattagaagaaatttggctttattcacacactgatgtaacattagaaaatatgtcataaaatcattcaaatttgaaatgtaaagatattttatttctaacacttttctgttttgtcacagatattacktatcttaaaattcgaccttgtttgtacacaatagcactaaaactgcacatgacttgaaatatactctattacctagtaactttgacagaacagttctggtaaggagaagttcaagtatgtgcaggcatagaatacatgaagacaaaaagagtgttagtatgatgactgagcagaaaactttgagtagaaaacacaactttcagttgtgttgtattttcattagagggttgtataaaattaattctgctaatataaacacacactgtgtttaacataatttctatactatgtcagtcacttaattggcttttaataagcctcggtggccagcaaatatccagaagaagaatgtatactttcaaaaggaaaaagaagaaaatgaggatacagtaaatataagtaagtaaaataaaaaagtatctacatagggccagttttttataatttctaagctttgggttaaccagcattcttctaatttgaccacattgagccaatgatttttatttttatttttatttttttactttaaacaaacagtgctcaattttacaggtcagtattttttgcaaatgcagtgtgaattaatataatacaaattaaagcaattagactgtcaagtttcacttttagtgattggggtttggggagtggaaaggggcacagaaactgttgcccttttcaaacaactcacaaatgtgctaattatgtgtcagaaattatgaaagttgaggcattgtgaccttcaagccaacaaaagaccttttcaagtaagccatccccatgtacattaataaagtgagcaatgcccttccacagttaaataatgtatggctgttatttcattatatgtgaatgaaaaccgaggagttatttcactattggcatattaaaagaaatgttataaaaaagcaaagactgtaaatccatttaaataacattttgtggtacttttaaaatagtgatccaaagtcatatgttgtttatttccactgcatgtggctaatgsgtagtttctccgcaactggatgtattttagatcttagcaggaaaaactgcaatgcgttaaagtataaaacaactgacagagatattttaaaagttagaaaaattactgttagataaagtaaatccttgcaatgataaagacaatgagatattttgtagatcagagaaaacattgcctctgtccataagccttactgtgttagtaagaagaatcttgaacaagagtggggtgcagaggaagggaaaataacctctcactcttcatcatggctctttcatggtctgaagaaagtatttgtaaaccttggatttaggtcatggacataatggtaattaaaacagcactcattttgttggaagaaaatgtaaatttcaaaagcaataatataagagaaatttgggtgtcactaatgcttgaatcaaatgcactgcaggaatgtcaaacagtgcccatgaagttgtagtggaaaatcaagagcaggaagaagttaattatcttgtatttgttcagctttgtagtatatttgatgcaaacaaaatgtataaagatacagtcatacttaatgcaacttaaatatgagtaatagacctctgggaaataataaaccaattacaaatttaaaataaatcacaatcatatgagattccaaaaacctattagcattcaatccacagataaacttttgtttttccagtctcacaatagcttcttattatgggttagatgttgataccaagagactgtatagggtttactgattctctcactagtctctcctcattttaaacaattatctaggtccttttattgttatttgctttaatagattctctgaattctttcataaaatagataccagtgatgattttgagaatgttatttgtcattgagattcttgatgaatgtgtacatgttcttgttcagtataagtgttgctgcatttccttgctaatctaaaataatttccattattttggattgtatttaaggtggcaaatcttgcttgttccatgtcaacaaatgaagatggaattaaaattgtcaaaattgcagccaatcatttggaaaccttgtgtccacaggtatgacaactaagttactttttgtgtgtaaaattatatataattcctaatgcttttatgcatatgaaaatacactatttttttttctttttttttttttgagaccaggtctcgctctgttgcccaggctggaatgcagtggcgcaatctcgactgactgcaacttctgcttcctgagtagctgggattacaggcatgcgccaccatgcctggctaatttctgtatttttaatagagatggggtttyaccatgttggccaggctggtctcgaactcctgacctmaagtgatctgcccacctcggcctcccaaactgttgggattacaggcgtgagccaccgtgcccagccaaaatgtttatttgaagcatggaagacagaattgtcctaaggcgattcttaaaaagagagtagagaaaaagactgacattctttaagtggccatattggaatctcctgaggcaaaggtgctttgtccaaatgatttgatttatttttagtaattatttattttgaaatttcaaatcagctgaaagaattgactctttttttcttttatcaaagaaggtatcggtttgaaaaaagttaagaaatattttcttgtyggtaattcagatgtttcttaaaatctgaagagtgacacacttttagggaattatttctacatgacaaatggttttgaagccatgaatcaagatacacatagagaaattttaaacactcttatctgagaagaagcaggatataatacggatacttcctaataaagaccacaaatgttataaggatgagaaawataacaaagattagggactttaagtctctggacgtctcctgagattctcagtctacaaaaagtagggcatgtgttaaattattgatttgccttgctgacaatttcatctctaagaatattaaggaaactgtgaaggaaactgcttctttggacttaatgttgattaacaagtaagaacaagctggaaaagtgggatctagaggacctgcagctgagatctcccaactgatgtcaattttctatgaaactccagagggaacagaatactgcaatgaggtctctaaagtagttgaatgaaatatactcccatcaacactctttaagtgttttcatctctgcacattgtgaataatgctcaaggttatcactttttaaaatgccttttcaatctgaagaggattaagtatctctcattggttttaatgtgtaattttctgattcctagtgagaacattctttttgcaaatatttattgactatttggctttctaattcggtgacttgcttatatcgttttccaattttccgatttttgttaggttgtmttttgtaattaatttgcttaggtttgttaaaaatatctctgttgcccatgtcttttgaaatattttttaaataatttttcagtcacagaagatttgaagaactttaaggtaaacatatgatttatcttttaattattttaatatatagttatggagcacctactgggtgtcctggtttgtggttttgtacctcgttaagacattctatcaacaaatttgtcacatatttcccacattatgttgttaaaagagtaaagtattattattcaacatacagatatttattccctctgaaatatatttttatgtctaacatgaggtagagatcatttcatttagtagtgttgacatttgggccaccatcatatattaaatagttgatcctttctcaattattgtgaaattctaccattgtttcacacacatcccataaggacttataaatatttccattgtctaatatatatttgtatacacatgttcatatatacttataaacataaatacacgtacacatgtacaagtttatataaacattatattatgtttgcacttggtaattcaccagtgtttttttcacatatggccatatggacagcttctttttttttattttttactttttatgtttttattattattatactttaagttttagggtacatgtgcacaatgtgcaggttagttacatatgtataaatgtgccatgctggtgtgctgcacccattaactcgtcatttagcattaggtatatctcctaatgctatccctcccccctccccccaccctacaacagtccccagagtgtgatgttccccttcctgtgtccatgtgttgtcattgttcaattcccacctgtgagtgagaaaatgcggtgtttgttttttttgtccttgcgacagtttgctgagaatgatggtttccagcttcatccacgtccctacaaaggacatgaactcatcattttttatggctgcatagtattccatggtgtatatgtgccacattttcttaatccagtctatcgttgttggacatttgggtttgttccaagtctttgctattgtgaatagtgctgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgacattttaatgattgccattctaactggtgtgagatggtatctcattgtggtttttatttgcatttctctgatggccagtgatgatgagcattttttcatgtgtctgttggctgcataaatgtcttcttttgggaagtgtctgttcatatccttcgcccactttttgatggggttgtttgtttttttcttgtaaatgtgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgctttaggtgttttagacatgaagtccttgcccatgcctatgtcctgaatagtattgcctaggttttcttctagggtttttatggttttaggtctaacgtttaagtctttaatccttcttgaattaatttttgtagaaggtgtaaggaagggatccagtttcagctttctacctatggctagcctgttttcccagcaccatttattaaaagggaatcctttccccatttcttgtttttctcaggtttgtcaaagatcagatagttatagatatgcggcgttatttctgagggctctgttctgttccattgatctatatctctgttttggtaccagtaccttgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatgccattttcacaatattgattcttcctatccatgagcatggaatgttcttccatttgtttgtatcctyttttatttccttgagcagtggtttgtagttctccttgaagaggtccttcacgtcccttgtaagttggattcctagttattttattctctttgaagcaattgtgaatgggagttcactcatgatttggctctctgtttgtctgttattggtgtataagaatgcttgtgakttttgtacattgrttttatatcctgagactttgctgaagttgcttatcagcttaaggagattttgggctgagacagtggggttttctagatatacaatcatgtcatctgcaaacagggacartttgacttcctcttttcctaactgaataccctttatttctttctcctgcctaattgccttggccagaacttccaacactatgttgaataggagtggtgagagagggcatccctgtcttgtgccagttttcaaagggaatgcttccagattttgcccattcagtatgatattggctgtgggtttgtcatagatagctcttattattttgagatacgtcccatcaatacctgatttattgagagtttttagcatgaagagttgttgaattttgtcaaaggccttttctgcatctattgagacaatcatgtggtttttgtctttggttctgtttatatgctggattacatttattgatttgmgtatattgaaccagccttgcatcccaggatgaagcccacttgatcatggtggataagctttttgatgtgctgctggattcagtttggacaacttcttttatgttcastttatgaggactcagcttaaatatcatcttctcagagatcaatctcccttctccctaaatcactcctccagctgtgacttattatgttaccatatttatttattttagagtctatatcacaacctgaagttatattttatattaatttgttacctttattatatataacacactcacacagaaagttcatgaagtcartgatttgatctcccttattcaccattaatatcccctgtacctagcagaaataaaatatatattggatgttcaataaatatttgttcagtgtataaatcagtgagaaggttgctagaatgataaatcattctatattcatagagggcagggatgattttggcaacagcttcttgatatttttcttaatatggtgtgtcttatttttaataagatgaaaaaaagacagtataattactttgagctgtaactgatagaaaaaaatcctttacagtgactattttatgtatagatactgaccaaagatgagatctgaattcataggctagattgattttagagtgagtcagttaagtcctgggtcaggaggagctaatagggtggccctgagtttctatttgttaagtacaattgaattcacgtaggtttcagtgaattgagttgttctggttcttactgtgtacaaaggaccacactgtaaagctttgcccagttataggtatcacccttcaaaaaagatttgtcacttggagcatatttagcagagatatttgaaatagtgacatgagttgaaactatatcatatgaacacctcagaaaagcaatagggaatttttagccaggaaaagacctggaggaacacaatcactctcattatatctttaaaggactatgatgtgaatgacttgttctgaagggccccgaggggcaaaatacaacctatgagcagatgttagaagaatgcaaattttatctcaatatagagawgagttttttaacagagctatcctgacaggaattggactttattgagaacacaggatttggagtttctcaacactgcagacatttaacacaaggagagtgactagttgaccaaggtattttgtggggggcacaaacaaatcttgggtgaaaagtgggtctagaagccttttgaaacccaatccttagatcctctaatggatctgtctgttttatgaaagagagaaatgtgatctggatgattgctggagtactacaggtgtgtgaacagttatactcaacctggtggaaggataaagcsatctatagggcttaatccttgctccactttaacaagtgacttggaagaatactgaaaaagtaaacattttatatttgtgtaaggcacaaaactgagaaaggtagaatggtctaatgtttgaaaactcataagytgaaattaaataagggcaaatataaagtcagggccttagcttaaatacaacctattgcacgagcatatagtgaaacgattgcacatcaaaagcacatgggtcatcaggagttgagagggacatttgctctcttgttcaatgaatttcaaacctggatctatgaaagcattttcatggtctatagcaaaagtagctcagtgtagttagctttttttcatatagtgaaatttattcaacttttcattctcaggttttatatttactactttatatttatcagaaatatttgatttatgaaataataaagtagataatagttttttacatttttatttttggcaacaaataaattatttatcaatcaataaaaaatatttttttactttactaataaaaaaataaaaatatacccaccctatgtcagttccttctccttcctgtgtctccttcttctttgaaaaatatttgtggcctgaaaagtccagaaagttaaaagtactaatttaggtgacttaacagtataagtcagtagcgtgatatggggactgacttatagcattgaaataattgatctttttgtagtgtaagtttgatcattggattttcatgctcacgtgtgatacgtgcctccttcaaaccttgttatgacactagcacattattcatatgacatgaaaaataaaataaaatggttatgatacttagcttgtgaaatagaaggaaattttcaatatacttggcacaggaatgtccacatcaagaatttcatgctgagtcctgggcccatagtttaaaggataggcagaaaaagaataagttgttttaagccatagtgagctatcacctcattactggaagtgtttaaacaaaagcaaaatarggtgtaccttgacaaaaatattggagagagaatttcattattgagaagtagaagaattagatcctcttaagtgttctttccataaataagattcactaattaacaaaaatcatgatgaaaacctagggtattttccctgtggtgaatacacattcaattaggcaaaccctcctaagtacttagattttccaaaatcacaagagagaaatgtggttctaaaatatgtggttctaaaataagtcaagttttccaatcacggtctagtttgagtcactatgtagtattgctttgttatatctatctgttgctctcaccaagtagtatccaataacctgacagggctaaaacagcttccagagatacctaatttattttcagtgatgtggttgggtataaagagataatatttttataagttgttactgaaaatctgtaatttctaaaagagatatatattgagtgtgttgataagtagggaagaaagtcaagattgccctagagaagcatgtgaaatataaaaagaacaaagtatttgggctagggcatgcactggagatcacttgtattcatattttagcatggaaagccataaactccatgaggataggaatttttrttccgctgatatatcctaagaataatgcttgacacatagtaggtactcagtacatttttgctgagtgaatgattatacctcaatgamctttttcagattatattcattggcaggtaaatgctggaagccattactattccccttccttctttgttttctgggagtgtagaaactcccaatttctaatcaaaatgataaaaagtcccagtatgacactttgtctgttgaagtacaagtcatgtgaagtgactggcattatctctctctgcatagacaggactattttgtaaaaacagcaacttgttctgattaagttatgatgtatttagcacacacttcagtaagagcattagactatctctttmaaatggaaagctatgtgcttatttgtatgggttttttatttgtttttctggtagagaagttgtcatatctgcgaactgaaagcacttaattttctaagtatcaagctttgggaagcaaacatattctctttcatctactgttgatgatgatgatggatgttttgtttgcaactaaacaatataggacccaaatattcaatgtaaaatgaccatattctttaagaatcatgtaaaagccatatcaggccttttataatttatgcctaatttatttcttttcacttcagggaatggcacaaaatgctcttaagactttggaaacaaacagtcgcgtcataatgtaaaaaagacttaaatgaggtgattttatttttaaaaagcttataataattgagtggtgtaycctcaagactgactagggtgatttcaaatgtaagtttastaccagtttctttctagtgatggtgtggtatctatgtggggagagagtgcgtgggtgcagctatgagcacagctactaagactggaaataaatgtctgtgcctttgtcctatcactgccctgtatcttgttccaattacacagccactttcttccacctactccaaggaactcttcattcaacaaatacttacggaccacctactgggagcatccatgaagctagggtgaggcaggggcagggagtggggatttagggggtactcaatggagcagttctgagaaataagaattttaaggcctaagttttattagaaggaaaatcggaggtggtgtgtcctggcagaagaaacagaatttgtggaggagaagtcatggccatcaaactcaagtgggaaagtggggtaaaaaattagataatgactttaaagtacatagcctagaattagcatagtttcacatgcaggccaaggcaagaatctcagaatgaattacaaaccaaagtgtttacagcctcatttataatcatggtgtgtgctgtgatattaagcacattaacataaaggatctgtgctggcctgtacaatgttcttctagtcacggaggaaaataaaggtagagccttgctgacattaagtttataatcaaaattgaaaatttattatccagatagaaaggaagtggtgtttgggaggaatcggtggaaatggcatgagaattggattcatgtcaggggacacagggagagcccacagaaaaatgtcattttccatgggccttaaaggagaagcaagatttgcacatttgggaaaatacgaaaagggcattctaggcaacggagatggaaaaacatgtaatagaaattgaaaaaagtaaacaattgagtctgtctaagccacgttgtttctttacaggaggcacccttggattttgggtggaacaattatttgttgtgtgatacagtcacagtggtggggatcaaccttttctggggaggccagaaagctcagaatcagcactaagacacaacttccacctcccccagtccagtctttctaataaccaaaagtgccttcacacatttccataaacctcccagtaaagtgatgttgccccasttaagaaccagtgggagggcatagtctgtggaaaggtaagttgtagcccttagtgccaagtgaaggggtttagatcagtttcatagatttggtttagttactacaggtactacaggttttgagtaggagagtgacatcatcacagctgtgctttcggaagattgatttgaaaattctgtgtcaactgaatgggaaaagggagaggcatgacctgctaaaagataattgaatattacatgcagaagtcaggatctgaataagagatgtaggaataagaatttttaagatgggacaaattgcaaatagacaatataaattgatcagaaactgaaaacaaattagatgattgtgatgatggaggtgaaagggaatgaatttgaggtttatagcctagtacctgggaaaatagtggttatattagaagaaattggaaacaaaattaagaaagggacactttaggacagaaatgaatatatttaagttactaccagaagatccaggttgagatgatagaaaataaaactacaagaacttgagatgtcaccactagattatggtgaccattcatatagatgtgatgattagaaccataaatgtgggatgagattgctaaagagcaaaataaaaataaaagaatcaaaggcgtaaccttaagaaaacacatctgggagagaaaaggaagaggaacctgaaaaagaacaatgagcaaagtaagaggaaagtcagggaagtgtggctggaagcctagcaaatgggagcatttcagcacagtgatcagcaaagacagatactccagtgaagtccagagggatgagtactgacaatttggaaattaggaagtgagcagtcatcttaaccaaagaatagtttcagcagcattgtgagaaatgaggagagggcaggggccagaagctatattcctagattttttcccccttaaattgaaaagtaaacctaattgtggaaaagagaatcactgggaagctccaccttgcagactttttaccataaagtcctaccattctttttactatcagttatttttttctttatttgtgtgtttattaattggtatatcatagttatatatattttgggggtacatatgatatttggatacataaacaatatgtaataatcaaatcagggtaattggaatatccaacacctcaaatatttatccttttttgtgttggagactctacaattcttcacttctagctatttgaagcatataataagttattgtcaattataattttcctactgtactatctaatacctgaacttactttttctatctaactatttttgtacccattaaccaacttctcttcactgccccttattctctttccggcctctggtaaccgccattctacctccatgagatccacagttttagtgaataagaacatgcaatatttgtctttctgtgcctagcttattttacttarcatagtgacctccagttcaatctgtattgctgcaaaagacaggatttcatttttttgtggctgaataatattccattgtatgtgtgcatgtatatacacacacatatgccacatttttttatttattcatctgttaatgaacacttaggttcattaacaaaatatggattttggctattgtgaacagtgctgcaataaacatgggagtacagatacctctttaacatattgatttcctttctttggggctatatatccagcattgggattgctggatcatatggtacttctacttttagttttttgagaaacctccatacagttttccatatttaccgtatgactttatattcccaccaacaatgtatgagcattcccctttctccacatccttgctagtgttattttttgtccttttaataatagctattctaactggcctgagattgtatctcattggggtttgatttgaatttccttgatgactagttatgttgaacattcttatgtcttcttttgagaaatgtttattcaggtctttgggacttttttttccccaacatgtctaaataaactgttattgaaacacagccatgtgagttcctttatktattgtctagggttgctttcatacaacaaggaaagagaccatccacctaacctaaaatagttactatctgacctttttaaaaaaacttttaagttcaggggtacatgtgcggktttgttacatagggtaagctcrtgtcacggggcctgaagcattgctccaggaacatagcccccccatgggtatttttacacaaaaactggaggctattcaaaagatacacatgaagtctattcctggagattattttgtcacccaggtattaagcctagtacccattagttattttccctaatcctcttcctcctcccatcctctactcttcagcaggcaccagtgtctattgtttccctctawgtgtccatctgtgttcctcatttagcttccacttataagtaagaacatgaagtatttggctttctgttccatgttagtttgctaagaataatggcctccagctccatccatgttactgcaaaggacatratctcaatcttttttatggctgcagagtattccatggtgtatatgtaccacattttctttatgcagtctgccaattgatggacatgtgagttgattccttgtctttgctatggtgaatagtgctgcartgaacatacacatacatgtgtctttatgatagaatgacttatattcctttggatatatacccagcactaggattgctgggtcaaatggtatttctgaatttaggtctttgaggattcaccatgctgttttccacatggttgaaataatttacactcccaccaacagtgtctaagttcctttttctctgcaaccttgctagcatctgttattttttgactttttagtaatagccattctgactggtgtgagatagcatttgattgtggttttgatttgtatttctctaatgataggtgatgttgagcgttttgcatatttttttggccacatgtatgtcttctttagaaaagtgttcatgtaccttgcccactttttaatggggttgctttttcttttcttgtaagcttgtataagtttcttatacatactagataatagacctttggctgggtgcgatggctgacaactgtaatcccagcactttgggaggctgaggagggcagattrcttgaggtcaggagttcaagatcagcctggccaaatggtgaaacttcatctctactaaaaatacaaaaaaaatttagcctggcatggtggcacatacctgtggtcccagcttcttgggaggctgaggtgggaggatcacttgaacctgagaggtggaggttacagtgagctgagatcacaccactgcagtccagcctgggcgacacagtgagactctgtctcaaaaaaagaaaaaaaaagataatagacctttgtcagatgcatagtttgcagaatgtatctcccattctgtaagttttctgttacactctgttgaatgtttcttctgttgtgcggaagctctttagtttaattatatcccaattgtcaattttttcttttgttgtaattgcttttagtgtctttgtcatgaaatctttgcccattcctgtgtccaacatggtattgcctaggttgtcttccagggtttttattggttagggttttacatttaaatgtttaatccattttgaattaatttttgtgtatggtgtaaggaaggggtccagtttcaaccttctgcgtatggctagccagttatctcagcaccatttattgaacagggaatcctttcccattgcttgttttttgtcagtttttttttgaagatcagatggttgcaggtgtgcagccttatttctggatactctattctattccattggtctctgtttttattttggtgtgctgtttttttactgtagtgctgtagcatagtttgaagctagtagcatgttgcctccagctttactctttttacataggattgtcttggctattcgggctctttttgttccatatgaattttaaaatagttttttttatagttgtgtgaagagtgtcattggtagtttaataggaatagcattgaatctataaattgctttgggcagtatggtcattttaagaattttgattcttcctattcatgagcatgggacgtttcgccatttgtttgtgtcatctctgatttctttgagcagtgttttgtaattcttattgtagagacctttcacctccccgattacctgtattcccagatattttattctttctgtggcaattgtggatgggattgcatttctgatttggctcttgacttgactgttgttgatgtatgggaatggtagtgatttgtgtacattaattttgtatcctgagactttgctgaagtttttttattagcttaagtttttgagctgagactgtgggattttctagatataggatcatgtcatctgcaaacaggaataacttaactttccctcttcctgtttacatgccctttatttatttctcttccctgattgctctggccaggacttccaatactatgttaggtaaggaatggtgagacagagcatccttatcttgtgctggttttcaaggaagtgcttccagcttttgcccattcagtttaatgttgactgtgtgtttgtcatagatgactgttattattttgaagtatgttttctcaatacctagtttattgagcatgtttgacataaaagtgatactgaattttattgaaagccttttctgcatctattgagataatcatgtggtttttgtctttaatttgcttatatgataaatcacatgtattgatttgaatcaaccttgcatcccaggcatgaagcctccttgatcatcatgcatttgctttttgatgtgctgctggattcagtttgcaggtattttgttgaggatttctacctcaaaattcatcaaagacattggcctgaagtttcttttctttcttgcttttttttttttttttttttttttggttgtctctgcctggttttggtttcaggatgatggtagcctcatagaatgagttagaaggagtccattctcctcaatattttggaatagtttcaggaggaatgataccagctcttctttggacatctggtaaaatgaggtcgttaatccatctgatcctgcattttcttcgattggtgggctatttattactgattcaatttcagagctcattattagtctgttcatggattcagttccttcgtggctctgtcttggcagggtgtctgtgtccaggaatttatccacatcttttatatttgctagtttatgtgcgtagaggtggtcatagtgttttctgatgattatttgtatttctgtggggtcagcagtaatatcccctttgtcatttttaattgtgtttatttggatgttctctcctttcttctttgatagtctagctagatgtctatctaacttattaattttttcaaaaaaccaactcctggattcgttgatctttcgaatgctttttggtgtctcagtctccttcaattcagctctaatttggattgatttgtttcttttcttctgctagctttgtgtttggttttctgttggttccctacttcttttagttgtgatgttaggttgttaacttgagatctttctaactttttgatgtggacatttagtgctataaattgtcctcttaatactgtcttagctgtgtcccagagatgctggcgtgaggtatctttgttctcattagtttcaaagaacttgttgatttctgccttaatttcattatttacccaaaagccatttgggagtaggttattcatgtaatgaatttccatggattatatggttttgagtgaatttcttaggcttgatttctaatttgattgcgatgtagtttgagagagtgattgttatgatttcagttactttgcatttgctgaggagtgtgttatgtctgattgtatgatttatttcagggtatgtgccatgtggtgatgagaagaatgtattctctcttgcttttagtggagagttctgtagatgtctctcaggtccgtttgatccagtgctgagttcaggtcctgaaaatctttgttaattttctgcctcaatgatctaatactgtcagtgaggtattgaagtctcccagtattattgtgtgggagcctaagattctgaaggtctcagagaactttcttttgtgaatctggacgcctctgtgttgggtgcatatatattcaggatagtgaggtcttcttgttgtatttaaccctttactgttatataatgtccttctttgtcttttttgatctttggtttaaagtctgttttatctgaaattaggattgcaacctcccttttttctgttttgcatttatttggtaaatttttctccattcctttattttgagcctatgggtgtcattgcatgtgaaatcagtcttggttctttattcagcttgcccctctgtgtttaattggggcatttagcccatttacatttaaggttagtattggtatgtgtggattcgatcctgtcatcatgatgttaggtggttagcgtgcaaacttgtttgtgtggttgctttatagtgtcactggtctgtatatttaaaagtgtgtttttgtagtggctggtaacagtctttccacatttagtgcttccttcagaagctcttgtaaggcaggtctggtggcaacacattccatcagtatttgcttgtgtgaaaaggatcttatttctacctcaattatgaagcttagtttggctggatatgaaactctgggttgagatttcctttctataagaatgtcgaatattggcccccagtctcttctggcttgtagggtttctgctgaaaggtccactgttagtctgatgggcttccctttgtaggttacctggcctttctctctagcagctttaacattttttctttcattttgaccttgaggaatctgatgattgtatgtcttggagcgatcttcttgtgaagtatcttactggggttcttcgcatttcctgaatttgaatgttggcctctctagctaggttggagaagttctcatggatgatatcctgaaatatgttttccaagttgcttatactctttctgtctctttcagggacaccaatgagtcatagattttgtttctttacataatctcatatttatcttaggttttattaattccttttcattcttttttctctattcttttctgactgtcttattttagaaagctagtcttcagcctctgagattctttcctcaacttggtctattctacgattaatgcttgtgatggcattatgaaattcttgtagtgtgttttttagctctatcatgttgcttacattcttttctatactggctattttgtctgtccgtttctgttgttttattctgattcttagcttccttggattaggcttcaatgtactcctgcatcttaatgatctttgttcctatccatattctgaattctacttctgtcatttccgccatctcagcccagttcagaacccctgctggagaggtgatgtggtcatttttaggacaaaaggcactttggctttttgagttgttggagttcttgtgttggttgtttctcatctttgtggactaatgtttcttcagtcattgaagttgttgacctttggatttttttttttttttgcttttatcctatttgatgaccctgagggtttgattatgctatgaagtgaattctgccaactggctttgtttctggaagactttagggagtgaacacttagctctcagctcctgtactgggtgctgtaactctgggggagtagtatggtgacctgagagtgttctttggttctttgaggttagaaatctgctacactagggggccgaggtactcccagaatgctggtcagtactctctgatgggtggtgtcagccaaagcatttcgtagtatggtgacagcaggatctgtcttcatccgcgtatgtcagcagcagtggcagccacagcatggcagggtgcacgctcatcggctgcagcagggtgctaatgggtgtcagtgtacctgcctccatgcggacattcaccacagcggtggaggcagcatgagtcaggggaacggggggcccctgctggcgaatgtgcatgcagtcacactggtggtggtgttagcatggggattattgctcattttttaattggattttttgtttttgtttttgttctttgtttttgctactgagctgcttgagttccttatatgttctggttattaatcccttgttggatggatagtttttaaataattttctgccattctgtaggttgtcgctttactttgttaattgttttctttgctatgcagtagcttttttaacttgatatgatcccattggtctatttttgcttttttcacctttgcttttgaggtcttacctaaaaaaatctttgcccagaccagtgtcctatactgttttccaaatattgtcttctagaagcttcatagtttcagatcttatgtttatgtttttaatataattttatttgatttttgtatatggtgaaagatgggaatctactcttattcttctgcatatgaatatacaatattctcagcaccatttattaaagagactgtctttccctgatgtatgcttttggcactcttgtcaaaaatcagttggctgtaatagtgtgggtttatttctgtattctctattctgttccattgttctatatgccttttttcatgctagtaccatactgttttagttactatagctttgtagtacaattgaaaaccatgtagtatgatgtcgagctttgcattttttactgaggattgctttaactattcagtcttttgtgtccatacacattttaggatttttttgtaattacctgaagaatatcattaatatttgataaggattctactgaatctgtagatcactttaggtagtagacacattttgacaatattaattcttcaaatccatgagcatagaatatgtttccatttttttgtgtcctcttcaatttatttcatcagtgttttacagttttctttgcaaagaccttttacttcttcattaaatttattcttaygtgtgatatatatttttagctattgtaaatgttaytgctttcttgttttttattttcagattgatcactgttagtttgcagacacactattaatttttgtgtcttggttttgtatcctgmagctttgctaaatttattgatctattccaagaattttttggtataataggcctttctaaatataaaatcacgctatatacaaacgaggataattagactttcttcctttttaatttggatgccctttctttgtttcttttgcctagttgccgtgactagaacttccagtactatgttggataaaattggcaaaagtgggcatcgtagacttgttccaggtcttagtgaaaaggcttagagttttccccattcactatgattgctataggtttgtcacatatggcctttattgtgttgaggtatatttcttctatgcaaaatttgttgaagatttttatcataaagggatatggaattttatcaaaagctttttcagtatctattgaaaggatcatagggtttttgtccttgattctgttgatatgctgtatcacattttttgatttgcacatgttaaaagattcttgcatccctgggatgaatcctacttggtcatggtgaatgatctttttaatgtattattgatttttgtttgctaatattttgttgaaaatttttgcatctatgtgtgtcagatatattggtctgcrgtttcctttttttgttgagtctctctggtgttggtatcagggtaatttttcaatattgccttttgtcttcagaatctacatagtgcagtaggcttttaagcaattctagcagcattttctaaagtatgtttttatatagtgaactcaagcttgtggagctaaatattagtatgagctttcactgattattaatcagtaagtaaataagatatcctggacttgtaggtggttcacacttagattaaccttaaatacataaacagtttttttaaaaaaagctttaaaacttaagatacttttatgtaattcagaaggtaatgttagtgctgaaaaatattttgttcataacattatttttaaatgtcattttaaatgtgaggctgaaatgaaatgtcatttgtagtaggatgtttaaccaaatggagaatgtctgactatttcttcccagaaccttgtcttgagggttaatatgaaaattacccatgcccatagatcctaagaacttctatacccagtcatgacaagttttccaaccaaaagaccttatacaaatctaagcaatcattcatcctcttccttgtactacaatcaagattacaaattgtagttctataactgaaagtctctgcactctcattttatgtgtcataactgacaatgctagtgtcccctacatcctaatttagatttagagaggttttctgtatttcttttcaagaagagagtattctaatttcatatctacactgaacctaaaagtttaggactggcagttcactccagatttcttggagtatataagctggttggggcgacgatctgggaaaggtagtgttaaaaagcaatgaaacagacttaagcatgaatgtcactaagtctattatatgtacaccaatagtcattattttttcatcctatactttctatttttttctgttctaaggctgcgtttgttagcaatattctgtaaaataagatttgtcattttggattacccaaggagaatgtgacaagggtaatttaaaacagtctaagcagtcctcccattacagatggttagtataacagacagtgtgcagaaacttggtctagggagctgaaacagaactacattgagatccagaagctataaggtaattgctccatagaaagaatgaactggttttggagaacttgagagtcaaatgttgtttctagtaattagcaagctatcaatatgatattgcatagtttattattttaaaaataactttaatctctgtcatgcttatgcagaaataaaataactgtacttatagcacaataaaattctactttttgcctaatggagggcaacatgagttagatatctcacaaaataaactacttttttttcaatttctcaatttctgctcgttgaatgctaaattaaagtcatgaatctgcttttgaacatgtagataccttctgggcatgctatggttgtgcgtttggtaagaaagtttataaaggaaaagatgacctcttctcatgcatctgagatctggcaggtactttcctagagctaccatatttaattcttgcaatggtattgtgacatacacattactgggctcattctattataaagaagaagaaattcagagattttaggtgactactccaaagttaaagaacaaaaaaaaatgctttaggatttgaacactaataattttcttggttttagaattatttcatcagagtttaatttactcataattgtgtaattctccaaagaacatagacttttctactaccccttgctgtaaaagacgtgataaagaaaatatcccaggaatcttacttttcaacatttaagtctgcaatgcttttgactgtcatatatttagggcttgctatttcataattgaaggccttagctccattagaaaggatgccaatattacttgacatttatgtatcactttattattaaaacaggctttacaatttctgtatcatacttggtaagatttgataccaagagagattttgggggttctgtaagattacacagcaaagagggggaggaagttaaaatacagttcttgccaaatcatttaacatccttatttacttaacaggaactccctcaggtaaaaaatgatggatcagtgtgttatgcaattttggcataatattttcaaaaatctagtagtcaaagcttttgactaaaaattaaaaggctgatttttatgggtggtgtttgggtataaaagtgtatatttcaaggtattagagcaatatatggtcccttgaacacgcacatgagtgatactggaaaaaacaatttgactgaattttaaaaattacattatttcaaggtatatgttcttattttctttaaaataatattttgtattaaaactttctgcttaggatccagggcaatatacctaatttttaaataatttactatcatgaaaaaccatttttctgaatatcggatctttaatcattaaataaattatataacttaatgtgttcctctttaggttgttattataggtgagttcaacataaatttgaggttctatctcagcaactgtgttagcctggttgttaaatatgcttcttttgtctactttgttttttattatttatttccatatcaacaatgactttgtactatcttaagtcatttttctaatctggcaagttattagctaaaaatgaataattgaataagaagtgaacatttcccaaagactttagctctaggtaacatagtgacctaagagaatgtacacttactctgtctcacatataggtgctattgaatatttttggtggtgatgttgaagatatttgaattaygttggtggtaagtggaggccagagagttacttaatatgtggactggcatggtgtaagtctggaaggaactgtggtgaacagtttctttgcttatggtgcagtttcttttgaaggacttaaagcaaacactggaactcatttcctaagacactttgaggtcactcattcccacccaattaaaaaaaaagtagaagaagaaaagaaaaacacctgtratgagttttcagaggcttatatggtgttactgtattttttcagaatgtattgttgtgtaacaagaaatatttcatgggtaatccaaagtataggagttctgggatagaaaagcaaactctagcatgggggcagcctaggagaaatgggccaaaaattgaagggaatagtacagccatgactgcaaaactgtctgtcagcattccagaaataattcatggtttttctcttaagcgaatacttaagtttatggcctgtgcctatgaaccaagctttgtggatgttaataaagagttgacagctatctttccattgaagtctttgcctctctgagtggaatatactgtcaactgtcaataaataataatcattatttcagtttctgccagatgctgcctagaaatcatggaattcaaaggcaaatatttgaaagcctgaacaaaagtatgatttcagtcatttgttgcagttctttgtagctttctcaagcttttataacaaatgtgtatatgcaagggtttatttctggggtctctaatctattccattggtctatgtgtctgtttttatgccagtaccatattgttttgattactatacctttgtgatataatttcaaaatcagggagtgtgatgcctctagatttgttcttcttgctgaaaattgctttggttatttggtgtattttgtggttccatatgacttacagtttttttctctttctgtaaaaaatgccactgggattctgataaagattgcagtgaatttatagatcacttaggatagtacaaatatttcaacaatattaattcttccaatcattgaacacagatatctttccatttctttatatcttcttaaatttctttcatcaattttttctagtttttagtatccaggtctttcatctttccagttagatttattcctaagtattttgttctttatgtagctattgtaaatataattattctcttgatttgtagttcatcattagtgtatagatactcaactgattcttcatatgttctgaatcctgcaactttactgaatttgcctattagttctaacagtttttggtggagtttttctggttttctatatataagaccatgttgtctacaaacaagaacaatttgacttcctcatttccaatttggatgccaattatttctttcctttgtctaattgctctgggtaagacttccagtacaatgttggatagaactgatgagaatgggcatccttgtcttattcctgatcttagagtaaaagctttcaaattttcatcattgagtgtgatgttagctgtggatttgtcataaatggactttactgtgttgaggtatattccttctatacctagtttgtcgagagtttttatcaaaaaagaatgtcaaatattatcaaatgcttttttcttcatctattgagatgttattttttttgtccttcattttgtaaatgtgatatattacatttacagatttatgtattcttgaattcctgggataaatcccacttcttcatgttgaatgttccttttaatgtgctattaaatttggtttgctagtaatttttgaggatttttgcatctacatttatcagggatattggcctctgattttcttttctaacggtgtctaatagcggtgtaatagtgtttaatactttcatatatttaatgttgctaattaaccttcttttgtttcaaataaaatattaaataactcccatttcttgtaaggtaggtctaatggtggtgaagtttctcagattttgcttttctggaaaagtctttatcttttatttcttggaaggacagcttttccaagtaaagtatcattgattgacagatttttttgtctttcagtacctggagtatatcatccgcactctcctgtgcctgcaagttttctgcacaaaaaccaactgataatctcatgagggttcctttgtatgtgacaagttgtttttctctttctgtgttcagagtttcttgtaactgatttttattatttatttgttatttttaaaatttttaataaatatatatatatatatatatatatgtatgaaataaaatgccatgttgaccaggctgacctttaactcctgggctcaagtgatcctccctgcctcagcctaccaaagtgctgagattacagacatgggtgtcattcaattttaataatatgattataatgtgtcccactgaataatatgattataatgtgtcccagtgaaggcttttttatgaatcctttgggcttcatagatctggtgttcattttactccccagattggaaagacttctgttatgatttctttaaatatgctttctgcctttttctctgctgcttatagggctcccataatgcagctattagtttgcttgatggaatcccataattcccataggctttcttcattctttttcctttatttctgtgactggagaattttaaatggtctgtctttgaattcactggttcttttttctgcttgagtctgctattgaagcttactattatattttttcatttcattaattttattcttctgctgaatttgtcttgttcttttttattaatatgtttccatctttttgttgaacttctcattttgttcatgtattgttttcttgattttatttaggtatctatctgtgttctctggtggttcactgtgcttttttaaaacaattattttgaattctttgttagacaattgttagatgtctatttccttgggattagtcactggaactttattttgttcctttggtggtgttgcgtttctttgactctttgtgtttcttgaagctgtttgatggtgtcttcacatttgaagaaggagtcatctccttcagtgtttactgtctgayattaggaaagaaaaaccttgaccagtcagccccgttggagattttgggggtctttcagacctttttgtatgtagaggcacccactctatttctcttttctcttcaaagaggtaagtatttagattttgtatattctcttgatcatgcaaagccaggcttgttgctaagagactctcacttattttccttaagacagtgtcctgaattgtttaatatagtatgactcctcccaatccagcagagtcaagccagctgctggtatttgcttgccatctttgggagcttgcacatgctgtcttgcaaaggctcaatgttttgtctgtgggtgagcatagggtaccatatgtagtagacagcagggctctaaccattttagttgaggggcatggaatcctgggaatacatatcagttagctgggggagtccacaggggtcatgggtagagatcctagtggagaccatcatgaaccagccagtgggatttatggycagttgttgagatattcatacaggctgccacggcccctacccccttaccctgttcctagtgtccccaagattatttcattttgctaatccccttagtattctgggtgggatgagacagaagtgggtctccttggaaggaaggaagctgctcccacttttcttcatgagagaaattgtaggacgagggtcagttgagttattgagtcaccatatcttgctgcacttgaaaaatgagtcaaaagtcaacaaggaggctgggcatggtagctctcatctgtaatttcagcactttgggaagtcgaggatgacttgaggaggatgacttgaggccaggagtttaagaccagtctgtgcaacacagtgaaacccgtctctacaaataaataaataaataaataaataaattagctaagtacagtggtgcactcctgtagtcccatcttgtcaagaggctaaggggggaggatcatttgagcccaggagtttgaggctgcagtgacacatgatcctactacttccctctggcctgggcaacagattaagactgtctcttttaaaaaataaatcaacaggctgggtgcggtggctgacgcctataatcycagcactttgggaggctgaggcaggcagatcacctgaggtcaggagtttgagaccagcctggccaacatggtgaaaccccgtttctactaaaaatacaaaaattagctggatgtggtggcatgcgcctgtaatacccaggaggctgaggcaggagaattgctggaacccgggaggtagaggctgcagtgagccaagaacgygccactgcactccagcctgggtgacagagcaggactctgtctcaaataataataataataataataataataaataagatcaatcaatcaacaagraatatttaacagcaataactataaagtctacattcaaactaaatgcatcttttatgggtctctcttggcacttggtgagataggtaaagtgaaattgtttttcttgtgctttttaatgcgtctattcttggattttggttgttgttgtcgttccactgtgatgctggaacagtggaatcttagctggattcttgagctcacataaaggtatttttgaccatgggtgtttgttaaaattgttgtttcttctgggggttgagggctgggatctccagttccacaatctcgctgatatcactcaaacgagataattgtggataataattgctaacatgcatgtagttcttatatgtgccagatgcagttataaataatttttatatattaactcatttaatccttacaataaacttatatggcagatattattatgtatacatttttaaagataaggaaagtgaagtacaaaagattcttgtaacttgcctaatttagagaaagaagctcaagagttaagattcatacttagatgatctggctttataatccatactgttgcctaccatactacatgctaccatatcaggaaaatcagataaattatgaaatagaaaaggactgtgtgcaaaaaacaaaaatgccttgctacagatggtgacatttgaattgacagttttatagcataaaggaaaaaaccgtgtamaattctaggagaagagcttttcaggcagaagaaacaaatgcaaaagcatccagatgggatgactgcaacctgtttgaatgaagagatgcagacttgagtaggsaatagggaagatagggcaaggaccaggtcatgtagggctatgctttggaaggagatttcattctaagggtactgcagtaaaacaggaagaatttaatcagatccatgatggctgtatgacaaatggattataagggtacaagatggaagtaggaagctattgaaattgtctgggaaagaatcatagtggactaaccaaaggtggtggttgtggaaacaatgaaacttgtcacattgagaaaatgttttggaaagagtggtaataggaattagtggatgtagaatgtgctaaaagggcaagatgaggtgtagactctctggggttccaggtcagagcatcacagtggatagtgttgccatttactgagctgggaaagatttgaggagatgtcatgaggtgcaggggagaaacaaattccgtttggtcagtattgtttcagatacccaaatggaagtgtcaggtggaagagatatttctactttgaagttcagagaagaactttaggcaggaaaacttggagtygttaacattttgatatttaaaaccattggatgggatagggataatataacatagagggargattcagccatcagaaaaggaaagcaatgaggcctagttcaaaattcagctatcagggaaggagtaatctacagaaaacaactgagaatgaatagccaaagaaggaaaaagagaatcacgagattgtggatagtggaacactaaggaaatagtttcaagaaggatatgtttaacctatggcaattcctgcttgagaccttaagtatgatgagaacttgagactgcttttttggattttggtcacaaacagaagtaataaaaacactttgattcaatgtgwctttggcaattacggctctgtawgctaattaaatttctaaataaggtggcttaagggacacttaaagtagtgatattcaaagtgtggtccccagaccaggagtatcaaaatcacctggaaacttagaaatgcaaatattgaggccctaccctagatctaaagaaacagaaactttggtgatgtggtccaactgtgttttgatcatcatccagctgattctgatgcaaactacagattcacctggagccagtggtgtgcatgagtggcctagtagagagtctggggagcagaatgtgcacttttattcacaactctatgtcaccagtgacttgaaactggccatggtgggagtacaaaaatcagaaaagtcagaaatcttcaacgttacagattagttctgttctcaccctgccctgccaccatcaccaacacaccagtattggtgaattcagtatgtctaagcaagatcctatgaattggcttttctaataaattcttacataatgctgatgcaatggtcaaagccccacacattgaaaattataaaaattaaatttgttttattccataatatggctcaaatgttctttcctttccgtcttataaatttcttagtggcatgattctgaaaattattgaatttgccttcttcttcattgtccataatgggtgaattcagaagtcacaacttttactcggttatcattaccattatttcaaactagattttcattgcttctggcctctattattacagtagcttacctcctacctccatgaaagtcttctctaacttatatgcctaatatatttaccctgtgcagacactttggtgtctcccacctctttctgccaaaccttgacataaagtcatccagtggctgctattgctttctgtatcaattcccatctccttttattgttttaaaacccagcacaaattaccattcttcaacccacactaacatatatccatcccttcatcttttaaatttaccaattatatttctgtgtctcagcttttgcttataactctgtagaggactggcctatgtttatttaattctatatgttttgactccccatatgcattctatctgtcatatacattctgatacaatgatacattttatcaatgtggtcttcaattatatatttgtgaccaggatggaaaagtggaggttggatgttagtacaattggggaacattgtaggaggttgacacaamgggttttggtaagtaggtaaattttatcctgaaggagattctgaacttgcttatgtccttttcaaatattttttgaagaaaggaaaataatctgacatttatggaacttctgtttcctaaaaactgtgataaatacttttttcatgatcttattttatttgtattctcacaacaatcctatgaaaagtattattgtataggtctgttgaaaaaccagatatctaatttattaaatttgtggttaatgtaaattcaggaggaaaagctaatgttatggatggttgagtcatgagtcaccatttttttttttttgccaagctagaataatgattcagaaatcaacaaggaacatttaacagcaataactataaagtctacattccaattaaattcatcgcttgtatttataagtccttacaaatttgcttgactgcaattcatgggagaggtcaaataaaacttgctaaaactcaatatgagctgatagggttatatacgggcaataaaactaacatactcttattctgtagttaaagaaatatagtgttcagatcaagaaaaagatttttttcctgtgtattattaactcgccaatgcttatttggagtgttgtattatttctgaatattatatttaaggggattttaacaaagtatagagcaaaaaaatgatgaatatcaggatggcatcattatcattgctgacaggataaagagagaatactatgtgggaatattattgctgcattaaaattccaccacaggaaagggctggaacagctgagagttagctaaagatgggtggatagctggaggtaaaagaggggtaagtttcaggtcaatgtcaagagcatctcttctagagtcagagcagccaacagatgaatgggttgctttaagaacagtgatcaagtaaagcagtttccatcattaatgattttgagattttattatctctctcatgttgccttcaggctgctcttattcaaaatgatatcttttccttctgatatgtaattgcactgatagaccatatttaattatgaaggtacttaattgctctttattccatgtgcgttgataatattcccaacaatcttccttccactgaaagtccccaaggggggaaaaatatgttttatataccactcagtactattctgaacacatagctggagttcaataaacacttgttgactgattggtaattttccaacctgctgaggctgctctcttttgcaagggcaattataaacaattctaggagacaactcaagttcttaaaatgatacagatgatgttctgttctttcccgcttcaatagaaatcacactacagaaaccagtgtcagcaaaatgggacaaaactgttgttttgattttcttaataagagaagacaggaaaataattatcatttaaaaccactcccactcagtaaaccgtattaaattgtactctgtgtgaaaaactaagtccctgtgtttatagattccacaaacaactttgatgccttagatatattagcaatgccatctctttttatatctgcacatatataagccatttttctccctctattaatcaaatgcattatcagttaggaagatattttatggcctttataattataatttttctaatactgttttttctccctctttagaactactgaaaagtattttttctccctctagaaataaggcaaactataactatttttaacattatcctcacatgttacatgactatgttaaaatataaatgccatagcaattttaataaatgaaatyaccctcactgaatcaaatgtaaagctggctttctgattcatggtcctcatttttctcattgttgtatattttcctaattcactttttagactgttttaaccgaatcataatcagatttgtatctagatggatgtatgttgctttaattatacactttgataaatggtaggataatctgaatttcacttttgtctcaaaatgaaatatgtaacatgtattttgccagtatccagttgtctggtacgggtgatttcatatttcatgtatgtcaaaccaagaaagagcagtgggcttccagtctggaaatgggtgctctagtcttctttcactaattaatgatgtggctttaagcaagtcacttgaaccttaaactctcagattcttcagtccctcctttgtaagtgggtagatttggactagatgtctaatattccttctagatttaatattctattttgggaagccttcaacttagtttatacctgtaaaacatactttaaacacataacagatattttacattataatttgattgaaacaataccattgaattagcagttcacaaacttcaatattatctaaacatattttaggctaccaaactttttttcaaaaaatcttactcctttcaatatttctttatactccttaagagcaaagtaatttatttttttctactttatagttaaaaaaataacacagttaaggcagcgtttatgatgggaatcacaaaaacaattcatatatcacagtacactgagcccactggcttttttcccattgaaatgtgtgggatggtccttccttttatctgattaacactgtttttaagtgatcttatctaagggaaaaagcaatggaaacaaatgatgagtcaaagcatgttaaatcatatgttttagaacagattaaacagctgccattatttctgttaatatgacaacatctcaacttgtatgccatttcttaagactgtatattccactcttgaaaattgtaaaaaggartaggtgcttttatcactgatgagttaaacccagtcaaatatgtgcactggttttctaacccaagggaggggaagctccttgatgttgatgcacaatgatatgtagaggaacaaccatgggtgtttatagtaaagagaaaatgttaatgtagaaaacactattggtttttctcatgtctatttcactttctcagtttcatggggtaggggcaggtactgattaacccaaaccaactcccttattgggcatggatatatattgccacaatcaaagtgaaatagaagaatttcattakctagctagggaacttcccacccctttcatccctctttcttttttctgcttcccctctcctctatttatccccatcttctccttgatccccctctctctggatgtgatgtgaccaatgacccttataaacctaagaatcactggaagccctcttataactataaaggaaaccaacttcaggacaaagtgaaactcagaaagcacaatgtaaatcaagggaaaagaaaaacaagatacattttaaatgacattgttgagctgtcagatctatccttacttaagaaacaaaactagaatttttctgttacctgagttaacaaatgtatttaattactagtctgtttgagttaaattttgggtttttataaccaaaggcactttaactgatgttggcttcagacacagagaccttcttttatctccactgtactcccactagcaatatcttggcaatatccttataattaggttcaattgtaatgaatttttgccttgtccatcctcaaaagtccaactcctactttgtaccttagattacccaagatttcatgcacctaatattgatgctcaagaaatttcttgtcttttattcccatccaaatatgctggtattcttccttttcttcgtgtctgacttttggattatgagagtgatgggataattagataaatgaaatagagtggatatgctaactagtcttcaaatgcataccctagcctataaaggaaaacctatcagactaacagcagacttctcaaataatgtaacagacccccaaatgatgtcaaatagaagcatgctaagttgcaggtgttttaagaattgtgttaactgaaaatctggcctatgtgttatttaaaatggcccagtggtttggaggcattgttagcctgcctctcccacttggaaagacaaaatagtgtgcagagattcacaatgtgcacttctttctaagaagcaacacaggaacttaacagaaaaactgaaagaaactacagaccctttgaaagaagaaacagcagcctacactgtgaaccagatggaaaactgtgagtctccagagtgtgtgagagggggagagactgccaccgtgacacacactcccaccggagagccgggcaattcaggccatggaggcagatcttaacactacccagtgctggagctgatttagcgagtgatggggtgagaagaagcggtatcaggatgcacattgcctgcactttcacactccagcaaggacagagggaagccattcctgatcctacctcacaggggacctcacagaagtctaccagctaactcaagctgcagtcacaggttgagagaagctcccatctgagatatgagattataaccttgagtgaggataaaccctgttggccagaaatgaggggcaagtagtaagtttgctatagccatgggcgcaggagctgggcactcctgcttcacaggtagaccagaaggggtgcggcctgaaagctgtggtttcactggtctccactgggacggcttatggcctggggcagtttttagttctacstacagactacctggaacccagcctgctgcttttagcgaacattatgagtgggatacatgccttgccaagtgcatgggagctgagtggggcttactgctgcttgctaacccctgcatcccatgcggattcttctgtgcaacagaggcagctgtgctactccctgaaatattaccccagtagccaaggaattgacttatgatcctcactggggccgctgcttgtgcctgcatgtgaggagccagagcaaggagttgcctgacctagcccatacccagctttgcccctccacctgccctggtagcacagtgcaatatacagggatgtttgggagctccatggccctacccattacctacctgagacacaggaatacctcccctgagtgacataaagcaagcacaaattctaccactacctccacagctggtgcttttctacaagccatgacctactggctggaggccaaccggcacagcccattaaaacatctgcataaacaataacccagcactcaggaagccaaaaacttttatgcaacctcagctattgccattgccagtattaccttagctaaataggacgtcttgagtctgtctatgtgcccaatacactactactacagctggcatttgagaaaaccaaaacactaaagctatttataaccaagaaaatctcagagtctgtgtcactccccacccacccccatcagaggtaatgctggcacctggtgctgggaaactagaggacagttcacatcactggatcccttgcagatattctccagtacagcctgaactgtggcagccccactggacagctagacctagaggagcagtagaattcagaatagcctggctttcagggactactattttttggggaaagagtagtgaaccacattaagggagcatcccatggtataaaagaaagcagaccatgggccttgagtcccttaacttcccacttgtgagaagtttctttcgggagagacacaagtgcagtgctgggctcagtggggaaagtctgcagctctaccccaacagtcaaacagcgctcatgaaaggtttgagaaggtgatttctttttcccctcacccaacactgcagagagctggggcttctctcatgggagctcagcatggatgcatctgtagacagactttctggaacactccaaggtaactatccacaggaagtgtgccatacaggttcagacttacacaagaggtagagctacaacccttctttagagggaacatcagcattcttgcagatagaaagagatacctgtttgatctgaaaagctagaacaccaggtcagcagtgtgactgggaggtggattgctttcctgctttgcctggaaggagagctggggtggctccttcacttccccatgaaaagacctcagtgtatttcacggagagctttgccagctgcctctgtcaaagctgggacttcatccaatcgttggatattacatttacccacccgccttagccacaacctgtgtttatctgtgggcacctcctactggcctgaagcctgaactactcaacccgttgaataaaatgctggaagaaaaacttttaaaggtgcacaccactggggaacaaaataagcttcatgagacctctgccattccagccccttaggagacagtgaacctactcacacacccagcccactgccactacaaccggcatctgagaaagacacttcacaatgattctctataaccaagaaactcatacagtctttgccacttgaaaccacccagagctgaaactaagtgtaaataaactataaatgttaaagtcacatcttcaaggaggaaaatttttttaaacccaattgaatcaaaaactaattttaaaataattagaagaaatagcctacacaaatgagaaggaaccataaaaacaattctggaaacataaaaaacatttgagttgttctatgacaactcaaaaaaatcaatcacactgactctccagcagtggatccaaatcaagatgaaatctttgaaataccagataaagagttcaaaaagttgattattatgttaatcaaggagacataagagaaagttgaaaaccaacataaaataccagataaataattcaaaaaagttgattattaagttaacataaagttgaaaaccaacataattttttttaattcaggacatgaatgaaaacttttctaaagagatggatattttaaaggaaagccaatcagaacttctatgaaagactacacatttcggcaactacaaaatgcagtgaaaagcttttaaaatagattagaccaagcagaagaaagaatttcagaactcaaaaacaaggctttcaaattaacccaatcagcacagcaaaagtaaacaaaaaagaattaaaagaagaaggaaagtctcaagaaatatgtggattatataaaatggccaaacataagaattgtagatattcctgagggagaaaaacgtagcaaaaatttcaaaagtctatttgaggaaaatttccagggaggaaaacttccctggacttgctagtgacatagatatccaaatataagaaggtcaaagaactcctgagagactcattgcaaaaacaaaacatcactaaggcatatactcatcaggctatctaaagtcaacatgaaggaaaaaattctaagagcagtaaaataaaagcatcaggtaacctataacagaaaaccaatcaaactaactgcagacttctcagcagaaaccttataagccagatggaattggggtcctatctttagtctcctgaacagaatgactgttggtcaagaattttgtgtccagcaaaactctttcatagataaaggagaaatagtttttctcagacaagtaaatggtgaaggaatttgtcaatactaaaccagctctatgagaagtgctaaatagaatactaaatcttgaaacaagttgttgttactcaccagaataaatactcctgaaagcataaaattcacagggcttataaaacaataacaatatgaagaaaacaaagtcactaagtaacaatcaatatgatgactagaacagcacctcacatctcaatgtttaatgtaactggtctaaatgctccactttaaaaagatgcacactgacagaatggattttaaaaatttgcaagccaaatagatacctgctatcttcagaagacatacctcacatgtaaagattcttatagattcaagctaatggggtgaaaaaagacatttcttgcaaatggaaaccaaaagcaagcaggagtagctattcttaaaacaaataaaatagactttagagcaacaatattaaaaaaggacaaagaaggtcattatgtaawtaaaataggataaattcaacaagaagatataacatgtctaaatttatatgcaccgaactctagagctcacagattcataaggcaattcctaccaggtctaaaaaagaaaatacatagtaacacaataatagtgggagtcatcaacactcctctaacagcactagagagatcatcaaagcagaaagtcaacaaagaaacactagacttaaatttcagtctagaaaaaatgagcctaacagatatttacagaacattctacccaagaactacagaatatacattcttctcatcagcacatggaagattctccaagatagattatatgataggtcactaaataagttcaataaatttttaaaaatcaaaatcatattaagtttcttgtcagaccacggtaaaataaaactaggaatcgattccaaaaggaaccctcaaaactatgcaaatacatagaaattaaacaatctactcctgaatgatttttgggttaacaatgacattaaggtggaaatttaaaaaatttttgaaatgaataacaacagtgacacaagttatcaaaacctctgggatacagcaaaagcaaagctaagaggaaagtttayagtgcaaaatgccaacatcaataattctgaaagatcacaaattgacagcctaacaatacatctgaaggaaccagagaaataagaaaaaaacatacctaaagctagcagaagaaaaggaataataaaratcagagcagaactaaataaaattgaaacaaaaaaaatccaaaggaccaatgaaacaaaaaatagctccttcgaaaagataaaattgttagaacactaggtagattaaaaccaagacaagaagagagaagatccaaataagactaattataaatgaaaatggagatattacaactgatactacagatatacaaaagattatttgggactactgtgaagagctctatgcacacaaactagaaaatttagaggaaatgaattaattcctggaaacatacaacccctgctagcttgaatcaggaagaactagaaatcctgaagaggccaataagaagcagtgagatttaatcagtaatttagaaaaacaacaacaacaacaacaacaacaaaaaccaaaacactgcaaacaaacaaaaacagtccaaggccaaatgaattcacagccaaattctaccagacatccaaagaattggtamtaattcaattgaatctattccaaaagattgagaagaagagaatcctccctaatacattctacaagcccagtatcaccctggtaccaaagcaaaggaaagacttaacaaaaaakagaaaactacagaccagatctctgatgaatatagatgcaaaaatgctcaacaaaatagtagcaaaccaaatccaacagcgcatcaaaaaaataatccactatattcacatggatttcactttagggatgcagagatggtttaacaaattcaagggaataaatgtgattcatcagataaacagaattttttwaaataaatatatgatcatttctatagatgcagaaaaagcattcaataaaatccagcatractttatgataaaaaccctcaacaaactagacatagaagaaacatacctctaaataattaaagctgtatattccaaacccatagccaacatcatactgaatgagaaaaagttcaaagtatttcccctattaactgaaataagacaaggatgctgacttttatcccttctattcaacatagtacaggraatcctagccagagcaatcagacaagagaaataaataaagggcattcgatttgtaaaacatggagtcaaattatctttgtttgccaatgatataatcttatatctagaaagccctaaggattcttccaaaagactcctagatctgataaatgaattcagcaaaatctcattacaaaaccagtgtgcataaatcagtatcactgctatacatcaacaacaaccaagctgaaaatcaaataaaaaactcaatcccttttacagtagctacaaaaagataaaatatgctagaacatacttaaccaaggaggtgtagtatctctacaagaaaaataaaacacggctgaaagaaattgtagatgacaaaagcaaatggaaatacattctttgctcatgggttagaasaatcaatatcatgaaaatgaccatacactccaaagcaatctacagattcaatgcaatttctatcaaattaccaacactattttttacagaattagaaaaatcaatcctaaaattcacatggaaccaaawaatascccaaatagtcaaagcaacctaaacraaaagaacaaatctggaggcatcacattacctaacttgaaattttactacaaggctaacgtaaccaaatcagcatggtactggtataaaagtagatcaatggaatataatagagatctcagaaataaagccaaatacttaaaaccaactgatctttgataaaacatacaaaaacataaatcggggaaaggacattctgttcaataaagggtgctagaaaaattgcatagtcacatgtagaagaaagacagtggatctctgtctctcactagatacaaaaattaactttaccttgactaaagacctaaagacctgaagctaagacctgaaaccataaaagatctagaagagtacctaggaaaaactcttctggacaccagcataggcaaataatttataactaagwcccctaaaagcaaatccaacaaaacaaaaataatgaataggactcaaactaaaaagcttcttcacagcaaaataaataatcattacagtaaacagacaacttaaaaactgaaatgtggacaaaasacatgaatagatatttctcaaaaaatatacaaatggtcaaaaacatatgaataaatgctcaacatcactaattgtcaaggaaatgcaaattaaaaccacaatgtataccaccttacccgagccagaataaccattattaaaaagtcaaaaaaaaaaaatccccaaaagatgctcgggtggacgtggtgaaagaggaacacttatakgctgctggtggaaatacacattagtacaacctctatggaaaagagtatggagatttctcaaagctaaaagtagatctaccatttgatccaggaatctcactactgggtatctacccaaaagaaaaggaatgaatatatcaaagagatgcctgtgtgcatatgtttattgcagcacaattcacaattgcaaagatatgcagtcaacytaaatgtccattaactgatgagtggataaagaaaatgtgatgtatgttatcatggaatactactcagccataaaaagaatggaataatgtattttgtggcaacttggttggaactagaggccattattctaagtgaagtaactcaggaattgaaaacgagatactgaaggttctctcttataagtgggagctaagctatgggtatgcaaaggcataccaagtggtataatagacatcgaagacttaaaaggggtgagggggtaaaaatgaaaaactacctattgagtacaatatgcactattcagataatgcatgcactaatatcctagacttcaccattatacaattcatccatgtaactgagaaccacttttacccctaaagattaccctcaccaggcagtaatgaggcaaccctcttcttcctctgccaaagcagtttcagaagaagccaactaaagcagaaatgtgatccagaattttaaatatgatccatagtcttttaacataataaccaaaatgtctccatctcattcaaacatcacttgtcatatcaagaaccaggaagatctcaagctgaataaaaaaatacatttaatagatgacagcgatgttagaattatcttacaaagatttcaaagtagccatcataaaaatgaatgaacaatcataaacatccttgaacaaatgaaaaaatatcacctatttcaaaattggttgaagagaagatttggaatgttcccaacacaaagaaatgataaatgtttgagataatcgatattcaaattacctagattttattatacattgtatgctcatatcaagatagcacatgtaccccattaatatgtacaattatgtagccataaaaattaaaaataaaaataagcaaaggggaagaatgtcrccaaaggagaataaaaaaatagaatgttacagcaaagaaatcaaagaagaatgaaatagaaatgttagaactaaaaatattaaccaataaaataataatttaaaaagtcaacatatgggctcaatagctgaacagaggagacagagaaaagaaccagtccattgaaaaataatacaaatagaaattacacaatgtaaacaacagggacaaaatagactttaaagaaaacaaaaacaaaacacaacctcagaaatgtatgggactataatgcaaaccccaaacatgataagcccaaagaaatccacatgaaatcacaccatagacaaacttctgaaaattaaagacaaatgtttaaagcagtcagaaataaatatcacattctctgtggaaaaaagaacgttcagatgacactggatctctcatcggaaaccagggaagccagcaaaaattacaatagttttgaagtgctgaaagaaaaaattttgtcaactcaggatcctatatccagtaataaatactcttcagaaataaaggagaaatcaagaaattctcggagatgaaggaacaataaaataatttgacaccagcagacctacattaaaagaatgactatcttggttgaagtatcaacaatgcaaaaacttgtattattttctctgtggcctgaaatattattgaaggctttgctatggataaaaacaaaaccaagtgataaaaacaatacctctaagtctgtaatattctgccaaagtaaagatcatactttagagttatagtggtaggagttgaaatctccactttaatggtctctttcaaattggatagatcatggtattttaaaagtcacacgtcagtttgcatttataatccattcataatctgatggcatgtactgcccaagcaaatactactgattcttctgtaatacttgatgtaagaacttcttttgtaatgcaactgagctataacttgacaaattaggtttgtgactatttagggaaataataaattaataactagattaataaaaggagaagaaccaaataaatacaatcagaaatgaaaaacgtgactttacaggtgatctcaaagaaatacaaaaaatcctcagagactattatgaacagctgtatgcacacaaactagaaaaactgaaagaaattgataaattcctggaaattcaccctcccaagaactgggaagaaattaaaatcctgaacagaccaataatcagttctgaaattgaatcagtaataaaaagcctaccaaccaaaaaaaaaaaaaggcctagagcagatggattcacagctgaattctaccagacatacaaaaaacagctagtactaatcctactgaaattattccaaaatttgagaagggattctctagcttattctttgaagccagcatcattctgataccaaaatgtgacagagacacaacaacaacaacaaacaaaaaaaaaaaaaagaaagaaaaatatcaggccaatatccccaatgaacagagatgcaaaattttctcaatgaagtactagtaaactgaatctaacagcacatcaaaaagttaatttacggtgatcaagtagggtttattcctgggatgcaatgttggtttaacataggcaaatcaatacatgtgattcaccacataaatagaattaccaacaaaaaccacatcattatctcaataggcaaagaaatagcctttgatacagttgaacattccttcgtgctgaaaaccctcaagaaattaggcatcaatagaacatatctctaaattttaagagctatttatgacaaacccatagccaacatcatagcaattaggtgaaagctggaagcattccccttgagaagtgaaataagacaaggatgcccacactcaccattcctattcaatatagtaaaggagatcctagccaaagtaatcaggtaagacaaagaaataaaaggcatccaaatagagaggaagtctaactcactcttggaagacaacatgactctgcttagaaaaccccatagattctgccagaaggcttctagaactgataaatgaccttagtaaagtttcagagtataaaatctatgwgtaaaaatcagtagcatttctatacaccaataatgtccaagctcagaacgaaattatgaacacagtgtcacttacaaaagctacaaaaagaataaaatacctaggaatacagcttactaaggaccttaaagaaccttgcaaagagaattacaaarcaatgctgagagaaatcagagacaatgcaaacacatggaaaaatattcttcctattccatggataggaagaatcagaattgttaaagtgaccatactgccaaaagcaacttacatattagatgctattcctatcaaagtaccaatacatttttcacagaattagaaaaagttattctaaaattcatatggaatcaaagaaaagactgaatcaccaaagcaagcctaagcaaaaagaacaaagccagaggcattacactacctgacttaaaactatactacaaggctgcagtaaccaaaacagcatgattcaggtacaaaaacaggcagactgatagaacaggttagagaaccctgagataaagccacaaacctacaaccacctgtcctttagcagagttgacgataacaagcaatggggaagggaccctctagtcaataaatggtgctgggatcactggctagccatatgcaaaagattgaaactgaaccccttcctttcaccatatacccaaattaactcaagatgggttaaaaacttaaaagtagaactaaaacaataaaaaccctagaagaaaacttaggaaataccattctggacatgggcctttgcaaagaatttatgactaagttcccaaaagtaattgcaacaaaaacaaaaattgacaagaaggacctaattaacttaaagagcttttgcacaataaaagaaactatcaatagaataaacagacaaccttccgaatgggagaaaatattagcaaactgtgcatctgacaaaggcctattatccagaatctgtaaggaacttaaatcagtaagcaaaaatatattaattgcatttaaaagtgggcaaaggacaagaagagacacttctcaaaaaaagacatacatgtggccaacaaatacgtgaaaaaatgttcattatgactaatcactagagaaattaaatttcaaactatgagatactatctcacatcagtcagaatagctattattaaaaagttaagggccgggcgcggtggctcacgcctgtaatcccagcactttgggaggccgaggygggtggatcatgaggtcaggagatcgagaccatcctggctaacaaggtgaaaccccgtctctactaaaaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcagtccggcctgggcgacagagcaagactccgtttcaaaaaaaaaaaaaaaaaaaaaaaaaaaaaaaaagttaagaaacaacagatgctgtttaagctgcagagaaaagggaacgcttatacactgctggtaggaatataagttagttcagccactgtggaaagcagtgtggagatttctcaaagaacttgaaacagaactatcatttggcccaacaattccactattgggtatacacccaaaggaaaataaatcattctaccaaaaagatgcatgcactcatatgttcatcacaatgctattcacaatagcaaagacatggcatcaaccaagatgcccattgacagtggaccagataaagaaattgtggtacatatagaccacggaatactgcacagccataaaaaagaatgaaatcatgttctttgcagcaacatgaaatgtagctggaggtcattatcctaagcaaactagtgcaggaacagacaaccacattccacatgttttcgcttataattggaagctcaacattgaatataaatggacacaaagataggaacaaagactctggagactgcttcattggggagggtggtgggggggcatggattggaaggctacctgttatgtactatgctcactaccttggtgatgggctcattcatacatcaagccttagtgacacgcaatttgcccatgtaacaagcctgtatgtgtaaccactaaacctagaataaagtagaaaccaatagtaataataattaaaaaaccagctgggatgtttataaaattcaggttcctgggcaccaccccagacttaattgaatcagaatcttaggtgagatgacactaaaactgtattcttaacaagctccccagtgattcttatccatgctgaagattgagattcacatcattggattgtacaagatatctttattaatgccaccatctgtgggcgaagtgggagtgacttctctcatcaatggacacactgctttgtgctcggtttcctcccatacctctctgtcttttctaatggaattcctttgcatgcagcagcctagcacctcttactagatcatgtgtccagctgaactttacttaacagccaaacacacagttattttcacaacaatattttcaggctgtgtattaagcctatttcacagctgtgatcacaggtattaaagaacagatgtattgatttgcggggcacccatttttcattgtatttgatgtccttgtccacaaggcggaatggcaagaggcttagaaatctaaccatgtaccggttatgttgtrtttgctttgagcctatatcctcattgaaaacagctgctgaactcagagttattatgaagactcctggagagaaagcagaatggaataaatgggaagagcacaggctttggagtttagagagagctggtgagaatgccatctctgtctcccaccagctgtaggatatggggcaagttattttacctctctaagcttcatcttcaaaatgagactaataatagtcccttgaccagcattgtcaagattaattgaaatgatccagatacatggtgagggctcaaaaaattgcaagtatcattttcagtttggggaaagaactaggcacagtgccagggatgcaaggcattttttcctcttataatttaaatcttctgagcagacttatcagctgtgcagctgcaaagtgaattttaaaggtacacagacatgggagcaattcctgccctagtatttcttacctctgtgactttggcacaagttgtttaaatttttgagcctcattttttgtttgttaaataaaggaaatagtagttacatttacctcacagaactagcataagactctaaagtagtatagctcacctttttctctcccctcctcccatgcctctcttccggagaaaagagatactggctaggacggtgcatgggtttacagtcaaattctggttaatgaagttgctattcaatttgtcactaaatcatgattgcattttttcaaataatatagctagaagactccagtcctctcaacttagatcaagatgtgttatttgttatgtaaccagtttaccattttttctaggttcttgaatagacaatcacacccatagttaagtggcttcttgggacatccaacccatacaagatggccaacattaaaagaatggatgcagttaatatagactccagctgaatctggaatgtagactaagaatcctcttttgagcataggctatggcatgagcatccttgcgcccatacggtgcatttctgtctttagagaggaaaactgtagtaaaaaaactgttacacttacaggaagctcaaagtaatcatggaaaattatatttcctaagtgttttgtrctttaatactcagattacagcttgtttgaggtagcaacatttaaagaggggaaaaaaaaacaacctttgtttagatcccttttcaatatgttttcttttcaaatgaatcaggaaatatttttgaataacagatatgtgatttacaactcaaccaaaaagaaattattcacatgtaaagaacgttatttcctagttttttcttattctaatttctttttaaattatcttatttttgcttttttcattggtacttttgattccatttctccctaatatttcagtgagcttttatttctttacaaaaacatggtagaacctttgctcacctttcatatctttctggatttttcggtgataattgaacaaaacatggtagtaattattacattattgctttcttcttgcctgtgccatttattgtcattgtttttccttttttcttcctttcttccctgcctccactgcaccccggattatcagattatcaccctattatgacggcatttctgagttaaattacccttagtaagacagtaaatgggtagaaattaaaatgaatatattaatactaatttcatctatgtcaactatctgcacagtcttgtaagcagacatgacagccttttgagtaaattattgctgtttgaaaaggatcacagataatcttggtaacctcaacacactttcaaattcctgaaatggcatttatttcaattgtgttttaggtgtacattaaacatttttactatttatctgtaaagtacatcagtagtacagcttttcaaaggatgatgatattctctgcacattgctgatagtgatccaatgcccaaaggcatgcttaaaaaaagtaacatgaattagaaaataatagtgttgtccattgctaaaaaattgttttggttatatagaagaatataattaatgcctaattcattataagtaagaaatattctaagatactaaatgactaaccagttttcttttaattgaaagcagggggtattaaatagaaagggcatttttatttctgctcatattcatcttgctgaaaattgtggattctgggaaggcaaaaatgaataggcaattcaatagaataagccataaagaagaatttctcatatgtatttgttatataatgattttgttgaacttcagtaaaattttgtgaagcactttgtgtgaaacacttagaatttttcctataatcctggagtgttacagttattaattttaaacagaaaatgctatctcttttctcattaatgggaggagacagctgtgttacctgaagctatgggctgcgagcaaccctggtagtcaatcacatcattcataatatgttgggattgtgcttctggcatttgcttattcagaaataatgcatatcattagaatttttcactgtgattgcatttttagttgatatattcggctaggcctaacactgaaatacagttgtccagaacatcagtggttctccaaattttgagaaaaatatatcacactttagtgaactaggaggtttatatttcatgtgaacctgagccacagaaaataattctgttttctttaaacaatgtcaatatataagccatttcccctagatgcactgtttccattactctacctagggatgtagtattagtcctgtgcacagacacttgtaatcagagccccagcattccatttktcattaggggaaacacaaggaaaactgtacaatttggactccgaayatctgataagcagatggcaggttagcctcaatgtagtgcaaatattgtctgtttgcaagactgatatttgcacacacgtctttggcagatgatggtaaagcattgcacagaagaagcatgtgtcctgagtcacacagcacacagaaggaaacatcttcctcaagtctattttctctcctctctttgcaaagactgatggattcttttaaatacaaagatattttgagaaaggttttgaaagttaaatgtggagataagtggcctccaatctgtgaagttttctttatcttttttcctccccagttaaaattcaaacttagaatttctcactcatctaggttattttggtttatttcatgttttgtttttttttttgagtcctggcctaaatgcaattagccacacagaatgtgattatcaatcatattcaagaccctcagcataaggtgtatgtatagataggtagatgtagagatagacatatagtttgtctaggtatgtatgcctgtttgtgtgtatatgtttgcttagattcatattcagatttttttttttttttaagacagagtctcctctgtcaaccaggctggagtgcagtggtgcgatcttggctcactgtaacctccgcctcccgggtttaagcgattctcctgcttcagcctccctagtagatgggattacaggcacgtgcccccacacccagctattttttgtatttktagtagagacggggtttcaccttgttggctaggctggtcttgaactcctgacctcaagtgatccacctgccccaacccctcatagtgctgagattacaggcataagccaccactcccggcctcatatctggatttttttcatactctgctcatgggagactgtgtagcataatgaaaagatgtccgtaagttttggaatctctggaggcaaatatgtatagtggttaagaacatggactctaaaatcaaaattgcctcataaatatgtacaactagtatgaatacacactaattaattgtttaatttctttaaaaaatgcgtcagtgattctatacaaattaatcatctgcattgtgcctcggcggcttcatctgtgacgtgacaatgacatagggtcattatagatttatcttatttaactgcataacaaggttgttatgggtcattacagatttatctcactgttaacaaggtcgctrtggggttaaatgagataaatctataatgaccctattatctataaagttcttatgagagggactcttgtataataaatactgtataaatgttacttttctttttgttcattagtctgccataygtatactaccttgaacccaaaagacttagggtgataattttaaaacactgaataaatacgtgttttcttgaactgggcttagttatgagtcagaggtccataactgctcagccatgtgcctttgagtaagccacttaactcttctaagccaatttcctcatccatgaaatggggcagtaattgctgccctgttttcctcacaggattattatgtagaccaagtgaaacaatttatatgaaagtatgggtttagcttgaaatgcaacacagatagttgtaatgctattttttaatctccaaaagggaatgcgataaccaattcaggctttcacttcttctggtctagcaggcatgataatacacctacacatatgactatattaaaggtagaatctgctaatgcatcagaaagttccagaacaaatgcttcgatacaacttaaaatataatgaaattgtttctccttctagaaataatggaaagagaataaatacacactagtcaagccttagtatatgctttgaagtaatttttaaaattgttagttaccttgattactatcttgcttaaataatatgtttcatctggagccagatcaaatcaactgggaacatgtaccaaaacctataagaatctcagcactttgacagattttatttcttggtgtattaggagaacatcaggacatttttttgagagctccttgctcaaaactgttttcatcttaggaaattaaaaatgtatgctcacagatatttcactcaaggcattttgttcagctagtaaatattgtttttttcttctttctttcagmggataaaggatatgtctcatcagtttatgtggtttaaaaaacatttccattagataatataaaattttgtctagaattcaagtgggatgtctttattttttaatttttttttttttacttttgctccatctgagacctgtgtgaaatcargtggtttttaaaagtcaagttagctggtttgttctgatgtgtttggtctttaaaaattcatattttgtyggctgggtgcggtggctcacgcctgtaatcccagcaccttgggaggccgaggtgggtggatcacgaggtcaagagatcaagaccatcttggccaacatgatgaaaccccgactctactaaaaataaaaaaattagctgtgcgtggtggcatgtgcctgtaatcccatctactgggaaggctgaagtaggagaatcgcttgaacccgggaggcagaggttgcagtgagctgagattgcaccactgcactccagcctgggcgacagagcgagactctgtcaaaamaaaacaaaacaaaacaaaamaaaacaaatcatatttttgaaaggtataaggaaaactagcatctattgcctttaagattttctgtgggatttaggtctcaggggtaatgtggagagacactgaacccacacagagctaaaacttctaactgaagtatccytaaaagggtccattggactgttttggtaacatatctcctgtctataccagaatgacttctcttacacctcattttggaaaggcaagagatgagagtcattcttaatggctgcacagatatgtggtagaccaaagaaaggtgtgtggctcagaggttgcagacaacttccctatgctcactctcctttcatagtattgcccttcaaaagaaagaaaacatttaacaaatatctacctatattatttttattagtaatggctctgccttttgaatcaactctttgaatactgttttattactgaaatgacttttacaccacccactcctgatattgctcataatatcttactgaggtactttcagatatcacatcaagcgtgggtgatttgtagccataaacaattgtcagtgtagataatagctgactgtacaagctgatatatttgaggtctcaaagccatcatgtttaatatccagaagtgcattctctgggacccaacaggatgctaacacctaccatcaaagttcatgttctgagaataataatgtcttattataatttttgaataaatatgtcctgcttattaattaaaattgttctgtgcacaaarcatgttattactgttttcttccagctaatgagtcatagtactgagatgattacttttgagattaatcatttttaaatattgcaaagtatatctgttgcatattatgctccatctacaggattctgttatatttgagtaaattttagataaagtccataaaagaatacaatactctttttacatgggccattatctcttattaaccttgataatgtttgtcccaatgaaagaaaatagaggagggtaaggaagactaaattgcaaagcaaaaggctggcgcagctaagaaatattggctgaatattttccatttgtccctccacatcccctttctctcctcctatggtcctaggaraacatcgatggggcagsctcctttgttctctggcttctggttgggcaaggctaatgagaggcactaggaggtgattagaggccaggagcaaaatgatgtctagcttttattctctagcttcttcctgacaaagccacagtttatcagagggcatgttcctttccaaggccacagctcctgcagatcctttgctatagtcagagtactttctggatttcagttacttctctcttcctcctcctcattcctttaggatgtagagataggaagcaaaggctttctctgctgccagccctggcagacttcgcttcccaggttggtttcctttgtcattctgccccatgtatgtaaattgtcctgttatcagtttctctttgtttactattcctagkattccatgcgtttctgctaacatctgatttggtacaagcagaagaatgcaaagaagataycagagttgcagccagcattgctggatttgaactttggttctattgctccctagctttgtgacagcaggcaaaccccttacccttcttggactgcagtctctttaactgtgcaatggaaggtggtgaacccaattctgagctctaaaaatgttatgttctgtatgcagctcaggaagtagaagtggccacccccaagatatatcctttataaattattcaatcatttccagaagggggagtgaaataaagacaccctaggggtattggtgtcagaacttagttaatgtcatccatgaacttaagggatataactcatacattgaaattgccttattttcatatttctctagtgttttctcattttggatacaaatgttatcaaagtagagatagaatgcttgtcagttttgttgaagggacactgtctacaatcaggttggactctaattgattttsaatgaagcactctcagctactacttcagttaggcaccagtttggctataatagatgattttttaaggtccttaatagatttctatttgaaaaaaatgtcaagcatcacttcttggctaatatcttctttatgctctcttttgtctgttcttctgttagaagctacctactacctgctttttcttgattgtcttgttgcaagatgaaggaaaactgagagaagcaaatgaaagtaaagccatagtaattactgtaaatgtgaagtatacatgtttgaacacaatctctatattttagtgtagttgttccaatggatggctctgcaactgtgtcagttataacattttcaggacccagagtagtcagaagagcaaatgaagtttattattgtaacttggagaactgctgtgctggggcactgagtctctgagctggaaaaaatcatcaaccaagatggatggatgccagctcagagatgaggagggtaaagattgaacatggttgagtggcaatgacctgaaagggggatgtgtgaaaacaatatcttagtaaaatggcaggatgataaatttgtttttagtgaagcccttcgctgttaagggaaatgaaattttcctctctctctcgtttatttttattttattttttccccgagacagagacttgctctgtcacgcaggctagagtgcagagatgcaataatgattcaccgcagtctctacttcctgggcttaaatgatcctcctgcctcagcctcctgaatagctaggactacaggcatgtaccaccatgcccagctaattatcttatttttcacagagacagggtctcactatgttgcccaggctggtcttaaactcctgggctcaagcaattctcctgccttggcccccaaattgctggaattacatctgtgatccacctcgccaggccagggaaatgaagtctcgatagactattggagctcttagtttctggagaatgtataatatacagaaacatcatctctttcttcataggctcccatgccatcctctgtcattgcaccttccactgattagtctaatcatatgattccttgcctgtgtctgtcaactgcctgtgagttccctgttcataatattgagtgatagtgatattgaaaaatgaactttagacttcaaaagccacctaaacccctccccactcctccctccctccctcccccttcccctcctcctccctccctccctcccttcttctctctctctacatccttcccactacctcatccactacttgtcatccactagccccccttcacccattgccgctgatgaagcagctattgttctacacaaacatatcctgcatactaatcaccaactccaccacgtaaccaaaccgttctaactcacaacgagaacatgacatcttggcgcacctaacacctagggcgaagctcaactggccaaacnnnnnnnnnnnnnnnnnnnnatagtagtgcatagatataagaagaagaaaacatgattagaaacggagtaagaagaagatacgaaagtagaaaagagagacaaatcgaagattaacaaagtagcaaatagaggaagaggagagatagatcacgaaaggagaagcaaaagtagaaaaagtaggaaattgagaaaagaaaggacgtacagtagatgagaggaacgacgaagagatgaagtaaaataagaagctagaaagagcagaaaacaaaagataagtcttagtattatggtatgatgaaggatggaaagtagtaaagattcgtaaaaccgatggaagaaaagttaataagaaaggtaaagtaataagaagtagacagagaaggtaggagaaagatggagtcgtagaatagagaagcaaaaaaatagctaaatgagataagaaaaatcagaagcaaatttggattaagaaacgactacaaagatggtatgagctaggagaacaagaagggaaggaggaggacgcaaagacggagagagaagaggagcgacaacaaaagacgagaaaaaagaacaagagagagagaagagagaagagaagaaggagagagcagaaagagaagagacagaggggaagaggaggcagagagaacgtgcgagagaagtcacacacgaagaacacacaccacccagcagcggcaacgcagaccctaccacagacgaaccgggctcctcctccctccctccctcccttccttccttccttctttctccttcccctcccatccctctttctccctaccccctccccttccctttgtcccttttctcccacttcctctctctccccctccccctaccatcctcttctccccgctccctgctcttgccctcaccctagcccactccctcccacctctccacctctctttttctctccctctctttgtgttttacaaattcagaaaagtagtaaagcagaaatctgtgatgtttctgtagcttaaagttatttgctaatatccacattcagtgacaacttctagcagtttatttcaaatctcagcttgggaaagaaattcaccttggtttctcttttgacatttttggatgattagccagactcctactcaggagtcacaggaacctagtagcaggggttgcctcttggagcatgaagaggacaaggagacagcgatgggaaggagattcacattgtactgcatatacttggttctgttattatttttcttaccatgtgtcaactagtcaaaaacattttcattcaactcaaaaataaatacgcccactcaattcatgaaaattgcttttgcgtttgattttgaattgtttgamtacttcagacgtgattatttcaattatgtaagctaagctgcatttcaatctgggcacagacttaycatcaaaatgttcctgttgagaagaaccagtttctcttctttaaatttcaagcagttttatatttattgtcatgatctaggacactagtgataatcatccctgattcctctctttgccactcccccatcagtcaccaaatcctgggcatttgaatatgtrcaactcgtgtctttcttcatttctccaagtmctatcactgttccattttgggacttcattatctcttggagagaatactgaaacattcatttaatgcctgcaggctctactcttagttaccagtcctccacattgcagccaaagctaacttttaaaaacagccccgattatgttttcctcccactgaaagtcaataaataaaatttagtgtttcccactctccacagaacaatgtctatgaatccgttagcgttctggtttcaacctactcgtcctgacctcaggatttctttcaacatttatttacctcatttcctttttttcttttcagtggctgctaatatgtcagatacaatactaggtgctgggatataatgaaaagcaacaccagatagatctccttttctcctaatgttttctgcccatgtgggagagggagcaaacaatcaaataatgaaaatgtttattcacaaggagagatcagtgcaatgagaggaaggagctcagagctcggaaagcctatacctgagagacctgacatattcttggggctctgaaaaactttcctgagtttatgtcgctaaaacagagatctggagaatgaattgcagcaacctcaggcgcgactccatgctagctgcagcaggcaacctgccatccttcaacctgctgtgagttttcctcaccctctgcctcaggttttccctacttcatttgatgttcggtaaaagtctgtttaattatatttcccctatccttccctttatggaatattaattaagatccgtctcacgtattacttctaagtgcagcttccctgacattgctaatggcctctcttcttgagccccatggccctcatctctcagttcccacatcattttatataaattagctattacttgrcatctgtctcattgttacctacacattttacttatttctctctccatctcttatgtatcctttgtattcccagaacgtaaaatggtgctagaacagtaaaaactcagtatctccattggatcaagtagtacctaacaacaaattggtgaagtgattgttttataggtgctgtcaattttattggctttagataataaatatttacagattgtgtctttcttttttacaatgtcattactccaagaagctcctggtataaggaagtgaaatatttcaattattgttttatgactyagtaatttgaaacttggaatgcattttcccaaagggaaggaaggtagaatggtatttttcgttcctgtatatgcatacgaaaggcagagctgcccagtggaaatagccaaagatacataggttctaatgctatttctgacttttactagctttrtgacttgagcaagtgccttaactgaagagcaactcatttctttcacttgaaaaaataaaatacaaataacccttcccccactaatttattgtaaacgtcgaataattagcatccataaattgcctagctcaaataattcaagctcagtattatatgttagttctcttccttgtcccttcctcaccttttatgtccttcaaggaaaaggcacttttggtaactttgtcaggatatgatagcataagtaggttactgagaatgaaagagtcmgtgcttttcaagtcccctcaaaatcagaaagagaagacctcagcattcacatgtgactcacttgtcgactcacttaacaaatgatctagcactccttatttgccaaccagtagttaagcaatggggcaatcaaatcccaatggcatcatcactttctatttgcagagaggcttggagaagctaggggaagagaattgtaatctggatgaagcgggcccatgaggtaaacagggaagagtagccatctagaccatagccctgctgaaacctgtatgacactgaagcctttcctggtagtctggccattgtacatctgctcattatgggtcctggctagaggcaagatctgtagtatgtcacaggcacagcaataaggactttgctcattatttaactctgcttttcagttctggaaatatgaacatagcaccaagtagacaacttttggcgaagtcttttccttattataagcgcataaaactgtatcgattattcctataaaggagagtattgtgaacccaaaatatctgcgacaggtctcagtcaatggagaaagtttgttttgccaaggttaaggaggtgcccttgacacagcctcaggaggtcctgacaacatgtgcccaaggtggtggaggtacagcttggttttatacattttcgggagacatgagacatcaatcaatatatataagatgtacattggtttggtctggaaaagcgggataactcaaagtggggaggtggcttccatgtcataggtagataagagacattcttttgagtttctgattatcctttcactgaatacacaatttattggaatagtcacttatgtcttagtctggcttcgtgaaacaatagggcaaaggaagcaatcagatgtgcatttgtctcatttgagcagagggatgacttagttctgtctgtcctttgtccacaaggaatttccttgtgggcaaattgtgaggggggtatgtagaccttttatctttgtaactatcttatgtaggaatagaatcggaggagggtttgcccaacatggttcccagcttgacttttctctttggtttagtgattttgggggccccaagatttatttttctttctcatatgaaacaactagcaaagagattatgtaattatatctttaaaaaatctttttttctgtaatggaacaactttttcttttaatctttttaagtgaattgcaaaatgacagcatattttcagcaaagaaaaccaaatcaggatttggtatgcctgtattcatagagaaaaagaagtctttgataaaaagaattacttttaattcttctgtaatttgcaaaataaaggagaaatggctatttcatttgatttgtttctctttttgtaaaacagtgctccaatctgaaacagctgtggtgactaatgtatgtatgactgatatttactaatgatagagatttgaaagaaaaaagcagtggttattctatactgcattatttaatataattattaactttgcaattacaaagatactacagtctatagaacactaagggaagttgagtgctatgtggtcacctgctgttctttggcagtgacagttctacactgacacataaaaagcaataggaattgatgatgtattcatgaagccatcctcccttaaaatgtgtgggtcaggcttatattacatattttcacgaaaaattattttaatgttcctgaaatgcaataaaagtgatcattaataggagttatgctatgttggagttaggatgaactgtaattggttttattgaacaaatagtataaagatatttccagtgaaatgcttcaaacttcttagaacaaaatatttatatacttaaaagtattattttataaaataataaatatagttattagactattttacaatcaataaactaaaagagatcctaaaattacctttgatctgtacatattagcataatccaatgacaaccacaaaaataaaactgagtatattctatgctcagaccactgggcaaggctcttatctacctgacatcacttaatgtagtcttaaatattgagtaatcgaggatagtaaaattgcttgtgcttttggtggctttcttttaaaattttcctcacrtgattgtattataggctctcaaagagtaaaggatagaggaggacttagcattacttaaaggagataaacgtgctgctggaaaagtaaagctggacttgggagttagaaatctcagctgggctatctgcttaggtgtgtgaacatcagccagttggcttaacctatctgagctcagtttcttctttttgaaatgagggtaataatgtttacatttatatgattaaaataaggattaaagagaatgtaaataagagaaatttgtcagttaccttatatatgaaaacaaagtcaagctgttagctgaagttttccttgaacaatgagatttcagtaaaattgacctgttctagcaccaacattctgtgagatgcacaatgtcctatgtctttgctaatatgtatgcacgtgtgtataaatttttacaaaactccaggccttaggttttcatagtaatttctgactcctagttctattcattgaacttctaatcatacttagctgttacctctcacctgttatcttctctcttctctgagccatctcatatgtggtactcgatcccttatctttgatctccccctcacaaaccatcgtcacgatgtatattgccaacctgactaaaggttattgacaatatagagcaattcaaatcatgtaggataatgtgaaatttragatcatgcaaacaacaaaaaaatgggtgtaaaaatccctattctcataaatcctatggtcactctcatgctaaagatttctcaaaagtttccattaggtaaagtttttaaagccctgcagcattttcctttgcttatttagtctgttcatccaggtccacaatctccttgcttcctgttttgaatgtctcctctcatcagagtcctttaacttcctctcttgtgatactgagtatcatccaaccctggtctcatctttgcaaactgtaattctcctttattcccctggttagatccttcttacccaatcactttacatagaacttggttttattgtgtactagccaagtgatgttgggcaagtttattaatgtatccgataaaaatgtgagaaatagtcctgtgatatgtctttcctgtgagcattaattaagacaatatatgtaaggtactaagtatagtgtctggcacacggtaaacatttaataataattgttagatgtaacaaattcacaaatacagtttttccagtatgtttgcccattgtcttgccctctcagtacatttgtgcattgtatgtcaaaggaacaaaaagaattttaaagatgaagtacattgataaatttcaggattctactcctcttgattttagataaaaagataaaattcctgtaaaactctgttttataacttgttaatgtttaacttgtagtgatgttactggtattttctttttcttgagtttaaagtttttatttttatttttttaaagagtcaccttgtcttagtttgggctgttgtaacaaattaccttaggctggctggcttaaacaacaaaaatttatttcccacagttctacaggctgggaagtttaagatcaaggtgttggtagatccaatgtctcaagagggtccacttactggtttacaaatggctgtgctcttgctagtttctcacatggcygagaaaagagagtcagagagagagggagagagagagagagcaggcaagctctctcatttctttttttatagacgcatgaatcctatttatgagggctccaacctcatgccctttcaaaggccccacctccaaatactatcacattagggattagacttcaacgtatgaattttggaggacacattcagttcataccacactccattatagatcaagaccgagaatataatgaagtttttggaataatgaattcataaactaatatccatttagctttgcaaataggctaggacataaagctgtagattccaaaatgataaaagtacaaaaaagtcatgataaaacaatagcaatggtgtagctgtgaactcttgatacctgtgttgcaacaccttctgcaataaccatacattgcaagatacagagacaaattttcttactcgtttagctttggtatcagtggaataatagctactaaagtatttattgtacaactattatgaatcaagtgctttgtaggcaattcaattatgacaacagtgccatgaggtaggttactgttttacagataagaaaaccaagactcaaaaagttataaaattcgctcacgtttctatctccaaattcaaaacctgaayaatctgactacaaaacccaaaatcttcctgctgtgttttgcttagaagatggaacacaaggagtttttattatgaccagcttaataaaaagtagaaatattaaggagtaattctcattgttgagtttacacttttaacaaagatgaaaagcatattatggcttttttctctaaccaccatttctgagaaatccctgtgagtcatgcaatcccgtcctctctccattcttcccacttgtctttatttcgtgcctattgtgtgttgagcgtcagattaagcactaggatacaatgatgaacagaaatagattatgatgtagaagtggagacagacacttcccaaatattatttcagtgaaagtaaaattgcataagagaaacactaaaaatgaattactatgtagtattataagagcttaaaagggggtggcgtgggatggagagatgttcatttggtcaagagggtagaagaggatcactgaggaattggtggtttaaactgtgttctaaaagatgagtacatgctaacccagtaaatgaggaaagaacatttcagacccagagatgagcatgtataaaagtctgtcgcgatacccgagcggggggtgcatggtggcataagaaactgaaagaaactcaatgttgtacaccaaattctccatgaagcagaatctcagctgctaattggaggtgggtgtggggggtgttcctgtgtattgtaggatgtttagcagcatccctgacctctgctcactagatgctaaaggcaaatacccaacccagagttgatacaatttaaaaaagctgcaacattgcaaaatgtcctctggaaggaggcaatattgtgcctcattgagaacaagtgaggaaaaaaatggtgtaggttagggtgggaggggtgggtaaaaaccagatcatgcctggccttgtagccatgtcaagtccttttgtccttatttttaagaaagggagcaagaccagatttgtgttaaaagtatcagagtcactgcagaatagaaacagagtggagaagggtctgattggctgcaaggagaagaagaatagctagaaggagatgatttgtataggtaataactaatatttgtagggaggttctggtgcaaaggaaaaatgaacatagatatgagagatatttgggttggatataagaacctgaaggaaaaggagttgtcacagatgaatccttagttttgctcacataggtagatgatgatgccatttactgatttatggaacagatgtgaagagtgaagaccatgttgttttttagtgacttttctaaaattagggtgaaatataaaaagacatttggatttggatcagcagctccaagagagactgatagaattatttagtgagatttgaatagatactaattaaaactgtgaatgtgaaattggatgttttctctaccctgaaagaggttttagtcataaccagtcatttcccccacagcagtttcaactccttttcagactcttgctgacaggtgtaccataaacattgatgaatttgtcatatatttaaaatatttatctatcttattccaataatgaaatagacacaaatcagtacacacaaacatacttgtgcacacccacaaggtgtgaaaaataatgaagtagaaaccatcaatatcagggcattttggcctttatttccatgtaggaatttatgcaatatgtgatacctagttattataagacaaaagtactacttaaatttttcatctagagtcctgcaggccatcagtgaatcccagaaaagtgtcaaagatttccaatacccaatatacctctttaaagagtataagttattttttgccatttccccaaaagaaaatgataatatgaacaaaatcttggcaagagtaggaaagaaagacatttaaattaaaaccattattcatatagaaagtagaagtgcttcagctttttgtaaaagattggagttggcaaccggagagatggctcttacaagcataactgaaggcttcatgtctgacagcaggatctgggaggtcaagcccagaaacctagctgctttgtccaaatgtacctgcagccttttccaaatgatggcatgtgcttatccatatcccagttttccccagtgcttattctctcattttacaccttctattcacagttctctggcattccagtatcactgaccatgtcattttcaagggtaaggagtatgattgtccttgaaggtcataattattttaaatatatatactggaaatacctccacagactcaattactagtgaactgttatatctaatgactatttctacaagaatttaatcaccagaaataaatgaaacatataaaaccaactcaaaattggtaacaggaaaaaagtgatgtaaaaaatatttttaatcagaatcagataatcagaatattgtaaggcttagtgtcttatgaaaaagaaagactaagaacatttcatgcataatcaggaaaaggaggagctcaacaattctgaaaaccaagtaaggagataaatataggaactccagttgtgggagtatacttatgtgtgagcagccagaaatgacgaagtcctgtctgttacttcacttagacattgtgatcaatcagatgggatattgagagaaacaaaaatcctaccgttgcagaaaattcccttggaaatggtaaaattcactcattattctgtctttgtcatcattttaacaaaccctcactgaagcatgcttaatatattcacaatgtttttgaccagagactgaacatggtatataccaatttttgtgttatcatatcagagcatgtatggaatagttaatgatgacaccattatcatcacctgtgtgaatgatacatgggaaattgataatggtcatttatttatagtagtcatttagtcaacaactttattgggccttgtttatggtgtcacctgtatttcagagaacttatagaaaattgatatgctagaaataatgatggatattgtttttccccattttgtagcatatgtgccttttcccaatatgcacacataataagcacgttgttcaattcaacaaaaaatagagaatgtatgttctttcagatgcttagttctgaattgagcaagtcatgaaagcaatgcttaataagcacmtagtagccacaaagatatgactatgaaaatgaaaaaaaattgcagttgtattattttaaatgctaacacttttttactttttaataaaattgtatatatttaaggtgtacagcatgatattttgatatacataatgaattgattactacagtcaagtgaattaacagatctttctcttcagatagttaccattggttttcctgctgggagcacctgaaatctattctctcagaaatttttggtataaaagagtattattaattatagtcatcatgctgaaagttagatcgctagacctattcatcttatataactgcaactttgtaccctttgaccaatgttcctctatttcccccacctttctgcccctgataaccagctttctactctttggcttctatgtatttgacatttttgtatttyacatataagtggatcrtgcagtattttgctttctgtatatgtcttcattcactcagcttaatgtcctccaagttcattcatgttgttgaaaatagcagaagctcctttattaaggctaaatatttcactgtgtgtatatatatatgatatatgtacacatatatcataatttccttatatgcattcacagatacataggttgtttccatatcttggctgttgtgaataaagttgcaataaacataggggtacagaaatctcttcgcgatactgatttcaatttctttggatatataccaaaagagggattaccggatcatatggtagttctatttttaattttttgatgaacttccatattcttttccataatggctatactgatttycattcccattaacagtgtggaagggctcacttttctgctcacccttgccaacacttataatctttcattttttgtataatattcatccttacaggtgtgagatatcatctcattgtggttctgatttgcatctccctgattatcagtgtcgttgagcacctttccatacacctggtggccacttttatgcctttttgggaaaatgtctatttggttgcttatgcttttgcttttgtttgttttttatttttgctgtgagttatgtgaattccttgtatattttggatattagccccttatcagatgcctagtttgcaaatatttttctttcataggttgcattttcattttattgctcttttttatttctgtgcagaagctatttagtttgatatagttccacttgtttatttgtgctcttgtttgctgtactgtccaaaagttatttccagggtcagtgtcagggagctatctttaagcttcttgatgtaatttttggtatatttgatgttaaagccaccaagaaaatggaatattagccttttgattatgttgatggtggactaggtaatttggactaaacttctcatgaagagaactaaaatagctggaaaaaatattgcttaaaatatcaccttaaaagcatcaaaatgctaaccgaacagtgaagcgggcctgggctaagatctaggttaaaatggaaatcaggaggtagtccagtcattttggtcacttttggcctgaggtaccagataaaatacggaatgcacagttacacttgaatttcatgtaacagtgattattkttaagtattaagtatgtcccaaatattgcatgggacattctcatacttacacttatttaaggtttatcttaagtgtaaacgtaactgggcattctgtttttttaacatttagcaaccttaatctaatggcatttgcagttctggaagaagcrgttgagaggatgaacagaacttttggcaacatctcaagaatttgaagcaaaagtctaaacaaggaactgccaaagggaagatcaccacaactttgttttgttttgttttttggctgggaccttgaagaactacatgtaagaataaaagtgaagcaaaatgaaaccagactacgctgactagaaccccttttcaagtcatttgagaaatcatgaaaatttccacaccctgaacttggactaagacagtcatgtgttaataatgcccagracaccatgaaaatcccttaaatggaattatcatcccagatctgaaattatttctacaattgttatttaactaatatccaacatataatcagagagccaagtatgcagtaaaactaaattcataggaacaaaaaatagcagagaaaaaataaccaaaaagtagaagaacagggacaccagatattaacagtgtcagtgagagactgaaaaaaatgaagaaaggaggaagacaggaaggaaacaaggaagaaagaaggaagaagcctgtacttattctgttaatgagataaaaagacaaaatatggaaactgtaatttatagaaagtgatatactacatttactacattttttaaaaggaccaaatagaaatcctagaagggtaaaaatagctgaaaatgataactcagtgaatgggctaaatagaatattatatacaggtaaacagaggactgggaaataggctgcatggtattctccagaaaaaaaatgcaaagatacaaaggactggaatgcaaaagaaagagtaacagctattaaaaataggagaagttctggcatatttgccattggaatctctagaaggagaacagagagaattaggcaaaaagaactattttttttaaaaattatgactaagatttaccccacactgatagtagataatagatttaaagagtctaaaaaaatttcaaggtggataaataaaaatgtatccctattttgacatatcactgatatactgtataaagctaaatcaaagataaaatatctgtattcaggggaaaaaaggcaactacttattaacaaaaacaatgggaagctgaactatgttttataatatattcaatctgttgaaagaaaataatttccaatttatatttacatatctcaagaaaatattcttccagatggaggactaacagtttcagaaagaaaataagaaaactcaccaccaggagacaagcacaaaggaaaattgtgaagtgttttcagacagaagaaaaatgactctgtgtgggaaaaaaatgaggagtaacaaaaagtaggtaaatgagcagtgacacaataaaataataataatgttttgccaaatttaaattataacttgaataaaatatatgacgaaaatagcctataattcagcttggcaaaacataggattaactgattgaaggaccttttattgttcaaaaggagagtaaaagtattattcatcatggccgggcgcagtggctcacgcctgtaatcccagcactttgggaggctgaggcaggcggatcacgaggtcaggagattgacaccatcctggctcacaaggtgaaaccctgtctctactaaaaatacaaaaaattagccgggtgtggtggcggtcacctgtagtcccaggtactcgggaggctgaagcaggagaatggtgtgaacccaggaggcagaggttgcagtgagccaagatgggcgccactgcactccagcctgggtgacagagcaagactccgcctcaaaaaaaaaaaaaaaaaaaaaaaaaaagaaaagtattgttcatcattagatcttggtgaataattcatgttgtcacttctagggtaatcactgaaaaaaaaaaaagatatgcttcatttccaaacttactgtggaaaacaatgtacaacawtaacaatgatcaaccaaaaggaagcaaaaaataaaataaacatatatttggtaggacaaatatagagtataaagtgtatgccaacatgttaaatttgaattcagccatgccagtaattccaccaaatataaatgtattaaaaaatgagtcatatagcaaagtttgtcagactcattttttaaaagataaaaaccatactacttaaaaactatatttaaaacatgaggataaagaattttcaagataaaaggattacaaaatatataccatgcaaatattaagcatattaaataccagtatactgctagtatagagaaaatagaatttaaggcagcaaaataaatgaataaataaccaatatcagagaaaatagacttcatgcataaaaacatattaatgtcaaagaaaattgattttagtgcaaaaaaatcactcagcatatttttaaaatacttatcaactatcagagaaaatagatttttgaacagaattttttttaacaaatatcaaagaaaataggctaaacggaaaaaaaggaaaatgtgcccagagaagctatattaatatcagagaagatagacttcaaggaaaaaaataatgaggctagaaatagtcacttcataaagataaaggtttaatttttcagagatatataaaaaattttagtgcacctaaagagtcctttcaaaaagaaaaattatactccaacctctgaaataaacacatatacaaaatccctagaaaaaaatacaaaatatcggagtctagaaccattagaaaatagcagttttagttttggcatggtgatgtaagctcactagagaccatatgtctcatggatcagaactgaatatgctgacaaaatgcaaaaatgactacctgactttaattggaaaagcagaaaaagcatgtcaactttggaggagagtacagacttggagaagcaattttacagggttgattttcctgttgtgtgcatgtgtgtgtttgaaatgctctcctgtggattgctccccaaagtgggcccagttgtaaagcatcatatagatggtggtaatggtctctttggctaaaactccaatacaactctcatgtttctgtctagagaaccaaaaagaaaagctccagaaggctggagagtgaggggaaatcccagcatagagaaagtctgataagaagattccctaatcccggccaagagtggtggctcatgcctataatcccagcaccttgggargccaaggcgggtggatcaagaggtcaggagatggagaccgtcgtggctaacacgatgaaaccccgtctctcctaaaaatacaaaaaattagccgggcgtggtggcacacgcctgtaatcccagctgcttggaaggctgaggcaggagaacagcttgaacccaggaggcagaggttgcagtgagccaagatcagcgccactgcactccagcctgggcgacagagcgagactctgtctcagaaaaaaaaaaaaaaaaaaaaaaggaaaagaaaagattccctaatcccgtgaatgaacctgtacaattttcaggatcaccatgagctatgcatgtacggacagstccaaaacagtacatcaaacctactgagagctaaactgaaatttaatccctatcattctcagaaggtaaaacagaacttacaaacggaacttgagttraatgcctactaaaataaaaatatcaacattcttcagagtattacaagatccacatgttacaaagtattttatcaaacacacacaagacgtaattccaaatttgataatttataagacaatatcaaaaggaattactaatgtaacaatacaagaaacaagagagtgactggagcagaagttgaggaaayagtggtcttaaatttttttgaattgatggaagtcttaagtttatagcatcaagaagctcagcaaaccccaaacagtataaccaaagaaaaccatagacacatcataaacccctaaaactctaagatgaagaaaaaccttcaaaacagctagaggaaactgatacgtatattacttacaggaatgcagtgatttgaataagatttttctgatgagaatgtctcatcagaaaaaatgaaggtcagaagacagggaaacaacattttaaagaatagaactgtcaagccgtaattttatatccactaaaaatatcattcaggaagggaggtaaaataaaaattgagaaaaattattaccttccagatctgccccgaacattggctaacaaaaggctaaaggaaagggaatgatgccaaagtgatatctggaccttccgtcatgtcttgagaacaattggaaagggtaaatattagagtaattgcagaaaacagagttatttttctctttaaattmacttaataaagaaaaaataattatctggtggggttttcaatgtatataaaagcaataaagtataacctaaaattcaatggggcaaaaggatttataaagtagcagcatttctacgttttatattaactaatacaatattaactcttagtaaaccatgacagcttagatatgcatattgtaatctctagaacaarctgaaaaaaaaatcagagatttataagcagaaaatcaacagattaaaaaaaagtcagccagtagacagaaattacaatgagataataaaaatattcaaataatcaaaaagaaaacaaagaagtgggaatagaggaacaacaaaataataataaaacggtagatctaaaattatccacatcagtaattacagtgagtgctaatgatgtaaactagcagttggcaaactttctcttagagggccaaagagtaaatattttcatcttgcaggccatatggtgtctgtctcagctaatcacctttgcatgaaagcagtcatagaaaatatgtaaatgaatggtcacggttgtgtccaatttaaaacgatttttgctaaattaggtggctggcctgggagcctattttgcatatcccttgcctaagcattccaattaaaggatagagaatgccaaagtggataaaataaaataagattttactctaagctacttcaagtataaagatacagatctataaagacagactgaaggtaagtaaaaagaaaatgatatatcatggaatctgtaaacataaaaagaattgaggggatagtttatcagttaaagtagacttcaagacaatgtgtataatgagagattgtaaaaattttatcatgataaaataggcattcatcaggaagacataacatttataaaggtatatgtgcctgataataggcctcaatttatggagcataaattgatagaatttaagagatagacaatttcataattgtagtaaatttaacacctctacgtcagcaataaatagaacatttagacaaaaatcaatgaagacattaaagatacgtctttatcttattagtataatagagtagtatatgcaactggaaaatatacattcttgcacatgtgcatagtgcataaaccaaattagatcctatgccaggccataaataagtctcaataaattaaaaaagaatcatacgaggtgtgcactctgaccacaacataattaaagtagaaatcaaagtagatatctaagaaaacacccaatatctataaattaaacagcacacttctaaataattcatgaattaaaacaaaattacaagataattagaaaatgttttaaactgaatgacatggaaaatataaaatattacaatttgtaggaaaagctaaggtaatgcttagcagcaaattcatagctttaaatgcttatataagaaaaggagaacaatctaaaactaaagtcctaagatttcaccttaacaaggtgaaagtaagttagcaagtaagcaggtaaaagaaaacagtgaagacaaaagtagaaatcaatgaaatagaaaacagatgagaaagggaacagctcactttgaagagaccaacaaaactgacaaaattctaactattcagatcaataataaaaacgataatcaatatcagaaatagaaaaggggttattacaaaaaatctcatagtggtgatgatttcactggttaattcaattagacattcaaagaagaaaggcggccgggcgtggtggctcacgcctgtaatcccagcactttggtggagacagaggcgggcagatcacgaggtcaggagatgcagagcatcctggctaacaaggtgaaaccctatctctactaaaaaatacaaaaaattagctgggcgtggtggcgggygcctgtactgtagtcccacctacttgggaggctgaggtaggagaatggcgtcaacccgggaaccggagcttgcagtgagcggagattgcgccactgtgctccaggctgggcaacagagcaagactccgtctcaaaaaaaaaaaaaaaaaaaaaaaaatggagaaaggcaagtcatattttaagccagaataattttaatagcaaaacctttccattataaaaattacagagaaatattcttcgtgaatatgaatgcaaaaaaatccttaataaatattagcaaaaaaatccaatagtatataaaaggataatatgttatgaccaactagaaacatttaaaaatgtattataagaaagatatatatttttcaggaagtgcaaagttgctgtaagactcaaaaatcaattgttgtaattgatttttaattgatttaattaaacatatgaatttacaaaatactaaaatattggatgatcacttgaatacatgcagaaaaatatctgacaaaatcagaattttagccaattaggaatcaatggaaaatgttcacagctgataaatgacatctgacaaaaaaatctataacatctaatggaataatgatacttgaaagctttcctttggaattggaaataaaataaagatgtttacaatcacacttttctattgtcctagagattctaattgaggatgaaatatgagaaaaagaacagaaagaggaagaattggaaataatttaatgtagagaaaatacaatgcaaagacaaattataatacttaataagtgagttagccagtttctggatacagtgtcagtattttaaaaaatcaattgcaattctatgtactagaaaaaagatataagcaatgaagttttataaaatataatatattcaataatatcaaaaatatcaaatacagccaggcacggtgtctcacacctgtaatcccagcactttgggaggccgaggtggacggatcacctgaggttcggagtttgagaccagcctgaccaacatggagaaaccccatctctactaaaaatacaaaatgggagccggacatggtggcacatgcctgtaatcccaactactggggaggctgaggcaggagaatcacttgaacctaggaggtggaggttgtggtgagccaagattgcaccattgcactccagcctgagcaacaagagtgaaactccatcttaaaaaaaaaaaaaaatcagatactaagaaatgatgtaacaaaaagttatgcaagacctgtatgcagaaaaccaaaaatcataattgaaagaaacatgtgtgaagaccgaaatctatatctgtatttctcaatctaactatggtcatgtttatggattgtaagaccaaatattttaaagcttgcaaataaccttaggctgacctataaatttaatgcaataccaaccaaaatctttaaaatatttatttatgaacttcacaaattaataagaagtttcatatagaaaaatcaggctgggtgcagtggctcatgcctgtaatcccagcactttgggaggccgaggagggtggattacgaggtcaggagatcgagaccatcctggctaacatggtgaaaccccgtctctactaaaaatacaaaaaattaactgggcgtggtggcgggcgcctgtagtcccagctacttgggaggctgaggcaggagaatggcatcaacccgggaggtggagcttgcagtgagccaagaatgggccactggactccagcctgggcaacagagcagactctatctcaaaaaaaaaaaaaaaaaaaaaaaaaaagaaagaaaaatcaaaggaacaagaataagttatatactcatttaaaagattaggttaatcattagtgctgtctatccaatattttattttctcctcttggttgaggtsatgagtggtcgtgtgacgtgttttgttaatgaaatgtgaaagtgacatttgtgactcctggctagaagatttaagagccaatwaataattcaccacactctatctacttccttctgctaaggtaattagcaatatgtgcaagagagtagctgttcaatcagtgtgggctccagaattagragaaatcaagtatattctccagacaacccaaaatggacaactagagagagcaagaaaaacaaaacaaaaagctctgttgttataagtcactgcaatttaaaattctttgttattgcagtataatctactctgacagaaacaaagtgtaacatggaaggaattactccatgggacatatcaagtctgataaaaataaagtaattaagaccatgactatggtttggctgtgtccccacccaaaatctcatgttgaattgtaatccccatgatccccataatttccacgtgtcaagagtgggaccaggtagaggtaattgtatcatgagggtggcttcccccatgctgtcctcatgatagtgagtgatttcacaagatctgatggttttataagcatctggcatttcccctgctttcacttactcacatctaccgcctgatgccttgtgaagaaggtgccttgcttccccttcaccttccaccatatttgtaagtttctcgaggcttccccaaccatgctaaactgtgagtcaattaaacctctttcctttataaattacccagtcttgggcagttatttataccagtatgaaaacagactgatccaaccatgttgtactgaatcaaggataaacaaatggaataaaaatacagaaatatacatttattattatgattattatgatgatgatttgatgctacaaaagtggggaaaatatattcttttcagtaaatgatgctgtgacaattacatgcatgtgaaagtaaatgaaatttgagttctccctcatatctttcatgtaaaccaattccatgtggattagtaacttaaaagtgaaagcaaaaacatatgtttttagaagatagtgtagaatatcttcataagcttgggatatgaaaaagttttaataggaaataagagtagtaaacataaaaataaacaggagataattatactgcatgaaaactaaggacctgtgtttatcaaaatacatccataagagagtgaaagtataagccttcacatggaaaaatatatttgcaaaatacttaactgacaatgagtttatatccagaagataaatatattatatttaaatatataatatataatgtacatacataattttatgtagataaaacatacgtatatgtttgtagatatagwtatataaaatatacaaagacagaagctaaccacttgggaatgggcaagtgacttaaatatactaataacaaatgacaaaacccaaatatctaatgaacatatagaaaacagaataatctctttagttattggtaactccgaataaaaaacacaactgtattctctccagaatggctataatttaaaagattgacaataccaagtggtgaagatgtgaaatatcaaaaatactcatatgttgctgggagactacatcagtatggacaccttagaaacatgtttagcattgtcttctgaaatgaaaagttaatacactctgtgacccaaccattccactcccagacacataatctgaagacattgatgcatataggaatgagaaaatattaatagcagcattaattgtaatttcctagaagcaatccaaatgtttgacagtagaatggatttgtgttatatttatataatgaaaaaaggaacaacaaaataaatgatttataggtacatatagcaatctggatgaatctcacaagtgtaatattgactaaaataagcaagaaataaagctgctgtttttgtaaatttcagaaagaaataaaattatactgtttagaaagggacrtttatgcagtaacattaaaaagaaaaattagcatataagggtgtgtaatttatgataatattcttttccacaacttgggtattggttataattatttgtaaagctatacattctgttttatagacttttaatttttgttttatttaaccatatgaaagcttaaaagaagataaaatatcctacccgttcaactttagtattccttctgcatatttaagattcatacataagtgtattttgttaagtcactgtgagagagttctactatagggtgattaattacaggaacaacagtcctcatctttcatgatttctaactagaagataatggtttgttacataaatcttttcccaaaccagtagaagaacagagaacaccgttggtttatttggtcctagacacatttaaaataatgaaaagtacacaatatgcattatcttttccatgaaatgcaagaaagttcttagtattatttaacaacacaatctgtaatattttacaaagctttcttctgatagcttttgtttactagagtgtgggcttaagataaaagcaaaacaaaacacaattatcctatagatataaattgagtgctgacttcatttttcctgaggtggtaacttatttgctcaaatggtacgactagatggtcatacaagtttaaggcacagaataatcaagagatttattaatttgaacctaggatatattactaaaaacacagaaatttcttatattttctgttaaagcartctcagtccacatttattaaaatactcatctagcttggtttttgggctatatcctcatcaaacgatggtaataggaaatgaaccaaagtgacatctgtagtctcagcaacttaaagtytgcttgcaatgattagttttcctttcccaaccctctgaaataaggtcttctcaagctttaggatgygttcaacattaagtcttcagttaagacatcttgcctatattggaagagaagggattttataggttaataggctgcatggtataaggtgggaaagggtaatttactaggaggctaatacatttactgggaaattggccatcctgtatctgtcatagttagcagattaaaatatttaatgccaaaggggacataatagccaatgaagccttgagtcacattactgtgtgaagtaaattctaaaatactattcaatcttctgcattaacttgtttcaaaggctgaagcagtaaataaaattactaatggagctggcagatagataggtcatccatttagctcaaaaggagatagaataaaataaagaaaaatgctgaagaacaaatatatatatatatatatatatatatatatatatatatatayacacatctcaagaaggattagctaaattcagaaaaagcataatttagcaattttaatacattcacctatttcaccatatacagtgggagaagaaactttaaaaaattaactcacaatggtgaattggatgttgttacaagctattcacagctttccttataattgaaataagattcagagatgaacagaggttctaataggaaagattttgaatcagctctaagagagcttcattttttctactatctttagaaatgtaattcattaaaaaatacaaaaattttaaagtagaaatttcttgtaatttctctaccagaaatcatgatgaataatatttggtgtataacctttcagcttcttctgtgtaggtagttgtctctataaaatgtatcacatatatttttaatttatttttttcttcacttaaaataacttaaacccctttccatgttattaaatattgtttaatgtaatttttcatggctgcatagcattttattaaaaacctgcattctgggcgggtgcagtagctcacgcctgtaatcccagcactttgggaggctgaggtgggtggatcacgaggtcaggagtttgagaccagcctggccaagatggtgaaacctgtctcttctaaaaatacaaaaattagccgggctcagtggcagagacctgtaatcccagctactcgggaggctgagacaggagaattgcttgaacctgggaggcagggattgattgcagtgagccgagattgcgccattgaactctagcctgggcagcacagcaagaaaaaacaaacaaacaaacaaaattctgcactctaayttacttagtggatatacattttggtaatttactatatrgtgtttatttattaaaaaatactgtagcctttttaagctaaatttcaatgtttaccttagttatttcattagaatacatttctaaaagtagaatttctattttaaagtctgcaaatttcaagttttattttatttttttaatgtatatatttttattatactttaagttctagggtacatgtgcacaacgtgcaggcttgttacatatgtatacatgtgccatgttggtgtgctgcacmcattaactcatcatttacattaggtatatctcctaatgctatccctcccccctcccccaaccccacaacaggccctgatgtgtgatgttccccttcctgtgtccaagtgttctcattgttcaattcccacctatgagtgagaacatgcggtgtttggttttttgtccttgtgatagtttgctgagaatgatggtttccagcttcatccatgtccatacaaaggacatgaactcatcatttttatggctgcattgtattccatggtgtatatgtgccacattttcttaatccagtctatcattgttggacatttgggttggttccaagtctttgctattgtgagtagtgccacaataaacatatgtgtggatgcgtctttacagcagcatgatttatattcctttgggtatatacccagtaatgggatggctgggtcaaatggtatttctagttctagacccctgaggaatcgccacactgtcttccacaatggttgaactagtttacagtcccaccaacagtgtaaaagtgttcctatttctccacatcctctccagcacctgttgtttcctgattttttaatgattgccattctaactggtgtgagatggtatctcattgtggttttgatttgcatttctctcatggccagtgatgatgagcattttttcatgtgtcttttggctgcataaatgtcttcttttgagaagtgtctgttcatgtcctttgcccattttttgatggggttgtttgtttttttcttgtaaatttgtttgagctctttgtggattctggatattagctctttgtcagataagcagattgcaaaaattttctcccattttgtaggttgcctgttcactctgatggtagtttcttttgctgtgcaaaagctctttagtttatgcaaatttcaagttttaaatacgcattgcaaaaacactttacagacatatggaagtttcttaaattagtctttaacagctatttaatagtataaatctcttacgtgttgtaaagttagaatccactgagtagtaaggggaagaatgaggagacttctctcttggggtaagtgcatgtttcacaatctaagagtttatctattagaaaaaataaattttgactttgtagaatgtcaagaccagaccactttcaagttttagtatcatacaatatctaaagaaacatgcattatagagaaaagcttggatgatttctgtagaacattttacctaacaatacattaaaatcctttaatagattagtaaaggaattggtgagaaatgcattcaatataggaactttacttcttatactgagaaagattttaatcatatatggaagtagctcagatgaagggaagmaatggaaggctaatcaggactttacttgacagaaaaaaaattgttgagtttctaatacacgaatattcttgcaaatgatccagaagagaaagtgcagaatgaaaacaccagggagatgccaaattgatgtaattaaatttgaggaagtatttagagctctggaagactgagcagaaatgaaacaagtcagattcctttggtataaatacaatgttggcttaagagaaaataattgaagccacacctatacaatgatgagatttgaacaggggataacaatarggaggcacctgagcatccctgtagattctccattgaaatcaccaaattgatgcagacaaatgggctaaaatagttgattattattaacaggtttttttctttttgagagaaaaaaactcaaagcaggttatcagattccgcaaatattccatgtagatctgattgctatactttgactttttttawagtggatatggaaaagacytacgtaaagttaaggaatataatgagttggaagaattcacacatgaagaccatcccttttaaaagataaagcctgagagggaataacatctaatttcatacagtcttgaaagctctgtaaaaggtagatacaggcttatcaattcatggactagaacttggaatgcagcggttcttttgtcagccctcacctagacccaaccctggctctcccaaatttctgataaccttaaactaggtgcctggctctgtactagaaaggaagaaaggaagaaaggaagaaagggagaaaggaagagaaagaggaagggaagggaagggaggggaggggaggggacctaaagatactgctttttatgctcacgtttatggcagtttacatgaaaaaacggctcaactttatttctgcacttcaggacatccaggctaagagctttcagtttttgactcattacagaaactgttttgtttcttttctgtccaagatagcagatacatgtggcaagtctctctcaatcagtggccaagtggtcctcctgtactgtccctcagtttctgctcatctcacagataaccatctaactttctgagaagttaactcgtctaaactagaaacttccaaagtgaatttcatgtacaacaaattgcctgtatttcaagtgagactgttccagctatctagtcattttgttgggatgctatttttcatagacagagaattagtttttctacatagatacctcatatttaagtactttctataaaatgtcctgccatcctaaatagattatatattctatttcagggatcatggcttgtacttatattcccaatgtttataacagtaaggatgtaatacctcttcttattattgttatttatgatgataatgtttggtgataacaaacaaaagaaggtcagctttctaagatagacagaaaatgagttaatccattttctgagttagggagggaagacaacatttaataaacattgaccaggactattataggtattttacctaagtaattttatccctttaaggtagtacttttaaatatttaatgtgcctatgaataacctggggttcttctataatgcaggctctgattcagtaggtctggggtagaacctgagattctgcatgtctaacaagctcccaggtgatgctgatgttttttgtaaaggaaaaaatttaaaatctcaggaaccctaaacttcttatgcaaaaaggagaatgaagcctgtcctgccacaccctcttccaaatgaatagctgtcactaacattattctttagccagatccccatgggaaggtaaaaggcctcaagcatctaaaaggactgtccctatagatcattcaaaagtaaaatttttgctggcctctcatataaacaagggaatgccaattgtaacttcagggctacaatgtaagtctagctcttaaaactaaagtctgttggatttcacactgataaagaccagtatgagcttatcttcccaggtgcagaacaatgtcaagactcattcctccacctacccagagacatctgcataatttcttcttcctttactctctttttctcttcaaacattcatttatcttatgtaaatgtagatttactgggcactaacccaagtctcatgggaatgtagccatttgccttcctgctcacctgcccctctttctacctgccctctcccacttcaaggaaatttataaatacccacataaagcctctttggaaaaacaaaagtgtctgtggctcctatttttccggatgtacactatagctggctaataaaccttgatgattgagactcatttccaatgtcgtattagtcagcagatgacactttgarcaacaaggttttaaacaactctatgagtaatataattatgacaataacagcaatgatgacaacaatagtcatttaacatacaccatattacttgaacggaagttctacaggttaggtaagatagatggtaatgtgtgaacaaatgatactgataagttagaaaatcataaaataataaagctagggaaaattttttaaaaacaccattatgaaaatcagttaaacctgatacattaactgtctctaaaaatgctccttttctgttcagtgaatctctagctaggatagaatttgtttacaataagacagtattgtgacagaagacatttatcttttctttaaatccacagcagttcctatcaacagactacttaaaatcagcagtttttctcatgctttcaatggttagtctatctaacagcatatgtaagwgaccttttgataattatttaaaaggttcgtcagtaaagtctcaaatgcctgattcaggagagtcacgtatctatctgctctggaagcactcaagctgaactgtcagaaaggcaagcactttctttttggttatgtttgttgcaacgctgctctatttttaaatttgccacaggaaggacttctcaagttcaaattccatagatccaaagtcactaaatataccagcacctaacagcagatttacaagcactaacctctggaaatatatcttccccagaaaaagcaagtctgcctttgctgagtccaagaaaaccaattacccgaaagactctgaaaccaccacctgaaaatgctagaatagaggcytctgttgatttttatgacaaaaatatttttttgatcactagccgaacatcacccttatctgctctcctgtgcacatcaattaaatgaagagggagggaaaaaggaaaataaaaaattgtgttattaaagagtagccagtgaggaactggttgttttcaggcaatgaggccatagtgtcttagaaaacccttaagcagacagtccctgagaaasagtgtgttatccaatgttaagaaaatatctatgattgattctttactacttcatgatagggaagttatgccatgtagtgatggtgtggagggtgtttttggaagataactttgtgatatgctctgaggaatgacagatcttttatcctttcaatatagtaaaagttcttaaagaaaaacctgggaactatggagatctttttttttctgctttgaggagaatattaacccatttttgctgattttagtaacttcacagagaagtttttwaaaaaawttcatatggatgggggtctcactatattgcccaggctggtctcaaatcctggtctcaagtgatcctccagccttggcttcccaaagtattaaggctgtaggggtgagcactgcacctggctaagactccattcttaaagcattgtgaatgttttcattgttataatttatttataacaatataaaatataaattaaaaataaaattataacaatttatttataattattataaatamatttataatttaataaataaataattccctttccttgagtgacaagggaaatggttgaggtcatacaagtttgcyttgagtttatctcacataaacatcgataaactaagaaaagtctaatttcaatggaggattttccaaggttaatgaatgaagtcacctcatggactgggttctgtgtaatcacccatcttgtgtttgtattcaaacatattgaaccttgaatgtgagtgaactctatgccctctgacataaagatgtggtctggtctttgtgactgtaattgcaatcctgaccattagtttctatgacttgtttaagttaataatcagtttttgtgcaggagctgattgccaccttttcttttatgctgcaaacttgtttttataactatttgtcaaactgaagaaaccactcgagttatttggaaagaggacagaaaaaattctgccatatacaactaaatgagccacccatagttatatattttatgtaagtctttttttttttcagtaaaaactgtgtttgacagaaaatgctttgcttctaatttaacctcggactttttatgctatttcacagttgacccagaagagtgaagcttattttcaccgcataaatgtcactttaaacattttaggatacataaaattccttcctatatacccagttgtataatagaagagagagagtttgacagagagaaagagagaggtacaaagaactacagtgtataatttagtgcaacgctcaatgaagaataagtacctatgaaataaacttaggttcaattacaaataatctactctatcatccatttttttctcatcatgttactttcaggctactgttgtaggttttctacctttaacttctctgttaaaggcattagtatctgcataagtaccaaaatttaggaacscctatttctttgtcttatttgactagtcttcagtatttgrtcctattgaccatgatcttcttgttgagattattactactctgagcatttccttttggatgcatttctttatttgtctacattcatgaatactggaattactttttttttttttttttgagacagagtcttgctctgttgaccaggctggagtgcagtggcgtgatctcggctcattgcaatctctgcctccggggttcaagcgactcccctgcctctgcttcctgagtagctgggattacaggtgcacaccaccatgcctagctactttttgcatttttagtatagatggagtttygccatgttggccaggctggtctcgaactcttgacctgaggtgatctgcccaccttgacctcccaaagtgctgggtttacaggtgtgagccacaaggattaccttttttaatttctctctctctgtctctctctgtctctgtctctctctctctctctctctctctctcatgtcgtttcacctcctggtactgaatccatcaccctgtttcaacaacaatctatagctctctatgtcaatgactctaaaaatctatttttcttccccagattttgtttctgatatctgtgtatctcaacatagatttgctgcaatattttaatttcatcatgtctataactcaactaataattttgctcacccaaaccatatattttrtgttctttattttcatcactgaaataatcattaattaaatcatcaagccataaatttgagactgtccttgattccttcataattcttatctctcacattcaactggtcatgattctatgaattctacatgttaattatccctcaaatcctgctttcacagctgctgtagcctcagctgactatggagaaatacagacttctccctccccatccctcaccacagggttgaaaatgagactagaaaattgaaggcagctatagtgtctgatatgttagaagactcagtcatcatggaaattatgcttggcctgcattatggagtgcatccagttcttcctaatccattacatagaatgacattagctcttcaaatagamcctgccagatgctaaaagccattgtaggtttgtcacctatatttccccggagataattccttcttattcatagctttgtgtcctactactcaatctaatttacatagtccaactcccaggaaacagtagtaccttattcctggttctatacatagcccattgaattaaagtctgtaattaagaaccatagccgtatttatctcttacacggcatgttacagctcaacctgccctgaacaaaayaaataacactttaaattacaaattgcagatctgtgctcaacaaagaggagctcttttccagtgtatattattgattatgttttccttgggtaatttttgtctatcaactaactcattttgtaactggtaattcagggttttttttttcccccttaagaagtaaactcacaaagtgagtctgactgaatgtaggccataggttctttaatatgtaattattacaataagtagtgcatcactgcagtactttgcatgcgccagtgaatatgcatcagcaattaaggactccaggtcctggagaatgaaataaacattagcaatttttgcaatctgttgaggccaagaagaattctccaatagagtagtaaattttaaatggaaatgtttgtaattatttaatgagaaaacatgcttttttttccatttccagaatggaaaakatgttctttccaaactttaatacttcataactttagaaaataaataatttaattttaatatagtaattcatgaagttcgtatagttaatttatgttttctaatcactcccaatgatctttgctattcagtaaatactataatttattaaattattataaatgatataatttactgaataattttatatattaccaatttgactgattaaaataaaaagatacaaagattgggttgcccaaactatagacaaagcttctaatttaagaaagacattattctattctcagggaattttatttctcttttatatatataaacataaatgtatgatttatagatacatatgataaaaatcatatatatacatatatatatatgatttttataaaatcctatcctagttgggaaaatccaatattctcttttaatagtagcatctgactatttttattatactctatttttaatctaccacctatactggtaataaagaactttgtttcaggtyaatttaaatagattatagagcttttcttaccttaaatgtgtggtaaaattgctacagtatttctaaatggcctttccagcttgaattcattcttattttcctgttctgacctctagctaaycaagtaatataattaaaatctgaagaaatagcaaaatggtcagtttttgagcataacagttccatgggggaaatcacactttaatgtttaccttttgctaactcgagactcactagagttgagcacaggatggatcaacaaggaaagcctggtgattcacttggaataatctttagaatagcttaatatggatatttgatgaacactttgctgttgaatatgcactttagtagtggccctattttttgtgactgcagagttataaataaaataaaatgataygtacattaaaaaattttttaactcttttgtaaggatggggtcttgctatgttgcccaggctggtcttgaactcctgtcctcaagccatttttccacctggacctcccaaagcactaggattataggcgtgaacctccatacctgaccatatagacatattttcatcaccatagctactggtataagagttcgctgtagggatagacttgatcacttgggaaaagcctttaataaatttgtaggcttgcaaagtagaaggagccttagactggagccctggttacatgggaagagggattctatttggcactttccacgtaccctgggraaataacataaagacattaagaycactgcttttttataacaatggaaagtagagattagtcattcatcagatgatcactctaatgaacatctcgttaatgagaagagatagtgagatcaatactcaccctagatggaacctgacctggatttgataaagtttgagatattgagataaatacccacgacaatccaggaacctgacctagatttgatatatttgaggtagtgtgataaatgctcaaccgtgacaatctaggaaactgacctagatttaataaagttttcrtgagaaaataatgctttaggtgagccctgctggataaattggagttasctaacaagaggtaaatccctacagaaagaaaagcatagacaaatgcccctagacaaagaagagtggaaatcgaggggtgctgataggaaataatgctagagaaataaacaggggccaaatatttcagggccttaggctaaattaagtactttgactttgatcctatgataaaagaggaggcaggaattttgtgaaattagtaatttggaaatatcactttgtagagagtggctaggaacagaactaaagctacctcagttgtcactgagagataatgatcgtgtagagtggggttgtggcagtggacatagtatcttggaggtcaaaatactaggtcaaggatattaataaaatttctaggaacccatcagaaggagagagaaggagaccatgcaagagcatgaacaatgagagaggaatgagaaaaagaagtcaaccctaactatttcgaccctatttgtaccttgtactcatattttcttaacatgcccttgcaactcagggaaaacattgcttacatagatttcatatacgtgttgtcctttattgaatatttatgcgtgacttttctcccttagaacacttaaagtgaaatattttctgagtttctcctgtcttatgctctctaacttagataaatggtagacacagagcaaaaatcctttgacaattaagaaagttaaatttcttaatgttatgtgaactcttcttagtgctaaaaccaaagctgaatccaagtctacaaagaatatgtctaatcccaagctgtcaggcatttcaaatacatgcctttttttttttttctttttgagacggagtctcgctctgtcacccaggctggagtacagtggcgcgatctcagctcactgcaagctccgcctcccaggttcatgccattctcctgcctcagcctccccagtagctgggacttcaggcacctaccaccacgcccggctaattttttgtatttttagtagagacggggtttcaccatgttagccaggatggtctcgatctcctgaccttgtgatccacctccctcagcctcctaaaaggctgggattacaggtgtgagccactgcgccaggccttgttttttctttttaacttttgccaacctcttattatatgaaacacactttggcaattaatgaatagcttacattttgactttatgtctatatgaaattggatggtacattaaagagaaactttgtagatgtttctgacataaaagtcctttaaaaaaaggagatttggcaaaaatattaaattcattttaaatttctccatttgaactgaaatgatttgggagatagtaccaatttttttccactccaaattctaaacttattaaatctctgagtagcaaattataatggatcaaaaaatctctgttgcctatatttattttttcatcattgccagttaaagtatttttattactttaaactgtaatatgtgttattggtatcagatagttttaaggcaatttttctcttattttagttttatgttacaggaaaaccctaaaaaattgtgtgtagattcaatttttcttatttatatttatttaactcagacttaaaaaaattggaatattaaaatgattgttgagttcaacaaaattgtaaattctgtgtgtatatatatttgtgtatagtattcttttaaatccctaaagcattcttgtattttattttcaaattatctttatagaagcaatcatttgtaaattagttgggcatggtggcaagtgcctgtcatccaagctactcaggaggctgagccaggagcattgcttgaatttttggggctgcaccactgctctctagtctgggcaacagagcaagcctccatctcacaaaaacaaacaaacaaacgaacaaaccataatctaatttaattctaccaacaacctttgtaacaagcattttaatgatcattacagattaggaaattgaggctcagagagtaagcaatttgtctaaaaccacacaaarctaagtaatggagctggattaaaatgggagtcctcactccaaattctatttttattagtctacaaaccctacgtattggtgattttgttttatcatcacaagcaatgcattttatattcttttcctcttttacttatttaatttggaaggttgtccaatcttaatatttagtgtaaaagacagtaaaataaatgttttgattttcatgtggaattattgccttttacagacctcccgggagcattatttttcccacttattacattttccataaccgaaatagtcctaggttgaacttttcctcttcagcagtatgttttatgagatacgaaaatttatactggcatatactttcacagaaagctctatcctcccagaaataaactttgtccccttctcctcttaaaaaatacttttaacccctagaataggatagcttggtttcttatacgtttatccaaggcaaatgagagtcttgtgagaagtttccgtgtgagtgatcccatcatgcagggatcatcccttcatggagtaagaagattacaaaaaaggttgtgaggccaaagttgaatgcagtttcattaattgtaaacctggagtccatggcaggttaggtctcctcagcaccacaccctcccctactctgaaatgcttttatcatttaacataaagttctgacatggagattcatggtgggaagtattacatgccgtaatttgaagtgtaaaggtaatttgccatagatgaagtatagtatgagagcaggtaaaatagaaaaagttatcaaaataaagaaatgtggaaaaactacgtagaaagtgagaaatatttggtagtagtagaacatcatttaagcaactgagaaaaggatgaacagagttagagcattgaatttgatgccattactccagttgctagaattctgaaattatgatgatgttaccaatttaagtggwtgttacawaaattcacctcacatacaaccttagatgtattcgaggcatcatatatctagttattttaattttctctacttgccgtgccactgaggtaatcagacctatagatactacatataaatcatctttttaatccacaaagtgcttttgttatattaagtaaaatttttaagattatttgtatcaatgccaatattgaactatctctgggaaaaattaaattacgtagatttattttcaccttttaagtaattgtttttagaaatctttcaagagaagtatatacatcagcattaaatcaaatgttaaaatctgaagaacctctaaggcatgagctaattcaaaccctgtctccacaccccacctcagtgtatgcatrcmtgtatttctgtgaaaataggtcctggagaggtaatatgactttttttatgggcataaaatcagtttaaagcaaagtgaaactttaacttgagcctcttggcttccaatctagagtttcttctataattttgggcaagttatttcatctctttgtgcctccattgtcttgtcagcacattggagatactgataagakctttctcaggggatgaaaaacaatacaaatcaagtaattagaaacatgcccggcacattgcaggtcctcagtaatgttatttttataactcctacactattcttccatttttacacatatagtaaaagcaaaataacttttttgaagaaaaccactgtcacatcaaaaggaaggtgaagggaaagaagtcatttttctctgtaaagaataaaaatattgcagttgaatatgtgttcattttatcatttcagaagataggtttttttattaaaaaaaaaaaaaaaaaacaaaaaaacactgtttggctgggctcggtggctcacgcctgtaatcccagcactttgsgaggccaaggcgggtggatcacctgaggtcaggaattcaacaccagcctgcccaacatggtgaaaccccatatctactaaaaatacaaacaaaattagccgggcactgtggcacacatctgtaatctcagctactcaggaggctgaggcaggagaattgcttgaatctgggaggtggaggttgcagtgagccaagatcgcaccattgcattctagtctgcttgataagagcaaaaactctgtctcaaaaaaattataataaataaataatacattgattgtgataggccaggctgtgtggagcctaaagtatacagagttttgagggccttaagaaaaagtgaatatttatttagaaaacaaaaaccaactagatactaattttaaaatgctgtcaaatatcaaaatatagcaaaatccagaaaaataatacatttgtataaatgatgtgtcagatacaccctcataaaacttttttcttttctttttttctgtctttcactgcacactcttgatcacctctaaaatgacaacaagttattttgtaatgtcactttctatgtagaaactgagaagataattcagtctttgttttagcatagtttgtttggggggtgtttcagaaaggagagcacatataattaggacaggcaaagtctctattggttctatcatgatccgatgtcaataccacaagtwtgaaggtggtaaaaaatatagggaagtgactgtaaaacacctgaaattacccactaaacacaaactaaatgtatcctcaactcaacttccccttagctggatcccaaaactatttgtggcaggttttactagaataaatgacaatgtgaacacatttctagagtctcttatgggtcttagaaggcgtctgtacaaatgagatgcctgtaaatacaagcttctaatacctagagggacacaaagaaaatcttgagacagtctgaaaatcctaaatattctgaacgtagtttagatgttcaagggtttcccaaggtaaatgagtttagaatgtagtaaaagttgtctatctgatttaatagaaaaatatgaggaagcttagcctgaagcatgttgaggtcttggccatatataccagtaaaaatggggagaagcctaaagaagatagaatgggaccagctgaagctaactaaactggctttggtctggggtgtcagacaacctaatgcacagggtctaacaggagctaatttggacaggcctctatgaggaaagagaaatgaggatcaaacacagcccttatgagcgagcgtgggcagggaatgtccttggaataacagaagccccatttaaaaggaggctggtgagtgctttcagcagttccttggagttstgtgtactcctcctataacctcaatcaatccaattaattcctttctttttacttgcctgacaaaatccaactttaaacgaataaaaaaacttatatatttttttggtggtatccaaattgagaaggaagaaataaaattatcactgttcagtgatgacatactcttatatttagaaaatcctgaagattatacacacacaaatcttaaaactaataacagaattcagtagaatacaaaatcaacacacaaaaatcagtgtgtctttgtatacgaacaatgaacaatctgaaaagggaattgagaaaacaatttcacttaataatagcatcatacgaaatgaaatgcctaggaataagcttaacgaaagaggtgaaagacttttacctgaatgtcttttcctttgtagtttttgctgaaaactacaaaatattgctgaaagaaattaaagaagacataaaaaacagaaaagacatcatatgttcatggattataaaatttaatattatgaagatgataatactaaccaaagcaatgtaccagttcaatgtaatccctatcaaaataccaacaatgtattttgcacatatagaaaaaaacacatcctcaatttcatatggaatctcaagggaccttgagtagccaaaataatcttgaaaaataagaacaaatttggaggcctcacactttctaatttcaaaattcattacaaactgcaataatcaaatcagtgtgatacagacatatagatcaatggcatagaaaagatatcccagaaataaacccttgcatttacagtcaaatgatttttgacaaggctgcccagataattctatgggtaaaggatagtcttttcaacaattggtgctgggaaaacaagtacatggcaacgaatgaagtttgccccaccttgtgccatatacaaaacttaactcaaaatgaatcaaagacttaaacatagtgactaaaaatatagaactcttagaagaaaacatagagtgacacttcrtgacatcagatttggcaatgtgcatatgacaccaaaagcacaaaaaatggaaaaaaaaattggacttcatcaaaatttaaaacttctgtatatcagaggacattagcaagagagggaagaggcaacccaaagagtgggagaaaatatttacaaatcatatatatgatcagagattaataaccagaatatgtaaaggactcctaaaagtcaacaagaaaaaacaatttaaaaatgggcaaaatacttgaatagacatttctccaaagaagataaacagttcgtcaataagcacatgaaaagatgttcagcatcattaatcattagggaaatgcaaacataacctcaatgagatgccacttcacacccattaggatggttgggattaaaagaaaaaacaaaagagaaaataagttttggccaggatatgaaaaaataggaactcttgggcattgcagatatgaatacaaaatggtgcaacttctgtggaaaacaatgtggccatttcataaattaaatttagaattgtcagtcttcgcacagtggctcacgcctggaatcccagcactttgggaggctgaggccagtagatcacctgagctcaggagttctagaccagcctgggcaacatgacgaaaccttgtctctatcaaaaatacaaaaaattatctgggtgtggtggtgcgcatttgtggtcccagctacttgggaggctgaggtgggaggatcgcttgagcctgagaggtggaagttgctgtgagctgagattgagccgctacactccagcataggtgacagagtgagacccctttttaaaaaaattgtcatataatccagcaattccatttctgggcatataccccaaataattgcaagccaagacttgagcaggcatttgtacaacaatggtcataacagcattattcacaacagccaaaatatggaaacaacccaatgtccactgacagatgaatgggtgagcaaaacatagtatgtacatactgtagaatattatttaatcttgaaaagtaatgaaattctgatgcatactacaacttgaataaaccttgaaaatattatgttaagggaaataagccagacacaaaagaacaaatgttgtataattccacttatacgaagtatctagaatagtcaacaaaagaggtagaaagtataatagagcttactaggtactagggggaaggaagaatgggaagctattgtttaatgagtacagaatttcagtttgakgtgctaaaaagttctggagatggatagttgcacagctatgtgaatgtacttaatgccactgagttttataaatggttaacttagcgaattttatatatatattctttctctctctctttcacatgcacacacacacactctctctcttttgtttttctttacaccaggcattgtaatgtttccttcagtgatggctttatggtttcaaggatcatcacttactcacagcatcataaattagtataatattgttatagaagagagtacagtgtggcaattaagagcatgaagtctaggtcaagttgacaacttctccttaataacttggtaaccttacctgaaaatggagatgacaacacctacctacctcattgtggtgtaaaaattaggtkaaaaaaattaggtgaatatgtagaaagtgtttggaacagtggtgcatgatgcaaagtatggactttgttagtattttattattatcgttattagcatttctgtggccttgtaatccaaaataggatactctcaaaaacagtcaactcctagttctttttttttcttttatctgagtatcattttctctctgttgatgttattgactctcttgatatattttccccattctcctcttgccacccactggcttattttactccacactttgcttttgcctgtttatttttgtctttctttctttcttttcttttcttttttttatttgaaatggagttttgctcttattgcccaggctggagtacaatggtgcratctcrgctcaccacaacctccgcttccctggttcaagcaattctcctgcctcagcctcccaagtagctgggattacaggcatgcaccaccacgcccagctaattttgtattttcagtagagaggaggtttctccatattggtcagtctggtctcgcactcctgacctcaggagatccgcctgccttagcctcccaaagtcctgggattacaggcgtgagccaccgcacctggcctatttttttttctttttaaacattataggttcagtctatttacagtttcttcttccttgcactttggctctagtttccttgtagcctcagttccattggccccctctggttctgattttataagatggctgctctttacagaaactttcagctttgatcttgactgctaactaatgatttctccataaattctagttcaaattttcaagattgattaacacaacacaactttttatgtcaaacctcataaccatcaccagccagccaacagattaactcttcttgaattgggtacctgcctatgacctaaatagtgttgaagtgggagaaaataataccaaacctgccctcctgtggctgtyctctcagtgtgggctgcgagcagaatagtttctcttagggacagtttgtaagtatagcatttatggtaattaacatgtttagtataccaagaagcaaagatgaataatacatagtccctcctataatggagctcattacccaggaakagacatgtgtacgagcaatcatgcaatagaataactactatttatttatatggacaaaatattttttaaacacaaaggagaaaattcaatttgctgggtatagggaatgggacaggcttcacagtatgtggtgatatttccatggatatgttaagtatgaaaaatgtttcctgagacggagtagagcagaaaaagggatggagcaagggcattaaggcagattcagctctaaaaacagtcacagaggtacaaagatgagtggtgtgataaggaaatggagcttaaaactgtggctggaacaaagactaaaatgagtaagattattacagcagaatgaactgtaggtaaggaccaacstggggacggttttagactatgaattactgaaaagaaatatggtgtttgtttttagtcaactaggattttatcaaaggttatcagcaagtggggggcatgatcacttcggcatttgagaaagaaatgtgtttgcattaaggagaatgtctaagagcamatagagactggaagtagaaacctacaaggctactagaatggcccagttaagatataataaggcccgaactcaaaagagactgtttcaaaggtaaactgacagactagataattatcagggtcaagtgaccgacatgtaaatatttcaaccataatttaaagaaacaaaatgcctcagaaagcaacataattcattttaaaaaaaagctttagttttacgtgaagaagatttaagaatggttattttattttctctagatatatggctaaaattctaggagtgtgacattgggatgaacatttttctgccttaaagagggttagaagaattcttctgaattgtgtcttcttttagatttaagctaaatatcacaagagtcaagtaggataaagcttcttcatagtgtgcagtgttgaatcagataaattggatcagcagcagaactgaaaatattcttataaaatgtagcctgtcttatattcataacttcatatctccactgagggttttacaccagtactttaaaagtatactttgctgtgaaggcataatttcagtacaaccacatgtgtacrtagctgtccaattgcaagaacaatgaaacaccagggaccagagccactgcagtatacacgaaggtacattgtaagttaataggttaataaaactctaaaactgaagtcaaggcatactgcacagtagttatttctaaagttagtgtgtttccttaaaatttaatatgttcctcttttgtagaaaagaaacaaaaaaagaggatttaaatatattattctcaggcaactaattttttccgtcttctacctccaataatgtggtgacaggaagtgacttaaggtacagtctttaggatattcagtagaaaaagcttctttttattgttgtcattgtatgagaggtcttcaaaacctttactgaaaatgtgttttatgaaaaaattatgcatagaattcaacatttttgcacaaaaataaacttgtgctaacttgtgataacgtgcgtggacaggatctagtttgaygggttaaaaatcagagacatcagtttgaaaagagccctatattagtctgttctaatgctgctaataaagacagaactgagactgggtaatccataaaggaaagaggtttaattgacccacagctccacagggctggggatgcctcagaaaactcacaaccatggcagaaggggatgcaaacatgtccttctttacgtagcggcaggaaagagaagtgctgagcaaaaggggaaaatccccttatgaaactatcagatctcgtgagaactcaactatcataagaacagcatggaggtaaccgtcctcatgatttaagtacctcccaccaggtccctcccatgacatatgggaattatgagaactacaattcaagatgagatttgagtggaaatacagccaaactatatcaaacccctatgaaaggcaacataaactctgctaaaattgaagaacaaacatcatatttatggcaaagtttgagtggaagaatgatgaaatcactgatgctttaaaaaatattcatagagacaatgccccaaataaatcttcagtttacaaactgataacttattttaacaagagatgagatgatgttgaagatgaagctcacagaagcagcccatccacatccatttgtgattaaaaaaatattatattattcatgctctaattgaaggaaaccaatgattaatagcacaagcaatagccaacaccatagacatcttaattggttcagtttacacaattctgactaaaaaattaaagttgaaaaaacattccactcaatgagtatccaaaccattttgcccagatcagctgcagacaacagcagagctttcgatggaatttttaaataagtgggaccaagatcctgaattgcttctttgaagaattgtaacaggagatgaaacacggctttacaagtacaattctgaagacatcacaatcaaagcaatggctactgagagttggaagtgatccagtcaaagcaaaaacagaccagtcaagaacaagggttatggcaacagttttttgatatgctaaaggcattttacttaatgacttcctggagggccaaagaatgataacatctgcttactttgagagtggtttgacaaaattaaccaaaactttaacagaaatatgcccaagaatgtgtcaacagaatgtccttcttcaccattacagtgcttctgctcatttctctcccgaaacaagggcaatgtttcaggaatatccatgggaaatcactgggcattcaacttacagtcctaatttggttctttctgatttctttttgtttactaatttgaaaaaaaaatctgttaaaggcatccatttctcaccagttaataatgtaaaaaagactggattggcatgtttaaattmccagaatcatcagttaaggatwgattaaatgcctgatatcatcacttagaaaagtgtcttgaacttgatggagcttatgrtaacaaagtttatatttaaaaaactcactctgcaataatagagggagtaggaaaattttaaaaataaaaattattatttatacctatataatttatactaataaatataaaacgttttgtacttttcaatataaactgtatatatggagacattttactgtttttcctattgtcgatgatgaatgtatttaaccataatttaatttaaataatctaattttaatacacttaatgtattgaaataaatcactgagtaaatgttctacatctttacagatttttttaaattccattttttatgtttaayatgaatgagtataatttaattaattttattttattgttttaatattttttatttattttatatatttaggaattataagtgcagatttcttacatgaatatattgcatagtggtgaagtgtgggcttttagtgtgcccatcacccaaatagtgaacattgcaaccaataggtaattttttcaatccttatctttatagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctggtatgtttttattcttttaatttgtttattttctcttgtcaattttataaaatagaataatactgggacaggcatggtggctcatgcctgtaatgccaacactttgggaagccgaggcaggtggattacttgaggtcagggattcgataccagcctggccaacatgatgaaacccccgctctactaaaaatacaaaaattagctgggtgtcatggctcacgtctgtaatcccagctactcaggaggctgaggcaggagaattgcttgaacccaggaggcagaggttgcagtgagctgagatcatgtcactacactccagyctgggcaacagagctagactctatctcaaaaaaaaaaaaaaaaaaaaaaaagaataatactaaataagattaattttatttaatccagtaaacatttaattgattgtatttttggatgcaatatgttgctatgtattagcagcagttgtgtcatccatggtctactctgggattatgagcctgacctcttgtaatctttttaaatttaacaatttacactgagtctataaaagaaactcctattcatggccaaaacatattagaaaataatacctagaatcttaggtttttcctagattttcaaataaatcctgatttccctgcgcttcttttccaaccaaatttttctcccctcatggaaaaaaacatattagtgagaaaacatcatcgatttgaaatgtgtgaaccacaaaatctgagacagatctcagtcaatttgggaagtttattttgccaaagttcaggacacgcacccatgactcagcctcagaagttcctgatgacatgtgcccaaggtgatcagagcacagcttagttttatacattttagggagacatgagacatcaatcaacatatgtaagatgaacaaaggttcagtctagaaatgtggaacaaattgaagcaaaagtgggacaagtagaaatgggaagggggcttccaggtcataggtagataagagacaaatggttgcaatcttttgagtttctgattagcttttccaaaggaggcaatcagatatgcatttatctcactgagcagagagatgactttgaatagaatgggaggcaggtttgtcctaagcagttcccagcttgacttttccctttggcttagtaattttggggctccaagatttattttcctttcacagatgcaatatgataattcaacaaccattatatgtatttgacagtgctaatctaaagaattaaacaaacaagtctaaatatctaactacaacagacaaggttgagattccatgtgaagcccagattattatctcatcacaaattagaataatatcccacaggattgtgaagatactcataaatcaatatcctcagaagcataattcaagttttgtttgtgttgtaagaacaaagaagtgaacacattttcgtcttttttattctctcaaaaagtaatcctctgtctaaaataaattatatatacatttttccttttttgwaagagaaggattttcttggaatgtgataatattctttcttataaaatgcaaattctcatgaatatccaacttcattttttaaagttacctgatttgttccagtctaacctattgacttcattactttcatgtatgtatacattctcataatgaaaaattattccagaaaccaactatattttcatgatacattagtgaaaatgaaatgtatgctaattacatatttttaaactactttatttttatagaatcaaaatctttggaaatatagaaaatgtatgggaaaaaaaattaatggcctttgattccactactcaggaataataatcactgctaactgattttttttcctttcaccatttttctaatatatatttatattttcaaatgtgtatcatgcatgtatatatgcatatttatgttacttgcctttttacacatatttggctgcatatttctgcatgattgtatattattcaagaacttattcatttatgtgctcttttggtaacatttaaacagtaattttaattattatgaacaacrttaagcatatttttgtctatttgctatctccttcatatagacttcacaaagtaaattcagtcaacaccttatattggaaaagccttttgtaatttgactgttgaatagtaggttctgtttctcggttcttttggttaaaaggcaaaggaacctacttacattcatcaatgtagaggtagtttagcatagtaatactgacagcacatagggagaatactctggacatgcaacaaggggaaccataatttaccaatctttgcatgattagagctgggggaggcctgggatccagggatattgtaggtccttaaagcaggaattaatagtttttccctttagtgctagattaacctgatataccgatattctggatctgcttcttttcatggacaacttaagcagttcaaaacataaacaagaaacagaaaactcatgtaaaggttacttaaataacaaaaacccttccttatctcatatacctagatgtttkatatacttggctttagggttactagccctagcaaacggaggacttgggtaggagcagttaagctatgtggagagggatattttcatggctaacattatttagaattgtccgtacaggaggataataaaaagtagactgatggttaatatgtttaattattatttttaaattctgtacagaaaacgcacattattttctatgcccatggtggactgctcatgattttctgcattttggttgccctggttggtaatatttctgttacaggaaaggggtcccattctagaccccaagagagggttcttggatcttgtgcaagaaaaaattgggggtaagtctgcaatgcaaagtgaaagcaagtttattgagaaagtaaagaaatgaaagaatgggtacttcattaacagagcagccctgagaactgctggttgcccatttttatggttatttcttggtgatatgctaaacaaggggtggattattcatgcctcccccttttagaccatatagggtaacttcctgatgttgccatggcatttgtaaattgtcatggggctgatggcagtgtagtagtgaggatgagcagaggtcactcttgtggccatcttggttttggtaggatttagccggcttctttactgcaaacctattttatcagcaaggtctttatgacctatatcttgtgccgacctcctatctcatcctgtgacttagaatgcattaactgtctaggaatgcagcccagtaggtttcaaaatcattttaccaagctcctattcaagatggagttgttctgattcacatgcctctgacagttcaaggttattttatttatttatttatttattttgagacagagtctctctgtgtcacccaggcttgagtgcagtggcgcaatcttggctcactgcaactccacctcccggattcaagcaattctcctgcctcagcctcccaagtagctgggattacaggcatgtgccaccacacctggctaatttttttgatttttagtagagatggagtttcactgtattggccagactggtctcgaactcctgaccttgtgatccacccgccttgacctctcaaagtgctgggattataggtgtgagccaccttgcccggcccagttcaaggttattaatgtgtaagcatctctgaattctgttcatgttccctcttggttgcatcttaaagcattgcatctccaaacattacacaacacaatttaaaacggaaaaagaagctggcttgcagctttaactttagagaagaaagtctttcccagatgattttcatcagtttctcttacttgtcataggtcaaaacttggttcctctctcaatcttgagccaattaccggcaaaagraaattagatttccaagatgagtttagagggtgctgataagtgattaacaactgactagaagccagagggagtggtagtcctaatttgtagcatttgtttatttctgtggcataaatacccccrcctttgcaggttttaagctaccaatgtgatgtcactgaactctgagttggtacgaaatgcatagaatcggctcttgtgagctggaataaacaggttctaattgaacactaggcttagaccagccacaatttaacctttattactagtcacttactacacaaacaaaatcagagatttgttagtaaaaaaagagaaatggccattaaacagtcaagcagacatgtttgcctaaaatactgagtggtttccactgctctctcaagtttctgtgccttcataagcttatcttatattagtttagccatgattctttaccagtgatctttttgtaacatcataatttttcaacatctgctcccacagattatggcatcttctctcagaattttcccagtcaaacaaaagagaaagaatctagctggccctctagatcttttttgtaccagcctagatgctgtaggtccaaaataaaaccaatgaatagatgggttacctttttttttttttttttttttcagataaytaatcatagtttgaatagctgtgatgagaattggcacaatcttgcatcttctgtaggggacagattttcttagaaaagttacagatgtgtttaatagcaaataacttatctggtacttgtgaagaatgattgatatggcttggctatgtccccaccaaaatctcatcttgaattatagttcccataattcccacatgttgttgtgggagggaccccrtagagataattgaattacaggggtggtttcccccatcctgttcttgtgatagtgaggttaattctcacgagatctgatggttttataaaggcttcttccttcactgggctctcattctccttcctgccatgatgtgaaaaargatgtgtttgcttccccttccaccatgattgtaagtttcctgaggcctccctagccatgtggaactgtgagtcaattaaacctcttttctttataaatgacccagtcttgggaagttctttagagcagcatgagaatggactaatacaatgatcttttagagtgatatgttgttttgtattcagagacttctggttcctcttttgtcaggtagatcaattgacaagttagttcttagcgtatctgtgttgtgaattacttagggaaaattttactttcaaattttttataagcatttaacctctcatgggctttctttcaggagtcaatactaatactatatatatatatagagagagagagagagacagagagggagagactattttccatatagatagatagatagatagatagatagatagatagatatagggaataagggtccaaaacagatttccattttcttctgaatcatttgtgaaaacgtgtgaattctcagaatatcagctctctctacattaaaatgtaaatacaaataaaaatttaaaatcaatggtaaaggactcttagactttaaactatttttttgttattaccacagaggaagatcacatgtggtaaaatatttgcttataattatgttttagtatgattcaatggtccaatattgactaaagattcttgaaataagggtatctctaatgacaaatgtcttctgtttatccattgcagttatatatttaaaactgaaagtttttcaatgatcatttaaaaattattcataccatcaacaaatgtctcatgatagttaaacatatattttcagaggtcagtttgcataaactgactcatcatgagctacaaactttgatagaagggatgaatgatttggaccataagaactattcaacaattactaagaactgattaaatataagggtttgtaaaaatacaacctttcttttatttattccttcgtttatttatttaatattccataattatgagtgctaaatcccatgaaaggtactggaaattgaacaatgagtaaaaggtagtggaagagattacttgcaaaagaactgtggtggtggagatcaaatgaggattggtggaagcgattgacaatggtttttgrattttctgaaaaagagattgaccacttctaaattagaattagcaatgttattcccttattgtggagtgttctgattataatatcacattgacctttagtgaactgtagtattgaaggatagttgaagatgtgttttattctatattttaaatttttcttaaatatgttcacttttcccccatattcactgctactacgccagttcaagtaactttcttttccctaagttgctgtagaatcttaataggacctcttacttccatagttttgcctgaagtctcttaataggtatttgctgaatgtgtaaaagtatttattcccattttaaattctgtgtctacattaattttccagatttatttcttcttaattcctttaatgtgtttggccccaggattaatattttaaaaaatcttcaaattatgaaaaaataactttcagcattaatcatcacaatgttctttgaccttggcttagtaacaccaaggtaactttcaatgccatcaaaaatgcactaacaagtgtcacaccagactacatcctgccctggggcctaattgctgctgcatctccacatcacaggtgcacagcctacatcccccgacaccatcccagaaggttgcagtgttacattaccarctgaacctaatggtgccacagggtctctgttacctgagcccacacagagacctaaatcccagggaataggcagtcctgcacgtcagggaggctctccccaggacatagaaatccaaagcacatgcttccaagagcctgagagccaccttccctgatgacagtgaccttgttccctgcagcaattgggccatcatgtgcctgcacacaatgcccaggggcctgaggaccagcttgcttgtgacctactgccatgaacactgatccccaaacgtgccacttagggcttaaggactgccctgtctgggatgtgccaccatcacaacccagcaaacttggcccagcaataacagggccactatgtacctttgtgtaccacccaggatcctgagaactggtccatgcaatgtgtaccaccagaggtgcgtgtgcactccccagggatccaaggactgcttgcctggaggccccatctccagtaaagtcacatcacagctttcaggaacaactagagcataagacactgtgaagccatagatactactgattggactaatgctgaagaaatcatatggtgactacagtactgcattctcccagaaacaaagccaaagcaccctactcaagtttaacaatagactagataaagcaaaagaaataatttgtgatcttgaagacagatcttttgaaataagcgaattaggcaaaaagagaaaaaagaataaaaatgaaaaaagtttacatgacatatgggatatcactatgcaaacaaataktctattcctrttttagaaattccagaaggaaaagcagtgagaaaataaataggccacttatttaatgaaacaatagctgaaaagtttccaactcttgggagataatcatctagatatagggagctcaaatgttcccaaatcgattaaatccaaaaaggtcttctatgaggcacatgatagtcaaattgtcaaagtaaagacaaaaagggaattctaaaaacaccaaaagaaagcatcaagtcacatatgagggtatctttgtccgactaacagcagatttctcagaagaaacttacaagctaggagaggataggatgatatattcagattgctggaataaaaaaaagaaaaaactttcaactaagaatactataaaccataaagctattctttagaaatgaaggagacataaaattttcccagacatacaaagactgagggaattaatcactgttaaactgaacctacaagaaatgcttaagggactccaacctctgaaagcgaaaggatgttatctatcaattaagcaaaagcagatatgtgtctatatcattggtagatgttacctatcaattaaggaaaaacatgaaagtatacaattcactggtaaagcagatatgcaaatgagaaaaagaaaggaataaaattttatcactacagaaaaccaccaaaccacaaaaataataaaagaagaaaggaactaaggctatacagagcaattacaaaacaactaacaaaatgacaagaataaatcctcrtcttatcaataacaaccttaaatgtaaaccgtttaaattccctaattgaaatatataaactggctgaattaaaaaactgagacccaactatttgctgcttgtgaaactcacttctcatttaaaaacacacatagactataacagaacagattaaacaagatatttgctgcaaatgcaaacaaaaagtgtgcaaaagtagcaaacttatatcagacaaaatagacttttattaaaaataaaaagataaaaagacacagaggtcattatatagtgrttaraaaatcaattcagcaagaggaaagaacaattgttaatatatatccaccgaacaccagagcactcagatatatagggcaaatattattatagttaaagagagagatagagacaccaatgtaayaatagttgagaactttaacacctcaccctcctcaccctcagcattgcacagctaatctatacagaaagtcaacaaagaaacattgtacytaagcttcattttataccaaatgaacctaatagacatttacagaacattttttccaatggctacaaaatgtacattcttctcatcagcagatggaacattctctagggtagaccctatgttaggcccaaaacaactctaaataattttttcaaaaatgcaattataccatgtattctcaggtttcagtggattataattagaaatcaataacaagaggaacactggaaactgtaaaaatacataaaaattaaacaacattctcctgaatgacaaatgagttaatgaagaaattaagaaggaaattttaaatacttcttgaaagaaatgaaaacagaaacaagacataccaaaaaacctatggaacrcagaaaaaatagtacaagagggaagtttaaaggaataagcacctatataaaaaaaaaaaagatttcaaataacctagtgatacacctcaaaaaatagaaaagcaagaacacgccaaacccaaagttaatagaggaaaataaataataaagatcagcacagaatgaaacaaattagaggcaaaaaagcaaacaaaagattcrtgaaaaaagttagtttttgaaaagtaaaccaaatcaacaaactattatatagattaagaaaaagacctaaataaataatatcagaaatgaacaatgagatattacaactgacaccacaaaaatacagaggatcattagagactgttaggaacaactatacaccaacaaattaaaaaacataaaggaaatggatacattcctagacacaagtataaaataccaagattgaaccaaaaatgaacagaatcaaacagaccaataacaaataagaagattaaatcagtaacaaaaagtctctcaaaaaagaaaagtccaagaccagatggattcactaatgaattctagcaaacttttaaataactaacaccattttttctcaaactattccaaaaaattgaggattaagaaattcttcctaattaattctgtgaagctagcattaccctgataataaaacsagacaagggcacaacaaaaaaagaaaactatgggccaatatgtctgatgaagatagatttaaacaccctcaaccaaatactagaaaatagaacccaacagcacgtcaaaaacataatgaacctaatcaagtagaatttattccaaggatacaaggatagttcaatatatgcaaatcaataaatgtaatgcatcacattaacaatataaaattttaaaaacatattatctcaatagacagaaaaatcttttaataaaattcatcatccctttatgataaaaaattcttaacaaattaggcatagagggaatatacctcaacacaataaagaccatatatgacaaacccatggctaacattatactgaatgaagaaatactggaagctttttctctaagaactggaagaagacaaggatgctcactttcactactcttattcaacatagtactagaagtcctagcacataacaattaggaaaaagaaagtaagaaattgccatccacattggaaaagagggtcaaattgtccctctttgcaaacaacatgttctcataaatagaaaaatgtaatgactctgccaaaatactcttaaaactggcaaatgaattcattaaaatttcaggataaaaaaaatcaacatacaaaaataattagtattttatataccagtaatgaactaggtgaaaaagaatttaaaaatgcaatcctacttgcagtagctacaaaaaaagacacttagaaataaatttaamcaaggtgaaagatgtctacaatgaaaactacaaagcactgatgaaagaaatagaagaggataaaaagaaattgaaaaacattccatgctcctggactgaaagaattaatattgttaaaatgaccatttcacccaaggcagtctacagattcagtgcaatccttatcaaaataacactgtcattccttacagaaatggaaaaacatcctaaaattgtctggaaccacaaatgaccccaaatacccaatgcaataccaagccaaaagggtaaaactggcgatagtacaaaatataatatagttagttaaaatataatatagatagttcaaaatataatacacagtaatagtaacaaaaacaaaaacaacatggtatgggtataaaaacagacacacagaccaatggaataagatagagaacccagaaatacatctatatatttacagtcaactcattttcaacaaagatgtcaagaatatacattgaaaaaaatgacaccctcttcaacaaatggtgctctgaaaactggatattcatatgcagaagattgaaactagaagaccatctctcactayattaaaaaatcaactcaaaatggattagagaattaaatatcagactgaaactataaaactagtaaaaaaagataaaggaaatgttgcaggacactgatccaggcaaagactttatggttaagaccacaaaaacaaaaatagacaaatcagactatataaaactacaaagcttctacacagcaaatgaaacagtcaacagagttaagttacagcctatagaatgagggaagatatttaaaaactattcatctggtaagggactactatccatgatatataatgaactcaaacaacagcacagaaacaataatctaatttaaaaatgagtgatttatctggacatcgtttctcaaaggaaggcatacaaatagccaataaatatatggaaaaatgctcaaaatcactaatcatcagggaaatgcaaatcaaaaccacaatgaggtatcatctcacacaagtcagaattcctattatcaaaaagacaaaaataaataacaaacgctggtgttgatgcagaagaaatggaactcttatatactgttggtgggaatataaactagtatagccactatggagaagagtgtggaggttcctcaaaaaactgcaaataggacttccatatgatctagcaatctcactactgggaatctatcccaaagaagggaaatcattgtattaaagaaatatctgcaaccccatgtttattgcagcactattcataagagcgaagatatggaataaacctacgtgttcaacaacaggttgaattgataaagaaaatgtggtatatatacacatggaatactagtcagccataaaggataattaaatcctgtcattcactgtaacatgcatagaactggatgacattaagtgaaataagagaaaaataaagtcaaacaccatatcttctcactcagatatgaaagctttaaaaaaggaaaatagccacagttaaagtagtataaaattatatataacaaagtcccagaagtttatacattataaaagtggcaagtaycaaaattgtggctcawatagggaagctgttgcaccaggagtgtggcaacagaagtctttaagaccatactcaaactgaaagcaactttaaaaacaagagctgcaagtgttatcaggagttttcagcaaactatttaaaatagtcaaaaactgagcagttaaaaagtaccttctgaagtgaaygccgtttctaaatrggatcccaatgcctggtgggagaggcagcctcactctaccgtgcaggctggacaaaggtcccagccctgaagtcttagackctgagagtcaacgaaattgttaaaaaaaaaaaaaacagaaaacaaaacaaaacaaaaaaaaaaaacaagagctgctcctgcaccaccacactcttaattggacaaagattggatcagattgtaagaatttattatgctcaacatcactaatataattttawtagttatttaagaaacaaacccaagaaactcttccacagaatctaaatgaaaggaaatgattwaaaaaaaatgctaacaaggatgtggagtaaggggaattcttatgtactgttagtgggaatgttaattagtacagctatttattatggaaaatactattgaggtttctcaaaatgctaaaaacagagccaccatatgatttagcagtgccactactgggtatttatccaaaggaaaggaagtcagcatagcaaagagatatctgtactgccatgtttattacagcactattctcaatagccagggtatggaatgaacctaaatgtccattaacagatgaataaataaagaaaatgtaatatatatatatatwcacaacagaatattgttcagctatttaaaaaatgaaatattgtcgttggtaacatggatgagcctggaggacattatgttaagtaaaataagtcagacgtggaaagataaatattgcatgttctcactcacatgtaggagcaaaacaatgagctcatggaagtaaagagtagaactctggttattacaggctgggaacagtaagggagaaggaggatagagggaggttggtcaatgcatataaagttccagttagataagaagaatatgttttagtgttctatggcactgtagggtgaatatagttaataatttattgtatatgttcaaaaagctagaagagaggattttgaaagttctcattaaacaaatgataatgacttgaggtgatgaatgttttaattaccctgaatttataatcacacactgtatacatgtatctgtcacttggtaccccataaatatgtttcayttattatgtgtcaagtaaaattgaaagaaaaaaagagaaaaatgaacaaaatgtaataacaaaggcctttttgtccatgacatcatagtgagcatgacctttggcttctacaaagttttaatctaaatttgacaaagaaaatggaaaataaattkattttccatgttctttcataagctgatgccaaaaaacacataataatgttagcaagagcaaaatgttaaaattaactgcatcaaaactaagcactattaaatctcaatatgatatttatttaataggagttgggataaaagatgaccaatatagtatgtatctatgcaaatattaattatacaatataattataaccaatttcctattaccatacattgcacttatacattattcttcaacctatacctagtcaaaatttagtttgattaaaagcatcaagccatgaagtggttcaatacaaatatatcttttaaattggagattgttaatcatttcctgaaaaaatgattttgataaaattaaactgagtatctattatgtgcaagacagtatgctggggaatgaaagaaaatacaawgaagaaaaatacacagaatttgctttgagagaactcacaatctggtgtatatgaatcagatttcaaaagaattgtatttgtyacgtaaacaaaatcttttacaattaatgctgctgtactgtcaggatactgaggaaatatttttaaagaaacagctgttcagctggattattgaattgaacctttagaaaattggaaaagcctcccataaagagggaaaaactgtgaaaattcaaggtgggtttgagggacagcaagttggccagtataaaagaagcacagactacatcaggattggtactgagcttaaaaagtcaacagatggcttcatatagggtcctgaacttccataggaaaaggcaagtgctgtggtttggacattcaacccctccaaatattacgttgaaactggatccccagtgttgaatgcagtgcctaatgggaggtgtttaggccttgggtgtggatccttcatgaacagcttggagcaatcctcttggtaatgagtgaattctcactctatttattcctgcaagggcaggttatttgaaagagcctggcaccccgcaccctttgcttcctcccttaccaagtaatctctacatgctggctccccatcaccttctgccatgagtggaagcagcctgaagccctcaccagaagtaggtgctggtgccatgcttcttatacagtctgcagaattgtgaaccaaataaacctcttttctttatagattatccagttttggatattcctttatagcaacacaaacaggctaagacagtaagccatctgaaattttaaatagtaacgttgtatactttatcagtttttagaacaccatctccagacgccaacttcttgtagaagtaagtgatgtagtgctaaataatccttaatggcccttagaaatgaaagtaaatccaatataaaacaggtgttccctcgttttctccattctatctccaaaaaatgaaagcacatgactgacacattcaagatgttacaataggaaggtgagaaccagtttgataactgcatcctagctcaagccgaataacctaggtttccatttaccgagaaaagaagctcttccttgtcaggacaggccagtgatgacttgcagccaggatcttctataacattgactaaaattaagagacagtgatttcatagctgtaagatttttttcccctgagtcatctgtgattacattttcatgttacagtatattgttcagggatcattgtggagactgaagagaaatgtacacatggctttatgtaggtcatrgtgaaagacagagagaaagtgtgtattcagaaatgattgaataggcttccccaaagtaatccattattgctttattggtaattatgttttgaattactgcctgtacttacatgactgaagagtagtttgggcatgtcaactggaatttatcacacatcatttcatgtactaacaggtaagttcacttaaggtgctttcatttgaataaacaataagtagactgcaggactgttctttgagtattatgacttagatctttagaaaagccataactgggagtccttttttgactgtcttaataagtcagatttgaaaatttttgctataactttaaggtatagctagagtaatgattaataatcttactgataaagtaaatagccctaaggatttgcattttagacttgcataacaatataatagtttctaaatacttcagatgcatgtgctatgtactgacaaaggctgtgaatgataaaatatactgtttataaacaatttgcttagaattgtctcagtgagtgtatgtgcattgttaataaaccatattattttcaatggccagatatattgacaaagactttcaacaaagcaatagagagtcaaaggaagtctcacaattttatgtgtattcagttatttaggggtgtatctcaactctaaccacctataatcagtataaattggatgaggaaaaatcgttaatatggtgaatcctttaggatattttatagattagatgaaggattacagggaaattttctccttgccacacagcacgttcctacctaccaatgagcccaagacatgttcctgggcawtgtgagagaacaaagatttcagctagagctgaaggggctttaggctggtgagaacagcatcaatcttgctatccaagtgggtctagataggaaatttgaaaacaggaatcatgtatctgattttaygagttgttgttgcaatagacttagggacttagaaagcatcctggggaattttaacaaaccggtaaaaacctttgcttggagaatggctccagagcctgtgctgtgaacaagttctacgtgtttttaaaatgcatctaggagttacattgtcctaaaaagtctaactcatagaagcagggagtagaatagtggttacyaaggactgctggtaaagggagaggactggggagatgttggttaaaggatacaaaatttcagttaaatgggaggaataagttcaagagatctattatacaacaagctgactatagttaataacaatatattgtcagtttgaaaatcgctgagagaacaagtaaatgttctcactataaaaaaatgattaagtatgtgaggtgatgtatatgttaattcgcttgatttagccattctataatatatacatatttcaaaacatcatgttgtacaccacaaatatatacaactaatatttgttaattaaaaaagaaataattttaaaagaaaaagaattatgttcttacaaactgcctatcgttcttactaaaatttcaccgctaaagtaattcttatagatttgacaggaagatagtgaattttctctttagagactacgtggaacatagaaaaagaaaaatctgggccaggcgcaatggctcactcctgtaatcctagcactttgagaggctgaggcaggaggatcacaatgtcaggagttcaagaccagcctggtcaacatggtgaaaccccgtctctactaaaaacacaaaaattagccaggcatggtggcatgtgcctgtaatcccagctactagggaggctgaggcagcagaattgcttgaacccgggaggcagaggttacagtgagctgagatcacaccactgcactccagcctgggtgacagagcaagactccatcttaaaaaaaaaaatctgtttttggagggagttatgtatgcttgaagatagataattctgtcatttcctacaaaaatctatgctctttgggaaataaccactcagactccctaaatgcctctttgaaaatgttaattatataatttatttattcatgtactcatttattaacaaatatttggtgagcacctactaggtgataggactgttttaaagatagaacarccagtagaacagacaaaactctctgcatccttagagctcacattcttttacaattggaagaattgaataaattacatattttaaatgttttgaatagtgtctaggacatattgagtggcctagtaaaagataactgttattactaacattattggcaggccagtgttaaaatttaaaccagtatgagaaagataaatctctttaaggagcacttttgttcaacctgtcccartaatagactatatagttaaccaaaataactgaagaattatcttaagagctagggtgcatgactatcagatattaaaagtaaaaaaaatctgataatttcaattattagatgtgatatacttaaaagagtatgctcatacaatacttctgggaatgtaaattgttacaatctcagtgaagaacaaaataacaatatgtggcacctgggttatgttgccagraatccccctctaggtttattgaagaaacttgtgcacayattcataaggaaaacccsgtacaagtatgatcattatagagttttttttttccatcaatggggaaatgagcaaatagcagcaaacacagtagttaagacaaatgagctagtttcatatgttaaaaagagaaattttcaaagtaatattgagtggatgagcaagttttatggacagtaggatgtcataaatgccatgtgtatcaaatacataacagtgattaactttagagagggaggtacgagactgaggaagagttcatataggacttcagtgttatctacaatgctttatcctktaaaaattagagcaaaatccaatgggaaaaaaagtkcatgttattattgaggtagatagattattttctatattttatgatctctacttttcttaaacatttataataaaaaatacatattgaataggagaagtagatgtcagggtgcaaagccaagtgacatagatgagtctgtgcctggggaacagagagatcatgccagaccaacacatatcagtacctgaaactcacctaagaattgtgattatcctatattctttcacttgactgtgaatctcagtaatacagtttaaaaaatgctttgtgaaaatgaaaaatacctaaacctttatcacccagggtcagactctaatagaataatactttctgaagttttatgtcatttttcattccagttttgttggtgagtgtgaggaaaggatagctagattaaaaaaatacttttattctgaaatatttcaagcatccataaaagattagagcatatagaatcacaatgtaatcttacggtgaagtcttactgagtcttaacttttctcatacttgttattacatgtataattgatgtcccctgtgttacctttctcaggtttttactatttttcttttttagtactaaagattttgatgaaagcctttgccccttcataagcaaatctgcatgacagacattttccatctattggattaggagatttagggcatcaaaataatcagaatctccctcaggcaatagaatattcttactctgagtatatgaaaactcaaagctaaagctgaaaagtttctcacaggcgcatgacaacaagatttaaatgatattctgttctgccatctttatagcaatcttgatagtatggggggaatgaatgcctttgaagccaagtgcccagtgaacactttcgtgttgacaagttaatcatttattgtgtcagtcaacaaatacttattgagcaattactattcactctagagatgaaatggtggataaagcctactggacttattcacaagagatctatagtctaatgggggaaacaagccctcacctgataattacagtgtgttaaaataggttctgttgggaaagacaccaaggctatctttctatcaacaaagtaattctgtgacatccagtctttgaaacctcatcattcttcattgttatttgaatttgtgatcactatttcatatattggcaattagtagctcattataaagacttacatgacaatccaaataagatgcaaaacataatccatgttcactgtgatagatttcattcatctctatagtaattacagatgtataataatcaaatttcaatctggttcttcataagtttgtaaaatgtgtaattaccaggaatttataaataagttaacactttacattcatttataaataattttgcaaatgcttgttttctctgtcagattttcttgtagggaatcagtggctttgagatttcaggctttcatcgcattagggcagtaactgccacatgctaacagtagaatataactattaaaattctaaaccagaaaaaatgatatatttgacacttcataaaatctgtcttaattataaatattaattttaaaatattcactgacatccagaccaactaccctacaatcccccataaccttataatttaatcaacttcagagactttcagttgtaggtgaaacatagttttcaggcacagttgtaatactgtatgtggaaaatggtcatgggaggaaagaaaaatacgtcctttttgtgtatctaaataatttgacatggcaacattaaattcccatgccatgatttaatatttacttgcaaatatgcattcactgtcttgatagtgatttatgtactttatgtttcatacctaaattacatataaatactcttcacctaactatatgggaaatttcatgaaggtagagatattcagccttggccttgtgacttgaccctttcttcttaaactagatcagaaaatctacttatttaaaattctgtaaggtgttttcaaccactgaattttaagctaacatcatattcaaagtatgtaaaactaccatggaataattaaaacttatctagggtggtaagccaattattattttattatcttctgtctgtcatatttagcaaaaacatgtgtggtgactggattaattaaaatactttattaaagcatgatatatatttatactatcactatttcactaaataaatttataatttgctagtatcaattttttttggtttgaatagctgaattttttatggatttataataaatagtgtatgtgtgagttttgttttttacttttgtttgtggcttttaaaatctttttttcttaagaaatgcaactattggccgggtgcagtggctcacgcctgtaatcctagcactttgggaggccgaggcaggtggatcatgatgtcaggagtttgagacaagcctggccaacatggtgaaaccccatctctactaaaaatacaaaaatgagccaggcatggtggcgggcacctgtaatcccagctactccggaggctgaggcaggtgaattgcttgaagccgggaggcagattttgcagtgagcggagatcgtgccactgcactccagcctgggcaacagagtgatactctgttaaaaaaaaaaaaaaaaggaaatgcaactgttaatgtgtggaaccatttatcccaagatctctaggagttccatagatattttctcatttattgctccacttggaaggtatttggctagtataatcacacataatattaactgtcacagagaattccttaattgctcaaattctctaagacaataaataacaatgatattagttttatatatcctctagtctggtcagcctattgttctctattaaaattgattttccctgtcgtcccaggagttcaaggttagcctgagctacatagggagaccctgtgtcaaaaaaaaattgtttttcctctcaaattaatttctgtatcttttttaatgtcaaaatatggatgccatgtttagatcataattctaagtttttccatctggaacctttctaaatcaggaaaaatatttacctgactgttaagcctagttttttatttgttacttattcagctgttaaatcaaataatgaacaaaagctgaagtcccttcctctttggctgtccatgcaaacacagctggataattttgcatgatttaataaggcaatataaaaatccttttgacctagattatatatggttttggtggcaaatgaggctctttcctctcccaccagaagttagtargattctagaagaaaatttacatgtgggaatgggtagggggaaacaagcaaaacatcagattagtaaaaaatgaagtcaaagaaagagaagaaccgacaactgtggatttgtacagatggttaggttttacttcattgcagtgctttacacaatatatggtataccgcagatgcctaataaacatttgtttaattaaatctgttttactcaaataaacttgtatatgawttttacaggagtaacgtccaaagtgatcaagggcaaaatttactctgtttatgtttcagagatgcccaacataggctttagagcaaagccagatgtatgtatgtagcataactattctagttagactgcaaaaattaagcacaactatgcaacgtgattttctccttggtatagcactgtttccaaatcaaggcttcttctagctgtgtaattgcacagaatgatcactctgcacctttcaccaatgtaaaagatgaagctcatttcccacagtgctaaaggtttacgtgccaagatctttattacckaatgtaaaatctgatgtgttttaaatttcattttgtaattcactgaactcaaaattttctgcttaattagacactaacaagtgatacgaaatgtgggatttatatgtctttcaaacatttgctgacatgaacctaaattattgccataatagtagaggagaaaaacttgaatgtgccattggataagttgtatgaacaaaaggaaaatcctttacttttgccacactgttaatataacctggctgagcaccattgaattgtcatatgttttaggtagtaagtaaatattaagtttatctgccagtgacccacgtgtaagaagtcataaggaagtatatatttattataattccataaaaattcagtattttcccctctataaatattaaaatggtattttgtataggttccttactattatcctatgctcttttaaaacagaagtaatcaaaattgagatttcgttgtcattgtcagaaatatgatttacttttcaagcaggactaagaataatgagttaggcagctaaacttacattgtactccatggtgataaaatatcacatttctacttaaaaaaaatctcagtgacattttattacaggaaagaatttaaaatactgttgtagcacataaatttgggaactgaccctctgaacaaagagctataagcatagatttttgatagatagatttcctaaaaggacaatccaatcgctagtggacttttattatctatgtcttcttctggcttatgaytggtacaattctaattttctccctattttatttcttctgaaaaatgtccataaatacaaatgatatgttggaagatggtggagaattattttatttgtctggttattggcctgtggtgtattttacattgaaaactgaagaaaacatgattttctatttctgcttttctatcagcagtcaaatgatctttattgtcttaaatacaaaatatgccatgtcaatcagagtacagtttgattataattaaatgaaacattagccctatacagtgctcttttctaatcatgtttgttcctatcctttccactayagttatctcaatatggtgaaatgaattataattaaatgaaaaattagccctatacagtgttttcttttaatttgttgtttcctatctttttcattatatttatctcaatatgctgaaatctcatcctagaaaactactttctccattaaacctttcttaattatccagtcattttctatgttttatataggttgatgcaaatttaattgcagtttttgtcatcaaagtgatgacaaaaactgcaactacttttgcaccatcctaataattttgactgtgcactataacttttatcactttctgccttctatgatagttatttttatrtattttcttctctattatgttgaaagtcttggagggcaagaacgctttattatgtgctgaattatgtctccacccaaatttatatattgacatcgtaaccccctgtaactcagaatgtgactgtatttgtaaatagggtctttaaagaggtaattaagttaaaatgaggtcattaggatgagcctcaatccaatataactgatgtccttgcaagaagagggaattaggatacagacatgtattgagggaaaccctgtgaagacacagggagaagatagccatctgtcagtcaaggagagagacctcagagaaaacaaaccctttcaacaccttaatctcagacttctagcctccagaaatgtgagaaaatgaatttttgttgtttaagccacatcaatcagtgatactgtgttatgaatgcactgacaaactagtatagctattattcaccgttgttctgaacgacctagcacaataccttgtatccagtactgcttcaataaaggtcgttaaattgatttcctttgtcgtgtgttcactgtcaactaaaagttttgtttcagtgaagtaggagaatactaagacaattccttctttgatcctttacactgaataaataaatagcaaccatgctataattatcaagctttccttcccatcattacttctttattgtccttcaaacctgaatttatttgtgacaactttgaaattgcgtaagaatcttctggtttatgtaatgtctacttaatttaattctcgtatggatcatgtgataatatttctatattttttcttcattattctagtaatgagatagtgattatagcatttaatcaaactggaaataattatattgtcacactttatgtagatatatcgttttaaaatacaacttttagaacattattttgtgtacccaatagttcagtcatttccttatgacacctattaatcagattatactacggaattttaaaaaatcaaggttgacattttggtattagaatgattttcatgttcgatatggtgatactaaaacctgtttccttagagtaaaaggttttaatcatgcaatatatgacacatgacatatattgctcagctaaatgttcagttaactgaaggagaatgtgaaaatgatatagaaaataaaaataatatctttttatctatcactctatgctaatatggttgttaggacatttccttagattgttgtcattactgcatggtggaaatagtttctataaataagctaaacaaaatgacttccaggccaggagtggtggtttacagctgtaatcccagcactttgggaggccaaggcaggcagatcacttgaggtcaggaattcaagatcagcctggccaacacatggtgaaaccctgtctctactaaaaatgcaaaaattagcttggtgttrtggtgcacgcctgtaatcccagctactcaggaggctgaggcaggagaatcacttgaacctgggagacagaggytacagtgagccaagactgcaccactgcactccaggctgggtgaaagagtgagtgaaactctgtctcaaaacaacaacaacaacaacaacaacaccccaaaatgacttccagtatgtatttcctttttctacaataaagcttagctaaacttcccaattacgtagatacttttgtgttatgatattgataagtgagctgtaaggaatcacagctatgtcattgattactacattgatctttgtatctccagatactaacaaaatatataaacaatagaatttttttttcccttagccatagttcctttaaattaatgcctctttgattacaccaagttcaagcctatatctcgttatggctatatgtgatctttaaaataaagtttaatatcagctttctttacatttattaatctgatttttttcagataaaatttggtttcttttctctcctcttataaaataatcccggagtttggctgctaaggcggtgggatgtataaagaactctgagagtttatgggctagccaaagaataattttattcttctaagtcatagtggtttatgcatatgccatgctactgtggtgaatatgttaatatactgataaatagatacatttaactagaggctgatggggtgtgcaatggcaaatatttggyacygattggtgggttggygatacaacatgaaatgtgggtaccattcacccattcccctctgcattttctgcgttcaatacgcaatgagggggagctgtagtccctcaactggcaagggaaatcacattctatcrtgtgtgctctctcaccaactatttggccttgggaaaattgcttaacatcccttgattccttcttctgtaaaatgggagtgataattcctaagtgacaggataatttttgaaatgtaatagacagtggttgtgaaagtgcataacagagtgactgtggcatagaatcctcccaacggtattggttgactctaaatcaaaattatttaaaaataaatggcttgatcccttttccattctgtagagtcattacatttcctatgtcctaaacttccaaactctcaacaatttctgtgtcaggtgagacaatttctcttctatcttctactcctttgctgctaccagtcttaagagtttggaagatattactgtgggtggcctattacccaatgtcatacttctttgctaatgcaagcacaaaacttagacacaatcttgtgaatatttttagtagaaataaaagaatgataagccatagcttctacaagggaaatttatgatattggaaattttactatgttttctactgtctctgtgaaagtatggaatgaacagggtctaataccctggaataccacctggcagtatctgctacacattactttaatcttcaactgrttaatcggaccaagttttcttttctggatttttaaaatgctggatttctattgagcaacaaattatgtcttcaggtctccgtgaagggactttttgcattaataatacagtagtttggcccagcgcagtggctcacgcctgtaatcccagcactttgggaggtcgaggcgggtggatcacctgaggtcaggagttcgagaccagcctggccaacatggcaaaaccccatttctactaaaaatacaaaaattagctgggcatggtggcacatgcctgtagtcctggctactcgagaggctgaggcaggagaatcgtttgaacccgggaggcggaggttgcagtgagccgaggtggcgccactgcactccagcctgggtgacacagcaagactcagtctcaaaaaaaaaaaaaaaaaaaaaaggccggcrcagtggctcacgcctgtaatcccagcactttgggaggctgaggcgggtggatcacgaggtcaggaaatcgagaccatcctggctaacacggtgaaaccccgtctctactaagaagacaaaaaattagccgggcatggtggtgggcgcctgtaatcccagctacttgggaggctgaggcgggagaatggcgtgaacccgggaggcagagcttgtagtgaccggagatcacgccactgaactccatccagcctgagcgacagagcgagactcggtctcaaaaaaaaaaaaaaaaaaaatactgtagttaaatgttagccaacccttctccccaacaacaacaaaaaaattaaaagtgccaggtagatttgaaagttcacaaacagactcccaaagaattaaatgacaagggagacttaaattaccgctttcttaacctttttagcatattctttgggagagtagatggatgtaggttcaagaggatttttacagctcttatgagtttagaaagctattaaaagctcctgttttcagtgcattgcctttgttgcaaatcatccatctctttggtctgtcctgcattgtggttttgcaaaagaaatgcaactgacattataaagctgttttatatagtgcagcacactgtattattattaattgaagaagaaaacatgctttggttagaacattagtttcctgttttgtaattgtatcaccattgatcttttaattgttccagatgaatatttcatctccttgtctcattcctgtctccttattccttgtaaatttgatctagcaattagtaatattctcactacatttccctagatatgatctgtgcttttcaattcaatttggtatgttcacagtagttttcaattcttttttcaacacaattcatgaaagtcccctttcatgtcaaagaagaacaaggaagggataaacccaactgtttaggccagatggtgagaaatcagatgacaggaaaaaaatgcagaaccattcaactcctattttgtttcttccttctctatcaaggagaatgatctttaaactagatggagtataataactatgcttaagggaatcaaagcccaattggtggtatagtaaaattacctgctgctttaaatgacttcaagcctctaggctagacaaatcacattccagaattctgagagaactggaagatgttgatgtagaactattttcagttatttttgcagaaccacagggaataacaatggtgctggagaaatgaaaggaaaatccacttcctgttgtcaaaaaaatggggaaaatataagtgattgctatcattgttgaacttcaacagacttccacaatagaagtttaaatcatttatgagcrtgaacagcaaagaagatggtgacctgggcaacatagcaagaccctgtctctaccaaaaaaaaaaaaaaaattagctgggccttgtggcgtgcgcctgtagtcccagctactcaggaggctgaggtgggagaattgcttgagcccaggagttgaagattacagtgagctatgattgcaccactgcactgtagcctgggtgacagagtgagacattgtctcaaaacaaaaacaaaaagcataaagaagatgatgaattcactagaaattgggcctcctataataagtgtattttmttctctgggtttctagattaagagatgaagggaattatgcaaaaaaggatggtgtgtagaggattacaatgtgttaggtatagtcaagattttcttgtgggaaacattgagaaaagtaggaaatgggagtttgtaacaaatcaatttctgtttgaggaaaggaggctaaaacacatgaaacaactagggaaccactgaagtgttcatatgtacagagggacaataagaacaatccctggtggattgattaggaaacattaaaaaaagagagaatttgaaatgatggatagattctactcagaagactaaaatggggatgaagaaaaaggatatccaaaacaaagagactgatatcatggccactaatggtacttatgacacacttccttgcccttatgtgtgttcacatcttattgtaagagtgtcagtctaacaaagggaagcactttttctaatccttttaattactctatttataacaaaattagcctgcctgattttgaaattggctaccttttgaaatcctattttaattccttttgcctccttcagatacaaaaagacaaatttttccctaatccatttaaggatgtctrtttaccaaaagagcaggcaaaaggattctgaaataaaaaggacttcatataggagatctgaaattagtactaatttctcatgggcaaatatgtagggttttttcagagaatattaattttaaaaataaaatggtcattacatttaattctgtgcatttctytgggaataaataaatatgttaaaagttcataggcttcttccactccatctggagaaattttgaaagaaattttgtaaactgtttcagctggattatatggttctggagaacaagaaatgttacctttttcttcttgtattttctacagtaccttataacctatctttgtttgcaataggccttatcaaatatgtgtagaatgaataaaacatgatatgctattataggccgagactaaaagatctatccctagcaatagtggtgtacaattttttatggaggagatggattgagagcaacataaatatctatataaaatagattaaagtgcagcggctatggttgagtttctagatgtctaaggtcctggaacagctcttcaattgcatttcttctctgttaccctcagccatttacttgagggcctaaagggctttgaggaatttcaagatatcagtaacataagatttggagaattgtatcatgtgggacaagctggattaaaggattggtagcaaataatgaaacatgtcagcagcttaaaatgaaaagtgaaaaggtttatttctcactacrtcatatattcgttgttcattggaggtcagcaaggggtgtcagcatgtattagtcacgcagagacccatactgatgaagactatatcttgaaacttgcttcctcatgcatagaggccaggtaaagagaagatgcgaactacacacatgcttctgctaggaattgctattttggctgcatttaatttcccatggccctgctaccacatgagttcaagtgggcagagaaatgtcatctgagagaactgacacatttgagaactgccctaatgatactgtagaaatgttccccaaatctcctgttgcctcactaataaattatctctggttcatgaacttatataaattctctgataatagggttacagatttaacctgtataagatcatagaaaaataagctcatgcattgcttacactatctttaaatagtcttctttttatatgttggaagatgatctgtttcaggttaaaaggcttcaagcattacaaattgagagaacaagttcttgtctcttcttcatcatatttatttttaaagattgatgtcatattgctcctcaacttttgtcttacaaacttgaaatgatgtgtattaaacaaatgtgacatacttgctatgtgaaaaatattatgaaaaaatattatataattcattctagtagggtaaatagctaaaattcagaaaatataaaattaagaagttaaatggtaaaggcttcagaggttatggctgtgtccaaagtcagaaaagagaccccacaaaatgaggcaccaaagttagtctagaatttgaatagatatgtttatccatataaatgtgttaaacaaaggggtcatccgtttttctaattcccactcgatagaaactatcgaaataaattggctttactctatgctgacaataatatgccttcgccaacattgtttactcaaaaaatggaaaccagcattccctatgcccagagtgttgcaggcatttttcaataaatagaaggccttttggccaagttttccaagtttttgggacaagttggaccagtaggtgatggtagtctacgtctgactttcataatcccttgccccagcatcctgtaattgccagtcattaacaaagaatccagtgggtttggagactctggctccttcctgaagtatctagttgaatctcagcacagcaaagttcttcataacttgcatgagataagtatacctaaagcctcatgaaagagtaaaggagagggaaggcttcatttaggaagcttctttagctctgtgtgtgtttgtgtgtgtgtgcacgtgtgtgtgtgcatgcacaagtgtgtgtgtgcatgygcaagtgtgtgtgtgtacataaygttggggagtatcaagaggaagaaatagtgactagtttttattctttaagcgttaaatttcctcccctttataatttctgtaattcttccagttggccattcctttattttttcttcttccatgatatctattttcatgagttacaacccaaaaacacacagaatacttgagctatttagctgtccttcaatcaattcctaacgtccttttatccaaggaatatttagaaatgtaactgaaactctctcatgaactgtttatggacaagagatgaattgacagctgcttttactctgtcccattgattgtttataaagctaggttaatagcttctgagtaaaattttgataatctgacctctggattttttcaaactctcgagtagatatcagtcagttctgatgagtgatctaaccttggttcgtcaatgcaccctgtgtatgtagtagtctttgattcactacgtctgtcttctcggctccaaagatcaaattaatttttcctggataaaccacaatgactgaaatccctctcctcttcaactttcaataggaacttcacttacttctcaatgatttataatccattattccctatctacccttttatctttgacacaccaaaaaaaaaagtctacttttatagatcatatgtccttgcatgtaaagttcttaaaatgttttttaggtcttcttaattttatctttcccctaccttgctctaggcttttttggagaggcatgatcaattaaaaaaaaatctctagctcctatgatgtttcatatgacctcttcccatgtgccagttactcatatataatctattagacagctgtttaaaatatttttattattatgatgcctataacttaatttgaaaaacttcaacttaaagacagtgatatttaagtataaatggtttatgctgcactgtagggacaatcatttggttaatcaggaattcacactggcattctaatcaggaaatgctcactccataggaactactaatagccattccattatcattatctttgatcaacaccaaaggcatttacaattagcaaaatgaaagaagtgggttttcattggtgaaattagtggcctgttaattagtataatggattttagaagtgggctctcactggtraaataagtggaattcaaggtatatagattagttagactatcgcaaagatagccttgcctaggctttatctctaactcatctatgtccatgcatgagggagatttctaggttcttatcgctaactataaaggtaatgaaatcatttatttggaatattgctatagttatttcaagtgatttatcatacaaggtatggtctaattgcatcaaaagacagagatctgtgaatttgtcaatttatagaaagattgtataagtgacttttgcttgcttgctaataaatattaataagtatgtggaggggtggcagaattcgaagggaaactttttaaagtataattttgtgtcagagctatgggaggatgagcacagactgactgctgatggcagtgattttctacccatatacacaaatacttctgttggatgaggttggtttacggcacttaccttgctaattcctggtaaaatgtttctgaagattttccagatggattttgagacagccaccaagctttttaaagagtatttaccaaaatctcttttcaggtatttcttaagtaaatttaacgtttactttagtctcttgttatcaaaataaatttgaacacactggtgaagaatagtttgtgttgtttaactgttggcaggagattgcaaggttttttgttttgttttgtttttaaatatttaattgacaaataataaattgtatatattcaggatttaaagcatgatgatttgataacatgtagatgtgaactgattaccacaatcaaattaattaatacattcattaccacctgtaattagcatttgggccaggcggctggggagtggggacacttaaaatctgcccttttaggccgggcacagtggctccgcgcctgtaatctcagcactttggggcgtctgtaatcccagcactttgggaagccgagacgggcggatcacgaggtcaggagatcgagaccatcctggctaatacggtgaaaccccgtcactactaaaaatacaaaaaattagccgggcgtgttggcgggcacctgtagtcccagctacttgggaggctgaggcaggagaacagcgtgaacccgggaggcggagcttgcagtgagccgagatcgcgccaccgcactccagcctgggcgaaagagtgagattccgtctcaaaaaaaaaaaaaaaaaaaaaaaaaaaaaaaaaatctgcccttttattaaatttcaagtaaacaacagagtattattactatcgtcaccatgctgtacattagattccctgaacttattcgtcttataacagaaagtttatgccctttgggcaacacctcatttcctttatcccatcccatggcaatcgctgttctactctctgcttctatgaattagacttttttagattccatgtataagtgagatcatacaagatttgcccttctgtgcctagcttatgtcacttagcataatgtatttcgggtccgtgtatgttgtcatatatggcaggattttctttttttaagactgactgatatttcattttgtgtgtgtgtgtgtgtgtgtgtgtgtgtatttgttcatccatgcgtctgttgatgagtggttgtatccatatcttggcttctgcgagtaacactgcaatgagcatgggagttcagatttctctttaaaatactgattttaattcctttggctatatacccagaagtgggattgtgggatcatatattagttctatttttagtttttttgacttctatactgttttccataatggctgtagcactttacgttcccacgaacagtgtacaaagcttcccgtttttccatggccttgcccatacttcttatctcttgtctttttggtaacagccatcctaatakgtgtaaggtaatatcttatcgtggctttgatctgcctttccttaattagtgatgttgagcattctgtcatatatctgttagccatttgtcttcttttgagaaatgcccattcatttttttgtacattttaaaaattgtcttatttgtattttgctattgagttcagtgagttcattatgtaatttggatatctgctccttaacagatgtatgatatgaaaatattttctttcattccacagttgtctcttcactctgttgtttccttgctgtacaaatgattttcagtttgatgtaatcccatttttatattttcgcttttgctgcctatacttttggggttatatctgaaaaattactgcctaagctaacaccatagagctttctcctgtgttagttttaaagtttcagatcctaactttaagtctttaatccattcaaagttgatttttgtatatggtgtgagagaagggcctaattgtattcttctgcagttttatcagtgccatttgttagagagactgttctttccccattgtgtgttcttgacacctttgttgaaagtcaattgactgtaaatgcatgggtttattcctgggctgtctcttctgttccatgtgtttttatgccaaccatgctgttttggttactatggctttgtagtatatcttgaagtcagatagtgtgatgcctctaggtttgttattttactcaggattcctttggctattcatggtcttttgtggatccgtgtcaattttaggattgctttttctatttctgtgaaaaataccattggaatttgtatagaaattgcatggaatctatagattattttgagtagtatggatattttaataatattaattcttccaattcatgtacatggtacatatttccatttatttgtgtctttttcaatttatttcatcaatgttttataatttttagtaaacagatctttcaccttcctggttaaatatatttctaagtatgttcctctttaggatgctgttgaaatgacattgttttcttaatttatcttttggatagttccctgttagcgtagagaaacacaactaatttttgtatattgattttgtatcctgtaactttactgaatttgttttttatttctaacaggttgttttcaagtgtgaaaaatttaggtcttaccatatataaaatcgtgttatctataaacagtgatattttaacttcttcctttataaattggataccttttgtttaaaaacaatttcttgcctgattgccttaaatacaacttccagtactatgtttaatagaattggcaaaagtatgcacacttttcttattcctgatcatagaagagaagctttcagcttgtcctcattgattatggggtttgtgggcttcttttatatggcctatattatgttgtggtacattcctcctatacataatttgctgagtatttttatcatgaaaagatgttgaattttgtcaatgattttctgtatttattgatataaccatatagtttttgttttccattctgttaatgtggtgtagcacattcattcattgacataggttgaatcatccttgcatctgcatcccagggataaaccccactttatcatagcacatgatcccttcaattagcttttgaaatcagtttactagtattttgttgaggatttttatatgtatatttatcargaatattggcctatatatgtttttttcttgcagtgcccttttctgactttgttatgtgggtaatgctagccttgtaaaacgagtttggtccttagcttttcttttttgggaggttttcggttactgatttaaaggagttgcagttcatcatgttgtagtcactatcactcaggttttatttatatagtttttctgattcccagtaagggttattcttgaaccaatcccatgttttctgattgcatatctttctctgttttatacttttcacattatcatattgcttctcagaagggactacactatgtccatgcatgttttcagacactcctttattctttctctttttctcttttttatatcctaaaatatacaagtttcaaatatataaaataaaaaatgaaattttgtaaaccartgcattcacttatcctctttggctatttttaaaactttaaactgaaattacttcctcaaagaaaatttggaacagttttaattgtttgaacattttgaaaaaaaatgtctagcagtgtagtttgcttcttgaagaagaaaaataaactgaaatattttaaaatgatacttcatgcttttcctttccaagtataagaacacaaaattttggacacagattcttttwtaagttccaggagctttggttgcattagcaacatggtttttgtttatttgtttattttattttgcttaacttggtctccaagggtgctaatatacttatagcaaccacaaggaaaatagagtaatattacttccttggagaggtagttctcattttttacctttttcatcatttaataaactaaagtggggaaaaagtattgtagtacagtatgacgaggaaattagagtagtctttaatatcatagtgactttttcagatagatcttatttttttaagtttttttctcttcttttaagttaatctaattcttggcaatggaaactagtgttcattagccccatctggcttagtcttaacgatttctaagggtgagtggggatgagaattgccattggtgttagagtaatttcagggacaaattaacatattcctgatctataacatatgcaagaattccgtgaactgcagagttcctccaataaaccagtgtccatgtctccaatatcatgtacattacatctctatctctcaaagctgaatagaggtgtaggaggtaaagacaacaaataaagaccctttttaaaattttactcttttatcagccagactaaaatgtaagggaacctatttttgagattgtagttgataattttttaataagtaaaacttagttaaatgaagatcgccagaggatgaatatttttattttgccctcaattctatgtaatgccaagctgcagctcatggccacaaatcatacatgtacatctataataatgataaaaaaaaagccaagttttcttggccacttcatctgtgttgggtgcgatgctaattactttatcaaaatcaggatatttaattctctcaggagtacaaataaacattcttgttttccacaatcttgagttgaagaaactgcttctccaaaatattaattaatttgcccaaggatatacaataataagtagggaagactttgcattcaagctgtgcaaattcagaatctgtcctcttaactattagaataaccatcaagtctgttgaaaaatatagttagcctccaagtcttcccccagctactgcagactgtttctgacagtgctgtctcattggcttaggaaaacgtccttctttatctccaacctctcctgtgctccacactggatgctggtcatcatgagagtgctattccattgggcttagctttcctgggatttccatcagtttaggatgaaacaamccctggaccaggccctcctccttaattcccacattgcacaaaggaaagtggtgcaaaagcttttttgtctgtgtttaaatatcatcaacaatcccaactgagctgtgtttttataccaaatcctactaatttatttacaatttcttcttcagttgactgaaaaacaaaacaaaacaaaacaaactaggcctgtacatttgctgaagtttttgactactgtgatgtccattttcctgtgaaaaatgttcagacaagaacacacatatatatttacttaaaaaaaagcaatcgtatacaggtaaactgaattgttagtgcatactttgtacaaaggaaatattatcttaagaatattattattataatatattggtttracgcatcagctcagaaatctcctacttaaaagcagtgcggccaatgataaactgaaattcccctaagctttggtttcttcatctatccaatgtctgtaaaaactgtggagggatagtgtcatgattaaatgaggcattttatttaaagcctcagtaaaatgccctacactcagtaagccttagttattagaggtactggtagttaaagatagtcatactcaatttacatttagaaaacaaaacagttaagttttcagtcagaatttcgtgttacattgtttttggtttttctccaaaaacaatgaatacttgttttcaatatgatatgctcaactgtgttggttttccagcacaaagggacagtctgcgttagacataaaattaagttccagtcttagatgttaaaaattgttagcattttgaagttctttcaaactattaacaaaaatcttactttcagctagaatatatcttcctcccccaatacatacaaaaacatacacataaatttagacctaatttggatgaaaaataacatccctattgatatttattttctcatgtctctctttttttttctttcaagcatgtaaaaactatcatcctcatatctttctaacatgggtatacaaatacctgtgttgctgtgctgtttaaagataaaatcaaaatggaccaacgtggaccaacacatgtcgttcctaccatgtcgtgattatataacaactattacttattatttttagtgtttgatattttaatgcaagaaacaacgcggtggctcacgcctgtaatcccagcactttgggaggccgaggcgggtggatcacgaggtcaggatatcgagaccatcctggctaacacggtgaaaccccgtctctactaaaaatacaaaaaattagccgggcgtggtggcaggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaagaaacaagggaataaggtttttgctttgtttctgtatacccaatacctaaaacagcatatacttataataattagtaagtatttgttgaatgaatggatgaataatgaatttgttcatttatttttagttttgtcaataatatctgatttttaaataatctacagctaatcaaattaatgggaaacttgcattaaaaaactgtaaagtgtattttatttttaaataccctctcagtgctatgaatttttaatacagtaaccctgaatttgtagtgaaaattgctctctcacaaacacacatatactcatatatacagacatatacctttacgcctaccaatttatacatataaactttgtgaactgcatggaattttttctatgttctcttctaattttggtgttctcctttatttactcactgtgtatgctttgagaatagtttttaatctatgaatttgttagaagtcagttttcattcatgaattagtatgaaattcaaaggttatgacatgcctctgcaataatacttaagtatacttagaaaatatttaaattaggccaggcatggtgsctcacgcctgtaatcccagcactttgggaggctaaggtgagtggatcacgaggtcaggagatcgagaccattgtggctaacagtgaaaccccatctctactaaaaaatacaaaaaattaaccgggcatggtggcacgcacctgtagtcccagctactcaggaggctgaggcaggacaatcagctgaacctgtgagacggaggttgcagtgagccgagattgcgccactgcactccagactgggtgacagagcgagactttgtctcaaaaaaataaataaataaataaattattttgccaacatctgaaaattakgtaatatcattggagtcattgtaaagtctctgatcacagaggctaagtttctgttttataatgacatatatccagtgcctatttgtcgaaagaataaatgactagttaaataagtgaatgaataattaaaagagcaaatgaaaagtactgaaagaaatacactgacacagaaatacatgattgattagaggagctgggaacatcaagttagcaaataaataattttacttcttttcataatttccaagaaaagtataaatcttaaatttaaataagtaagtcatagttaggaacatactgttctatcttgccacctccagaattatagtttgaaaatgactacaactgtgagatatatagctaaatgagctatagaaatagagaagaaattgaatttctctagtttatttactcaaacaaggagtaaatagctttggaaatgaaaactgtcttgaaacagatctattttccatttgggattgttttctaaatcagcttcagttttagcctgtcatttccagattgatattagatttcagttcattagctttacttaataatttgcataatctgggctgagttgaaagttctggggtgtgtgtgtgtgtgtgtgtgtgtgtgtgaatgctttggtatttttaattatcttgtggtgaagtctttctgttgatctcttgatgagaatgtgcagaaagatgttcgattgatataagtatcttgtagggcacataaaacacaaaccagataacaaattcagctaaagtatttcgaaaaagaataaacaatactcaaaaatgatgcagttaaaaacacacctaaaaaacactgtcataataagcatgcctttccttggttccgtactcttgtcttaccacaacacttacaatatagtatgagatcaacatatgtgttgaattttatttaatttcaaagtacttatgattcacaattttaatacacttttgaaagaaaatataattatttgtgactaaggggtgctggtagagacatttaaaaaataaatgggctaatagaccatgttatatgattataatatttaatattgtaaagatgtcacatttccaaaaatttgtgtattgatttaaagaattttaaattaatatcacaatatgtttttgatttgtgtgtgaaaagtgattggcttattctaagattttatatgaaagtacaaagagtcaataaaagccaaaaatctcttgaggtagaacaataatttgaacatatttgccctaccagccagcatgagatttaaggaagtgtggtactggcatacaaattgaggatatagacttcaatatgaatatagataatgaaagagaattaagagccaatatatagatacaagtatatgtagagacttgatagataatagaggtggttcttatgagatgttgggaaagggtaggctttacaataaatgattctagaaatattaaaaaatgtaactagatgcaaatctcaaaaactgtacaaaaacgaattctacataaagatctaaataaagaaacaaaatctatataatattaggaaataaaaaaggtgaatatctttatgaccttgggttaggaaaaaaatttcttaaccagacataagaattattatctataagggggaaaatggtaaattcatctaccttaaaattgaaaaattctgtttagcaagaaatcacaggtgtacagctatgaattatatataactaaaaatctgcagaataccaattactaaatattatcattattctgcatgtctgggagtacagtagatgggccagtggatgttgggtgaggaataaaatgacatagatatttctaaataattatatatttcatgaaatttattttaattacattatatttgcaaaattactarttacattgttgaaataaaattgtaatagcgttaagctttattactaataatgatctaaaggattaaaagcatgattattttccaaattttaaaaaattagctatattttttcatcaaaaatttaaatttcatacagtgaaatttgtttacatatgaaattagtttacacatgtttaaaataatatagtccttaaaatatttcaattatttattcaattaaaaataccaattatgtatttcaaaattttcaataaaaattatcttaataaagctgaacatgcttaatattcttgaagattttattaaatctgattaaatattttcaagtgtaaaatctgtttgcaattcaaatgtttagtgtccatctcattgtcagtgtaaagatatacttcacacatactaccaatagacactcacatgtacataaatttaagattcaggtccattatttaatactgtaagatcattcttagcctgcatcttgggcatactgcacaactttttgaatacctagaaacaacaaattggaacatagaacaaagaataaaagtgcatkctggagcattgctggaaaataatgctgcattatgtaagaatctattgcattattgctacttgaaaggaagatttgactatttggttaatttgtttcttcttttacctaaatgctttatctattcaaacactttatgaacttaraagcagtgtctgactcacacaagtcttgaaggcattcaaaattaactaccttttgtttcgagaagttaaggcaagatatgagaagtatttccctggggcctgttgatgttacttatgagagtggatgtttaaagttaggagttgcactatatcagctgtgaatgtagatcctggttgagaattgcccataatttatctaacaaatattttatgtgagtatttgtgatatgaagggcctcctgatgtgtgaagttatagtttgtattgccctaagatccaggcaagaaatgcttctgcagacctataaagatgactataaactataccttcccctccatcaacacattcctttgtgtttgctggagttgatggggttgtagaatgcattcatattacaatacgatatgtgtttctgtactctcctgccatgagtttgagtgaattttcagagtgggtcgtagaaatattcctggaagccatttctacatcattcattgaaattactgtcaaccacataagtagaactcactaaacctaaacttaatgcattcccaaatttacttcctctaagccagattctgtcaaaaacaacmccttctgtccaatttttgcatgatagatacatcaacattttaaaagctctgaaatattatataaaagattcaaaagataaacccaaatacaaacaagatttcaaaaatttagtcaaactattgataaggcccagaaatgccattttagttgaaatgttctaaattcaaataacacaaaggaaaatttgtagaaataaaaattgatgtatatcaaatatattatctttcatcatctttacttttattggttaaataacagagtactgacattaatgtcatagattatgaaatataatttataaagatgaatgataaaatcaacaaaaagttatctgcaagccaattgtaataaaatatcagactatatcaaagcaggaatttatttggagaaagagttaaatattaacataaataatggatacattttgaatgtttgatagtcagtgacaaggaatgtgacttaggaggacatgagaaaaatatctagatttcttgctaatttgacaccaaacacaaatatcaatgaaataacacaaagaaaaatctgccactctaaggagtcattaatatcaaactagttagagaataatcaattctaaggatgcttaagattagacatagcagaagacagcttcaaatgttctgatatttttcagctcatttatgacagaacttggtagagaggttttatataacattgtgaattataaaatgaagatgaaatatatttttctgcagtatgttataaaataatacatattaaaaataaaaagtaaatagttttcattatttaacaaataagataaatacataacaaaaataaacactaatggaaacaagttttaatcaactattttagaaaaaactcaattgccttttaattatctcagtacaaaatttggaaaatcatttttgaaggaaaagccaagaagaatgctgttgcaaaaatgtaataaaatatactattgaaatctgttgtcaattgtgttctgtctctcactttttaattttattttcagtttcagggtaaatgtgcaggatgtgcagttttggtacataggtaaacatgtgccatggtggtttgtcacacctgtcaacccatcacctaaatattaagcccagcattcattagctattttttctgatgctctccctccccacatccccccttcctgctgataagactcatgtgtcattcccctctctgtgtccatgtattctcattgttcagcttccacttgtgagtgagaacaagtggtgttcggttttctgttcctgccttggtttactaaggatgatggcttccagctccatccatgtcccagcaaaggatgttagctcattcctttgtattgctgcatagtattccatgatgtatatgtaccacattttctttatccagtctatcattgatggcatttgcgttgattccatgtcttttctgttgtgaatagtgctgcaatgaacatatgcatgcatgtgtctttataataggatgatttatatttctttgagtatatacccagtaatgggattgctgggtcaaatagtgttttttgtcctaggtctctgaggaatcgtcacaatgtcttccacaatgtttcaactaatttacatttccatcaactgtgtaaaagcattactatctttccatagcctcgccagcatcttttgtttcttgactttttaatgattgccattctgactggcgtgagacgatatctcattgtagtttagatttgcatttttctaatgatcagtgatattgagcttttcttcatatgttttttggccacatgaacatctttttttgagaagtatctgttcatgtcctttgctcactttttaatgggttcattgatgagatataattaaactaagtatcttctgcacagcaaaataaattattatcagagcaacagacaacctacagaatgggaaaaaatttttgcaacctatccatctgagaaaggtctaatatccagagtctatacgaaacttaaacaaatgtacaagagaaaaaataaatgaccccaatatcataaagcatttcccctatgttttctactagtagttttatatttttggggtcctaaatttaagtctttaatccattttgagctgattttgtatatggtaaaagataagagcttagttttgttcttctgtatgtggatatccagttttcccagtgctgtttattgaagagactgtacttttccaaatgccttatgactttggtttggtcaagaattcaaaagcacagacaacaaaaacaaatcaacaacttaagttacatgaaactagaagacatgggtatccaagtctcttctacagcagtggaaatagtcaagagaataaggagacaacctacagaatgagagtaaatgtctgcaaactgcacttgtgacaaggggttaatatccagaaaatataaggaactcaactgaactcaatagcaaaaaacaaagcaaaacaaaacaatctaattaaaaattgagcaaaggatctggaaagagttttcccaaaagaaacaccatatacaatcatatacaaatcactaacaagtatatgaaaaaatgttcggcatcactaatcatcagggaaattcagtcaaaactacaattagataccacttcacctcagaatggttattatctaaaagacaaaaaatgacaactgctggtatggatgcagagaaaggagaacacttacatactgttactcagaatctaaattagtacagccattatgaaaaacagaatgtaagtctctcaaaaaattagaaatacagctatgggatcatccatcatttccactattgggtatacatccaaaggaaaagaaatcagtgttaaagatatctgcactcccatgtttattgcaacaccattcacaatagccaagatttagaatcaacctaactgtccatcagtggatgaatgggtaaagaaaatgtgttatacatacacagtgggatactattcagccattcaaaaaatgaaatattgtcatttgcaaaatcatgaatgaatctggaagataaagtgaaacaagccagtcacagaaagacaaatactgcatgatctcactcatatgtgaaatctaaagaagttgatctcatagacatagtgtttgccagaggctagggagtgtagaggggaaggaatcaataaagagacgttcgtcaatggctacaaagttacagttagatagacagaataacttctgttctattgcacagacgggtgactatgattaactatattgtattgcacatttcaaaatagctagaagagaggattttgaaagttgtattagtccattctcacactgctataacatccctttactgggtatatacccaaaggattataaatcatgctgctataaagacacatgtacacgtatgtttattgtggcactattcacaatagcaaagacttggaaccaacccaaatgtccaacaatgatagactggattaagaaaatgtggcacatatacaccatggaatactatacagccataaaaaatgatgagttcatgtcctttgtagggacatggatgaagctggaaaccatcattctcagcaaactatcacaaggacaaaaaaccaaacaccgcatgttctcactcatagatgggaattgaacaatgagaacacttggacacaggaaggggaacatcacacaccagggcctgttgtggagtggggggaggcaggagggatagcattaggagatatgcctaatgtaaatgacgagttaatgggtgcagcacaccaacttggcacatgtatacatgtgtaacaaacctgcacattgtgcacatgtatcctaaaacttaaagtataataataaaaaargaaagaaatacctgagactggataatttataaaggaaagaggtttaattgactcacagtttcacatggttgaaaggtctcagaaaactataatcatggcagaaggcaaaggggcagcaaggaccttcttcacatgtcggcaggagagagaagcatgaggagcaargcaggaagaacctcttataaaaccatcagatctcatgataactcactcactatcacaagaacagcatgggagaactgcccccatgatccagttacctcccatcaggtctctccctagacatgtggggattatggggattagaattcaagatgagatttgactggggacacaaagcctaagcatataaaatgttctcaccacaaagaaatgataaatgtataaagtgttggataggctaatactctcattttattattacactatatatgtgtatcaaagcagctcactgtactccataaatatctacaatttgtatgttaattaaataaataaataccaaaaacatggagaaagtttgcaaagtgggaggcaagtgtcagatctcttttctaccaatgtcattttatraaacttttttttatctcttaggctatatgaatgattgcataacatattgagatagtgttgaagttggtttgactttaaacagctgaggtaaaattacatgagttactaccacactatatttttgtgttttgaaagaattactgtagatttctaaaacaacttactaacctactaccagcaggaacttgcatactggaataattagattatttcatgtaagtatttcaaaatgttttataacatctctgaaacgctagactttttgagtttttatagttaattttaataattcagaggtatccaaattataacaaattgtgagactttatctcaattttgttattgtagagaactttaaaaatatttttataagaaaacttaatacataaatataactttaaaaatatattggcatatgccaagaagtgctactcaataaaaaatctctaaaayaaaatgagaaaaccagccacagtccccaaatttggctttaacctttgttttctcattcatgcatctactagtacagcagattcttatatccctgattttcctcccccttcaccatatggctgatcatctgttataggataatacagaatgttccagagtctacaggggagatgtctttgctgtagaacacactgcccaaatctcaacaaacctggacgaaatggctcttcctgtgtaaatcacacttttctctcctaaaaaaaaaaatctaaattcattctactttgttctgttcactagaataaaagcacccttctttctgccaaggtacttggccaatttcaagcttctatgatgtgtatataggctagcatcttattctttctttagcttttctcatgtgattgagagattagttaaaagcccakggaggatgctttcaaaatacaaaacaatctgctgttttgcccataatgaactaaatagcaaatgcttataatacttttacacacgtcagtgtgaaattgagcaagaaacaaaagtctaacccataaaagatttggaatattttcaaattgagtgtatgagcattttcagcaaccaatatatatttgtaagttttggggggttttgtttgagttaggtagaaagcaatcttgagtataatcagtgtaaggacagcatgggaaagcgttttatttatcacccagaattgaatagtcaaacaacaataaaaacaaccaaaatttaaaatgacttctgagcatgtcttaagttggagcattttcacggtggagccgacctttatatgtgatgtcactaggtaagcatatgttgttaattaaattataataaattatttaatgtattcagttttacagacaactgaagaacattcagcagtgaaataaaaagctgtatttaattcactggcgtgaaaattgttgatgtaaaataaaacaaaacataaaagactcatatccacatggaaaattaatggaaaattagcttagaaagggattttgcaatattttagctgtgctaaaaagaagacaaaaacatctcaatatgctgaagaacttttgaaaacttaaatttaagttagaaatcaaaacagtcttgagcaatttgaaggaatgcctactatagctgtattctttatgaatcattgtaaaaataagaaagatataataatactagatatgcattgatatatgttgtaagacatagatatacattrtaaaaatatgatagagataatactagaaataaagtgtcaaattattagaagcattctagaatttttaattgactttataattacaaaaaatgctacttttttcaatgacagttttcaaggaacagagaaccatggacaataaacaatgggggatgttgcatatttccaacgccatttcctctccagaatttatcattattagcagtttgatgatgaccgttttttctccttccattttatctggatccttaaattttcagatggaagaataacaaacaatccattttaagctggtaaaagttaagttgatggcaagcttctctcacttttttcttccagtacaagtttcttgaaattgtcttgctcagaytttagtccttcagatatacatatttttttacctcatgcagtctattcttttcaagagaattaatgacattttaattactaaatgttcagtgctggtttccacctccctttcacatcracacggctgactagtgacctttcttgctttctctccttcattctgcatgataataggctytcttggctttcttcctacttctacctacttatctgtctcttttgctggcttgtccaactctaatatattcttcctttttctttattagtctacccattctccttgagtaatacaatkaatgcctcaggtttccaccaaaatccatgtttataactgctttagaatgcttcattcaaatgcttccatcttgsatgattccaactatccacttttccatgtctagagccaggtggccaagagcttcaagagacaaagcacaacaggcagattgacattgctataaattaatgcttgccaatctcatttgaacctcatcttatctacaaatcctatagatattttgtctattctgatcatgttgactccttgcaattacaatttcaaaccttctccacagtcttcaaacttcctgttcgtgcgttcccctttcatgtttgacagatggccttgtctcttaatttacagattaaaaacaacagcaaacagcaatattctcaataaaatctagcacttataatatattctgcattcttccagttccaatagaggaattgttgttcctcctatccaaagcccatgtttccagcttactctggtcctgatttttggtctcaaaaatcttactttattcattatatttttatatgtcatgtgtgttttactacttaaagtggatccttctcaaaatattttaaacatgcacaagtctccctcacttaaacaaaatttcctttagatgtaagctatctcattgtctttctccttttattttatagtcaaacttcatagaagaaaagatactaccctcatttcctctcttcctgttttatgttttcaattaagtctcgtatctgcctccattcagtgctaccctgcttttaaactcatctccagattttattgattctacttcctagatatctttctcttctgttcacttctctcattttttactatcatcatagttaaagcttccattatccttcaccttaatcacaataacagccctcaactggtgcacctacatccatttttgcttatctgtatttcagtgtctgtagtgcagggtatactaaaatgcaaatttgaacttctcatgcacagacttcagtctcacctctttatgcaccccttgcaccctctgcttaatataagtagatatctcactattttttaacgataaataacatacatttaacatagtttgcaaacaatttcagggtccaatatcctactatacttccatatttttcttgtgccactcttgttctctgggttacagcgaaaaaaatcatttacttccacaagactccaaaaatgctcctactttaggacctctgcttattctctaccctttgtctcagatatctcttctcccaccttacaacttctgttcatcttttatatctcaagcttttcaaatattctgcactcattgaaaattccttgacagcttccagtaatgttttttcatactttcaaacatatgtttgtgttactatttaagtgttttccttcttgaatatgtgagccccaaaaggtcagagactgtttctagttttgttcaccattgtactccctgtgtcaagtacaatacctggcacaaactatttaataaatattaaatgaattaatagatgccaccatgcatttgtgcattggatccaggtttttattgactctcctttcatttatatttcttttttactgttttatttattttttaaagttttatgcaaagcatattcattacagtactatttataatagtcaaacaaaatatatatcaaaaaatatgggaagattaaattgtggtagatttatacttaaagtcataaaatatgcatataaaactattgaaaaaataccagaaaattcgactgtgattatctctggactgtggcrttataagtgcttcttattatttatttttcagctttattaaggtataattggcaaatattttttatatttacagtatataacatgatgtttgatataygtatacattgtaaaatacttactacaatcaagctaataaacatatacattacttcacatagttattattttcatgtgtgtgctgagaagttatgatttctctcttagcaaatttgaaagatacaatacaatatcattaattatagccaccatgctgcacattagatctccagaacttctttatgctacctaaatgaaactttgtacaccttgaccagcattttcccatttcccccacccatgactcccttttaaattttatattgatgtacatatcaaacttttaaaaaatctgtctaaataacattaatatgtagttcaggaaatactctgtcctttaaaagatgccttgttgtatgtactgttcctacacagagtcctgcaacaatttagtcagataacaaattggtgtaatctctctgtacacttactttttgaaatacatcgcaattaattcctttttcttttgggagttcggagatcatagattttggatatttcaacatctttactgattctatcactgtttaaagaatttaactaagtgacctaaacatgctccttcggacagccaacaacaaataagaatttcttgatttgcttcaaaattaaaatcgctattttctctattatagtataatagttatacgtttagtaaatgcttgttgattaatgtctagtaacaaataagttttataaatttaagggtctgttacttactattacgctaagaagatcctcctactactattaaattttctagttggggaaaaaaaagaaaatatgtacattaacagagactaataattacttttgcttttcaaccactatggaggtagtttttaagtttacactcatatcaccaaagtaaaatgatgcttccaggttcaaataactcaatgctaatttcacttaccatacgctatgatacaaagtccaagagcaggacaatctaagttctgatttcacttctctgctattgttttttctaaacccttttatgcgggttggcttcatcttaatagctattagcatgatggttatagtaatctgatatcacacatacacaacaaaagttttcagagggagaaaagagttgccttattttgtgcctctccctaagaacctgggcatggtctcctctctccttaatgagaactgtagcacttgcccgttcttaaaccagtcactggcaaggaaaaggggactgccattttttgtcttgggcaagtcagatcatactccctgggagtgggtaagagatatggtttgtagcacagcatattggaggatattagatatctgcacaaaaatcagtcattgcatagaaaggagcaagtagaggatgttgagtggtcagtcaagaattatttgttatgaccagcatgaattcactcattaattcttcatggaggacctactctcttgtgttttaagtgctgtgatgagtcagtgcatgaatgcacaccaaagggcccagtcaccaccggagggatcaaaaaagactttcccaaaagaagcactgccttgactgagacctaaattctaagtaggagttaaaggaacatagagttgataaagaatgctatagacataaaacacaatgagaaagaagattctgccaagcctgacatttatttcttcagttagtaaaaatatctattgcatgcctaytgtgtgctaggtcagattccagtcttgagattagaatccctgccatttaggatttacagtgagagaaacagtcaatcaacaggtaaataaaaaataatataatgtcaattagtaatgaatgccatgaagaagaagcaggcaaagagccaaagagcaatgggaggtgacactttacatctattcttttcaagcattgacatgcacatgaatcacctggcatattactaatatgtagattttgattcagtaggtctaggataagatctgtgataaattctttatttttaataagctcctgggccatgtcaatgctactagctcataaatcccacttgtgttgtgaggatttagagtgagagttgaacagagacctcagtgaaatgaaagagtgtgctcttgctggggaaggaaattccacaggagagggttayatgcaaaagctcaacatagaaactgacccagaaggtcagtgttgctggacacaatgagtgaggggggaaatggtagtaaactaagtcagaggggtctccagcagtcagatcatgaggaatttataggtcacgttatggattttcaatgacttactgtgatgagaggtccttgcagggrtgaaagtatattggtcggagttctccggggaaacagaaccaatagattgtgtgtgtgtgtgtgtgtgtgtgtgtgtgtgtgtgtgtgtgtgtgtataggtgggtgcgtgtatgtgtgtgtgtgggtgtaggtgggtggagagagaaaaatttattttaagggattgacttgtacaatttcggagactggcaagcccagaatatgcagggtaggctggtagcctaagacccagggaagagttgatgttgcagctccagtgtgaaggcaggcttttggccaaaatttctcttccttggggatgtcagtcatttttctagagccttcaatttattggatgaggctcattcacatcatggagggttatctgttttactcaagtgtactgatttaaaaactaacctcaatttaaaaataaattcacagcaacatccagacatgtttagccaaatatctgagtactgtggcataaaattaaccatcacaaaggacatgtagatatgttgtctcattgtactatctccattcaataaattttgttcacatctataatgtatttgggtgaaactatatgatttctaatattcctttcagttttaraatctcacaattctgtgggatccctatcagataatctcttggaccatgtgcagattgaacaaaattctggttaggaaccacactaatgcccagtgatgttctgagtatccatctgatgtttcctttcccatcaggagatggcaagtcaccagggtcttgtagcaggtcagtccagaatgcacaggatgtgcttcctgagtctgattctcaaccagtagaccagtgacatgagatttggctgtaaaaattaacttgcctcagcattgcagaggcaaggaagtaaaaatttgccctcatgtacagtaagattgaaaaacacgcttcagtgcaggtcttaaccagattctcactgcaatgtatcctaatgggactttctaatgtgatatagaaattttatggcatgggtcaaagtgctgggtaatttctgaaagatagacctaatgtattttgtcacatcaaaagtgatcctaagtctgaacactgattcaaacatttgaaaattttataaccaactacaagtctcagaagagattttcttccctttaaggacactcacagtgatcccccaagagggatatttcatggtgtaccactcattaggtttggtgatcagtcactgttacactaaatcttaaaatgagttgtcacacactatgttctatgtgtggttaagttttacaatgtatctattgggacattttgttagctcctaacaggcaatttatttgtggtatagctgtagctttaaaatctgttttaatcattaggcagtctcttgtttctgaaattttgctatcatttgtctatgtccgcaccctatttcatttactctcattactaattaccatatggaactaaggaagaaaatcagcattaccactttacaagttcatatttgtaatctagctgaatagagagcttatgtttaaaagttgagatcttatttttttttaatgaggctggccgccaacttcagaaaaattctccattccaattagcctrtragagacaaattgttaattccagtttaataatcttattttcctgaggtgtttttgtttttttttttattttttgagacagtctcactccgtcacacaggctgaagtgcagtggcatgatctcagctaactgcaacctctgtctcctaggttcaagtgattcttatacttcagccttccaagtagctggaattacaggcaygcaccaccacacccagctaatttttgtatttttagtagagatggggtttcaccatgttggccaggctggtctcgaactcctgacctctagtgatccacccayctctacctcacaaagtgctgsgattataggtgtgagcctccgtgcccaaccctattttgctgtttgacagaaaatttttgattttgtaactgcctgagatacagttgctccctgtggaggaggaaatagcaactatgtcaagggaataaagactcacagaaagaagcaagtatgagtgacaatattgtggaaaagattgagttgatccagtagcattaaacctagcaggaggaagagtagttgctgaataacaactacatttagattctttagttgaaaaawttagacttattatgatcttactggaaataattttagttgaaattttccattgtaaaataatacatgttcattggaaaaaactgaaacaaagtttaaagttccctagggatttatttcatggaattttgcctaacgaacatactttccctttcccgtaactcttgggagtatctaaaatagacatattaataaagtcatttaatttaaaaagtaataagtaagttttaatcaaatgccaacaatacaatttgtagatggaacctgagtggtcctgwgaccaagctattaaatatccattcctcttccctactgtctttgaaacttgtttctttcttacgcttatttgtaaaaaaaaaaaaaaaattggaaagtgactgctccctctgttcagaccacatggtttgcctcttttgccagarcatcgttctctgttctgactttaagctctcccaaagcctacattagacctatttttgacgaggctgcagcaagggagggaatggctgattctcctgatctgccctatcagtataggggattatttcatttctttccagawtagagggtatacatgagtctcataacttttgtagcttactttagtcatggaaatgatttttcatatattattgtttttctggtaatttctatgcagttttactggtaaagttttctgcatgttattctactgacaacttagcccagagtgatctatttgggaagtttctcaattttgttttagtctgttggcattgctataaaggaatatgtgagagcgtgtaattgataaagaaagaggtttaattagctgataattctgcaggctgtacaagaagcatggcactgatatctgcatttggtgagggcctcaggctgcccccacttgtggaggaaggtgaaggggagcaggcatcacatggtttcagaaagggagagagatgccagcctctttttaacaatccrttctcaaaggaactaatagagcaagagctcagtctttactttgagaagggcaccaggccattcatgaaggttctgcccccatgactcaacacctcccacaaggcccaacctccaacattggacatcaaatttcaacaagagatttttcagtggataaatagctaaactcggtcaaatttgaaagaatatcatttcgactatatcatttagaagtaatagcaatgcagaaaagaagatgaacatggaagctaaaagaattttgataggaaatatcaatttaataaactgcctatcgttcattcctcctccaagaatgtaaatgaattatttcattttgaactttaattttagaaaactatccttaaaaacacttcagaaaataaaaaggtttataggagataaatgttacttttaagttaaaaaatatcacttaaatttataatgatactgtgaactgagacagttcatatcctgattcttccatttcaagttatgtgataccttgatgatactactccatcattaaatatcagtttcctcataaatgaaatatactattagtatctatattataaagttgttttgacaatgaaatgmaataatttgtgtaagattgtaagatgcttaacatatacactgggagctaataagtcctcaagaaatgttgtattattatttttagtatcattgtcaggtaaatgctgacttgatattgaactatattcctatgacaaaataggtaataaagagaggaaagaatgatattaataaatggaataggaagaagatgaaggaatgcaagtatgtaggcaaactaattagattaaaattataatgatattacttgtgggagggaaatggcaggcaattttatacactaagaataaaaaaaggttattgaaatccatatgtaaaggtaaaagactccaaattaatctgtgcttccaagaaaaagcaaactaaatcttatgaagaattgtgtaacatgatattgaatcctcttttccaccccaactttaagtcttttcctgtcaataagtagcatgtgaaaccattttgccccatttctgctcctttataagtacattttctgagggataaaaaggttatctatatggagggaatttatataaaataagcctttatctttttctagaattaataattggagacacatggctgggcgtggtggctcatgcctgtaatcctggcactttggggggacgaggtgggtggatcacaaggtaggagtttgagaccagcctggccaacatgatgaaacctgtctctaccaaaaatatagaaaattagccgggtgtggtggcacgcacctgtaatcccagctactcaggaggctgaggcaggagaattgcttgaacctgggaggcggaggttgcagtgagccaagatcacaccactgtactccagcctgggtgacagaaggagactccatctcaaaaaaaaaaaaaaaattggagatatacaaggatattacttcagcagtagaaggaagagaagagcactctttgaaatgaggaaatatttgcagtacttttgaaatattactaatatattccacttgatatatatatatatatatacatatatatataacgtgagtgcaaactgaagctctacatgtgaaataatgatatctccttattatataagatgctgattataagcaccgacacctaataatcccttaagaagtgtcctgccaagagtcttattgacgcactacccaagaagcagggatggatccgaaactacttgagtcctcttctactcatcagttgttaatttcgtaggaaatatattacctaatcactcagaaacatacttccaattcactttttacttctttttattatgcaatttataatagctatgaataaatgaactgttttaaaataatatgctgcatgtaagtttctactgcccatgcaattcaaatatctgtaacttctttaccctgaggagtcacccttccctttcgggctcatctagcatggtctgactatccataactcatctattatgagtacacaatgctcagtctttatcagataccctccaaaaatgtttccagtgattcctggggaaatgcgcacatcctgcaagcatgtctactttgtacttgtattctcttgttccttccctcaactccaggctcctctaatgaccagtttttaccagactataattattttcccatgctacaacttctctgtcttcattacttcaaccataagtagagatcgaagcagactctaacattgaacacatttttgtgttttttcttttttcctaaaagactgagaaaaacttcaggaattaaaaaatctacaagaataatgttttaagccaataaccacaacagtagtctaaaacaagcctttattataaaaagtgaactttcttgagagaaaaaaaagatttgtgagttccaaggagccagagtttaaactataagtaataaagcaagaaagaatgcataatttgatttcagaatagtttttgcaccactcaggaagaagatgaaattttaactagttggtaagtgagagatgataccagagattttatgggattccatgctgcctaagcccttcagaaagtcctaatgctcagtcgctctatgggctgcagcatgggaagagaaaagtcatcagaaacactagagagaaaatgcaagaaagggacttgcagggatgtgcatgctatagaaagttaggaggggtaggagggcagggggaaaaaaccttctagaacaagcatggttccctggctttagattacccatagccaagaagtctaaaccaatataactcaagtgcagtccacccatcgcaacttacatgaactgttttattttttaactagttcattatcagaatgtgtcagaatataggtcaatgcaccagttaatttgtgaaaaaagtcttgctatcaggtaaagtagatggtatagtaagtgctgtacttaatttacattctggcacaagtttctcagcctgagggcagcattaaattaaactgtttaaaacaattggacagaagagtgtgagtgaaggcttgctgtaccagctattaaactaagcataaaagccatcatgattaaaacagtatagtactgacacaaaaataatcaaatagatctatggaaaacagtacagaacrtataatcagatccatttggaataggaattttaggtagcattttggataattctagaaaaataatatatttgttttggcaattggctgtctattttggaagaaaaaaatgttagatctgtcatttacatcataacaaaaagtgagttccatttaaaataaagaaccaaaattttgtttcaataacaatataagaaattaaaaaaataaataaataattactaaatgcagtcattcattacatgatagtgtttaagtcaatgatggaacatatatatgacaatgatcccataagattataaaactttatttttactgtaccttttctatgttttcatatgtttaaatgcataaacacttaccctgtgttacagttgcctccagtatttagtacagcaacatgctatgcaggttttagcctagaagcaacaggctataccatccaggtttgtgtaagtacacactatgatgtttgcacaatgacaaaatcacctaacaacatatttctcagaatgtattcccaccattaagtgatgcatggctgttattttgtttttaaagaaaagaaaataaagtactggtgaggatgtcgagaaactgaaacccttgggtattgccagtgggaatgaaaaatagtacagccactgtaaaaagcatcatagattactrtctgatcagaaatcttacttctaggtatatgattgatcattgaataattcaggggttaggattgctgacccgtgtgcagtcgaaaatctgcatttaactttcaactccctcaaaacttagctacacatactcactgttgactggaatctttactcatagcagccatttaacacagattttgtatgttgtatgtattatatactgtgttcttaaagaaagctagagaaaagaaaatgttattaaaataataagaaagaacatatatgtactattcattaaatggaaatggactatcaaaagtcttcatctttgttgtcttcaggttgagtaggctaaggaggaggacaaagatgaggagctggtcttgctgtctctgggagaagatgaggaagtggaaggggaggcaggagggacaggaatggtcagtgtaagttttattgaaaatatctgcatataagtggactcatgcagttcagacccatgttgttcaagggccaactgtgtgagcaaaataattgaaagccaggacacaaaaagatatttgcacaccaatgttcacagcagcattatgtacaatatccaaaagattatcaccgcccaaatgctcttcacgggatgaatggttaaacaaaatatggcttatcatacaatggtctattattcagcttttaaaaagaataaaattctgattgcttcaacatgaataaacattgaagacattatgctaagtgaaataagccagacacaaaaggacaaatattgtctgattctactaataagacacacctagaatagttaaatccrtagaggcagaaaatagaatagtggtcaccaggatctggggaggggagaatggaaagttgttgcttaatgggtacagagttttagtttaggatgatgaaaaagttctgaagaggaatagaaatgatggttgtgaaacaatgtgaatgcacttaataccactgaattgtacacatccaaatgacttgcatgataaattttgtgttacgtatattttacctcaatagtcaaaagaaaatataagtttaacactttttaaaagtgaagaaattatattaaatgaaatacaaatctagaatttacaacacagtgatttcatttatggcgttgagtatatcaataattctttcctttttagagctgagtagtatgccatgatatgaatgtaccaaaatttgttcatacacctgttgaaagacatttggattgtttacagtttgtgtgattataatagagctattacaaacattgacatacaattgttttgtgtgatcaacatttttcactccctaaggtctctctaatcccaggagaggggtttctgggcttatgataaacatcttccctgcatrtctctagagaggctatttggccaaggcttaactacagctgatctaagttttggtaaaatgctmtgagatattcctggaacatgagagtgtgggaggctttgaagagcctaccccctctacctatcttccaaggaggcygccatgagacagttactcatcacttcatgggttttgaagaggcctgaggctctctgcctctctgttatttgggcacaactgcaaagtataaagctgcttatctgcaagatgcaattggatctgcagcagcaggttgctcccactactgatgatacatcatcacattactcgctatttttgtttcagtgtcatcctttgagataaggggcttgggtatctggcatttttgctcattttattttgctaagtaataaactgtctaaatataacataaacttttttttttaaccagtcaaatgtgtcaggctttgattgctagaactttggcttgttttcgtttttcagcaattatgaatggagctgtgtttatattcatgtacatatctttctgtgaacataaattttatttttctaaagtaaattcccaggaatagtattgctgaggcatatgggaagtgtaaacaagagagtgcccaacagcaatgtaggagtgttctagtcactgcacattctcaccagccttttgatattatcatgaatttttaaattgagttgtttgttttctttttattgagtttcgagagtgctttatatattctggatacaagttctgtgttagacatgtggtttgaaaatattttctccaattttgaagtttagcttttcattttcctaatagtgtcttttgtaaagcaaaagttttacattttgacaaaatctaactgatctgtttttaaattattgattgtgcttttgctattatctctaagaactcttagactaacaccaagttgtaaaggtttttttgttttgttttgttttttccattttttgagacagggtctcaatttgatgcctaggctggagtggggtggtacaatcaaagctcattccagacacgacgtcttgggctcaagagatcctcccacctcagcctcccaagtakctgggactaccagtgcatgccaccacacccagctaatttttaaaaaatttgtagagatgggttttcactatgttacccaggctggtcttgaacttctgggctcaagcagtcctcacacattggcctgccaaagtgctaggattacagacatgagccaccacccctggctgattttttcaaaaagttccatggcttttcatttcatatttacatcataatgttttttgagttaaattttggataaagtgaggtttaggtcaggttgttgttgttgttgttttgtttgtgttttttgtttgttttttgagatggagtcttgctctgttgcctaggctggagtgcagtggcgtgatctaggctcaccacaacttctgcctcccaggttcaaatgatccttctgcctcagcctcctgagtagctgggattacagtcatgtgccactatgcccagctaatttttcttagtagagacgggatttcaccatgttggccaggctggtctcaaactccaggtcaggttgttttaactgcatataaatgttcaggttttccaacatcatttgttgcaaagactgtcttttccccattggattattttgcacagaattcacttggccatatatttctagactatcttctgctttattgatcagctgatctataccacattgtcttgataacagtagctttacagtaaattttaaatttaggtagggtgattcctccaattttattcttctttttcaaaaccctttcagctatgataattcctttgaatttccatattaatcttcaaattggcttatctatatctataaagttctgctgggattttgtttggaatttcaataaatctaaatttgggaagaaatggcattttactatgttgagtctttcaatctatgaacatcatatgtctcaatttatttggccctttgatatcttttaatcagcatttgttgttttctgcatacagattctgcacattttgccagatttataccaaatttttgaggtgttgtaaatggtatttcttttaaactttcagtttatagttacattcatattgtgcagaaataaaattgttttgttgtatgttgatcttgtatcctgttgatgcagggcaggtgagccccaaaattggggcttagtccagaagggttcttgactttgctcagaagataattcaagagtgagctagtggtgaaagaaagcctatttattgaaktgtcagtgtaccgcagaatgacagctccttgtggagcagcactaacccagagcctgagcatccacagtagcagcatgtggactattggctagyagtatttatacccacttttaattacatgcatgttaaggagtgggttactcagaactctctagaaaayggccagtaacttctgggtgttgytgggcatttgtaaactgtcagggcactggtgggagtgtcttatgctgatgagcagtggggacacctagaggttggttctgttgtcatctactgattcttgctggtttcttcacttcatcctgttgagaccaggaataagtcctgctggtctcctacctcactataaccttgctrcactccattgggttgacgagtcttttgtggatttcttgggatttctatgtagatgatcatatcacttgtaaatagggacagttatatttcttcattttaagtttttatttcttatattttaaaattgttattgtagtagttagaatttctagcacaagattgaatgggagaagttagagtgaacrtccttgccttgttcccartcttaagagaaaagccaatattcttttatcattaagtatgatattagtcacaggtttttcttagatgttcttcaccaggttgaggatgttccttaccattcctactttgctgagaatttctatmatgaatgaacactgaattttacatatttttcctgaaaaaaagaaataattattacatttttcattagactattaatacagatttcattgatgccaaaatattggccagacttgtacccctagaataaatcccatttggttgtggtacagacwtacatacacacatgctaatatatgatgtttatatttttttatcctcttcctcctctcctccgccttttccccctttcttcccctcctccccctcctccccctcctctccctcctctcattcctctccttcctcctccttcatcttcatttttatactatctttggctttgatatcagtgtaatgctggtctcataaaatgaaatggaaagtgttacctcttctattttttggaggagattttgtagagttggcattacttctaaatgtttggtagaaactaacaatgacatcatcaccaaagatgacatttttgagaagatttaaattatgaattcaagtcccttcatggttttaaaaatattcagagyatatatttcttcttaattgaattttggtaatctgtgtctttaaagtrtttggttctttttatttaagaagtaaaattatggccataaaattgttctagttttctctcagtatcctcttaatgcctatgatgctatggtgataattccctatttcattcatattattgtaatttggctttctcctttttttctttgacaatcttgctagagtcttatcaattttagtggcatttaaaagacttttcagttttattgctgcaataataagttacagtcttagttgtttaaaataatacacatttattatcttacagttctgcagtctagaagtctagttacacaggactaaatcaaggtgtcagcaaggctgtgttccttcctagagactgtaggggggaatctatttccttttcccacttttgtgtgctccttggctcttggcctctttcctccatcatccaaaccaacaatggctggttgagttctcacaactcatcacgctgacctactcttctgcctctctctttcacctgtgatgactatggatccatccagataattcaggataagctccctatctttaggtccttagcttaatcacatctgcaaatccatttttgccatgtaaggtaacatattcacaggtcctgaggatgacaatctgggtatctttggagccattattctgcctactaaagtatctacaggtatttaatattatattaagaggctttgtttaccttctatggagaatgcttatattgttgttttatcaggcaatcaacatgcttaagttcagttgataattacatctagcatcctattgtctgtggttccaatgtcagttcaatttttaaagcatttgctgtgttattccaatgtgtccaatgttagtggttattagtctctgacctgagaggtggtctgttccttcgattaggctgattacattcagatccacataagcatggtttggagttgatgccaggggttcacaatcaacattgcagtgtcattttccctagcacttctttctccctcatcttcctacttctgatggttccctggccctggccggatctccagccaaaaagctggggctttagttacctggttctgctaaggactttcacaactgatgccaagtggcagtgtaattgcccaatgggtttatcttgtctgctgcccagaaaagctgctctactgagacagtgttattgcaatagagagtttaataaacatagagctagctaaacaagagaccagagttttattactcaagtcagcctccctgaaaatttggaggctcagtttttttttttttcttttttgagacagagtctccttctgtcgcccaggctgcagtacagtggcaygatctcggctcactgcaacctctgcctcccaggttcaagtgattctcctgcctatacttcccaagcagctgggactacaggtgcatgccgccacacctgacaatttttttttgtatttttagtagagacaaggtttcaccgtgttagccaggatggtctcaatctcctgaacccgtgatccgcctgcctcagcctctgaaagtgttgggattacaggcatgagccactgcacccagccagaggctcggatttttaagagtagtttggcagacacagggctaggggatggggaatgctgattagttgggtcagggatgaaattataggcagtcaaagcttatcttcttgcatggagtcagttcctgggggccgtgagatcaggtaagttggtttaccagtctgggtggcaccacctggtccatcagaaggcagggcctaaaaaatacctcaaaaatcaaccttaagttttacaataataatgttattcacaggaacagagaagttaggaatcttgtggcctctggctgcatgatttctgagaaataatttctaatcttgtggctactttgttagttttacaaaggaagtctgatctccaagcaatgaggggttttgtccaagaaggagctgttatcatctttgttccaaagttaggccataaactaagtttctcccgtagttagctaggcccacacccaggaatgtgcaagggcagcttgggggttagaagcaagatggagtcacttaggtcagatttatttcactgtcataatttttgtaaaggcaatttcaccaggaagacacaagagaaataaaagtaatataggttcatcccaccctcttggggtcacagatttattatcattactaggtttcaggctgccttgacaaaaagtctaatggaaaaaatacagtacacgaaataatataaatgggatatgaatagaatataaagaatgccaattgcacataaatatactaatatgaaatttctcaatgctactgaagttgaaaataaaaatatagaagaaatgtaactatcatacaaacccatcaggcaattacactgccacttggcctcagttgtgaaagtccttagcaaaactaggtaaccaaaggctttttggctggagaactggccagggaaccattcagaaataggaagatgagggagaagaaagtgctggggaaaatgagatgagagtgagtgagatgtgagtgcagttcaaatttggaagcagaatcagaaattttaaactatcctgtggaccatgcttatagataacatccttgaaagcatgaagagtttggccctgtcgggatgcttaggaagtaggagttagcatttgctttatgacatggtaaaaggattgaaagtttttggattggctagcagccaaaatttttatattttaatttttgagtagtttcttataaaartggataatcccaattttaactcacataattatgtatctaggagtccaaaaaatcagtcttgtcttaaagtcttsaaatacttaaaactacttgaaatacttaaaactaaaaatacttaatacttaacatacttaaaaacctttaaaaacttaaaactaatgatgaaaatattattttcattaattacccttatgttttacrcttgattaacaaattgcttcgaatctagaccatttttatatagcatctgaaagatacgtttttatttcctaacttgttttcttgccttctaaaacaggtctctcttatttctctctggtgttatattcatttgtctgtctcaatctctktatcccagctctccttatccataaaatggggataattataataacatttaccttattgtgttgttacatgattaaataaaatgacacgtgtcaagcataaaaagtgtcttgcacatagtaactgttcactaaatatttgttatagctacttacgtgatcatcttgtcttaactcacacaactamaactaccactattaatcattattgcaatcaagcattggttagatttacttaaagactatcacaygaaggcaattgccttcactatgtgaaggcatagtctttaagtgtatgtgagtgtatgtgtgtgtatgtgtgtgtacacgtgctattgaatccactcaaaagctatagatgatatctactattgttaagttccatttatattggaggcaactgagatatggaragaacaaatacctggcycatgatcacaattttggcaacygctaaaaccggaaaaatgtttgtagtcttatgttactttatcttcaaaaaagttagacttgtgtcwtgaagagtgagttggggttaaagtaattggrttaatcagaaatctttacaaatctatttcagcaacatttacttgaaaaagaagaaataataagttggagcaaagtaacatctctagcttgtgaggaaatgaggcagcattttaaatattgctacaacagggtctaaagtttagcacaattttcttctattgctagttcttcyttgagatgttatatcaatggagcaagatttttcttttaagtgtaaatattctagggaacattttcttacctattgtaaaatgcaatttcttgttatattctgtgatgttctttgatatcatccttatcttcttattcactgtgaaatgaatacaacgttatttctgaaaaagctgaaatgtaaaatgcttagtgttttgctgtatggtgaccccttaacatcagtatagtaaagtgaggtctaaagccttactatattatacaagggaaacagaacaacaaactgatatttatatagattagatttgctttcagtttacaggttatttctccmagctatatttatgttagtactccaaacaaagtgtttttattttctggaaaaaataccaaaactcttctagcatgtgacttaaacataactgcaaaatatcaaatgagaaaataaatttaaattacatgagtttctaaaaatggcttgtccttttcacatatttggctgggattttttagacaattatctggggtaagtggggatgttaactgctttcattactctctaaactgcagaatggaagttaggaatgatagaagatttcactttttgaaggtcagttaaaaaaataattattgaaacaattacctcaaaaaaaattatgaacttagactaagatctctgatggagaatatgataacttaattttattccccagtaggcaatctgaaaatcaaagccaatattatgttctattgataaatgaaacccattttgaagttagaattttcagtattttactgtcatttgtccatccagtatgtgcattttcatgtagaagatcaaaagaaatgcatgtattcttgctagaaaaatgtctgattaatattctttattatgtggtattattttaaaagatatattgccggactttgagtcattaaatggtttttctaagatgatggtgttctccagaatccagattttctggatgagtgccctttggtaatgcagtagttactaccttttgctgaaggttataatttatagaaggcaaaaaatcatagcctttcctggaattgaaaaagctttccaaaggcactcatttgaaatattttactaacattatttatgaagctaaaattaacaataaaaaagcatttttaatttcaagtattgaaatgccaaaaatcaaacaattggaaaacaaaatgacaatttgtttcatgtaattttgaccacattataatgtctgtaaaggatccagcaccgtgcctgtggtatttgacgtgttcgttcccttactcttctcccatcttgtttctttgttggttggcatctacatacattacagatttccartcagcaccaagaaacaccaaaaaatggataatgcagttttcagtgatttttcccgtaatctgtggattcagcactcaatgtagatgaatgtccccccagcacctttamtttstaatttatgtccctcatctctcattttgctcggcattttttcctcatttttttaagcattctcaytttattgggcatatattttctaggatttttacatttgctttttttatataattactccaatgggtgtcattatttcttcattactttctaatgactaaaatttctaattctaactttttaaaaatgtgaactagtaaatctttcaaaaagaaagagacatatggatttactcttagccaatctcatctgattattgtgggttctgccaaatatgaggaatataaaagcagattaaatgagagtagatcaaaaggtcattaaagtttaattttatttatttatttattttttaattttattattattacactttaagttttagggtacatgtggacaatatgcaggtttgttacatatgtatacatgtgccatgttggtgtgctgcacccattaactcgtcatttaacatcagatatatctcctaatgctatcccaccccccttcccccaccccacaacagtccttgaagtgtgatgttccccttcctgtgtccgtgtgttctcattgttcaattcccacctatgagtgagaacatgcagtgtttggttttttgtccttgcgagagtttgctgagaatgatggtttccagtttcatccatgtccctacaaaggacatgaactcatcattttttatggctacatagtattccatggtgtatatgtgccacattttcttaatcmagtctatcgctgttggacatttgggttggttccaagtctttgctattgtgaatagtgccgcaataaacatatgtgtgcatgtgtctttatagcagcatgatttataatcctttgggtatatacccagtaatgggatggctgggtcaaatgatatttctagttctagatccctgtggaatcactacactgacttccacaatggttgaactagtttacagtcccaccaacagtgtaaaagtgttcctatttctccacatcctctccrgcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtatctgctcatatccttcgcccactttttgatggggttgtttgtttttctcttgtaaatttgtttgagttcattgtagattctggatattagccctttgtcagatgagtaggttgcgaaaatattctcctattttgtaggttgcctgttcactctgatggtagcttcttttgctgtgcagaagctctttagtttaattrgaycccatttgtcaattttggcttttgttgccattgcttttggtgttttagacatgaagtmcttgcccatgcctatgtcctgaatggtaytgcctaggttttcttctaggatttttatggttttaggtctaacatgttaagtctttaatccatcttgaattaatttttgtataaggtgtaaggaagggatccagttttagctttctacatatcgctagccagttttcccagcaccatttattaaatagggaatgctttccccattgcttgtttttttcaggtttgtcaaagatcagakggttgtagatatgtggcattatttctgagggctctgttctgttccattgatctatatctctgttttggtaccagtaccatgctgttttggttactgtagccttgkagtatagtctgaagtcaggtagygtgatgcctccagctttcttcttttggcttaggattgacttggcgatgcgggctcttttttggttccatatgamctttaaagtagttttttccaattctgtgaagaaagtcattggtagcttgatgaggatggcatggaatctataaattacctggccagtatggccattttcacgatattgattcttcctacccatgagcatggaatattcttccatttgtttgtatcctcttttatttcattgagcagtggtttgtagttctccttgaagaggcccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacratggggttttctagatatacaataatgtcatctgcaaasagggacaatttgacttcctcttttcctaattgaataccctttatttccttctgctgcctgattgccctggccagaacttccaacactatgttgaataggagtggtgagagagggcatccctgtcttgtgccagttttcaaagggaatgcttccagattttgcccattcagtatgatattggctgtgggtttgtcatagatagctcttattatttttagatacgtcccatcaatacgtaatttattgagagtttttagcatgwagggtttttgrattttgtcaaaggccttttctgcatctattgagataatcatgtgktttttgtctttggttctgtttatatgctggattacatttattgatttgtgaatgttaaaccagccttgcatcccagggatgaagcccacttgatcatggtggataaactttttgatgtgctgctggattcggtttgccagtattttattgaggatttttgcatcaatgttcatcaaggatattggtctaaaattaccttttttggttgtgtctctgccaggctttggtatcaggatgatgctggcctcataaaatgagttagggaggattccctctttttctattggttggaatagtttcagaaggaatggtaccagctcctctttgtatctttggtagaaatccgctgtgaatccatctggtcctggactttttttggtttgtargctattgattattgccacagtttcagagcctgttattagtctattcagagattcaactttttcctggtttagtcttgggagggtgtatgtgtcaaggaatttatccatttcttctagattttctagtttatttgcttagaggtgttaatagtattctctgatggtagtttgtatttctgtgggattggtagtgatatcscctttatcattttttattgcatctatttgattcttctctcttttcttccttcttagycttgatagcggtctatcaattttgttgatcttttcaaaaaaccagctcctggattcattaattttttgaaagtttttttatgtgtctatttccttcagttctgctctgattttagttatttcttgccttctgctagcttttgaatgtgtttgctcttgcttttctagttcttttaattgtgatgttagggtgtcaattttggatctttcctgctttctyttgtgggcatttagtgctataaattttcctctacacactgctttgaacgtgtcccagagattctggtatgttgtgtctttgttctcgttggtttcaaagaacatctttatttctgccttcattttgttatgtacccagtagtcattcaggagcargttgttccgtttccatgtagttgagcagttttgagtgagtttcttaatcctgccttctagtttgattgcactgtggtttgagagacagtttgttataatttctgttcttttacatttgctgaggagtrctttacttccaactatgtggtcaattttggaataggtgtggtgtggtgctgaaaaaaaatgtatattctgttgatttggggtggagagttctgtagatgtctattaggtctgcttggtgcagagctgagttcaattcctgggtatccttgttaactttctgtctcrttaatctgtctaatgttgacagtggggtgttaatgtctcccattattattgtgtgggagtctaagtctctttgtaggtcactmaggacttgctttatgaatctggktgctcctgtattgggtgcatgtatatttaggatagttagctcttcttgttgaattgattcctttaccattatgtaatggccttctttgtctcttttgatctttgttggtttagtctgttttatcagagactaggattgcgacccctgccttttyttgttttccatttgcttggtagatcttcctccatccttttattttgagcccatgcgtgtctctgcaygtgagatgggtttcctgaatacagcacactgatgggtcttgactctttatccaatttgccagtctgtgtcttttaattggagcatttagcccatttacatttaaagttaagtgttatgtgtgaatttggtcctgttcattatgatgttagctggttattttgctcgttagttgatgcagtttcttcctagccttgatggtctttacattttggtatgtttttgcagtggctggtaccggttgttgctttccatgtttagtgcttccttcaggagctcttttagggcaggcctggtggtgacaaaatctctcagcatttgcttgtctgtaaagtrttttatttmtccttcacttatgaagcttagtttggctggatatgaaattctgggttgaaaattcttttctttaagaatgtgaaatgttggcccccactctcttctggcttgtrgagtttttgccaagagatctactgttagtctgatggctttccctttgtgggtaacccaacctttctctctggctgcccttaccattttttccttcatttcaactttggtgaatctgacaattatgtgtcttggagttgctcttctcgaggagtatctttgtggtgttctctgtatttcctgaatctgaatgttggcctgccttgctagactggggaagttctcctggataatatcctgcagagtgttttccaacttggttctattctccccgtcattttcaggtacaccaatcagatatagatttggtcttttcacatagtcccatatttcttggaggctttgttcgtttcttcttattcttttttctctaaacttcccttctgacttcatttcattcatttcatcttgcatcactgataccctttcttccagttgatcgcatcggctcctgaggcttctgcattcttcacgtagttcttgagccttggctttcagctccatcagctcctttaaggacttctctgcattggttattctagttatccatttgtctaatcttttttcaaagtttctaacttctttgccattggtttgaatttcctcctgtagctcggagtagtttgatcgcctgaagccttcttctctcaactcatcaatgtcattctccgtccagctttgttccgttgctggtgaggagctgtgttcctttggaggaggagaggtgctctgctttttagagtttccggtttttctgctctgttttttccccatctttgtgkttttatctacttttggtctttgatgatggyaacgtacagatgggtttttggtgtggatgtcctttctgtttgttagttttccttctaacagacaggaccctcagatgcaggtttgttggagwtkgctagaggtccactccagaccctttttgcctgggtgtcagccgtggtggctgcagaacagcagtggctgtagaacagcggattttggtgacccgcaaatgctgctgcctgatcgttcctctggaagctttgtcccagaggaatacccggccgtgtgaggtgtcagtctgcccctactggggggcgcctcccagttaggctgctcgggggtcagacacccacttaaggaggcagtctgcctgttctcagatctccagctgcgtgctgggagaaccattactctcttcaaagctgtcagacagggacatttaagtctgcagaggttactgctgtctttttgtttgtctatgccctgcccccagaggtggagcctacagaggcaggcaggcctccttgagctgtggtgggctccacccagttcgagcttccccgctgctttgtttacctaatcaagcctgggcaatgacaggcgcccctcccccagcctccctgtggccttgcagtttgatctcagactgccgtgctagcaatcagtgagactctgtgggcataggaccctctgagccatatgcgggatataatctcctggtgtgctgttttttaagcccattggaaaagtgcagtattagggtgggagtgacctgattttccacgtgacgtctgtcacccctttctttgactaggaaagggaaccccctgaccccttgcgcttcccgagtgaggcagtgcctcaccctgctttggctcgtgcatggtgcactgcacccactgtcctgcacccactgtctggcactccctagtgagatgaacccagtacctcagatggaaatgcagaaatcacccatcttctgcgtcactcacgctgggagctgtagaccggagctgttcctattcggccatcttggctccaccacaagtttaattttagttgtctttcattcttattgtgttgaggaagtaggggaataaagctattttttttctattcatcaatgcaactttctttggtgcaaacaatatgagaaaaaacttgcttgtttcatataagtgaatctgttttatgttgtaatctattaacatagaattcagcctttaggttttaaaagtaaaatgccaagcaatttgtactgctccaaaatatatttacagttattttaattgagaatattttatgtaggttttatttaaaaagcttgaggtcaagagcttttgaagaactttaggaaaaaaaaacctaakccatattatacagccatccctcggtatccatggggggttggttccaggaccttctgcagatgccaaaatccatggatgttcaagttccttatataaaatagtgtactattggcatataacctatgcatatctccctgtatactttaaattgctacagggttacttataataactaatatactgtaaatgctgtgtaaatagttatactatattttttaggaaatagttacaagaaaaatgtctgtacgtgttcaatacagaagcagccatggatgcagaaccccaggagaaagagggttgactgtataggttttcaaacaatgtactattaatattttacatactattycagtagtttcagtgtgaataattatggaaaggatggattaagtaaatgtaattctttttctgcaagagtttctattttagatagcactgaacaagtctaaacmtctttctcttatattttgctttaccaaaattctccagaaatcagaagtctagccttatttctaatctggcaaatacacagcygtgaatctactctttgtatacattagaytgccatccacccaaatgttatctatttccagctacatgtatatwgaacatttgcacacagtgtttttatattctggaaaaatataagaatgttttgaaagcatacaatggatatgtctgcaagagagtaaacgaagaaaaataaattcaagatcagactttctaaaagcaatctgttctttacaaatgtttgcattatgtaattcacacaaataactggaattggaagagttcttaattatttagtcttggaatagcaaagcaatatttagaacttttgcttaaaaattacttcgtatttgcaaggctaatttcaaaataaattgaaaatgtaattttattaattttaccttgctaaatttgtacaaatgracttcctttcccttttctccagagaaatttttatttattccttatatttcaatttaagcattatttcttcaggaaagcaacttaccagtcttgaacagatcaatctatcataacatttttatctttcttttctgtcaattgtcacattacaattttactttcttgtattagacagcaagcaccatsagaaaagcaaccattagtgttgattttttaaaattattttaaaatgattaaatattttgtaaagacagggtcttgctgtgttgctaagtctggtctcaaactcctggcctcaaacaatgctcccaccttggcctcccaggtgttgagactacaggtgtgagcyatggcacccaaccctaatatttattaattactctgttttttgtgcctggcttggtgccagagaagtacatagtaggaactcacttacagttattaataaatgagaaaaatggaataaaatcttgatataaacatcacattgttggaatttatacaaaaacatctacttagagaaacagacatgtttggagggaacaaataataacaaatgtttatttagcacttattgtgtgccaggccctaatctaatctctttaattatatttaytcaactgataaacaagaaactgtacacaggaaagttgagtaactcatttmatgtcgtagagctagtcagatgagggtgccccaggatttaaacctacataatctggctccagatttgatgcttttaactactaccctattctcaagtttcaaacaagaatagtgaagtggttaaaagcatataatctggagtcagatgggtagtgtatagttacaaaagtcactaaagattggtcattttgatcatcgtaagagcttgargccctaaggaaaatttgacagattttattttgtcagcatttaaaacttgatatgaagaagataacataaacattaagtgaaaagataagctgcagacacagagaaaataccatgcatayagcacatatggtgtttaaagtgtttcaggttttatatacaaaatattacaaatcaataaaaaaatttcactagaaaagtaggcaaatctgaaatagaaaatgaatatattaagaaatgccctgatttatataaataaacatatatatgctcaactgtactaataatcaaagaaaaattgattatattacaaagatatcatttttcctgacagtcacattgagcccattttggctcgcattaatttcaccttcaaatatctaaagtggagatataattgcaaaagctatgtgaacaataatatttattggaatactgttttaatagcccaagctggcaataacataaatgctatcaatatgagaaactgataacagagtatggttctgagacattaagaagcttgcctgaggttataaaggattgtgatattcaatgacacattcatgtgattttataggaatgaaataaaaaggctttgtgatttaatgggaagaatattaattcttatttcagttgtaatacagattttctttgaggtattgaccagcttctacttctaaaaacctgtgatttgatttttttgttgacattttataaacagcccttatatatgatctaatagtccttcataacctagtgtaacatattgatgaactcgtttattgttgaggtaaaaatgaatctattttgtgatttttatttttccctccagtgacctaatttaaaccatttatataattactattttgatttattagccggatattcctctgaaatagtctattatgctatatctaatgtgtaacatacatgctatgtaaaaagttatattaccatttttatttgcttcatttttcatttgcttaattattttatttatcataaggaatctttgagatcacaagtcagagaatctgaaaaccaaaatctacagaaatatgcacatgctaacctctgtatcataatcctcaggtaacaactactctctacaaaatttgtgattaaaattcaaatctttattttttatcatgctaacctatcagcttttttaatgtgtgttcttcatagggtcattgttgtgatgatgtaaatagtatcctttttttaagaaaaagattagaaaatatmaatttataatctcattatacaaatacaaatagtactatttgatatattgtactttatgaagtatttctttataagtattttatcttataawgttataattagattacaaccattatattaaaaatgtgtatcatgaggaatagaagatggctgaataggaacagctccggtcttcagctcccagggagatcaatgcagaaggtgggtgatttctgcatttccaactgaggtacctgactcatctcattgggactggttacacagtgggtgcagcccatggagggtgacccgaagcagggtggggcatcacctcacccgggaagtgtaaggggtcaggtaactccctcccctagccaagggaagccatgagggactgtgccttgaggaacagtgcactctggcccatatactttgcttttcccatggtctttgcaacctacagatcaggagattcctttgggtgcctacactcccagggccctagatttcaagcacgaaactgggcagctgtttgggcagacactgacctagctgcaggagtttttttcatacctcagtggtacctggaatgctagcaagacagaaccatttactccgctggaaagggggctgaagccagggagtcaagtggtctagctcagcggatcccacccccatggagcccaacaagctccatggcttgaaattctcgctgtcagcacaggagtctgaagttgacctgggatgctccagcttgstgtgggtgagaggcatccaccattactgaggcttgagtaggcagttttcccctcacagtgtaaacaaagccacctggaagttcaaactgggtggggcccaccaaagtgcagcaaagcctctgtagccagactgcctctctagattcctcctttctgggcagggcatctctgaaagaaaggcagaagccacagtcaggggcttataaataaaactctcaactccctgggacagagcacctgggggaaggggcagctgtgagcacagcttcaccagacttaaacgtttctgtctactggctctgaagacagcagtggatctcccagcacagagcttgagctctgctaagrgacagactgcctcctcaagtgggtccctgaacccggtgcctcctgactaggaaacacctcccagcaggggtcaacagacatctyatacaggagagctctggctggcatctggcaggtgcccctctggaataaagcttccagaggaaggagcaggcagcactctttgctgttctgcagcctccactggtgrtacgtaggcaaacggtctggagtggacctccagcaaactccagcagacctgcagaagaggggcctgactgttagaaggaaaactaacaaacagaaagcaatagcatcaacatcaacaaaaaggacacccacgcaaaaaccccatccaaagatcaccaacgtcaaagaccaaaggtagataaatccacaaagatgaggaaaaagcagctcaaaaaggctgaaaattccaaaaaccagaatgtctcttccaaaggatcacaactcctcgccagcaagggaacaaaattagacagagaatgagtttgatgaattgacagaagtaggcttcrgaaggtgggtaataacaaactcctctgagcaaaagaagcatgttctaascaaatgcaaggaagctaagaaccttgataaaagattcccctaggtctccctaggaactgctaactggaataagcagtttagagaagaacataaatgacctgaaggagctgaaaaacacagcatgagaactttgtgaagcatacacaagtatcaatagccaaatccatcaagtggaagaaaggatatcagagattgaagatcaacttaatgaaataaagcataaagacaagattagagaaaaaagaatgaaaaggaattaacaaagcctccaagaaatatgagactatgtgaaaagaccaaacttttttgattggtgtacctgaaagtaacagggagattggaaccaagttggaaaacacgcttcaggatgttatccaggagaacttccccaacctagcaaggcaggccaacattcaaatttaggaaatacagagaacaccacaaagataatccttgagaagagcaaccccaagacacataattgtcagattcaccaaggttgaaatgaaggaaaaaatgttaagagcagccagagagaaacgtsgggttacccataaagagaagcacatcagactaacaggggatctcttggcagaaaccctacaagccagaagagggtgggggctgatattcaacattcttaaagaaaagaattttcaacccaaaattttttatccagccaaactaagcttcataagtgaaggagaaataaaatcctttacagacaagcaaatgctgagagattttgtcaccaccaggtctgccttacaagagctcctgaagaaagcactaaacatggcaaggaaaaactggtaccagccactgcaaaaacatatcaaattgtaaagaccatcggcactgtgaagaagctgcatcaattaatgggcaaaataaccagctagcatcatgatgacaggatcaaattcacatgtaacaataactttaagtgtaaattgactaaatgccccaattaaaagacacagactgacaaattggataaagagtcaagacccataggtgtcctgtattcaggagacttatctcacatgcaaagacaaacaaaggctaaaaatagtgggattgagaaagatttaccaagcaaatagaaagcaaaaaaaaaaaaaaaaaaaaaaaaagcagggattgtagtcctagtctctgataacccagactttaaaccaacaaagataaaaaagacaaagaagggcattacataatggtagagggatcaatgcaacaagaagagttaaatatcttaaatatatgtgcacacaatacaggagcatccagattcataaagcaagttcttagagacctaaaaaaagacttagactccaaaacaataatagtgggagacttttacaccccactgtcatattagacagataaacgagacagaaaattaacaaggatattcaggatgtgaactcagctcaggtccgagcagacctaatagacatctacyraactctccacctcaaatcaacagaatatacattcttctcagcaccaaatcatacttattctaaaattgaccacatmattgaaagtaaaacactcctcagcaaatgcaaataaatggaaataataacaaacagtatctcagaccacagtgcaatcaaattagaactcaggattaagaaactcactcaaaaccgcacaactacatggaarctgaacaacctgctcctgaatgactaytgggtaaataaattaaggcagaaataaataagttctttgaaaccaataagaacaaagacacaacataccagaatctctgggacacagctaaagcagtgtttagagggaaatttatagcactaagtgcccacaggagamagcaggaaagatctaaatttgacgccctaacatcacaatgaaaagaactagagaagcaatagcaaacaaattcaaaagctaacagragacaagaaataactaagatcagagcagaactgaaggagatagagacacaaaaaacctttcaaaaaatcaatgaatccaggagctggttttttgaaaacatcaacaaaacagatagaccactagccagactaataaagaagaaaagagagaagaatcaaatagacacaataaaaaatgataaaggggatatcaccactgatcccacagaaatacaaactaccatcagagaatactatagaaatacaaactaccatcagagaatactataaacacctctatgcaaataaactagaaaatctggaagaaatggataaattcctggacacatacaccctcccaagactaaaccaggaaaaagtcgaatctctgaacagaacaataacaagatctgaaattgaggcagtaattaatagcttaccaaccaaaaaaaagcccaggaccagacagattcacagccaaattctatcagaggtacaaagaagagctggtwccattccttctgaaactatttcaaacaatagaaaagawattatcataaaataactcattttatgaggccagcatcatcctgataccaaaacctggcagaaacacaacaaaaaaaagaaaatttcaggccaatatccgtgatgaacatcgatgtgaaaattctcaataaaatactggaaaactgaatccagcagcacatcaaaaagcttatccaccacaatcaagtcagcttcaccccaggatgcaaggatggttcaacataagcaaatcaataaatggaatccatcacataaacagaaccaatgaaaaaaaaacacatgattatctcaatagatgcaaaaaaggcctttgataaaattcaacaccccttcatgctaaaaactctcaataaattaggtattgatggaacatatctcaaaataataagagctatwtatgacaaactcacagccaatattatactgaatgggtaaaagctggaagcattccctttgaaaaccagcacaggcaaggatgccctctctcactactcctattcaacrtagtattggaagttctggccagggcaatcaggcaagagawagaaataaagtatattcaagtrggaggagaggaggtcaaattgtctctgtttgcagatgacatgattgtatatctagaaaaccctgtcatctcagccccaaaatctccttagrctgataagcaacttcagcagagtctcaggatacaaaatcaatttgcaaaaatctcaagcattcctatacacctataatagacaaacagagagccaaatcatgagagaactcctattcacaattgctagaaagagaataaaatacctagaaatacaagttacaagggatgtgaaggacctcttcaaggagaactacaaaccactgctcaaggaaatcagagacaacacaaacaaacagaaaatcattccatgctcacagacaggaagaatcaatatcttgaaaatggccatactgcccagggtaatttatagattcaatgctattcccattaagcaaccattgacttttttcacagaattagaaaaaactactttaaagttcatatggaaccaaaaaagagcccatatagccaagacaatcctaagcaaaaagaacaaagctggaggcataatgctacctgwcttcaaactacactrcaaggctgcagtaacaaaaacagcatgatactgttaccaaaacagatatatagaccaatggaacagaacagaggcctcagaaatarcaccacacatctacagcyatctgatctttgacaaacctgacacaaacaagcaatggggaaaagattccctatttaataaaagctgttgggaaaactggctagccatgtgcagaaaactgaaactggattccttccttacacctaatacaaacattaactcaagataaattraagacttaaaggtaagacctaaaaccataaaagycctagaagaaaacctaggcagtaccattcaggacataggcatgggcaaggacttcatgactaaaacaccaaagcaatggcaacaaaagccaaaattgacaaatgggatctaattaaactaaagagcttctgcacggygaaagaaactaccatcagaggaaacaggcaacctacagaatgggagaaaatttttgcaatctatccatttgacaaagggctaatatccagaatctataaagaacttaaaygaatttacaagagaaaaacaaccccatcaaaaagtgggcaaaggatatgaacagacacttctcaaaagaagayatttatgcagccaacaaacatgaaaaaaagcttgttatcactgatcattagagaaatgcaaatcaaacccacaatgagataccatttcatgccagttagaatggcaatcattaaaaagtcaggaaacarcagacggtggaaaggatgtggagaaataggaacacttttatactgttggtgggagtgtaaattagttcaaccattgtggaagacaatgtggcaattcctcagggatctaaaaccagaaatgccatttgacccagcaatcccattagtggrtatatacccaaaggatcataaatcattctactataaaaacacatgtacacatatttttattgcagtactattcacaatagcaaagacttggaaccaacccaaatgcccatcaatgatagactggctcaagaaaatgtggcacatatacaccatagaatactatgcagccataaaaaaggatgagttgctgtcctttgcagggacrtggatgaagctggaaaccatcattctcagcaaactaacaaaggaacagaaaaccaaacaccctatgttctcactaataaatgggaattgaacaatgagaacatatgggcacagggaarggaacatcacataccctgttgggggttgggggcaagggtagggatagcattaggagaaatacctgatgtagatgatgagttgatgggtgcatcaaacaaccatgtcacaagtatgcctatgtaacaaagctgcatgttctgcacatgtatamcagaactttttttttttttttttctgtgagatggtctygctctgtcacccaggctggagtgcagtggcgcaatctctgctcactgcaagctccacctcccgggttcatgccattctcyttcctcagcctcccaagtagctggaactacaggcacctgccaccactacrcccggctaattttttgtatttttagtagagatggggtttcactgtgttagccaggatggtmttgatctcctgacctcgtgatccacctgccttggcttcccaaagtgttgggattacaggcgtgagccaccgcacctggcgtatcccagaacttaaagtataataataattttaaaaaatgcgtatcgctgttttagtgccataatatttgtatactaaaagtattgtttcatgttgcaatttaattgtggctttcttctggatgagtaggttagcttttgatacaatttagttttgtaacaatcacttttaagattttaaactataccattaactgaataaattatatttttcttaaccttttattgttctaaatttgttttttattattaaataccatacttcaataaagtatttctcaatatccagaattattttacgaattccaaaaaatgaagttactagatcaaaacacaaacttttccttgctttgatatatttttattaatttaatattgtactagtttttctacatccttgctctaactggatattaacaggttgaacattctttaaaaatatttcacagattaatacaatgattttatatatatatttttattatactttaagttctagggtacatgtgcacaacgtgcaggtttgttacatatgtatacatgtgccatgttggtgtgctgcacccattaactggtcatttaacattaggtgtatctcctaatgctatccctcccccctccccccaccccacaacaggccctagtgtgtgatgttccccttcctgtgtccaagtgttctcattgttcaattcccacctgtgagtgagaaaatgcggtgtttggtttttttgtccttgcgacagtttgctgagaatgatggtttccagcttcatccacgtccctacaaaggacatgaactcatcattttttatggctgcatagtattccatggtgtatatgtgccatattttcttaatccagtctatcattgatggacatttgggttggttccaagtctttgctattgtgaatagtgccacaataaacatacatgtgcatgtgtctttatagcagcatgttttataatcctatgagtatatacccagtaatgggatggctgggccaaatgatatttccacttctggatccctgaggaattgccacactgtcttccacaatggttgaactagtttacagtcccaccaacagtataaaagtgttcctatttctccacatcctctccagctcctgttgtttcctgactttttaatgatcgccattctaactggtgtgagacgatgtctcattgtggttttcatttgcatttctctgatggccagtgatgatgagcattttttcatgtgtctgtaggctgcataaatgtcttattttgagaagtgtctgttcatatcctttgcccactttttgatgggtttttttttttcttgtaaatttgagttctttgtggattctggatattagccctttgtcagatgagtagtttgcaaaaattttctcccattctgtaggttgcctgttcactctgacggtagtttcttttgctgtgcagaagctctttagtttaattagatgccatttgtcaattttggctcttgttgccattgcttttggtgttttagacatgaagtccttgcccatgcctatgtcctgaatggtattgcctaggttttcttccagggtttttatggttttaggtctgacatttaagtccttaatccatcttgaattaaattttgtataaggtgtaaggaagggatccagtttcarctttctacatatggctagccagttttcccagcaccatttattaaataaggaatcctttccycatttcttgtttttgtcaggtttgtcaaagatcagatagttgtagatgtgtggtattatttctgagggctctrttctgttccattggtctgtatatctgttttggtaccagtatcatgctgttttggttactgtagccttggagtatagtctgaagtcaggtagcaagatgcctccagctttgttcttttggcttaggattgacttggcaatgcaggctcttttttggttccatatgaactttaaagtagctttttccaattctgtgaagaaagtcattggtagcttgaggggatggcattgaatctataaattaccttggccagtatggccattttcacgatattgattcttcctgtccatgagcatggaatgttcttccatttgtttgtatcctcctttatttccttgagcagtggtttgtagttctccttgaagaggtccttcacatcccttgtaagttggattcctaggtatttcattctctttgaagcaattgtgaatgggagttcactcatgatttggctctttgtttgtctgttaatggtgtataggaatgcttgtgatttttgcacattgattttgtatcctgagacattgctgaagttgcttatcagcttaaggagattttcgactgagatgatggggttttctagatatacaatcatgtcatctgcaaagagggacaatttgtcttcctcttttcctaattgaataccctttatttccttctcctgcctgattgccctggccagaacttccaacactatgttgaataggagtggtgggagagggcatccctgtcttgtgccagttttcaaagggaatgtttccaggttttgcccattcagtatgatattggttgtgggtttgtcatatgtagctgttattatttttagatacttcccatcaatacgtaatttattgagagtttttagcatgaagtgctgttgaattttgtcaaagaccttttctgcatctatcgaaataatcatgtgttttttgtctttggttctgtttatgtgctggattacatttattgatttgtgtatgttgaaccagccttgcatcccagggatgaagccaacttgatcgtggtggataagctttttgatgtgctgctggattcagtttgccagtattttaytgaggatttttgcattgacgttcatcagggatattggtctaaaattctcttttttgsttgtgtctctgccagctttggtatcaggatgatgctggcctcataaaatgagttagggaggattccctctttttctattggttggaatagtttcagaaggaatgataccagctcctctttgtatctttggtagaaatcggctgtgaatccgtctggtcctggactttttttgttggtaagctattaattattgcstcaatttcagagtctgttattggtgtattcagagattcaacttcttcctggtttagtcttgggarggtgtatgtgtagaggattttatccatttcttctagattttctagtttatttgtgtagaggtgtttacagtattctctgacggtagtttgtatttctgtgggatcggtggtgatatcccctttatcattttttattgcatctatttgattcttctctcttttcttctttattagtcttgctagcrgtctatcaattttkttgatcttttcaaaaaaccagctcctgaattcattgattttttgaagggttttttgtgtctctatctccttcagttctgctctgatcttagttatttcttgccttctgctagcttttgaatgtgtttgctcttgcttttctagttcttttaattgtgatgttagggtgtcaattttrgatctttcctgctttctcttgtgggcatttagtgctataaatttccctctacacactgctttaaatgtgtcccagatattmtagtatgttatgtctttgttctcgttggtttcaaagaacatctttatttttgccttcatttygttatgtacccagtagtcattcaggagcaggttgttcagtttccatgtagttgagyrgttttgagtgagtttcttaatcctgccttctagtttgattgcactgtggtttgagagacagtttgttataatttctgttcttttacatttgctgaggagtgctttacttccaactatgtggtcaattttggaatagatgtggtgtggtgctgaaaagaatgtatattctgttgatttggggtggagagttctatagatgtctattaggtctgcttggtgcagagctgagttcagttcctggatatccttgttaactttctgtctcattgatctgtctaatgttgacaatgggatgttgaagtcttccattatcattgtgtgggagtctaagtctctttgtaggtcactmaggacttgctttatgaatctgggtgctcctttwtatggtgcatatatatttaggatagttagctcttcttgttgaattgattcctttaccattatgtaatggccttctttgtctcttttgatctttgttggtttaaagtctgttttatcagagactaggattgcaacccctgcctttttttgttctccatttgcttgatagatcttcctccatccttttattttgagcccatgtgtgtctctgcaygtgagatgggtttcctgaatacagcacactgatgggtcttgactctttatccaatttgccartctgtgtcttttaattggagcatttagtccatttacrtttaaggttaatattgttatgtgtgaatttgatcctgtcattatgatgttagcttgttattttgctcattagttgatgcagtttcttcctagaattgatggtctttacaatttggagtgtttttgcagtggctggtaccgttgttcctttccatatttagtacttccttccagagcccttgtcgggcaggtctggtggtgacaaaatctctcagcatttgcttgtctataaaggatttatgtcatagtgcagatatcactcatatgctgaaatggcttattgttgttccacctctgtttacaagagcaaaaatatgataaatgacttcaaatgtccatgttaccaatagaaaactgggtacatttcctctagttagakaaacacattatacacattgcaaaaattcatttgtctaatcactaatctttcttcagtgcctactgtatagtttgaagtgcccagatactgaccctatagatgttaagacagttccaaccgtaaggaagcttaggggaaggctagtacaaaatacaaatacaactaacagaatataagccaagatagtactgtgagtccatatagaaatacaaaaaaaaaagtttaaaagaaaataagtagcaaggataaaaatcaagaaacacatggcagtgagaagaaattagaaccaaaggtatcctgggctccaatgtggagtttttgcttgtgtttacctccatgattcaaaattttctcagttatggagggatattggagcaaagcacactgtatgcaactaaagggtagagttacaatttttaaaactggaagtccttgatagaaaatcaaacaacatcaacaaaagtatatattgacaaaagggcctttgagagaatgacactaaaaagctaaaatttaaagaaattaatagacaaagtaaatttaaatgaaatatcagaatattagttacttgaatgatataaatgaggaattcatgaaatatatagcacaaagagaaaaaacagatttaaaatatatatgaaaaaataaagtatttggcgaagagattgagaaattataacatgtatcaaaggaatcccacaaagaataagcatttttttttaaagacagaggaaatatggctgataattttatagaattgaagagtgggatgatctttcaaattgaaagacttcattgagggccaaacaggtcaataaacacaatccttaactggttatatcatggaataarsaaagaagttaatggtaagaggcaatttaaaagctactagaaagaaaaacagattgcttgcataggaaaaaaaaaagattggcttttaacttcttaagaacaaagcaattaagttttatgtgaaaatcactrccagcctagaaatgtacttgtagctaagctatcctttaagagtgaaagcaaaatagagacattttcaaatattcaaaaaatgaggagtttacaatccacaaatacaaagtatttcttcagcaagaagagtaaattaaaaaagaaagcacggtaatcaatagcttttgaaagtgtatcrgtaatatacttcacttctacctytaaataaatctacagttttattttttaaaaacaagttaaattggacaatactttaacagtataattaaaacaataacygagtascctatgacacagtcattccaagtatacacccaatagaaagcatatatgtgcaccaaaagacaagtactagccaaaagttggaaaaagaacaaatacggaaatgaccataatagctctaagtagtaaatattcatcaacagttgaattaataaataaactgccttgcatttacacagtggaatactacaaaacaatgaaaatraatgaaacagtcatatgatacaaattattctcacaaacataatgggttgaataaaaaatacaaaaaatacattgtagatgattaagtgatataaagtacaaaatgacaaaaarcaattttatgctggtagaagtcagmatgtggtcatccttggaaaaagagcagtgggtctgkatggggaacgaaggagcttctggggagctggtaatgttgtgtattcttaatctcagtcctggttccatatgtgtggttggtttgtgaaagtttatagagcagtacagctgtgagatgtatactttatgaacattgtatacattaaactttgataaaaagcatgtgtgtgaatatatatgtgtgtgtatataygtgtgtgtgtgtatatatatatattctttayatgaagaatgtagcacattaaaactacamatgtgtatataggtwaaactaaaattctaggaaaaagaacttgggagaaggaagaggaaggttccattagtactttaaatatgctaagattcttgtcttatttagttggtaggcaggacatactaaaatttaatctctgtcagaaattatgygtatctgagtgtgtgtacagttacacaaytaataaaaggaaaaaagagagcacatgaaaatcaaaaaagcaagaaataagatcctcccctaaaaacaataaagaaggaattctaaacagaacactaaaacaagatcatagagatcagtttaaatatgttcaataatcatactcattgtaaatttattagttttctaataaaatattaaatgtattatattagattaaaaaaactaactgctaatcttataggaaaatatcttttaaaaagacagaaaaattaaatatagatatactatgcaaatactaaaacttgtgtcaaaatattaatttcagaagaaagaatttaaggcaaaaacatctatagaggatttttttaaataacaatatattttcataaaaagaacaatccacacagtatataattcacaattatttgtagatagcttcagaacaaagcagaaccaaccaaatcatagggagaaatagataagttcaaactcatgatggaaaaatgagttttaatttttaattttttatagagatgggtcttgctwtgttgcacaggctggtcttgaactcctggatttaagtgatcctcctgcctcagcctcatgatagaatatttgagtacaatgctatcagaaattgaaagctcagataaaaattttaaaaaggatatataagatttgaacaagtcatcccaaagtcttaattaatacccctgtagcaaacagagactgtatcttctcttcacacacacagtgttatgaaagttgactacatattatgtaacaaaggaagaaagtctcttcaagtttcgaaaagtgaggtcactataaactacattatctcaacacaatacaattaaattagatatcagcaataaaaatacagaaaattatgtgtgaaaacaaatttatttataaatatctaatatgtaaaagaaaaaataatgaaaaattagaaatatattgcaagacaatgagaattcatttcacaacctgtggaatgcaactgaatgcgtctaaatctgcaatgactgtggaaattayagtattaaactttttaatttaaaactaagaaaaagggacacagttatttaggcatttatctctgaaaactgtggaaagaacaacagagttaatccagaaaaagtagaagaaaataaaaataaaaagttgtgaagaaattaatgtaaaataaacaaaaatatatggagtacttaaagctgattctttgaaaatttagtaaaataaacaaagcccttgcaggactgaataatttttttttaatacagggaatatttaactgtgaaggagaactcatacwgtaaataaagtagtgcataaatagaatttgagaatactgtgaaaaaccttaggaatgcagcttcaataaactggaaaatttagatgaaatgaacaattttcatgaaataaaatattcttaaataaatatacttaataaaatagacaagtaaagtagaaaacctgagtaagttgccaagtggtcaataaattgaactagtagtaataacaacattaactcttccacctttggccctggccaaagacaccagacatggatgtttttcccaagcaaattctgtaagagttaaagaaagaggaaagaaacacaaaaagcagctcaacagccaaagacaactttattttttagaataaacctgagaggggcttctggccgatttcagtgaggagcattctctcttacagactgagagtatttaagtgtttagggcaagagggcttatcacaggcttggaatgttttygtgtcggggagaagtttattgtggggttgtaatgtctctgatcagaggggaagttaccttggggctaaacatctctctgggcagagaggaggttacctcagggctggcatgtctctggtttgggagggatttatcttagggttggaatgtttctggttcgagatgtcatttgtggtttatgttcatgctgaccttagccattaggctgatgccctttggatttaggtggtttttgatcaaggggaactttaaaatgatagtgcttgtccaagacagtgatgctcctgctctgtcaaattctaccaaacattcaagaaacatattattcccatattttacaaattattttaagactaaatacgatataaagaacatgattaaatttgttagtataattttaacatccacagcagtcaggagaagaaaaaaattataggccrgcttcacatataaacatatatgtaatgggaaatcatgaaaaacaaagcaaatcttatctgacagcgtattttaaagtttttaaaacttttaaacatcatgaccaagtagaattatcattcttaatgaatatgtatatacatatatagcctagtagccctagattttctgtacaggagaagatgagagttggagttggacagggagtggctgtaaaactaccaccaggtgtagtagtggttgattaatggattgaaggagttaaagctgcccccctacctcctgagctattcttggcatagcaaacttctttttaaaaatgaaatttggctgggagtggtggctcacgtctgtaattccagcactttggtaggccgagggaggtggatcacttgaggtcaggggttcaagaccagcctgaccaacatggcgaaaccccatctctactaaaaatacaaaaattaaccaggtgtggtggagtgaaactccatctcaagaaaaaaagaaaaaaaaatcatctttctcaaaatacaacagcagttcagtgactagattgatatggaaaaaatcaaagcgatatctgcaatgttgaaaaataaacatagcatttctctagaaccaattcatcctacagttgcatgccagaagagggggtagatacaattcactgtaagagtctatcaacaatagaaaaacagcctcttgttttgaaaaaaaaatagcttcttgttttgaaaaagaaacaaaaagatcatcaatgatgcatataatagacctacatgaaagacagaatatttatatccttttgttagaaacaaatcatgatttgagaatcatacatgctcctttattgtgagagatatggagaaactggagtggtcatagaaaaaaatattaagtgataaaaaactgatgattcactgagacatctgtaagaaactgggcctatttcatttagcaagagctactgaggaaatattaatatatattttcaaatcttattagtttcattttgagcaatttgtgatcagcattaaaaattgctgcaaaagtcattgattgtaactaaagcagaataagttacttacatgcaaacttgaggattataaagtaaagaatatatttgtgcaatgtttacttctaaggatccgttgagaaatatcaacattgaatggtgtgtttatagactgtatgaagtcaagactccagaaatggcaatttgtaggaatttcatttggaaaaaatacaatccatgtccaaggtatttctacaaagaattgatatcagcaggattcatttcaaccctgtaattctgaattctttttttcttgtgtgtgtgtgtatatatatatatatatatcacatttattatgaagctcttagaaatttaaaaacacacttttctttttttttttttttttttgagacagagtcttgctctgccatccaggctggagtgcagtggcacagtctcggctcactgcaacctctccctctcgggttcagccatttctttgcctcagcctcccgagtagctgggactacaggcgtgcaccaccaagcccaactaatttttgtattttttttagtagagacagggtttcactatttkggccaggwtggtctcgatctcttgacctcattatctgcctcccaaagtgctgggaatacaggtgtgagctactgcatccagcctaaaatttcactttttatggatacataatattttacatatttatggggtacatgtgatattttgttacatgcatggaatacacaattatcaagtcaaagtttttgaagtgtccattactgtgaggatttattatttctatgggttaggaagtcctttcttatagctactttgaaatatagattatattgttgtaaagcatagtcactctactttgctgtcaaaatataaaatttatgccttttatctaattacatgtttgtacttattaacctacctctcttcaccctccgctaccaacccagtcaaccttcccagcttctagtatctatcattcttctctctaccattatcagrtcaatctttttagttcccacatatgaatgagaatatgcaataatttgtctttctgtgcctgggttatttcacttaacataatgacatccatgttgctgcaaatgacaggctctcattctttttatggctgaatagtattccattgtatacatataccacatgttttcttatccatttgtctgttaatggacactaagtttggttctatatctttgctattatcaatagtgctacaacaaacatgtgagtgcaggaatccctttgatataccgatttcttttcctttgaatacatacccagcagtgagattgctggatcatattgtagttctatttttagtttgtttgagaaatctccatattgttttttatttatttatttatttatttatttatttatttatttatttgagacagagtcttgctgtgtcacccaggctggagtgcagtggcatgatcttggctcactgcaacctctgcctccccagttcaagcgattctcctgcctcagcctcccaagtagctggtactacaggcacatgccatcacgcccggctaatttttgtatttttagtagagatggggtttcactgtgttagccagggtggtctcaatctcctgacctcatgacctgcccgtctcagattcccaaagtgctgcaattacaggcatgatccactgtgcccggcctccatattgtttttaatagtggttgtactaatttacattcccaccaaaagggtatgagcattctcttttctccacatccttgtcagcatgtgatattttactgcgtttttaataatagacactctctgttcaattgggtagaaaaataaaaataaaaaaatagccatcctaactggagtaagataatatttcattgtggttttgatttgcatattcctgaggattagtgatgttgagcatttttccatgtacctgttggccatttgcatgtcttcctttcggaattatctattaatgttctgtgcctacttcttacttaatgggattcttattttattgttgaattgtttgagtatcttatatactctggatattattccattgtcagatagtttgaagtattttctcccatacaggtggtttctttactcttttgattgtttcctttgctatgcagaagtttttgattttaatatagtctcatttgtctatttttgttccatttgtctgtgcttttgaggtcttagccataaaatcttttcctagacgactgttggaagtgcgtttcctatgtttccttctaggagttttatagtttgtagttttacacttgagtatttaatccatcttgagtttatttttgtgtacagtgagagataggggttcagtttcattcttttgcctgtgactgttcaatttccccagcactatttattgaagaaaacctcagttttccagtgcatgttcttggtgctttgtcaacaatcaattggctgtaaatatgtggatttatttttgagttttctattctgttccatttgggtatgtgtctatttttatgccaatgccaagtgttttggttattatagccctgtaatataatttgaagtcaggtagtatgatgcctccagctttattatttttgctcaggattgctttggatattctggttattttttggtttcaaatgaattgtaggattgttttttctattctgtgaaaaatggcattagtgtcttcatagggattgcattgagtctttaggttgtttatggagtatggtccttttaacactattatttttttctgatccatgaacatgggatgtctttacatttgtatgtgttctcttcaatttctttcatcagattcttatagttttccttgtagagatatttcacytcattggtttattcctatgtaatttttttggtagctagtggaaatgggattgctgttctgttcttctgtttttgtttttgttttgctttkcttttttttgctatttcattattggtgtatagaaatactactttaaaaaaatgttgattttgtatcctgyagtgtaactgaatttgtttaacaactctaagggttttttggtggagtcttttgacttttctmaatatgagtatcatgtcatctgcaaasagggacaatttgactttctctttttgaatctggatgccttttctttctcttgcctgattactctggctaggactttcagtgctttgttgattaggaatggtggaagtacatatccttgtcttgttccagttcttagagaaaaggcctccaaacttttccccattcagtataatgctatttgtggatttgacatatatggactttattttttgaggcatgtttattctatgcctagtttgttgagaatttttttatcatgaaggtatgttgaattttatcaaaagatttttctttgtctataagatgagcatatgagttttattccttattctgtagatgtttcatgtttattgatttgcatatcttgaacatccttgtgtcccttgggtaaatcccacttgatcattgggtattatttttttgatgtgctgttaaattcagtttgcttgaactttgttgggkttttttgtgtttatgtttatcagagatattgacctatacctctgtgtgtgtgtgtgtgtgtgtgtgtgtccctgtgtgcttttggtatcagaatgataccggctttatagaatatgttaggaagaaatcagtcccctacaattttttggagtagtttgggaaagattggtattagttcttgtttataggcctggtagaagtcagcagtaaatcagtccagacctgggcttttctttgttgggagactttttattactgatttaatttcactacttggtgtgttcaggtttactatttcttcctgattcaatcttggtaagttgtatgtatgtttctagcaatgtatctacttcctctagattctctagtttgttagtatacagttttccgtgatagtctctgatgatcttttgtatttctgttgtatcagttgtaatgtctcctttttatttctgagtttatttgggtcttctcttttctttgttagtctagctcgtagttttttttttttttaatgttttcaattttgtttatactttcaaaaaactagtgttacatttcattcatgctttttattgtttttctagtttctgattcatttagttctgctctgatctttattatttcttgcctcctgctaatgtttggtttggttcattcttgatttttcactttgttgaggtggattgttagattatttacttgtaatatttctacttttgatgtaggcaattatttctataaacttccctcgtagtactactttagctgtatcccacagattttgatatattttgttttcattttcattagtttcaaaatttttaaatttcttcattgacacaatggttgttcaggggcatgttatttaatttttgtatatttatatagtttccaagtttctttttggtattgatttcttgttttattccactgtgatctgagaaggtacttgataccattttgcttgtttaaaatttgttgagacttcttttgtggctcaatagatggtctgttctagagaatattctgtatgattatgaaaataatgtgtattctgcagttgttggataaaatgttctataaatatctgttaggtctgtttgttctaaattccactctaacttcaatgtttcttttttgattttctttctagacgatctgtctagtgctgagaataaggtggtaaattcccccacagttattgcattggagtctttcttttcagatttagtaatctttcctttatgaatccgggtgttccagttttgggtgcatatatatttagaattgttatttcctcttgctagattggtccttttatcactatttagttgtctttgtttactgtttttggcttcaagtctgttttgtatgatatgagtatagctacctctgctcactttgaattctgttagagttaaatatctttttctatttatttactctcagtctataggaatcttttcaagtaaagtgtgtttcttgtaggtggcatgtagttggatcatttttttaaaatccattcattcagtctatagcttttaagtgaagaatttaatccatttatgttcaaagtaattattgatatgtgaggttttattgctgtcattttgttaattgttttatggttggtttgtatattctttgttcttgattttcctcttaatgtctgtcattgcagttggtagttatctgtagggatagtatttgagccctatctttttccacatttgtatgtttgcttcaccattttttatacttttgtgtgttttcatgtagataaatgtccttttgcttccatgtttaggagttctttgagtatttattgtatggtcagtctagtggtgatgaattatcttagttttatcttgtctgagaaagactttatttctccttcatttatgaaggataattttgttagatatagtatcttagcttgcagtttttctttcagcattttgaatacattatcccattctctcctggcctataaggtttctactgataaattttctcttgttctgatggaggtttcttataggtgactagatgcttttctcttgcttttttttaaaaaaaaaaattctctatttttcatggattttagaaattttaactatagtataccatgaagaagaactttttgtattgtgtctgtttggtgaytgctgggactctgtatctggatgtttaaatctcttgctagatttgggaaattttcmtctattaattcattaaataggtttttaaactctttctctctttgccttcttggataccaataatttatatattttatcacttttttttctgtcccatatatcattaaggctttgttcattctttttttttaaaaaatgtgtctgagggttatttataaaacactgtcatcaagttgtgaaattattttgtctgcttcatctagtctatggttgaagcttttaaatgtattttgtaattcattcaatgattctccatttataggatttctgtttgatacttttctacgttatctrtcactttgttamatttctcattcttatcctgaattgtttttctgattcctttgttttgtttttttagaattctcttatatctcactgaaattatttagaatcaataattgaatttttactaggattttatgaattccatctcctttggagctgtcatatattcttgctttttcatgwttcctgtgtccttacattgatatccgtgcatctcatgtagcagttgcttcttctaactttttcaatttgctttcacagggaaggactttttttgaggaagaatctgtggtgttggttgggtggggaactctggtttcaattctaggtacatgaattagtgtagtctcccttgatttttttggctacaaacagtgccagtgatatctgagacttccttggtggcttagggtccagttattgaggaaagctctggtgcagttttgcttgggactcagaggtcaagtggaccagtctttgagctcctgtggttgcagcagtgggctgagagtgcctgctcatatgccccataatgtcatacaggtgggccaatttttgttccttcaggtggcttactcaaagcccagtagtggcagctgtgaactgagcaggtaagtgggttcttgggtccatgggcagctaatatggcgtaggcaatgcgagtggcagtggtgtgacaaccctctaggtcccttgtggtgcatgctgtcattggaagtaactgtaatgttctgggaaggtcagtgtccaggcctgcaggtggtaatttgtggtagtagctgctgtgtgggtaggcctaacctcaggtccccgagaggagtggtcatatgtcatcagtggtgaactaaactgggagattccctggcccctggactgtatgctgtggcatggggatgatggggaaacctgggctaggctggcttatcttcaggcccccagatggcatgtacaggcactggccatggtagtcaggagcggggtgatccccaagtcattgtggaatgcttgagtgggaggctatagtagctgccctgctgccctgccagtgggggttgagggtggtaccagcttcagtgatgatggcctaggacagcaggtggggagcatgcatgccacctgcaccacagccttggtggcacccttgctcagccttgggtggagaagcctgtggtcacttgtgtctaaaccccaggcagtacccatcacttctcttgcacctcagcttcagcaccactgggcttcaggtagtgtgcagtttgctggggatggtgctctagaatggcaccttgctggcacctcagtcctaaagatggcatcccataccctggttgcaactccatcagagtgtagtggcccaaggtcacttgtgcctaagccctgggagcagcagcctaatgcttctcttgcacattagcctcagcattcctgggttccaggacagtgtgcagtctgttgcaggcaaagttctaaaatggcatcttgctgtagttgcttaggtcacaaggaatgtgaaggaccatgaccatattcaagcttcctccatgggaagctgccataatacaatcttcttgcaactccctatgttagtttcatggcctgagagtattgaggactctcccgtggctaggactataggagtctatgatgaaaatgcaggctgctgagcatctctcacctaccgtttccctctattggggagtctctctaggctctcagtcaatccaggctgaacaggctgcttgcttccttctcccattccttactttagatattgcctgtcactattttgttggattccagtgttctctcttggatgatctaatatctactgggtattttagctctttttagtggagaaagcaagtacaaaatgctccctagtcagccatcctgaagcctcccaaggtgcccatttcaaaacccatttttgaactacctaactaacctacctaaccagagcatttgttttaaacatactaatatatttaagtgttttaataatccttttgtttcaccaataaacaaacaaaaaagaagaataaatttaggagaataaaataattactaattcttctcttaaaagatatatctgtaaggaaggaaggactggactgattatatcaagtagtagaatttatctgtgaagatttaatgcacagaaaatattgtcctatattcttttctgtatctccccatttgatattttaaaagtcttttttggcaaacaaagtkgtacctattgttgattgtggatatttaaacgtgggaaattgtgatcagacataaatctctcaaggaaagaccttgtgtcctctctgttattaagaatccacactttcctttgtgggacactcaggaactgacatttatgtctaaccttctggataatggatttacatggctgtttaatcttctaaggaaatattaagactcctgagattgtatttccatgcctttataaatcatacattagtggtattaagacacaagaaaataccttttcaagctctattgcttgtaccaactataaaattaatagttaataccatgttaccatattttgttttataaaagtgacaaaatattaagagagctaattcccacctgtttttaaggccaatttgagtcattataaatattcagagacatttcagaacactgtttgaaaatatagtaattctctaacaatgtaaaacagtttttctttgtgagtgtgaaaattaactatgtaaccttctagtgcagggctttttaaacttgaatgtgatacacatcatctgagaatcttttaaaaatgtaggttcttatccagtaaatccggagtggtacctgagattctggatatacaacaagttctcaaggggtgccaatagtgctgacccatggaccagatattaccagcaagaatggagagtagaggtttgtaatgtaggctctatggattaccaccaagacttgtgctaactacataaaactgtatacaatgtgtgtgtgtctgtgcatttacaagatagagtactcataagttgtatcctgtttcaaagacttgtgacctgctactctgaattattagcatttcctcaacatgttacttatattgcaattcctgtgatataatcactgaaaattttataaaacttgatgtatgttatctttcttttggatacttaaaattaatataaagtgttaatcacttcaagaaatcctagagttattacacctatgtgactttcacctaagtgtttcctaaactatttggtaattgaattcatttttttttcaagttttaccaaataatattccaggaacaataaaaaagatactggctcacattaaataaaaattaatatttggggccaggcgcggtgactaatgcctgtaatcccagcactttgggaggccgaagcgggcagatcacaaggtcgggagatcgagaccatcctggctaatacgataaaaccccgtctctactacaaatgcaaaaaattagctgggcatggtggtggacgcctgtagtcccagctacttgggaggctgagaaggagaatggtgtaaaccagggagacagaacttgcagtgagccgagatcatgccactgcactccagcctgggccacagagtgagactctgtctcaaaaaaaaaaaaaaaaatagtatttggctctctgatttcccttctactactttttaagctatctttctgtgcagctcacatttgttccaccaacctatttaataccttggcctctcaaccttgtggcctcttcatttttaatgatctttttcttcaacattattgtagtcagccattcctgtgcttattattccaagtatatttttcttttccagaatctctcttttaagatgctattttctgaccaccactttattatctttctgattatgtattctctaatccttcatgccaaattagctttttatcttgctggaayatcgaatgcatgtttttcattcctcacgtttttgtttcctgtcttactcagcttagatttcatgttctattgtgataattactcttgtacttggatccacaattttgccrtaggaaacttctaggcccaaagttataccctttcaagtgatggctttcatcagcgactgacggagatggggataggtcatctccttgccccaatttggtagaatccttacaggcttcagagctcctcggaatgtcatttgagggctcagtgggtcaccttctctttttgcacaattccttcctcatttccttttgggtgtgtttcctggaggaactctgcatatagttcttcatacaagaagctgtgtctcagaaccaatctaaaagacactcatgtaaaattgaactccaccatrtttgttgttagttattttcctcattttattttatttacagtatttatcactgtctgaaattatagtccttatctacttgctggtttgtcatcatttatttttaataaaatgtagactctcttgcttaggaactttgtctttcatgttcagcactgtgtctcaagcacccacattatctttatccaatggtaaaccttataaatatttgttaaatttatttttgaattccatatttatataaaaaattacctcatggtaattatcatattcataattactatattgacaatagtttctaaaaatatttatataatatagtaatgataaaaatgttatctcctgatagtgtttatgtaccagaaggaaaaacaaaatcaaagaaaaacacaaaatcaaaataaattaaaggagtatactgaatagctccattacagtaagcatttagataacttagtcctaaacataacttgctttatattatttttcttaatattctggtctatactttaagaatcaatgattttaccaaagatgtgaggaaaaaatgtgaacacaggacrcattatttactcaaggcctactttatgccagaaaaataattttaggcatattaacatgtctttcttaattttcaaacactgttagcaaataggacattattattttcaaattgacagaagaaattgaagttgagagaagctaaatatktgttgaatgttgaaattcaaattaatctaatcacagctttgccagttacatattatgccatcttgggtaattcacttcactctttagatctctatactcttctatatattgagagggctcaattgcctttaagagttccgctggtttaaatgcttgctaatggtgtaagttttaagagacacaggcactttatgaccaacaccaggatgagaaagagccttagaaacacagcacgcattccaaacacgaacagtacatctctggcagatggagccttgtgtctggtaatgggagaagtaggcaaaagatgggaagatgatctgtgatagggtcctgacaaagattatttatgattattctagaaggcaggggaaacccagtgacagagaaccaatatacacctaatatgcagaaaggcagagggaaaggtcaggagtggggggcaatcagtatttagaattgcctcatctcaaggactgaggatcagaggtagactctattccacagaaacagttgtgcatgataaargcgtggggccaaggcacagaagcttaggtttgctagtaccagggcctaacatcagggtgggactagcatactctttatttggtactgggttgcaaagttcaccaaataaatgcccctttggtttttctagaagtaggcctgagtaggtactaaagtatgatggaactactagagggaagagagtgagtgtttctatctgaagattagaatactctgtgaagagcaggctggtctgcaatcttgactccacctgaaagataattattctaccaaagttttgttccaaggtcaaggctgatcttttttatctttttgatctgattatttaacagccatccttaaatgtatttagttacttataaarctttcctgaatagatttactgcaacattttgtaattagagcattcatgttagaaagtccttttaaaaatatagatgtatttgtctggatgtttattgcttgcttttagcacagattacttaatcagaataacagtggagcaagccaggccactgaaggagtagaaaacgcaactggtagggagagagaaytgggaaaggtctagggcacttggtgcttcctgagtatggagatttcccagagcagaactggcagtatcagaacactctaaaagacttccttaggagaaaaataaggaataagtgaaggtccctgattgtacctttctaattctatataatcaggttcttggttttaaatgttgcattttaagttctagatgttgacctaactattaaaactataaaaatattatcgatcctgtcttgttttgtgtttaatacataaactaaatgtctctttagtaatttcagctagaagacaawgtgacctattgtatagttatggtctcactgccatcagagtatatccgttgagttctggatttcccaaagcatttccaatttaaaattccacaaaatcagacttgayaatagatgtcatattcatcatactgcaccactatgtttggctatatttattttattatgattatattatctctcctggtttccccacagtaactattgaaccaagaagattcccaagttcatctctatccttcttaaaaagacattttttttttttgggaacagttagaaaattctctgtagaattagattgaagaggatgagatgaggtgaagtgaaaattcagaaggcatgttaagtagacmaaaaacatgaagcaaagttagagcaatctaaattctcaaatcccaaaatttctctttgaccacttctcattgctcagactttcccaggaatttcccattgaacccaccctcattaaccrtatttctagaggcaggttaactatttgatttgaagccatctttattagccatatttctagaggcagattcactatttggaatatgagagatatgtagaatacccagaaaatgtcaatagaagtggacttgatagaaaaataatttggctgataggataactccagaaatttaataattttgtttyggtatactgtacctattagcaaaaaagtatgccaatgctctttgaagttatttcaaatattctagttcaacttaagccatcaggattctgtcaagaaaatgagatatgtgtggttgtggcctgctcatatagaaaaagattagtatgaagaaytctccaattgaaaaatatctctccattccagtgtataaattatatattcatttcagctaggttytatacactgttcttttaaaatgtttaatgtactcattagacatctgaattacagtcattgacattttagtgtgaatttctttaatccaaacattgattgccaaggctatattcactaaagagtaagagtattattgaaagaataaatggaaagttggaggaatatttatatatcaggaagacctttatggctgacctaggtaggatactttgtacagcttaaggatgattaaaattttgggtttggaagaaggaacattaaaagatgatataaagatagaaggatactgaagagaatatttgtctactttataattttaacaagaccttgtgtgccaatgagaatgattaggtgccccttctgtcatgtggtygaggttttgtgactaaaatatgacatatactctatgaaaataaataaatggtttaatgaactataattttatagttgaaggagagaaaaaaggccaccatttggaaaataagaattgtataaaaaatggagatttaaaaggtacaactggatttccacatccatgggttccatatttgtgcattcaaccaactaaggataaaaaatatttgaaaataaaaattttacaaattttcaaaaagcaaaacttgaatttgactgtacattgagtactatgtcgaatctgtgcagatgaagctatgtgtaggcattttattaggtattataagtaatttagagatgacttcaagtgtatgtgaggatgcacgtaggttatttgcaaatactatgccattttacaccaggaacttcagcatctgtggattttgatatccgttggggttgtagaacaaactctgcattgataccaggaaggactataatttatgcgttagaacagaactgcaaataatgaatgaaaacatttaaaaatatgtaaaagttggccgggtgtggtttctcacgcctgtaatcccagcactttgggaggccagggcgggtggatcgcaaggtcaggagatcgagaccagcctggccaagatggtgaaaccccgtctctattaaaaatacaaaaattagccaagcatggtggtgggcacctttaatcccagctactcagaaggctgaggcaggagaatcgcttgaacccaagagtcagaggtgatagtgagccaagatcatgccactgcactccagccygggtgacagagcgagactctgtctcaaaaaaaaaaaatatgtaaaagttgtgaaagtgggcttttagcttcaaataaatatatgtctcayatcaaagccacagctaattaaagaactaagaaagaaaaggaatattcaaatatctggagtaatctaacaaacagcagtgttcagagtttttaaattattattattattatcatcggtgctagatatttctcctatagtatgtgatattgtacagaaacaggcccatccacttgatattcacataggctgctttaaaagtggagtggcaaagtagtagtaaatgtcactaaaatataggtttttttagatgtgttttgggtcgagttgagagtacataataaaaatgatgaattgactcaaatcttcctttcctgtttttttttttttcttttaagcacagttgtttaaattccctacaaggttagaatacatgcacttttaagaaagcattctaccgaagstaattgggtgttttccactatcacataaatctgttggctggtgtttgatattcttggaaagtcggaggataggcatttattagtatcagaggagccctttgaagagaaaattcatagtgtttaataaaagggtaaattaattagttctatgtaaataaaatcctttgaaagaaaattttattcagaaaccttttaaaacttaagaaatcaaaacatatcgaaatgatctgcttttgctatgaggaagatataagtatggttatttcactaaatagtcatggaaaaattatctatatcattatactatctatattcttataatgacataattatacaagagtggcagcatggagaagtggtttagagcaagagctcttgagttgaattgtccagatgtaatcctaactctataccacttaatatattggtatttgaactaggagcaggttgcttgattagtgtttgtctctatatctttgataagaatgaaggtaatgatactaattatctctttgtgtcatttggaagattaatggaactaataatatatgaagaattccttggatgtacaagtattcaacatcagcttattattataacaataaagacttttcttcatatagtttttggtttaagactcaggcattggtatggaaaacaaattcatatacattttgaaaatttccttggaacactggaaatccaggcagcaagaaagcttatagaacaagtaccttggacaggaaaaagcttttcaatgaacataaaaacccccacagtattttgtattccattcttattctttgtggtggtgatgaaaaasagtgcctaaaaatgaagagatgaaagaatctcaatcatcacttcttcatcaaaccactgagttatgtttcatgcccattctaaatgatggtcctcaaaagtggaggtgggtcttctttgggagccaagataatgcatatagttagagaatattcctcaaaattattttcattagttctcagatcccttttttcattgtcattaactgccatttaataagatcctttttttattcttcttgaagagagataacactgctgatagcaatttcagagaaacccatttttgcctctctctttccactgtggagtgaaactaaagagttaaaatgtatatataagcggacaaagcagtctgaaaggatgctgctttcaaaatatgactatttccaccctggtagtcagtatggctgaaaggaaaagatgtggcaaatcctgttactgatattctgtccaagggagtagacttggatcaaattacaaaaccaggaggtttagtttgaaatctgttttaagaggcaggttgtcaagaaaaagcaagaccttgcaagctagtgcagcataggacaggaacaccagacatctgagtcaagtacattatgatgtatggctcaaatatgatatgcagcaaaagaataggaaattgagttggtagtgctacccaaagcaaaccaccagaggaaaagttcaggagatgtttttgtggtttcaagttagaaagatatataggattcttatattactcatatataagagaagaacattggatataaatgaatgcaaatggcaatgatgggggtcaatgtacctcattttgagccaatcttaaaaaggaaacactgaaattagatgcactgtttaaagttagttgactacaatcatttagcactctattcgacatatttttcttaaataatttattagttggaatattaacgcaatttattgttaataaataaatttattgagaacacattatgttctagacatcaggtcacttatttaatataaatcacrtaatttaacaccacaaccatagttttctgtgtcaagcagtctatcaaaaactttgattagatctaagccagagctgtgtagcaaggagtgcaatcatggttatttgactctaaacatttttagagtccaaataaattcactggaatctgtataaagacactcattctgtgtccattataatgttaaactctgattgatcatactattgaaacagcatcctttagatagttgcttaactcttctgtatttcttcctaccaaactcaccctggccttagggcaaaggcaggagatgattatacaattccaccaaactcgccctggctttaggatatcacgcttacttctcccacatctcccctctctttggaatgttctgcccctaaccatttttcatggatctaaagcaggggtgtccaatcttttggcttccctgggccacagtggaagaagaagtgttgggccacacataaaatacactaatactaatgatagactatgtgaaaaaaaaaacccacaggaaaaacctcataatgttttaagaaagtttacaaatttgtgttgaactacaccacattcaaagctgtcctgggccacagggctgcaggtyggagaagtctgacctaaagtgtcttatttaaacatcttatgtgaatgtattcataagttgttctctaaaataacattaggcaaagtgttgttacttttatacttattatttaatttaatatctctttctcttaaaggactttaagctcaagacagtcaggacattaaaaagtactgttacgctttaccttgaaattagccaagtgcccagcacacaatagaatctcaataagtatgcgctaggagtttagtcaatcatgtaacaggttctttctgtctgctgcacaaacaaaatcaaactactgagaccacagcattgcagtagtgaacgagtttaattgacctgaagctggcccatgtaagagaacctgggctgttggtcaaatcagcctctctgaaggcttggaagttagggggttttaatggacaatttggtggtcaaggatttaggttatgggtgctactgattggttgaggataaaatcataaaggtgtagaaaacggtcctcaggtactgagtctgcctctgagtgaggccacaagaccagtaaattcaagagtcatgagtccagttggggttagtctgaaaaacatctggaaaaaaaaatctgaggttctacagtagtgatgttatctgtaggagcaattgagaaggtcacaaatcttgactcctgaccacataactcctgaycagtaagcgattttagaaattacatctatcttgtggcctctcagtcttacaaagacagtttcagtctccaaacaaggaggagttagttttagggaaggaatattatcatttttgtttcaaagttaaactataaattcctcgcaaagttagcttggctgatgcccaggaatgaccaagcacagcttagaggtcagaagcaagatggagtcaagtatgtcagatttctcttactgtcatgattttgcaagggcagtttattaatgaagcggattgtacagtagctgtcttgcaaataccgttttaggaccaaactggggtctgctcaccctgtgcagtaaaacgaggtgatatggtttggctcgtctccccccaaattacgtcttgaattgtaatccccrtgtgttgagggagggacatggtggaaggtgattggatcatgggggcagttccctccatgctgctctcatgatagtgagtcagttctcatgagatctgatggtttaaaagtgtttggcagttgcccctgctcctgcctccatgtaggaagtgcttgcttctccttcaccttccgccatgattttaagtttcttgaggcctccccagccatgtggcactgtgagtcaattacaattcttctttatcaattacctggtcacaggtatgtctttatagaggtgtaagaatggactaatataccagatatctacaccaggatagtgatagaaagaaaggctttaattgcagggtgccaagcaaggaggaccaggcagctaaatgctcaaatcctgatctccttgatggcttgcacacaaggttgtctaaaggcaagggtaaatgtcaggaaagcagaagatacaggcaaaatcataaataatacatggaggttacacattggtttaggcctaaaagggtgggatttcttgaagcaggggcttacaggtcataggtagattcaacgattttctgatttgcaattggttaaggcagagaagtttgtttaagaattggagtgagtagaaaaatgttaactaggtagggggagtgactttctccaaggccctcgggaaaaaacttggaacaaatatgatgattaaagttcagtcttcacttccccttatctgaggtcttcatgccagtggatcccttaggtggggggttccctgtgggggtccgagtttctgaaagacaactcagtgacattaagatgttaccataagtttctatgcagaaagcaagcatctctggaactctaacttccttggctgttgttttaggctacgattatcttcttgtttaacaagttccttattttccttatttatttctaggactaactaggttcctagaatttccatcctrgaaactcagcatttgtctttatgtccatgattgagatccataggcttttaaaaagtggtatccctgctctatctcaataatatttcaggtctctgttaactgttaatatattgacatatgagtaaactgaaaataatttacaaagtaattaatgaaataaaaatgtaagaaaaagccaatgtatratattggttcatttgaacaacttttattgaacgcttattgtattcctgacactctttttggtactgaacatttaataaatgaagaagamaaagtgtttttcctcaaggaaatcacagtcagcagggaaatatacaggtaaagagggttgaacagccagaggattaataaactctatgcatctaatcaatggttctcataataaaaaatgcaactaatttaattcagtacagtctctttaatattgtatatctgttgggttagtgattactttcttatgttccttgaattatgagtaatataaaatacagcatgaaataataaccattatattgaacaaatgaattttatctgaggtatttcacattcatgtgagatgaaatcagttattattttgtctcatgagcattttccactttgagcattttaacctcactatcggtggagctatctatttacaactaaatttctatttaccactaaaaaataaaagaggccgggtatggtggctcatgcctgtaatcccaacacttttgggagactgaggcaggtggatcacctgaggtcaggagtttgagaccagcctggccaacatggcgaaaccccgtctctactaaaactacaaaaattagctgggtgtggtggtgggcacctgtaatcccagctacttgggaggctgaggcaggagaatcacttgaacctgggagacggaggttgcagtaagccaagatcacaccactgcattccagcctgtgtaacagtgcaagactccatctcaaaaaaaaaaaaaaaaaagaaagaaatggaataatttaatgatggaaccaacttgcaaaagtaaaatcaaaattcaatcaatatttgcatgcctactaaatgccagctactatgctgtgtgtgtgtgtgtgtgtgtgtgtgtgtgtgtgtgtgtgtgttttgagacacagtctagctctgtcaccaggctgaagtgcagtggcacgatcttggctcacagcaacctccacttcagtgattcttgcacctcagcctctggagtagctaggattacagggacacaccaccatccatggctaatttttttatttttagtagagacaaggtttttccacgttggccaggccggtcttaaactcctgacctcaaacaatcccctgcctcagcctcccagagtgctgggattataggaataagccactgctcccggactatatgtatatttttatttaattcttacaactgtctcagagactgtaaatcttattaaccccattttattaatgaggaaatgcaagtttatggttaacactatatctaagtttatagaactggtaagcagcaaagccaaaacaacactcaaggactcataatttagtcaaacaacaataaggccacataatttatctatatgttaatgcctctctttatctgattgcttctctatattatgacatacctgtggtcttttcagaatgatcatagtccccattttccaattcagaatactcccagtacttatcagacagtaggtaccaggcttatttctatgtctgtgttgtctttgtatatgacacacccaattatactagtaaggcatattcattcatagggaagtcaaagagttccttgattttatatgaagctgttggaagagaaaataggtatcaaaagttgaataatcagcaataaaataaaattgatagatatagctatctatctattgaaagaaataagtaaagtgagtcagctcaaacatttcttgatgagacaagtttatattatagcagggaagagagggataaagctaccagagattttgtttccaaattacctatgacatgcagttatagaattgacatgggagagaggtggaaatagagctgccacttatgaatatgtgtattatgtgtatatatctatatatctatatctatatatatcactctttctcacacatgccaatatcgacagcttgaagtgcttagtgtgggtatattgatttcatttgccattaggcccctcagtcaataacccatttataatataygctcttcaaagctatccactggggcaaaagagcttgacaaagagaatatttaagttacataaaaagcaaatgataaaaattactaattatctcatgttccaacagattatgtttctcttttgccttggctgccagaaagcatagtgacaaatctgtaggatattaatggtaattctcttgaaccttatggttggtttatttgtattcttcttttctattttttatattttctttgtaaacatgttttgattctttgttttgttttcattttttatcagcttcttagcttcaggattattcttataaatactaaatttaataggctataaaaagcatatgtatgtatgcacacatatatgtctgtgtgaatatgcatatgtgtatgcctttaggatcttaatttttttaagccattgtaaattattattatatttaggagttcatcttctaagtttgctgttttgacaaggagataattttgacataaacaacttataaacaagtggcataaacttaggtttgttgggacagagaagtgacattatccatatcaggggatatattctttcttggcacctgacagcaaattataaaaattaacacttaaagagctgaacatatgtcatataagccagttatagagaaagcagtatcactggaacatgattaaattcactacatataactattcattgaaaatataatgatattaggtcttatacagcaatgttttttagatgacagcatagatctgtatagwaggataaggaacaaaggaattttgcattttggctttgatagctgatgacagagtaagtgtgagaaaaatagtccagttcttatttagttcctttaatgtgattttataatatatagcatcttcacttcacacgcatataccacagaataaattaggatggaatgtagggtgccatatgcacgcatttacttactcttgactgtcaaagtcaagtattatgtttatcattcaggctataatattatatatctcttgtggtttttttctgttaaaataatattgttctaagtgatcagtttctttcttaaaatgttgaaaattcactagtgcagaagacacaagaggcaaccagatgcaggaaaggaaaataaatcagagcccatggatacacagcattgagaaaatattcacagtcaattttaactcaggtgtctggtgtgaataatactataagaaaacaaagcttatgtcaacatttgaaattgtatgaagaaagcaagggtaattatagtcacccagattattattttacatctaaccttaagcaacagggtagacctctaaccctaaaaataggaagtgaaataaagaacatagatatcagtgaaattactattttcagttcaacagacatgattggaaaaggaaataaaatcaaagaggcaacaaaatgaaaactaaagtaaaaggaaatcagaccagatgttgtgaatctgtttttcatgcagagatgcttaaatgcaaggaatggccttccaggcaaggttgctgagataataacactgaatttgtgcaagatggtttgattagatggtctgacagtggaggtttagaactaaaaggagaataagctatgtaggctaactgcactctttgcatttttaaaagaaatttcatatcttcattcaagatcttgaattgagtaaaagagaagattataatttctctgattttaatttagtcttagcactaaaaaaaagtgttctgtttcatgttttatctatcttttccatactgtacctctcatttctatcagtgtttttgccgtcatgttacctttcttcctgattttattatcactggcctcattacagtacgtccactggtttctcctactgtgatccttattatatggttgtgtgttctatgcrttactgtctttcatcatgtttgagtcctggcaagaatttcttctaaatacaataccatagatacattacactgatcccatgcaatcgttgtaactgctgggcatatgactgctattcatgccaattttcactttccaagtttctgtatgagacaaaaaatttgttcttgagcacataattaggaaataagagaactattggtgttcctatctttaacagggaagatttttaattttcatgccactcttttcataaatctgatctaaacaaaactgaaatcttgtacacaaaggccacgaattgtactttgcaagttgtgaaagagccaactgaaaatacttaaaatgtgcaaagaaaagaaagagaatataaacaataagccatgtgataaaataatatttgtaaattggttatgtaacataaaactctcttamtaaaatatcttttatataaatattactctagtaataactctcacagtaagtcaattacttgtcttcaaactcttaatagctgttgtcagcaatgcctattaaacatatacttattattttgatrggaaaattgccccacccctactcccacaatcacccaggaacttgtaaatacacaataaacttttaaaaaattattttcataaagaccaagatatacacattgtgatcagtctgatcccagtgggacaactcacggtacataatgcaatgatgtacacatgtggaaaaagtaagtatgtcattggaaaaataaatggtctagcattgtttacccatgtacattatgrcatttatcatgttccttggagtcatttctttagttgcttatttctacgactagactgtgagttcttttaaagcaaagacagtgagttatttatcttgaaatttctctacacctcacaaaataccttgtagtaggaactctgcaaatactcattaaaatgaatatatcattattcaatgaaagagatattgaatgaatgaatataccatgtgaatatatatatgagtactaattaaatagaaaatattagtttggaattactatcatttggtgggcaaagagagagaggaaaacaatactggaagaactaaggatgttaagctttatctgtgggtatcaatgttatatttacttcagcaatatataaatgttaataaatggtagtttgcttagttccctaagccttagctataagagttctctgtttaataacaatggctaatcaaggatagagtataattttaatagtatcttacaatagtaatgcatgtatattactgcatgcaatattattttatggaaaatatatcaatgctttaaaaaataaaaactactcataatgccactatttattgaaaactacaattaggagtttggaaatttccttccatatatttttcttaaaatgtatgtaattatatgctatattgtagagaaataaatatatgaattttaaatgagggtcctatttaatagatacatagcctgatttttttcacttaaaattatgtcataagcatctttttatgtaatttaattactttataagtgaaaagcttatattggtttgttatattctattaaataaagttattatttgtgtttaccaatggttagtttgcattataaattaaaatcattgtttcacttcaatcagtagctgtggtttaaattttattttgacatgaatctgtaaacttatgtgtgcatagaaaagcatcttctttattagaaatggaatttctttgaggatgrtaatttggggactatttactagaaatggaattgcttgagggtgataatttgggaactattatttcctgatctaactctacccatccataaactcatttctttaaaatgcttaataactattccaatgaattgttgggaagctgtggttaaattactcataaacatttctagatctgctgtaaactgagttcatttacaaggttttaatacatgtcagaagcctaaggtgtcactttcatgtggatgcccaatttataattgaggcgaaaatataattactctcttaacattttaatccttgaaaattgtactaagttatttcaatactttttaaaattaagtttagtaaactacatcattaattattttgcctgattacatwccatgtattaggataaaactggttcaatataactaaaagggaattttagtatccctcttttaatatctaaataagtatagtttattcagttcaataagattttggctcctgcatatgctttcagagttaaattagaaagctaatagtatataaatacatatctttgtattctattatttgattggatagagaaaatatggtatatgcatggaatactatgcagccattaaaaagaatgaaatcatatatttttccagcaatataaatgttgctggagggcattaatctaagtgaaataactgagaaacagaaaatcaagtaccacaagttctcacttacaagtgggaactaaacaatgggtacatgtagacatgaagatggaaataacacacaacgcaaactccagaagggggaagggtaggagtggggcaagaattgaaaaattacctattgggtaccatttttgctacgtgggtgatgggtatgctaggagcccaaacctcaccattacacaaacctgcacatgaamcccctgaatctgaaacaatataaataaataaataaaaattacagagagtatcaagaaatagagaactcttaagagaacaattactgatgytggtgaaattgggatcttgttcagaggttacagaatggctatgattaggatctgttagagaatcttctagaaagctttgtggcaggttcatggagaaacttcatggaaaggtaaataataagtacagactttttggaaatctgaggtaagatgaaccacattgaattcctgaaaacatggtaccttttaagccatatctttttgccttgtatttttttattagtctttgtaatttgttgtccaattccatgtagttttatagcaatttacatatgataaaaacaatcagggtgatacagaatattttgtgaatgataccgatttgggcatggaaaaagtcataccttgtgtttgcttttaacctcatggactcctcctttgtcatacctgtggaaaattcaagtttttagttatggtttccttgaagcaattacaaatgatgctgaagagaatttgtctcatagagagggatctgttctgacaatttttgtgcacctctgagcaaaatataagagaaaaatgaatttcagcaaaagaatgctgtacttgactttaaaattaattcattgactaggaaagtgaacttccctaagacgtatatctactaatagtcttcttctcttttgttagcctttttttcccacgtggagagatactgtattttcgaaggtagtaaagataattgagctgtgtatatacttattattctgaggggaaaaaataaataaaaacttagtaaaatttaccaggttatcagcaactcatttattcttaattttatctgtacatttgcattctatctrtgcatttgcatttattgtactttatttgtttagggtttcttttctgctatatgtgtcatatacctctagggggttattttaaacagtactgggatttgcttttctgtgtccaaaagcacagattttatatttggacactcaagttgttctrtattttgaactatgagaaaggaataatacccgattgaatactgactgtttttttataagacaatcgagcaacagaggcattcaacattagcatccagtgtgcaagacttgaatggttttattgcataatatgggagaattgctcactactgtctgttcctgctgacagtcctgatgctcagtctggtaatatcctgaaagatttcttcttctttttttttttttttttttaacccagtgctttgttattagatgttaataggttctcagtctgtgggagaggaagcaatgggacaattaacatgaaaaagctcagtagtagaggagttgatggaaaagagtatggtctgagtgagaatgcctaaggtttgtttcactttttctgtttgtttattttgtcaggataagaatggcataaaatgcaataacttagactttagctcctacaccagaatagctaagtagctaaggcactaaacttcatttgtttatttattcttctatggccaccttcctggtgatgtctctagaatacttgaagttccctctagctatgatggctccttattacagatccagaatgttaacattaccagagcatagtcaatgtaagctttgcagaattaaaattatccttctaaaatgcatagatgattatcttatgctcartgaaaattaatgtgaaaacttataatgcattcagctatagattactatagcataaacaatcttttgtaccatttctataaaatttagaaaatattttaaacctatgattttcccttcccattatacatttggaatagctgaataatataattatagaatcaccttatcttgaagtcagatgagactttagcattttttrtagaaacttagcaggttagataaaccttgattttgagttatgactcaaattactataactttgtgaattttgagaacatatttatcagctcaaaggctctattttgctccaactataaaaatgaaatgtaacagatctatctcttggaattattatgagaattaaacaaaatcttatgtatatgttacccaacacagtgcctggaaaagaagagagactcaaacagtatttgttaaaaactccaagaaaccagttgacaaccagaaggtgttactgtgtgaaggctagaaacttggggaaagaataggaccaaactttttcttagttatattctcagaaaattgtagtatgttcacaattcctacttcattgttggtagacatctgtaaataatgtatgtaattgaatatttttattcctattttagaagctgaacagtgcttatttaaggtctaaaatggacttgacactgaatgtagaakgtttgaagaacatcctttattgttactattgatgaaccaatactgatacattattattatgtaaatcctaccgtttacagtaggcttcaccttgtgttgtaaattctatggattttgacaaatgtatattaatgtgtattcaccactgcagtattacacagaatagttttaccatctggaaaaatcccctacgctctacctatacattttaccctccctaggaattttattgttcccgtagctttgccatttccagaatgacatgtaattgcaatcatacagtatgtagcctttcagattgacttctttcattagcagtatgcatttaaatttcctgcatgtcttttcttggcttgatgtatcatttttcatcgctttttgtacattccattgactgagcgttccagtttatccattcatctactgaagaacatgttggttacayctaagttttggcaattacaaataaaactgctattaagacacatgtgcaggttttgtgtgaacgtaagttttaaatttatctgggtaaataccaaggtatggttgctcgattgtatagtagaagtatgtttacttttgtaagcaactgctgaaatttcttccaaagtggcattccaaactgtcttccaaaatgtcattttacattctcttcagcgatgaacgagagttcttattgctctacattttcaccagtgtttggtgttatcagtgttttaaattttagtcattctaatagatgggccatgtgttgttttgaattgaaattccttgatgataaayaatgttgaccatgtttttgtgtccttatttgtcatctgtatgtctttggtgaggtgtctgctcgcatcttttgctcattttttaattgagctgttttcttattattgaattttaagaattatttgtacatccttgataccagtcgtgcatcagataggtgttttgcaaatgttatcttccagtctgtggctttttattcttttttttgttttgttttttgagaaggggtctcactctgtcacccaggctggagtgcagtggagcgatctctgctcactgcaacctccacctcccaggttcaagcaattcttctgccacaacctcccgagtagttaggactacaggtgtggaccaccactcctggctaatttttgtatttttaaagtagagacgggtttgaccatactggccaggatggtctcaaactcctgaccttgtgatctgccctcctcagcctcccaaagtgctgggattacaggcatgagccatcatgcccagcatctttttattcttttaagtgtcttttgcagagtagaagttttaaatttttatgaagtccaatgtattcattttttgtaaaaaaattgttaattatgtttttggtgttatattttaaaagttcttgccaaacccaagatcacctagagtttctcctctgttatcttacagaagctttgtagtactgcattttaaatgtaggtttatgatttaacataaaatgtttgctttatatcttttcttctggatagcactctaattgaaaaatcagtagcttccaagtcaaggtgtacagtctatggataattttataaatttgaaagcctgagttttacaaatttaacatgagcatgtgtcaaaaatttatttttgagaggcgctaaaatgataagccttgtttaaaaaatttagataaagaatggttcaataaaatttctcatttagaaacaaaactggttaatgtcctacagagcaatgaagctatagcctttaggattatcttttctacaaaaataacactttttgtaacaagaatcatttacatggtcatcaaatttttttttaaagagcattaactcttacagagttttaaaatatcctgatcgacactaatagcaagtggaacaaagatacacactccttgagaattagatatttgccaggtgggcctgattgcaatgtctgttcaacaggacattaaaaggacaagcaatagtccattttttctgtttccaagctttgataaatttcttaacaactacacaagttgttacaagagcctacttaagacatattgagagaaatatgaagccttcaatgactttcttttttttcgtgtgtgtgtgttcttctatagaattgtgtgtgaataagtgctgcagagtttgtataagtattgttgataattggcttgtaaatagcaatattggactttatttttctttcaataattttcaaaagtaagtcaastaaattcgagctgtctaaaagcgaaagaataagcagctttcagtgcaaagaaactgggcaaattttgttaaagtttaacaaaacttttgtaaaattaccaagtgactacaattttgactattgtattgggcggaataaaagacaataaaatacaaagtgctttattttctggttactagattgtgaatcctttgcagacagggactgtastttatcttttatatcgtctacattttctaacatatattaagactttggaaagaagagacagaagaaaggatttaggaggtaaagaggaagaagggactttacattttacatttaactgtatgcatactctgtattctcaagctagtttttgcttagatctttctgtgggatattatttaatttggaaaccaatcatcatagtcaaactcctgacaaacaaattctgtaagtasatagataagcaacaattaactcacacactaatgcattctatttgctttttagtttcatgtatgttgggtaaatgsgaaagaaaaattactgtattcttgtttttatttgttgaacatttatgtagttgcctatgtaatgtgtttttaatttatagctatggagccaggtatgcaaaaatggaaacttttttttataattaaatttagcttaagtctcttagctcatatacactgggtagctagaattaatcttgacaatttagaaaattcaatcgattttgcattataactcagtttctccagaaaaactagttaatatctttttctctcttcttcccttctctgaatctttttcttgtgtatgtagatatcaggggaggaaactgttgatagtgtatcatttcttgcttgatggattatagcataaactctcttccccttaaggctttgctgttgatgtattcaaagtcccacttcaggaattaaaaggagaaacttttacctctgaaccaatctagcttttgcaaacaaaatgtgctgctactttcagtctgttctctggactatagatttataaaattctactttggctgtagaaagccartgatttaacattttgttttcactgaattttgtttgttttctactttccctggggcaatagatttgacctttaaattctggctttaactgttgaaaactggccaggtgcaggggctcactccagtaatctcaacactttgggaatctgaggtaggagaatcgcttgaggcgaggaggtcgatatcagcctgagcaacgtagcaagaccctgtctctataaaaaattaaaacagccaggcatggcggtgagttcctgcagttctagctacttgggagcctgaggtggaatgatcacttgggcccaagagtttgaggttgcaatgagctatgattatggcactgtaccccatcctgggtgatagaaggagaccttatctctctctctctctctctctctctctccatatatatatatgaatgaaactgaacaactagaaaaaattataattttaaaaatgcatttcaaaattttattgtgctacacttcctgtggtgactgaagatggagttagccagagaagcttgcaccaaacaaagtatcttttagtaaaacatcaattcctttattatcccatgtattactattttccaacaaaatagaaatcaccctttgcatctcaagatggctataaaaatgattgatagaaattgctaataattcaccaattgtctgctcttaaatgaatgcatttcagcatttacgctaacaccaggacattccacccctcacctcagagcaaatgttaagctgatactctgaagctgttaagaaaaatcttcactatgtgacaatccttcaaaacataatattctaaatgtgcttgttctataataacatattctctttcttttaacctcattttaaaaatgatgcatttgttgagttcaagtgcatctacttcagaaaaaaaaaatttttgaggagagaaccaaatgacttttgctgtgtttaaagagtaaacccattccatcagaagcaaagtctaaagagattcaacagtaggaagttgtatacaaggtatttggcattttttttctttcctaaaagtttaaaggctgtgtagctaggcataaaagctcaagccttcatgaagttcttttagccacttaaattcaccagaaatataaatagcagagaaataatcatttttaagaagttgcttaatgtttagttattgtgcatatgtgggaggtacctaacattttgattttctttttcgggcattctatgtttagagcttcatgcaaatagttgttcctagcattctgtaaagcattcagggtaatgggaacgtgtcacagtaatacaaactttgtgaaccttttctaattattttgtgctatatttaatcttagtaatttcaaagatcatttacacatcttctctaatattcttactatagctgctttgggttaagtctggttatagcttcttttcgttattttatttataattttttcatatcatatgtttatataagacttttatttccatatctgaccttacatctataattcttcaacaagatttaacactatggcctcagacaggattatttaattgtgagcagtaatcacacaaccttctgcaaagccaaacaaaaaaagaaccagaaaaattcttgctatatttttattcactgctttaaataataaattcatgggcatatagatcatacttctacagaagaggtgactactcattcattgttagtgaatattctttgtatattttctcctctgcaaaattcactagggaaaaaatagtttgtacaagctatcatttcatctttaattaaagagaaattacatagtgtattatatattattaatcttccaagaacagacattgtttttactgtaaatattctttcacttttataggactaagaaaatagctctacaatataaaattgaacaccttagtgaatacagagtaaacattcgttgaatacatatatgttgcatttgtttttaaaaaaagaaaccttgccaatatacttgaaaatagtagcttcttctttcttttactactatactttaatttctagggtacatgtgcacaacatgtaggtttgatacataggtatacatgtgccatgttggtttgctgcacccatcaactcataatttacattaggtgtttctcctaatgttatccctcccccagccctccatcccctgacaggccccagtgtgtgatgttccccaccctgtgtccaggtgatctcattgttcagttcccaccaatgagtgagaatatgcggtgtttggttttctgtccttgtgatagtttgctcagaatgatggtttccagcttcatccatgtccctgaaaaggacatgaactcatcctgttttatggctgcatagtattccatggtgtatatgtgccacattttcttaatccagtctatcattgctggacattgaggttggttccaagtctttgctattgtgaatagtgcagcaataaacatacgtgtgcatgtgtctttattgtagcatgatttataatcctttgtatatatacccrgtaatgggattgctgggtcaaatggtaattctagttctagatccttgaggaatcgccacaatatcttccacaatggttgaaccaatttacacacccaccaacagtgtaaaagtgttcctgtttctccacatcctgtccagcatctgttgtttcctggctttttaatgactgccattctaactggcatgagatggtatctcattgtgattttgatttgcagttctctgatgaccagtaatgacgagcattttttcatgtgtctgttgactgcatagatgtcttcttttgagaagtgtctgttcatatcctttgcccactttttgatggacttgtttttttttctagtaaattggtttgagttctttgtagattctggatattagccctttgtcagataggtagattgcaaaaattttctcccattctgtaggttgcctgttcacgccgatggtagtttcttttgctgtgcagaagctcttcagtttaattagatcccatttgtctattttgacttttgttgccattgtgtttggtgttttagtcatgaagtccttgcctatgcctgtgtcctgaatggtattgcctaggttttcttctagggtttttatggttttaggtctaacatttaagtctttaatccatcttgaattaatttttgtacaaggtgtaaggaagggatccagtgttagctttctacatatggctagccagttttcccagcaccatttattaaataaggaatcctttcctcatttcttgtttttgtcaggtttgtcaaagatcagatggttgtagatatgtggcattatttctgagcctctgttctgtyccattggtctatatatctgttttggtaccagtatcatgctgttttggttactgtagccttgtagtatagtttgaagtcaagtagcatgatgcctccagctttgttatttttgcttaggattgtcttggcaatgtgggctcttttttggttccatatgaactttaaagtagtgtttctccaattctgtgaagaaagtcattggtagcttgatgggggtggcattgaatctataaattaccttgggcagtatggccattttcacgatattgattcttcctatccatgagcatggaatgttcttccaattatttgtgtcctcttttatttcattgagcagtggtttgtagctctccttgaagtggtccttcacttcccttgtaagttggattcctaggtattttattctctttgaagcaattgtgaatgggagttcactcatgatttggctctttgtttgtctgttaatggtgtataggaatgcttgtgatttttgcacattgattttgtatcctgagactttgctgaagttgcttatcagcttaaggatattttgggctgatatgatggggttttctaaaagtacaatcatctsatatgcaaacacagacaatttgagttcctcatttcctaactgaataccctttatttctttctcttgcctgattgccctggccagaacttccaacactatgttgagtaggagtggtgagtgagggcgtccttgtcttgtgccagtttccaaagggaatgcttccagtttttgcccattcagtatgatattgggggctgtgggtttgtcataaatagctcttattattgtgagatatgtcccatcaatacctagtttattgagagtttttagcatgaagcactgttgaattttgtcaaaggccttttctgcatctattgagataatcatgtgttttttgttgttgattttgtttatgtgatggattatgtttactgatttgcatatgttgaaccggccttgcatcccagggatgaagcctacttgatcatggtggatgagctttttgatgtgctgctggattcagtttgccagttttttactaaggattttcacatcaatcttcatcagggatattgatctaaaattctctttttttgttgtgtctctgccaggctttggtatcaggatgatgctggcctcataaaatgagttagggaggaatccctttttttctgttgattggaatagtttcagaaggaatggtaccagctcctctttgtatctctggtagaatttggctgtgaatccttctggtcctggactttttttggttagtagcctattaatttttgcctcaatttcagagcctgttattgatctattcagagattcaacttcttcctggtttagtcttgggaggttatatgtgtcgaggaatttatccatttcttctagattttctagtttatttgcatagaggtgtttatagtattctctgatggtagtttgtatttctgtgggatcggtggtgatatcccctttatcaatttttattgcgttcatttgattcttctctcttttcttctttattagtcttgctagcagtctatcagttttgttgatcttttcaaaaaaccagctcctggattcattgattttttgaagggtttttgtgtctctatctctttcaggtctgctctgatcttagttatttcttgccttctgctaggttttgaatgtgtttgctcttgcttctctagttcttttaattgtgatgttagggtgtcrattttagatctttcctgctttctcttgtgggcatttagtgctaaaaatttccctctacacactgctttaaatgtgtcccagagattctggtatgttgtgtctttgttctcattggtttcaaataacatctttttttcttccttcatttcgttatgtacccagtagtcattcaggagcaggttgttcattttccatgtagttgtgttgtttggagtaagtttcttaatcctgagttctaatttgatggcactgtggtctgagagacagtttgttgtgatttcttttcgtttagatttgctaaggagtactttacttcccattatgtggtcaattttagaataaatgcgatgtggtgatgaaaataatgtatattctgttgatttgggatggagagttctgtagatgtctattaggtctgcctgttgcagagctgagttcaggtcctggatatccttgttaaacttctgtctcattgatctgtgtaatattgacagtggggtgttaaagtctcccattattattgtatgagagtctaagtctttttgtatgtctctaaggacttgctttatgaatctgggtgctcctgtgttgggtgcatatatgatagttagctcttcttgttgaattgatccctttaccattatgtaatggccttctttatctcttttgatctttgttggtttaaagtgtgttttatcagagactaggattgcaacccctgcttttttttgttttgcatttgcttggtagatcttcctccctccctttattttgagcctatatgcatctttgcacatgaggtgggtctcctgaatacagcacacttacgggttttgactctttatccaacatgccactctgtgtcttttaattggggtatttagcccatttgcacttaaggttagtattattatgtgtgaatttgatcctgtcattatgatgttcgctggctattttgcctgttagttgatgcagtttcttcatagcatcgatggtctttacaatttggcatgtttttgcagtggctggtaccagttgtttctttccatgtttcatgcttccttcaggagctcttgtaaggcaggcctgatggtgacaaaatctctcagcatttgcttgtctgtacaggrttttatttctccttcacttatgaagcttagtttggctggatatgaaattctgggttgaaaattcctttctttaagaatgttgaatattggcccctactctcttctggcttgtagggtttctgccaagagatccgctgttagtctgatgggcttccctttgtgggtaactcaacctttctctctggctgccgttaacacttttcccttaatttcaaccttggtgaatctgacaatcatgtgtcttggggttgctcttgtcaaggagtatctttgtggtgttctctgtatttcctgaatttgaatgttggcctgccttgctaggttggggaagttctcctgaataatatcctgcagagtgttttccaactgggttccattcttcccatcactttcaggtgcaccaatcaaacatagatttggtcttttcacatagtcccatatttcttggaggctttgttcatttcttcttactcttttttgtctawccttgtcttctcactttatttcattaatttgatcttcaatcactgataccctttcttccacttgatcgaatctgctattgaagcttgtgcatgtgtcatgaagttcttgtgccatggttttcagctccatcaggtcattgaagatcttctctacactgtttattctagttagccattcatctaatcttttttcaaggtttttagcttccttgcaatgggttcaaacatcctcctttagctcagagaagtctgttattaccacacttctgaagcctacttctgtcaactcatcaaagtcattttccatccagctttgttccattgctggtgaggagttgcgatcctttggaggagaagaggtgctctgatttttagaatttccatcttttctgctctggtttcttcccatctttgtggttttatctacctttggtctttgatgttggtgacctacagatggcgttttggtgtagatgatctttttgttgatgttgatgttgatgctacttctttctgtttgttagttttccttctatcaggtccctcagctgcaggtctgttggagtttgctggagttctactacagaccctgtttgcctgggtatcaccagcagaggctgcagaacagcaaatattgctgcctgatccttcttctggaagcttcatcccagaggggcagccgcctatatgaggtgtctgwtggcctctactgggaggtgtctcccagttaggctacacagaggtcagggacccacttaaggaggcagtctgtccattctcagagctcaaccaccatgctgggagaacgagaaccactgctctcttcatagctgtctgacagagtcgtttatgcctgccaaagttgtcttctgccttttgttcagctgtgccctgcccaagagatggagtctagaggcagtaggccttgttgagctcggtgggctccacctagttcgagcttcctggccactgtatttatctactgaagcctcagcaatggcagattccccttccccagccaggctgccgcctcgcagatcgatctcagactgcygcactagcagtgagcaaggctccatgggcatgggacccactgagccaggcaygggagagaatcaccttttctgctggttgctaaaaccttgggaaaagcgcagtatttgggcagggagtgccctgtttttccaggtagtctgtcatggcttcccttggctaggaaagggaaatccgctgaccccttgtgcttcccgggtgaggcaacaccctgtcctgcttcagctcaccccttgtgagctgcacccactgtccaaccagtcccartgagatgaaccaggtacttcagttggaaatgcagaaatcatccatcttctgcatcaatcacactgggagctgcagaccggagctgctcctatttggccatcttggttaggtgaaaatggtagcttcttaatgtgtcattaaagtgtacatctgtggacttcttaaaaattgatgattattataccttctaaggtccaacctatacttctgttccaggggaaatatgataatatacatatgctttctgttgagattrgaccatgactgtatttactgtagggcttaatgatacattcataactgaatgctgcaaattaggttaaagccctagttaatttataatgaaggttttcagtgtttaatatttttaatataagtgactttaaatgtccttaatatgggttaaatttatctaatttcagataacagatatgtgttcacttaggttcatagcccatgatttaagaatgtcttataagagagcttcattcattcattcattcattcattcaacaagcattcttgttagcctaacaagtgccaagtattataacaagtactacttagaatacctcgaggaataagataaaattctttccctcagatatatttcaaattctactagagagatatttttaaaagtaaataattaaaacacaggtagaatctctaattgaggcacataaaccattttatgtgaatcctaaacaacatggaacaaagttggttttgttgtagagaatgaggaggtcagcatgcatttcctgaggcaggaacatttgcctagtgrcttgaaagaatagtaggagttgagcaagcaggtcaaaggggacagactgttcaggccaaggttctaatatgcccacaggacagaggcatggaagatcatgaaggattttggaaatcataaaatatgtataacagaataatagaagccagatctcagaaggttaacagggaccatattcaatggtagtttgactttattttcttttttcaaaaattatgtctcttaggtctgcttgttgcagagctgagttcaggtcctggatatccttgttaaccttctgtctcattgatctgtctaatattgacagtggggtgttaaagtctcccattattattgtgtgggagtctaagtctctttgtaggtctctaaggacttgctttatgaatctgggtgctcctgtattgggtgcgtatatatttaggatatatttagtgttttggcttctggctttatcacatgaatccccacttaatatctttaatgactatttctttaaaacacacacagaaaacaattataacagtaagatctcagtaattccggaacatatcattatgaaatatatgaatacatatatgattaaataatgttatgtttataaatacatttaaattttaactatatataattaatttaatatatatatatakatagatagatagatagatagatagggcctcactctattacccaggctggagtgtagtggcatgatcaaagctcactgtagcctcaaactcctgggctcaatcaatcctcccacctcagcctcccaagtaactaggactacagcaacatgctgctactcctggctaaatttattttgttgtaaagaaagggtcttgctgtgttttccaggctggtcttgaacttctggccccaagtcatcctccttcctaggtctcccaaagtactaggattatagatgtgagccaccacacccagactgattttattttttgkacgataagagggaagtgtgactctgaaagaaaactgaagaataattgtcytttgtagcaaacacacacatagtcagcacatatacacaagcagattgggaaagagaaagacagagagacacagacagagagagtgagagagacaaaaaaagagagaaagagaattaatgatatgttctggaattactgagatcttattgttataattgttttctgtgtgtgttttaaagaaatagtcgttaaagatattaagtggggattcatgtgataaagccagaagccagaacactaattcttttaatattctttcaatttgttagaaatatcattgaccatgtttgttgatattccacatatttgtgcatcttcattcattagttttagctgggagtattaatcattttatgaagaaagaaaatattactgtgctatagtaacttcctgctatcttcatggcctagtcatctaaagaatggagaggatgaggtcaggagacactcttcagagtaggcaactttctctggaattcatttgtttaaatccatcttttaaaagacttatgtatatataagttttataatctgtataatattgctttcattcacgatgtagaatttcatcatcacatattttgttttcattttaatctagaaactgtctttaatttccacctctatgtcastctaaaatctaatctactggaactagaatctaaaataatatgcagtcaatacaaatttctcttaaaaatgtaacatgttatatttcatggattttgctattaaagaataaagggatgtaagcaaaatatgtctccaatttttttataattctcaaagtcttccatttccaatgtgcactctatctgaagtcagaagttaacataattataatatgctagatttgtatgattttaaacacagacacaygcaaaaactaatttgattcatttacttacagaaagccatatcttggaagatgtcaacaagtgtatcatagccttaagagaccaggatgctgataatttagacygtgctgcgggtgctatcagaggccgggcagcaagagttgctcacatcgtcaygggtgaaatggacagttacgagccaggggcttacacggaaggtgtaatgagaaatgttaacttccttacaagtactggtaagtcagttgccaataacagctgcacaatttctcttatttgaatctacatagctacgaatattcatacatgtgggaaagattytagtctgtgttgcttcttttgacatacattgctatacagtgcttgcacactttggttatgcgatttgaaatttatcactgagaagtaaatatattcattggtaaaaagaggtcttctataaatatatgcgttatataaattacccacaggccttagtcagaaaccacttagaatgttcattaatgccttatctattaggagatataattaggctgatatggtatcaagtatgtgatagtcaccaaaccctctgttaactgtatcattgatatccctaagtttttgtttacattacttaaacacagcaagtctgtcctacgtttccagagaaatgctcttaccttcatctgcagtctgtttgcaaaacagcaatttgttcttgcacataatcttctttgattgcataagaaatgyggaaccactcttttgtgttgrttgcagcactcaggttagtattttcgaaaaaycagccagcaaatgcttagttcttgaatccctcagtgaaatggcattttaacactattgttaacctttctccaagaaacttacagaagtgtctgaattcatatggattcaaaaacaatgaggacaatcaactatttttataagtcatgatagcagaactccttcctgggaaaaccctttgtgaatttgtgaaatcctcaggttagaatttttactattgcctcctcacactagggtgatggtgcatctgtgattcctaaaatatttgaaattccaaccttaagtcatcgatcctggagaatcatttttcatgttatgcatatggaatatgaaatttgatatgcacattgtttagccaaaagagtagaagggacaaagatgagtcattttttwaatttttcttttatatttgaagccactccttgaaatgaattaagagaaacaaaccaacagttgaataatattcactagagactaggtctgaagtgctatgctgcaaggcaagcttagcaaggtttgcagggaattgatgatcagttttgctgtttttctagcaagttgataaacaaaatcattgatgaatcttggtatgtaattttcttactatctctttgaaatatttctaaaataatgcaatgctaacaatgtggtaaggaaagataaaactcttgatattattaaatttatattgctatatccactcctcaaagtcaccggtatcaatagggcacatagtagttactttttcaataagttatggcaatatatttacttgtttaaaaagatgattgtgctctggtcattcagtatctcttccctaactaaatttaagcactcctttcatgttggtcaaaaccacrtacagagttttctgtgtccctgatttttttctaccttctgagaatagaatgtaagtaaaagaagaatgtaacaggggttttttttttagacaaataaaaatttcctatcaggaattggttaggtaaaatctaggaggactaatattttgcctctgtctcagttttataatcgtgttagtcttgtgagcatactttatgatcataattctgtttgaggtaccaggtttacagttttatgccactgtttgcaatcactctgagatcagaaaataatgaaacaaagttatttaaacacttaattgcaagtttattaatacctctttgatttataataacctttctagatagctaatccatatggctacattatcacattcagaagagaaaaaaatctgttttcttctaattagttgtatataattttaattaaaattctctagataaattatgtcctatatcccaaatataatgaatataaaataatcctgggttattatgtataaacagcatcttattattagcgtaacggtatagtttaygatgtcccaattttgttattttagttactcagaaaaattttggtgtatctttgaaaaagctttccatttttgtttatgtctaattccaaactattctccaaatagccttctttgaaatttatgaaaagcatgccttactaaaaggaattctgagcaataaattagatgagaaaactaattagatcagtttgatcttaaccaaagctgaaaaatgtgaaaattttctttcccatggagacattgtctatgaaagatacttcccactactctatcctccagaatttactaacaggagatgttcatcgttgtttgcgtctgcttcacatcttggacttattagttataaataattgccaaattaaataattggaaatatcatgttttgtgttatgaggccttaatagtttactttttagcaagtgaacagtaatatctgtggactgtctttctctgtgtttccttttcttttatacagtcttcaggatttaaccctgctttctgaaaatgactttatgaggagctatagtgaattgttgtttattaccaagacttttccgtctttgcaaagtttgccttaaagtattgtcataaatgatgaaatataagccatacttatctaaatcacaaagaargtttttagaacatagcacctttgattttaatcagactttgtagctcattagtacattttcaaaatttgatgatcttctaagtgttttctcagcattaagaagcagggctgacctattatatctcaggaatttatattgttcacaaactctagtgaaatgtagtcaacatctggaatgctacatttcacccagatagaagcataatattgtaatcttcatgtgaaattctttattccaccccatttatccctgttactaagctcctcctcctgtcaggaattcttaataragaatatagaatatattagctttttaaataaataataaascttctggactgtattgtgaaggcttacaaattatactcttagtgtcaacttcagttcttttgtactacgttggggaaaaacctaaactggaagtggacggacataagacatttttgtgtgatttatgaacgctataaaattcaggaatcagcaggccccagagcagctgttgcaaacctccaacccccacctagttttactgtttgccaggctcatggaccaaaacagaacaggtacataaatgaatctgaccaagatatcctggtggcatccactgttggcaactggcagtgatggcaaatacaggttcattcatcaagtatctgatgaggccgagactggaaagtgtgtatccagaattcccaccttcttagaatgaacaattgccatatagttacatgttttttgtctcaaaggcaaatgagacagttgaaagaaattttgagccaataaatttttctaaaattttgttgtaaattgtttactccagtttaagcaacagatagagttttaagatgtatttcatttaaaacgtagtttgaaaaaactttaatagcagttggtaacccctctcaattccctttcatttaatatggtttacatatacatatcttgcattttgtagcttgattaaaacatgctttttttttttggcattgcagctctgtcctacaatcttaaatatttataaaaactaaaggttttagttctagcagtccttaccctctgcagtccggcagtgtttgaaaattagtagtctacatactaggtatgactcaaagaatttttatgtggccagtggagttttgaccaacataattttcacgggaattggctggagcttagtggtgtcctctttttcactgagccttggccatggtctctaccatgccatagtctcttccactctgtctcattatagccccagtcttcttcactcagtttaccttcttgaactctggaggaatttgatttcacctaaaattttatttctaactttttttttttttttctgatgtgggccaaaaggcaccttccacaacacttaagttaatacttccacaatggcggggacatgccaagattattaactgccatcactctctttttaaatatctctaccccttgtttctcacatcaaattctatgcatatttcaagaaaaagcttatattcatgtcctctagaaatytttggcaataatgaattctttctgttctcgtgcactgtagctcttaagggacgtgccaactcaattacatcatcccagacaagtatatgctcttgatgaactcctcagatatactgtcataaaaatggcttttctggtctgggtgtggtggctcacacctgtaatcccagcacttttggaggccaaggcgggaggatcatgaggtcaggagttcaagaccagcctggccaacatggtgaaaccccgtctctagaaaaaatacaaaaaaattagatgggtgttgtagcatgtgcctgtaatcccagctacttgggaggctgaggcaggagaattgcttgaacccaggaggcagaggttgcagtgagctgagatcctgccactgcactccagcaggggtgacagagcgagactccgtctcaaaaaaaaaaaaaaaaaaaaaaaaaaggcttttctttcaaaatggaatatgagctacaggagaaaaagacactcatattatttttctttgaatctctcccagggcctaccattgtgtcgtatgttagaattaaaaagaaaaaaaaatcaaaacccaaaacgaaatctcttgaattgagcttctaaggctttgctaattctatccctgcagttggaatgattgccttttcttctctactgccctcttaaaatataatcattctaaacactttctcaaatgccaccacctttgcaaaggagcttttgattccctttcagttagaattaattgctccattatctgtattactatgagcttgtcctctagttaatgtttatttcactttgcctttgatcataatcagccatttacatacaagtttctcccactagattgtaatgtccttaaagacagacaccacactttctttatttttattttccccrgtagcatctacacatagcagaggggcccaatgatcaatgatcaccaagtccttctccaaaatttaaatttaaaatgtactgcaagattacactgtgatacagtctagttaagcaggagaataggttgtcatcccaattcaggaggaaaacaacccctggaaacagtgggctgtgtcaaaggatggggcagagaaaagattaagaaagtgattcattactgtccagagttagatcttagccacttccagaaaacttggggtcagatttttaaaaggttctttagcaagcttttgaacaattgatcatgaatattgtgtattcaattacttacaagaaccatcattgaactacgtctgttgaaagatccgactsaacctaattttggtaatgcttccagcaaatccctgtaaggggtagtaactgtgctttcacatttgggagccattgttggcgaatttcctcccctttaagcagtctgaacaggctttcaaattatatcctttctgccttttggattagacgttaatataactctttttttttttttaacacaattagagagcattaacaagaggtttctgtctgcagatcacttggctaacctggataactgtgtgtcttcgtgttgataattctaaagttggaaattaaattacaactcagcctctctaaagaagagtaagatctcatgaccgtggaagtgcttctgttcccataggagtgtgggaccttaggtaacattatgagttgaagaaagtagctgttagaacttctgagtggaaaaacctattttctgtccaaggaagactggatttatataggacccagatctagttaagagactaaggatccagttaaagaactaaaataagaatggcaagattcttatcttgccattttaagtaaatgaacatacaaacttgtcagaaaaaagaaaatgctataaaaactgcaatcttcaatatgtattgtgtgatgcaaaatcttttctcacctttttgacatggtacatggagtaatctaaagtgacactgttggtatagccttattttttaaaaaataatatattctgacacagtgatagaaattttattgttaaatgaggaataatataaagggcttaagagtggatattaaagaatcataaagaggggttgagatactgccatatctgaaaaatgtaaaatatgtaactgatgtggtttggctgtgtccccacccaaatctcattttgaactgtaattctcataatcctcatttgttgagggagggacccagtgggaggtaattgaatcatgggggtggtttcccctatgctgttcttgtgacagtgagttctcacaaaatctgatggttttataagcatctggcatttccctttcgggcactcattctctctcctgtctccctgtgaagaggtgccttctgccatgattgtaagtttcctgaggcctgcccagccatgtggaactatgaataaattaaacctgttttctttataaattagccagtctcaggtatttcttcatatcagtgtgagaccagtatgagaacagactaatacagtaactttgagatttttgctaaatgaaggatgggttaacaacagtggagatgaattggcatgggctgaaaagaagggagaattggaagatgaaccagagaatgggaacatgctgtgtggttattcaccagtgcaaaggtgttccagaggtcttgtatcttctgtaactctagaacacctgtgactagcctcatatggatcttctcctgggaaacaagatatcatctagaaagagaaagaggtcacatctttcattctgatcctactttcccgtatttctgtaaaatgactaattcagatttactctatggatctttatgtgctgaaggcaatagaaaaataatttatgtttaaaaagattagacatgaagtattaagtattagttttggttctgggttgcaaagaactgaaattaagaatggctaaattaggcagaaaaacacaggaagactggagaacaagaagaaaaaactggcagactgcaagggacacttcatataggaacacagttaaagtcatcccaaagaatagcttttcaaagtaccattccagccccctctgaacacttaatgccactaacagtatcataacattatgacactggaccacacagctggtacatttattcgctaccacatttcagatggttctaccactggaataaatcataaaatatccctgcttttgcctcacttgctttaaactcaacttccagtgccagaagcattatcttagtagagtttaaatcatgtgcccacaccttggctgtcagcatgcataggggtgagtacctggccttcgagcttctttgcagacagtgctctgcctcacactaagactcttacactggcatattccctgcataataaagggctttgaagtctgttagcaaagggggaagttggggatgatgagaagcaggagaggatgattatcaacgaggaagcaaaaggacccagagaaaggaaattgaggattgatgctgccaacttaattggacatcactgggacaatggaactacttgcatccatattatgcaaccaagaacattgcccttcagcagcttgttgcaaagccaattcttttagatggtttatgaaacctttaaaacaagcataaaagcctgctttatttctggtagatttattaaacaagktattatgataccactccaaattgaggtacattccagggaagacatgccatagcagaatatatgatgtgaatatgattctatggccaagacactagcttcataaaataatgtttgttttgctgtatatgtaaaagtataaaggagtctatgcaggttttcaaaaagggggaacgtttacccttcagtgatatactgaggtttcttctttctttaactacaatgacaaaatttaacacatctgtatcctggtattgttcaaatgtagagtgatactgaattgaactttatattttgttttaaatccaacggaatgggtactttgacttcactaatttttaagattactaagtatgagacattctttgtaacagcatagactagtgttttctaagatcatactgtttgaggctgggcagtggttcatacctgtaatcccagcactttggaaggctgaggtgagaggactgcttgaacccaagtgttcgagatcagcctaggcaacatagtgagacccagctctacaaaagaagaaaatagtaattaaaaaatgttagccaggcatggtggtacacacctgtagtcccaaatacttgggaggttgaggtgtgaggatcacttgagcccaggagtttgaggcttcagtgagctgtgaatgtgccactgcactctatcctggggaacagagtgagaccctgtctctcaaaaaaataaaataaaatcataatgtttgcacagccactgggagaaaagaagtggctgctcaaggcccgaggggatcagaggctctgcagttatcaagcagttttagctccttcccagctaccttgagagctaaggagctcaagatctgaaagctcctctcactaacacacaccaatatgcctcaccagagctgttaggagctctgttctagatagctgtctactgagtaatccaatagttaagtatctttgaaagataattactgtaaaatgttttataaaccataacatagtgtatgtttttaaaaatgtagacaaactggcagaaggcttctctcttccatttcatctcaaaaatcagatttatgaaactaatgaaacaattcccttcagttgttgcaagtatctatttcatgtatgaatagcctgtagctgcaaagacagctaattttacttttttaggggtctttatatatagccagaaaagtctggttatatatttattgatgtgagctgataaaacttttatatactcatctgtaaaacttaattcgaggttcaaggtcactgaggctggagaataaaccaagatattatgtcccttagattttctttcctctagtttgggagagaacataaaccatgtgaattcgagtgtgtaaatcagattgcatttcccctggtggtaagtaattggtgcaggcagcagaacttaattgacaatagctttagccatttcatccccaccctcttcccaactatgtctttcatgccaatttttatgtgattcctcagatgtagtcctggttgggtgggggtggttacaatgggtataattatattgccacgttttcaagacgagcaagtttagtaaatgaagaattaagcatttcttaggtgagcagtacctatagctgttgccgaaataaggtatattgcatttatgctatcagacttcatggacgtaaaagcaaatgctgaaagggcatattgttgctaagaaaaaaacaaattagccggccaacatttgcaaatgacaatgttatctacaagctttattaatagatgtgaatattttattcaatgaaatcaattaattgtttatcatgcatgggtaaattctatttagctctctttcacttgggaaaaaattatgtgtaactaacctgcacgttgtgcacatgtaccctaaaacttaaagtataatagaaaaacaaaaaaactgtaaacactagatatcataagatcatcaatgaagaaagattgcttgactaaaggtggaaaggatattctaaagatagccacaattggaagaacaattctgagagcagaacaagtggacatcgatcaggtgtccagttaaccagctcagggaggatagaagtagttcgaataaagccaaggagactttagacagctggaaagcggtttccactgtgtgccaagccatgatttctactgaaatatattttcacttcacaaatcaaaatttctagctcatggtaatttacagcttcctctttcatcaattacaaaagaaagtattactgcttaataatactacacagcagcctaaggacctgggaagagatttcttctcctgaaatgtattagtaacccagtgctatcttgcaaaatgtaatatattctggtgatcatccaccatttaattttactgtctgccaaaatctgtagcagttaaagttaaatgaacaatttatattataaaattcctctgctgatatagggatttttaaaagtatcatttattataaacactgctggcagtatttctttaagattccagatattctaaagtctagtgttgattgtaggttrtagtgatttaagaaaggttwtacaaattccyttaccacatgcctcaaaatgcttatgtaaaaagaggaattaaagtatggatgttgataaaaaatgaaattatttttgagggaagaagaagtaagttaaaatattgtacttctcttgccatctcccctatgttatttatttatatatcctttaatagctacttctgttggtaaatcggtattagtgtttttccattatttgcatttattaatgtatttgccrtatctccacaattacaatcaaataactttgagtcaaggtactamcaatgttttgttttgtcttttccatctatttagaaagctaacacaagagtaaactgaaaagatataactacgcagtcccagtctaacatcccgttaaaataacagtaaaggaacacaaaagggaataaactcttaatggcaaatgcatgggtgtaggattatcacagggaaaaaaaaaagatccagaagatagaaagcagctggaaacatggagatagatgaaagagagcagcaaaagcctctatctaaactgtgcacaggagggctctgctgaggagctgtgagtttctgcttgactgttgttagacttcttatcacaacactgagttctgcaaggcaatgaagcaatggcttcatgttcatgagaaaattaacatgatcttagaatactatattcatccaaattatgtggtcaaataaaaacctttttgtgtgcataagaactcagaaatgtaacttgtgtagatcttcttgagaaatgacttgaaagtgtgcccaaactaaacaagagatgggaaaaacagaaataggacgacatggaatgctgaaatagtgattctaacccagagatgtaatgaataaaatggcaagttggcagatgcccagcagatccagaaagcaatggatccacattagaatacaaagtcagcgggctcccagaaaataataataataataataataataataataattattattattattattattattattatwataaaagaagccttaaaaagatgcagaaaaccagaatmactaaattagtcacatgataaagaaagcaattcgctatcctctgtaaaatgcattactctaccagtccccacccaggaggcttagaatatcatgaatctaactatatgaccccaaaattttaaaattcggcttccactgctatcagcttatgcttaactttttgtatttgttcatttcctatatttgtcatttcttttgtcattgttaagaaaccagattttagtgtcacatggcaaacatctgttatgctggttttgaatatctattacatatattaaagatatgtacatatgtgcatatgtttctatatatttacaatattatatataaatatatgtattatatgtaatgttgmaactatatatgtatagtatgtattatatatataacatgtcaatgattgatttcttttgttttaaatgatcatttggaaaagagttatcttacagctgggctggaactctccatgattacctggaggtctgacactgacttttggccacaataagaaggcttgaactagtttakatttataatacattgtttaagtttgaaatcaccttgttggtaccaagagtcagcttgtttacaatgtttaggggtgtgtagattgatggcttacgcatgggctaaccagttacatagcatggcttggctatgtgatcagtgggacgtatatcctgaagattcataattcagagatgaagcacatcctgtgtgactgagaagggactctaggtaggtgtgcaagtctcccaggcccgggtgtgtgggctgcacattctttcttctgctatgttgcatttcttacattgaataggtcttccttgagtagtttccatagaattttgcaaaccctttcaattatccaacaccrtctgtaactgttgtagttataactcatttattttattttaaaaacccactgaagatactagaacacacacacacaaagacacacacatacacatctaccttaatcatacagagttaagcaagtggttgcattaggttttgttgctaactgctctgtttttatttactttttaaaaggtgctcagtaagcttttataattagaccatctcagttcatccaggctgctataacaaaatatcttagtctgggcaagttataaacaacagaaatttattgctsacagttctggagctggagaaattcaagatcaaggcaccagcagattcaatgtctggggaggatgcatccctcatagatgatgtgttctaagtggtggaaaggacaaacaagcttcctcaagcctcttttaaaaaggcactaataactgttcatgaaggcagaaccatcatgaccttcatcttttaaaggtcctaccacttactactattgcattggcgaataggttttaacatatgaattttgggggaacacatatgtagacaatagcatagaatttgtgcagtcagaattgctgaatcatggttttttctcagagaactttccaagctcaaaaaccttagtgactaaagatttatttcgtttaacttacacattacacctaactgacatgcatattatatctcattagttaatgggcaaacgtttctcatgagtactgactcagccttttatggcctttcctgcaacagtgtgagctgcccaccaaattacagcttccttactctgcctccttaaaaactgagaactgcaacagacattatcctctccatattagttatttatgctgcatagccaatctccctaaaatttagcaaattaagacaacaaacatttactgtctcataatgtctgacggtcatgaacctgggagcagctaagctaggtggtgttggtcagggtctcctgtgaggttgtattcacactgttggccagagctgcagtcatctaagtctcaactgaggctaaagaatctgcttccaagcttattcatatgtttttgttggcaggaggcttcagttcctcactaaatgggcacctctccatgctgcctatattttttcacatcatggcacctcagtgtgaatgatccagatgagagagagagagagagagagagagcctaagatgcaagccagcatctttgtataacataacttctaaagtggcataccatcgcttttgctgtattcagtttgttagaagcgaatagggcatgaataccaggaggcagatatcactggacaatgttacaggctgcctactacaacttctaaatggcttatactctggatatgcttcatatggtcccatgtcaccaaatagactatacattttttatttattatactttaagttctgggttacatgtgcagaacttgcagttttgttacataggtatacgcgtgccctggtggtttgctgcactcatcaacccaacacttacattaggtatttctaccaatgttatccctcccctagtccccccagcccctgagaggtcctggtgtgtgatgttcccctccctgtgtccatgtgttctcattgttcaactcccacttatgagtgagaacatgcagtgtttggttttctcatcttatgatagtttgctgagaatgatggtttccagcttcatccatgtctctgcaaaggacatgaactcatccttttttatggctgcatagtattccatggtgtatatgtgccacattttcttaatccaatctatcattgatggacatttgggttggttccgagagactacacatttttagtgcacatatatcttatacccctccctgttttctcgcctgacatttaatactggaaacattagcaaaggacctgacatacagtaaatgtatatattaaatggatgaataatacaatgcacatcttaccagggatccttaatagagttgattattgatagtacggaatactgtggaagaggaaatcctctccgttgctaattcatgcaacatggttttatcattttagagacatacatagaggactgtaaccattgccataagtatcattttatgtgccatggtcatgtggagaaatcattacagaggaaatatggaaaaccaaaattctagatttagatttactgtgatataattgtgaaaatccgttaaactctatgggccccatatctgtaagtgctagaagagggttaactaggagatcttcaatgttcctctgtacattattttacttaaacgtttaagaaataaatttaagactcatttgtctacaatgcattaatttatttgctatttagctgttttcaaattgtcaaaattctacatctttttaataaccaaagaaaaaatggccaaaatataaaataaccaaagaaaaaatgtccaaaatataaaaaagtgttgtttttaatttcttaagaagttttctgccaatcttatacatttttactcctggagaactagatgttttgtcgatgtaatttttttattcaataattttttaaaaaattgagatgggatctcactgtgttgccgaagttggtctcaaactcctgggctcaagtgatcctcccacctcagcctcccaaagttctgggatttcagtcatgagtcagtgcacctggacattttgtccatattttaaatgattttattgttgtttttgctattgttctaatggttgaaattaattattttgctatatatatatattatatatatataccaagaacaatttgtcaggtttgtcaaaagaaagagaagtacataaagactaagcaatttagtttattgtggtttagtaggcaaataatatttgtagatattaaaaccaaaagctgtattataattttagctctaatacttaccaacaataagtgatcttaggcaaattacttaaccagtctaagccttagttctgtcatctgtaaaacaagggcaataaaacttatctcttagaggttttgtgataatttccattaaatagcatatatagatctcttgaaatgcctgctgcatagtcttagttctataaatagcaagttattaacattattgttgttattattggattggaatatagtaaagcaatacttggttagatttcatgtgatttaccttctgaatgaagtggaaatatgttaatgtgcaatatataaaacataartcacagaaaacaaccaatactgagatttgtattttgttctgacaaaattttatatccagggctgttttcacttcccctaatatgtttttaattttttttattgtaatctggtgtcttggtcagtttgggctgctataacaaattaaatggagtagtggattaagcaatagagatttatttttcacagtctctggaggctgaaagtcccaaatcagggtgccagcatcatcagcatctggtgagggccctctttctggcctgcaaacagctgccttcttgctgtctctacatgatggagagccgaaagataaaggaagcaagttatctaatgtctctccttataagggcactaatcccattatgagggctccacctttatgacctaattacctctcaaaggccccatctccaaataccatcacattagggattagggtttcaacatgaatttgagagggacacaaacattcagtccacagcatctaggtttaccagttttgtgtcctttcttcaaactaaaattattttgaagagaagacatttttaacaattcaaatgataagcagcgcacgatatagcaaaggagatttttttggcctaatgtttagcagcttcattctgttgttgaaatgtatcgctattacacatgcttaaggaatacaatggtagaagaaaccgtgtattttataccaaaagaaaaatagtgaaagactaagtcatctgatctaagtttataatgaaggaatttatttaaagatgttttccttttcagaaatagtcacttttttagagaattaaaaagatatcaagaacatctaattaatagttatcttaaygacagatgacagtttaattaaatgtgaaaagcaaatttgaaagcatcttagtctgtaaaactacttcatgtataaaaaataaacatttgacagaactctcagagcaaagctatctgagggattctttaaagcttccaatttatcaaattacctttttttttttggtcggcagggggaagtagtctcactctgttgcccagggtggagtgcaatggcaggatctcagctcactgcaacctttgtctcccaggttcaagtgattctcccacttcaayctcccgagtatctgggactactggcatacaccaccacacccggctaattttttgtattttttagtagagatagggtggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtnnnnnnnnnnnnnnnnnnnngttgcacacctatagtcccagctacttgggaggctgaggcaggaaaatcacttgaacccagaaggcggaggttgctgtgagctgagatcgcacaactgcactccagcctggtgacagagcaagactccgtctcaaaaaaaaaaaaaaaaaaaaaaaattgtgtatgaacctctgtgatatttgctggaaaatatcactgttttgagcaaaactagtggtttcttttagttaaagctgcatatgtcacacagatcttttctgatattacaaaggctaataaagtttcactcaaaagtattctctcaatgcagtggtggggtacaatttaacacttcattaaagaaagaaacagaaggtaagtggatgataaaggttaatgatggaaacgactaccctaatctcaaaaagaatggttaggttgggcatggtggctcatacctgtaattccagcactttgggggrmtgaggaaggaggattacttgaayccaggagtttgagaccagcctgggcaatatagtgagatctcatytctacagaaaattagaaaatcaaccaagtgtggtggtgcacccctatagtcacagctacttgggaggtttaggtaggaagatcccttgagcccaggaggtgaaggttgcagtgagccaagattgtgccactccactccagccagggagacagaacaagaccctatctctaaaaaagaaagaaagaaagaaagagagaaagatgmagagagagggaaagaaggagagagagagagaaagaaaaatagaaagaaagaaagagaaagataaagaaagagagaaagaaaagaaaagaaagaaggaaagggaagggaagtggaagtggaagggaagaaggaaggaaggaaaggaaaggaaaaaagaaaaggaaagaaagaaagaaggaaaggagggagggagggaggaaggggaggggcggggaggggagaattccttgttggtttaaaacattatgaatttgatggctgggcacagtggctcatgcctgtaatcccaatactttagggggctgagacagatagattgcttgagcccaggggttcgagaccagcctgggcagcatagtgagacctcacttctactaaaaaaaaaaaaaaaaattcaaaatttagctgggtgtgaaggtgcatgcctgcagtcctagctactcaggaggctgaggtaggaggatcacttgagcccaggagttcaaggatgcaatgaactatgattgcactactgtactccagctggggtgatggagtgagactccatctcttaaaatataatagaaagaaagagagagacagagagagagagagagacagaaaggaagaaagagagagagagagagagaaataaagaaaaaagaaagaaagaaaaagaaagagaaaggaaagaaagaaagaaagaaagaaaggaaggaaggaaggaaggaaggaagaaagaaagaaagaaagaaaaggaaggaaggaagaaagaaagaaagaaagraagraaggaaggaggaaagaaagaaagaaaagraaggaaggaaggaaggaaagaagaargaaagaaagaaagaaagaaagaaagaaagaaagaaagaaagagaaagaaagaaagaaagaaggaaagaatacattagaggtaagcctcagagttgtttccctgtcccacctggaaagcacatactggtccaaaaaattcagcataatctgttttagattatctctacattgactttggaaaatttctaaaattcagatgtcatattcaaatacatcctgggtttttgttcagtaatgagcaacatctatttcccacagaaaaatggggaagacttcactttaagccattgcctttcctataatgaagatatacaaatgattagatatgagagtaacttttattcatagatttcctctttcccaaacagrtggaaacccttattttcaatgtacagatatygaataatgtaaagctacatgatagagggatgagaaattgactgagtttaaaaaaaaaaaagttcagtgtttttatatatagatataatgctttaaaagttttcaaatgctgaayaaatttagtaagatgagggccaggtgcgatggctcatgcctgtaatcccagcactttgggaggccaaggcgggtggatcatgaggtcaggagttcgagaccagcccgaccaacatgctgaaaccccgtctctactaaaaacaaaaaaaaattagccaggtgtggtggcatgcacctgtaatcccagctactcaggaggcttargcaggagaatagcttgaacttgggaggcagaggttgcagtgagcagagatcaagccactgcactacagcctggatgacagagggagacccatctcaaaaaaaaaaaaatagtaagatgattggtacaatggcatgcaattacatcacaattagaagatcactttaaccttcattgaactatactgatgcacaagcactgtacctatcaaataatgaataaagacaaaatarataagacataattctttctctcaagaagaatgaatgtttgggggggatgacagatgtgaacctttaatgcaaaacagaacagaggtatgcatgtatctcctaattgatgctattgtctgggaatgatttaatccagaaatcaggatactcaaattgtagaaaatttggagtactaccctggaactaaacatttaagaaattagcttattaattatctctataacataattgtaggagaatattaattcctgatattcctagataattatcaggccttatttaggatcaccagctttttcttatccaccattatgaaatgagaggctaatcaagtcataattcatattctgaaccaatccacatccactcacccccatctccttctataataaaaaagaaaacagtagacttcaatccctgaaagtaagtgcaaactttcctgttctgtccctttttacgacctcctatctatcaacatttacctgtgaggagcctgtaaaactgtctccagcttctcatcatataagtgtctggatgcaatgctatcccctctgccattttagggtgagaatataatgaaggattatgctcactttacttgtttcttcagtcaaaactgatttgatatttacttgctgtgaggataccaataaactaagtgctgaaaaggagagcatgattcaaatctttcagtkgtttaactgtggttgaggatatattaaatagtgggattcttttataaaacaaggcaggaatatgttaaggaacaaaatgaataggggcaaaaaggaatagattagagcataatacaactgtaagttttataagttttgtaggtcagagaagaccaggtagaagatgtaagaacaaaagtaggaatctaaacattatttaaatttaaaaagaaagtatgttcttcctggaaaggatgtcaaaatatttgtattacattatgatgtaattagagacaactaaaattatactgaacttgatttaatcttcttttgattgcaaagatactttaggttcttgtaatgtttcaggattatccttcaagtattgtgtccttgaaagaaaaatgagcagaaaggtgagtagattttcccactaggtcaggcagtttatgtgactagtaagtcatacgtgggactgggtagcttgtggcaccaacccaagttaaaaatggagtaagtatacctttccctaactcttccactgatgtcaactacaacattggacataatacttaaagcaaatcttggaggactctgtaaagtaatggcagactggagaggaaatcagagtttgaaggataaccccatacaataatatgttccctggactcccctttttttccccatatttcctggcttagactcttctgcaagctgaatctgggaagtgcacaccaagcatggacaaaaaacctccaagcaaaacactttctcaggccagaggacagataagcaggggttaggggtatgggatgaaactcatttaactctcctagcctttgaaaatgcagtccactttggaggtagtggtggcagcagttcccctgttgactgaagagaaatagaaaatacaaattattaatatcaagaatgaaacagggtatcactacagaaccatggacactaaaaggataataataaaatactacaaacacgtctatgcacatacatttaatgaactagatgaaatgaaccaagtgcttgaaggacacgtacctttaaatgtcattgaacagacaataaggagtgttggggaagatgtggagaaattggacacaatgctggtgggaatacaaaatagtacagcttctctggaaaatggtcagactgtttttaaacaatatacgtatgtgttactatctgacacagcaattcagttcctatctgtatacctaagagagataaaaacatacacccacacaaaaacttacacatgcgtacttatagcakcattattaatagccctaaagtgagtataatagtactgatacatactatataataaagtatgatacatactacattattccaagtataatartacttggaaacattatactgagtgaaagaagccagtcaaacactacatattttatgattccattaatataaaatgttatttcatagcagactccaataggaaaatatatataagcacagaaagcagattagtggttgcctagagggactggggacatttgagagtgatggctaaagggcgcagagtttctttttggggtgataaacttattcttaaattgattatggtgatagatacacaactttgtgaatataccaaaacgcactgaattgtacactttaaagggtgactcgcatggtatgtaaattatatcttaaagctgtcaaaaaaaagtcactgaagaagatagagacatattgaatgtcctctatctgttgcagaaattaaattggcagtttaaatgctttcaagagataaaactccaggcctggacagtttccctggttaattctactaaacattgcatcatgtaaggaattacattaaatataatttcaaaaaattaaaaagatggaacacttctaaacttatttcagtaggccagtaatacccgagggatcaaactaaacaaagacattagaagaaaacaaaactacagaccagtatctctcatgaacgtagatgcaaaaacctgcaacaaaatattaggaaatctaacccagcaatatagagtaataactgtataaccaagtatagtttatctcaaggatgcaaggaccgttcaaaattcaaaaattaattattgcaacccaccatattaacagactaaaaaaggaaaaatcaaatgattatatcaaagatgcagaaaaaagcattcaacgaacttccaattttattcataataaaaattctctatacattagaaatagaaagggactttcctaatttgataaaaggtatcaacaaaaagcccacagctaacatcattcttaacagtaaaagaatgaatgctttcttcctaacaacaggaacwtgacaaggctagttatttcactggtcctttttaacattacattaaaggttctagtcagtgcaataaggcaaaagaaagataaaaggcatatatattggcaaagaaaaaataaaatttttctatgtgcagatgacatgattgygaattccaaasatctattatatttatacgtgctagcaatgaacaattggaaaccaaaattataaaagaataccagttaccaaaacttcaaaaattgatatacgtaagtataaatctaaaaaaaaataattgctgcacctatatgttgccagaaactacaaaacgctagtcaaagaaattaaagaagaccttaaaaaatggagtgatgtatcatgttccattattggaatatactcaatatgatgatgatatcaattcttcctaagctgatctataaacttgttacaataccagtcaaaatcctagcagaatttttttccagctatatataagctgattctaaagaaagaattacaaaaatacatttatatggaaaggcaaaggaaccagaatagccaaaaaaaaaaaaaaacaaaacaaaacaagcaaacaaatttggagcatccactgtacctgattttgagacttgcactataaaactatagtaattaagagtgatatttgcaaaagagtagacacatagatcaatgaggtcatttggaaagttcagaaatcaaacaattcttgatggaaatgccaagataattcagtggagaaagactagccttttcatcaagtggtgctggaacaattagacattgaacctcaacttatgccttacattatatacaaaaaatgagtcaaattagataacagctttaaattacaatagaaaactcttaaaagaaaacataggataaatttttgtgaytttggtttggcattgttagatacaacaccaagtaatgacataaaaaattataatttgatttccttggaagttaaaaaaaatcctctgtgaaaggcactgttaaaagagtgaaaagtcataatagagtgggaaagaatatttgcatatcatatcatactcctcaaaaatgttgcatctagaatatatgaaacagtgtaaaaattcaaaaataaagagtttcctattccatagcaaaaataacataataatggaaattacaatcaattaaaagagatatcctattttatgtttgtaggtgctactgacatattgttctcaagggttagagggaagcgtcattcatggagggtttataatgtatcgaaggtactgctaggtgatttgcatttgccattacatttaatcctggtaacagccctatgagcataatattattttcattttaaagatttgcataaaataattttcccaatgtgacccagttaaatggtggatccatgaaatagtgacttcctacaataaaatgggcttgctaccaaaattggcataaacacagaggccacagagtacctttaaatgcaagtttcttacacatactaatactcagtaatgagctctcagttaagttgtatttcttttaaatcgtatatctacttaaccaaactcactttgtcatgactctcaggtatgtttgatgatgaacgccacaccagaattaagcctgtctagcgtgtgtattcctgcctggcctgtctgaatatttgattattctttaaaaataatattagttgcagatgtctgagcctatctttctggtaattccaagttaagactgataagtgtagatcatgatgatcctttgaatcccagtacactagaactaacatttttatacatatgctttctatttcagtgatttttcattcaacaaatattattatgcatcaggcactatgctgggtggtgagatgctatgatgtacaaagtatgtattcttcaggagctcacagttagttcgggaagagagagcccacagtgacagacttagagtaatggatgtctargtcctaatggaatgaggtctagaatgacttcccagggcacatgaagtgaaagcctaaatccaaaaaggctaaggacgttacccaagtgaagaggatggcaaaaagaggaggcattttcaacgatccacttactctaaaagacagattctcaactacttctaaatattttgttgcaaatagatgacccaccctcaaactcaggttcctttgagcctgataaccctttagttataataattcagattttcaactgtttttggacacatttttgatatctcaaggtagttcagaacaatgtgctttatgagacagaaggaagcagagcttgataccttgatgttgtttcaagagccagtgctagtttcttttttagacacagactaacaagggactcttatttttttttttagtgttcatagactttttttttttatttttgagatggagtctcactttgttgcccaggctggagggcaatggtgccatctcagctcactgcaacctccatctcccgggttcaagcgattctccctgcctcagcctcccaagtagctgggattacaggcgcccgccaccatgcccagctaattgtttgtgtctttagtagagacggggttttgccatgttggccaggctggtctcgacctcctgacatcaggctatctgcctgccttggcttcccaaactgctgggattatcaggcgtgagccgctgcgtctggccgtgttcacggaatttttacaaatgtcacggatactcccatatggatgattatttttcctcactattcacatttttgagattttgtgtgtttttaatttgttttttttttactctttccccatttgcatagtgaaacaaaacaaaaagcctcctcaaatattctaaacccagttttcatctccctagatttatctcagcgatccctttcccctgttacaaaaactatccctgggttgattaatctccagttcctccttcctgatttttttttctacatcaactcctgaaatccagagggaaacaaaatgaaacaaattggcaatcttaacttttgcttggttgctcccctagcaggctgagtgggcagactcggaccagctgtctgacctaatttatgtagataagtttacttccatgttcttttctgcttggcagaaacacacgtcacactagttcatttttcttgaggttctccctcaggcaaaagctatgacttgattctctggatatgaaaaatacaaaaacaagacaacaatattttatttttgtgcataccaacagatgtctgcctcaacacagtgagctgcgcatccaacaggctaagaaagatgtacaaacatagccttttaaaaatatatatttgagcctactgaatttacaattgtgcccatttctgtgggccctgaagcagtcactggttttataatggaaatgaatctgatactgtagcaatgaaaattaggaaagtacccaacaatatatatcatgaatctattctattttaatagattttgttccaaacattaaaaatgctttactgaggaatttttaatgaaattggaaagttttcagagtatattatacaggaataaaaagtaggacacaaaattagagaagcatatatatatcatttaaagataaaaccggctacctttaaaatcaatatttatttatgatgaaatatatcatacatgaaagattacataatgataataaaataatcacccatttacctatggctcagcttgagaaataaaacttgcttcatttttggaagcccctttagtgcccctcgttgatgacctcctcttcctgcttcaccacagtctgcctccccaagataaccactaatgagtgcttttgtttgtttgttatttcttttaaaaatagttttgccagataagaatatagtgcataatatctaatgtagctgtacatttttgagatttataaaatggaattatattgttaagtatctttacgtgatttgcttctcgcttttcatttcatccctatgttcacagttaaaacaactcaatggcaccttaagaagtgagagtctctgtgccaattaggggaatttcatgataggattattggccacatttaatgacacaatttattatacagccctttttcactccaaagtatacaatggtgttaggctagatgggtttagctgagttcaaggccctatcgcaatgcagtgctgagaaccactgttttccttcatctttcagaccccatttgttgtatttgcttcctactgctagtcctcttcctttattatgaatgttcttggaaaactatctctatcttccttcaatatttggttcctcctatctctaccaatttgtcatgcacatttgtctatgttttgatcacaatagttcattgtgtatgttccttccccactaaagaggctctgcctgaaaatcaatttatgaaatgagatacaaggagggagggtagccccaaagagcccatgtatgtttgagtcttcagtctgactgctggggccttgttacctactaagtataatgaaatattccttccatttgataccttcttgcttgcttgttgaaattctactatttaaaaacccatccaagtgacatctgctctaggaatccatcttaactaagtcagaatgaaatcttccatctctttagtgcttctccctttcattctggcatatagtacttacttcatgactcttaaaattattattatttttattattatatattgtcacctcctggacagtaaaattaaagtttggatgcatgtgaaattgatatacttaatggcatataatagtcactaaacatttgctaatttcaactacatttgtgttatttgtactataaaataattcagattttcagacctctttttgtgcagaattgtatatgagagatctttaatattacatgatgaaaatttcacacacttaattaggaaatatcttacaaaactcatcaaactaggaagttgtcttgaccttcccataccaaattctccatgctactaaacatgatagtgcaaatttttatttttattcatttatttttgtaaatatctacaatgtgatcatgtttttaaccatctacttgcagcataccgtaaatctaattcaggagttgagttttgcagcatttgattgcagtaaaattatgaatctcattaagcaatcatattgttaaatgttcctgaataaatgtaagatgatattattcagtttctaacactgactcacattttttttaatatctgctatttaacaatggtactcaggaatcagattgtctgcattcaaatcccaactttattctgatattgtaggtaagttatttaacttctctcagcccaagtcttcttatctgaaaaattagaggaaatacttacagcaacctcatgggttgttgtaataaccttctacatattgaatgaaatagcagagcacttggcacatagtacattctccatacacagtaattgacaccggagtggtcatgattactgtatcctcagaaagattaatttttagatgtgtgccctgaagcagaatgtgttgtagaagcatgattcactgaattctgycataaatgggaaatgagattgttgggtctgtgcacaaaattacagacttttgtttttgtttttgttttattttcaaagaaaataatgatctttccaaagaatctgatatagtatattaatttatgtttactaggaaatcactaaagtatggctgtttactatcaagttatcagaagattgttatttaaagactatttggtgtttaacaaagctcttggatctttcccataggatctggaggagtccttctgtggatagacaaggctttgtttgcctttacagtacactaagtaaaacctcaagaggggatgtgtaaatagtgtaaaattcaggatactcaaagaccaaactcattcctccaacttgtgtttaatatgtaaataaaccattcagctactggaatctcttgagatgacattgattctgtcatgtgttgccctgaaataagaggaaamtaagcattttcccaattgacccttcagcaatttctccaggctttttttttttttcaggagcccctttccaattycccatcatttttcaataagatgtgggaatttcttccccaattttttttttctggagctacgttttgatttattttgtgttcattgactatggagtcaggaaatgtatctcttgcccttactcagataaattcgttcaacattctatttttgattgggaaaagaacatatttctaagttttgcttcttgtttgtggacaaatgctaaaaagtataatcaaaatttctctttctcagagcaaattgaagctctatcatttgcctaggcagtgacagcaaaaagcaagcttcctttcccttctctgtcctgaatgcttcctctaagattcttgcttccatgtatagtcttatgtgtctttcagtgagtagcccagaatgttcacagaagagccaattaagacactttgaagtatttaacgaaagaggatattgcagttaacttgggcagcagattctcaacaaagtacccaatttatgcctgctatctagaacaatatatactaaaaatcacagaataatcctttacactgaatgatataactttatatcaccaatgtgttacgttgctataatagaggaaatgtgattcctgtgcagttgaagagtattagtaatggtccactcatttgtttttctttggctctgtaaactgcctctaaagaaaactgcaggatcaaagccattggtgatggggtgactgagaagctaggtatgtgatattctgaagagtaaatgatgagtatatttgttttggttagttttgattaagccatttaatggtaaagttgcagtttaaaaactgtacttatgaccataaaaccaccttatttcaacattattcttgtacaaaaaaaactctcaaacttgttactgcacatgtcatactctctggattttgaatctctttgggtatttttctcatggaaatgattacttytaaagatcatcctgataattcaattttcttaagattgcaactgtttcaaaatagaaaagttagcgtagttgtgaaatttgtgaatggctttggaaagaataacctgctttttcttttccttcatgagccactctctgatgatagctctttattttccaggtatatttgttaatcattgttgcctattaatatttcaacaaagttctcagcttaaaacaatactcacatgtgggtttttgtgtgtcagaaatccaggcatggcttactgtgtcctctgattggagttgtgttctctgattggagtcttagaaagcaatcaaggtgtcagacagggctgtggattcatttgaggctttttcaagctcattcaggttgttggcggaattcagttccctgtggttgtaggagtgagggcttcagtttcttctttgtatctgccaaaagccactgtcagctcctagaggctgcccacaggttttgctgtatgatttccccaacaaagttgcttgtcttctgaatgccatcaaggaagagagagactccatcaggacaagaaatataatcttrtgtaacgaattgtgaagtaacraacatgtaatcaaatatatcycatcaacttttccgttttctgtttgttacaaacaagtcacaaactcaggaagaaagggtcatggtggccaccttaaaggactacctgacacatcagagaaatatttagaatagtcacaataaaatgcaagcctaaatcttatgcctaaaccataaatcccctggtaccagtagaagcaccaggaaattttgttatttgagcagccaatacatggtctaatcataaaagtagttatatgattatcaacttattaaatattctattcaagtcagattctggtagattacatcacatcatcaacaagcggacactcgtagagtaaawcctacagactataatggtgtaggaggcaagattgattgtaaactagcttcttttccttattaaaatgtatgtctctttttgtatatgaatttaaaagtaaacttgattctttctcaacttgaaaccacaatttactattaagttgacccaagtgaaatgactgatattcaacttttttgacctacaagataatttcatatgattcaacctgatagtttccctgtattgttttatacattccaagaagaatgctaaattgtatatacattatcacactcaatcccacaaccatactatgcagtacatggaataatatgcattgtacagatgaggaaatggagtctcagtgggattatgtgaattgattatatttaagctaataatcggctaattaaattatagggttgatagcaaaatgcaaatctgctgttcaaagcctgttcttttagccactattctaagactgataaaaatatatagactaattaatgctaacatcatattttatctaagatgaagttattgtgtttcatttttgcaagaaagactgaagaaagagtagacaggaagagaagaggcttaagagtcaggattcctttctgaatctgatgccaacctgattgtctttcatgatttggtattcttagtattcttaaggttgttttttgtctttgttattctgtagtttcactaaggtgtgtctaagtgcggattcatttttatttatactgttttggaggtatatatcattgcctcctgtttgtgaactcatgtctctaacaagtttcagaaagttcctagctattttctattcaaatatgtcatttattctattatctcgattatctcrtcctgagcatgtgacagtatacatgatgggtagtctcattctatccaccatattctttattcagatttatgtatttccaggcctttgtttcactgtactgtaatccagataatttctgcagataacttttccarttcactaatcttytcttcagttgtgtatratatgatgattcatccatttgttaacttttttwaaacatatatatttcttcaattttagatatttggtagattcttgctgtctgcttttttttttaagataggttctcactctgtcacccaggcaagagtacagtggcaggatcacagcttactgtggcctctaccttctgggctcaagcaatcctcctacctaagcctcctgaatagctggaaccgcagatgtggccaccatacctgactcatttttaaaatgttttgtagagacggaatctcacaaaaatcttgccccagctggtcttgaactcctggcctcaagcaatcctcccgccttggcctccyaaagtgcttggattacaggtgtgagccatggcatccagcctgtttggctcttaataagacataaaacttcctttaatttcaatcttttcataaataaaatggaaatatggaaattgttattaccttagacaataactagagaattaaatcatttaatgtattgaaacttataaaatgtttggcccataggaaatgacatgtatatttttttctactatttattgaatttgcctgatgattatttttgttttctgattttatgattccatatctctatctatagacaaagaaagagaaatactatattagatcactctagtacwtgaatttttttcaggatgtaaatctgatatttgttgtttgctgctttttgtgaggcattttttttttctaccgaagatttatattcacatctgcagatctcagaccacattagccccattccagggtcccaagtataatcaagattcttaatctcatcacctcaatttttccactcaagtctagatgcccaatgtctttcacacttggttacaactctttccccaacctaacaccttcaatgagtctctttacttactgagagcccagaaatgtgataaaaataacgtttcatgtaagttattaggtaattaagtaagttattaggatcaagtaattagaattgtctatcctaccatatagctgcaagcaaaagtctctaatccagtcattactggtcatacaaaatttatgttgtgagagcagttaccaaacaagtgtttttaattgttatgaatatatttactatttggccaggtgcggtggctcacgcctgtaatcccaacactttgggaggccgaggcaggcagatcacgaggtcaaaagatcaagaccatccaggccaacatggtgaagccccgtctttactaaaaatacaaaacttagcygagcatggtggtgcatgtgtgtagtcccagctactcaggaggctgacgcaggataattgcttgaactcaggaggcgtgggttgcagtgagccgagatcatgccactccactccagcctggcgacagggcaagactctgtctctgtctctctttctctctctctctctctctctctctmtatatatatatatatatatatacacacacacatacttactattcaatttaatttcctatattacaacaaattggaggatgtattccacattctttctaacatgagaacagaaggcaatggtttccaactaaatnnnnnnnnnnnnnnnnnnnnctggcccctgacagcttacttctctccgactacggccgcccgtccgcgcgcgctctctagctcacccgtctgccgtgtcgcttcgcattcacccttcgtccaccctcctgctcccctccgctgtcgacctgtctcccagatagtagcaatatacggagctgaactggactccccgaaagcgttcgggaggccctgcctcaccactttgtcccgtgtcgacgctacaagtctgcgtcgatccggatcggaaagccgccataggcatccgccgccgcccacacgtacagcccacgtaccaaacgaaggaagcgttacccatgagtcactgcacacaaagtctgaaccacaatagctacaggactcacggcacccccctccgccccgcgcttcgcacgcatcccagacgtagcacacgcacgtcacctcaccaacacccgccgcccacgccgtgctcaccattatcttgacgtcgcagcacgtcggtctccctgaccccccactcgcctacacgctcggtccccatcctcctgtcgtcccaggtactcggctgacatccgcgcgaccgcccatcaccatcccgtccgcatgcgcactgccgatgactgtaccacactgctgctgacgcagcacacgcatggcacccgtgccatggcgtcacgactggagcagccgacacgatcgcagagctgctcaccagccaccaggctacgtctgcgctgtgcgtcgtctttatgagatggagtctctctctgttgcccaggactggagtgcagtggtgcgatctcggctcactgcaacctctgtctcccagattcaagcaattctcctgtctcggcctccccagtagctgggactataggtgcacaccaccactcccagctaagttttgtatttttagtagagaacggggtttcaccatactggtcaggctggtctcaaactcctgacctcaggtgatccacccgccttggcctcccaaagtgctgggattacaggtgtgagccaccacrccattatttcagatgtgggatatttcaagatgattcagaaactttctgctgctttcagaaatgtatgcatagcttgtcattataaaaagggacttttcaaaaattattttgctatatcatgaagaattcaaccaaataatacttacccaagtgaaataacacctttattctttaaaatcatactgaattcccaagtttccaccttctttgggtacagttattctcagaaaagaattgtttacatttatttagagaaaaaaaataaaaccctctatctagaggcttgaaaattgtttcaaactgccatctatacagtaattcccttcagaatgaaatggtagaataatgacacagaggagcagagtccatcagccattcacactgcctgatttaacgctggtcatcaaaatcaatatggaaatgagcatttttatgtttgaaacctttgtttaacatttttcagaggaaacatggctttggggttttttatgatgctatacattttccagaagccatttaccaattccactgcagtgggccaaatttgctataaactacattctagcctttattgtatctcctggcatcttgctttgttcccatcacatattgttgtttagtgacaaaattatcttaacagcagcatttgtagttcagaatgccggcaaaatttctatgcctgaaaatataaagactatgccatattttttctaatttatgataaacctttaataaagataagtcttgctcctctctttcctgagttttactctcccctattttgaaattacctgtggcttagctttttaatatgtttccttaattattaaattaaatatagttaatgaaggactagaatttttgtatacctttaggttccagaaaggaaacattttttgctttatacttgtgggcaagaaagcattcatgtttagatttgtatacactggggattctagaaccaggaaggcaggaatatgataaggccatatttataccaactggctttctaaatcagatgcctctattgccagtaccattggtcagttcgtctgaaggatgtttccttctatagaaatcataaactwtcataaagagactgtttgggaccatagagagaagactttagatcataagggtagtggtatctaatttaggtttatttaagtaaacagtggcaggaatttcaatttttgatttttaaaattagaaacatacaaaaatacacactacaggctgggcccagtggctcacacctgtaatcccagcactttggttggccaaagccgacggatcacctgaggtcaggagttcgagaccagcctggccaatatagtgaaaccctgtctctactacaaatacaaaaatgagccgggcatggtggcacatgcctgtaatcccagctactcaggaggctgaggcaggagaatcgtttgaacccgggagacggaggttgcagtgagctgagatcacgccactgcactccagcctgggtgacaagagcgagactctttctcaaacaaacaaacaacaacaacaacaaaaacacattgcagtcaattttttttttttttttgagatggagtctcgccctgtcccccaggctggagtgcaatggtgcgatctcggctcactacaacttctgcctctggggttcaagtgattctcctgcctcagcctcctgagtagctaggattacaggcaaccgccaccacgtctggttaatttttgtatttttagtagagacagggtttcaccatgttggtcaagctgatctcgaactcctgacctcaggtgatctgccagtctcaccctcccaaagtgctcagattacaggcatgagcccctatgcccagcctacaatcaattttatagagatttagaggaagagtaaaaattatagaatttgaagattgagagggcttgtctttttaaatttatttaattgacaaataataattgcacatacttatgagtacatagtgatgattcgatacatataatgtatagtaatgcacagggtaattagcatatccatcatctcaaagatttatcgtttctttgtgttgggaacattaaatatccacttctagctatttgaaactatatattattgttaactagagtcatcctagagtggtatagagcactagaacttactcctcctatctagctggaattttgtatcctctaataaatctctccctatcactcccttcccctgacctttcccagccccagtatcctctgttcttttacttctatgagaycaactttttttttttaacttccacatttgagtaagaaagtgtggtgtttamctttttgttcttggcttatttcacgcaacataatgtcctaatcctccaattctatccactgtgaaagacaggatttcattctttttatggctaaatagtattccattgtgtatatgtgtcacattttctttattcattcatctgttgttagacacctaggttgatttcatgtcttgcctgttgtgattaatgacacaataaacatgagagtgcaggtgtctctttgatataatgatttaatttcttttggataaattaccagtaccaggattgctggatcatattggggtcctatttgtagctttttgaggaacttccatacccttctccatagtggctgtactagtttacgttcccaccaacagcttatgagttcctttttctccacattgagagggcttgtcaatgtgccagagactttaaactctgccaatgactggttttgcatctttaggcaaagtgcttaaactttctgaacttcagtattcatatatktgaawtggtgacctcatgttatatttgttgagaattaaawaaaacaatgaaaagattcttactgccctttgcacatagttttcaatcagcaaatattccaaataattctttacatatagttgtcattgaacaaataatacgacaaagataatatcttccaaaaattattgaatattaaggaataaattcagaatattgaagaagagaaataaagratcctgtgatgtggcttatattacaacattacctaaagtagtccattcctcttrgtgaataaatgaaggaattaatgaattatatgaccaatatttatagcacaaaactaatttctttccttacacacagatgtttataatgaatgttatataagagaagctctcctttattgacaataatagtaagcaattgatakttcatatgttctatgcaacattgttttctaaaatcttattgactatgtagaagataataatatttgcatacaaagaatgttttctctgtccttcctcatttttacattaattataaatttaaaacatctagaaatttcataagtttaaatatgtgtgacttggaatgctgtcatttataaatacacacagttttctaaatgaataaatggatgtatttttcatgtcctcaattatctattcatttaatgctctttatgaagttcctgatatgtgccaggcattttgttgggctctgaggaaacagtgatgatgacatgatcccagcgtttaaagccagcacattttactgacatagtcaagaaacttggttgaacactaaatgctaagtacggtttagactatttggactattgcaaaaaagaagtgtaattttctaagacctagataaggactaacacatgcaactaagaattagaaaaaattgaattagaattagaatattgaaatctgtgtgatcttgtgtaagttataaaccatccttgtatctcaaactcattatctgtaaaataatttttcaaaaattatatatatgtgaatatatatatatatacacacacacacacataatgatgcctacttcataaatgtgctatgaatattaatcttcctactgtggtttctgaagactttctatcccatttccatatattgttccccttctgaggttaatacgcaaagaataatatcaacagtagaaagcaaccccctgaccagcacacagactcagcggccatctccaaatttctctcaaattaggttcatttaaccatgcatcacttcgaaaaccaatatgaaaaggtaaaggcaaaagtagtgatgcattttaatgtctgtgtgtttacatctgttttcttagattttattctgtgactcaattaagaagataacaccaagcaattgtgcataaagaaaaatctaaagtacaatttactatgtccattatttctgccaactttaataataactactgatgagcctcacatttaagatatacagcctaggaggcatatgtgtatccaattagtcctatttcttcttagaactaaaaatactcttttatttgtagttttaatagcttaattttgctgatgttataatttgaaatgagcttagtcaaagtagcctctgacacccaaacatatggggttttgctttcactgaatttatttaagtcctttattatctcaagttacagcatggcaaagagactattttatttgcatttagtaaactttcagaacgtgtgcagttttgatagcttataatttactagaatgagggcgtaaagaaatttgatggttgctaacatgtttatggtttcttgaaaagagactggttttatcatcttgtttcatcttcttttaactcatccatgagaatatttgaatctcagaaaagcatccctgacaatcaccatgaaaggaagtaagactcttaggatgatgatagttcatggcacttaatctgtatccacttgcccattataaagacatttggagtctgtttcaatgttagacagaggtatgtttcttaatctgattccatttagcataatgctaacttctaaaattccattaaaaatacattatagagacaggagcataatttttactaccaacactatatatcgagtctgcagatctgagttcaaattatacctaaaataaaaataatgttacctttggatattacttcacctttttttcgccacattttatttatctattaaacaggggtaagaatatctcatccgtatatctctcaggatggttacgaaaattaaatctaataatgtatttaaaatttctcatcaaatgataaatatgagatattatttaagacactatctttaataatatttcatgtattgaaatatgaataaccataattactgcaattgcttaataactgttaaatagggttagtagtaatgaatcttattagaatagaatcatgtaaatagtataggctccttcctgtcttcagacatagtaatatttaaaacaaatatagaaaatttctaaacatatatacactctatactatctgtctagtggagtacgtaaaacaaacaaacagctctaccatctctaaattagagtttagattttaggtttttaggtataaccacccaagggattagctgtgtctccttgacctctctgactctctgattctcaatttttatctctggaacttgacatagaattggtatctgcaatggaaaaattcagtagtagagttgacactttttatactgaatgtgactttttggatgctataagtattgttttggagatgtaacaacctatattgtaagtcaagaaagctagtcaggcaagggaagttgagtttcttgagtatatggtgacaggcaagagatgacaatttaggcaagctctaagtgtcaaccaagacccacaaatataaccctgtccttttttattaatatgtaacaggtgtgtacaatcctgggtaacattagtacatgtattattaattatgaagtcaaatgagtatcatgcatgagggatgtctgcaaggctccatccactcggctgtatttcaaagatgagatccatgggattctagcaagataaatccagcaaattatgggtattagaagcagggagccactcaagaaatctgacaataaagaattcaattattgaaatgaagtagaaaatggtgacttaatctcataggtaaaccagaagtctagttactagaattaacacaaggtcagagctggattatgaataagattaaatcaactctgacccttctgagaactgatttttaaaattcccttttcactacaggaaagataggaattgggacattagacggcactcaagtagcaggaactatctgtaaccctgtctgtagaaataaaaggaatttgggggttaggaaaccaagtaggacataagaattaaccctggctgagcttttaaaatctttcctttactgtctttatctatctttttattttagcttataattgtttatttctctttcccaatttcttcttttaatcttctcaaagaagaaatttcataattggtgaacctattacctctgctgatttatgaaagatttctaagatttaacaatcagacttttatgtttataatatagaaattaaagtttgatttagatattcacaaaagtaccatatttttctctcctttgctttggaataaataaatgatttaaaaattattgttcttttaatagctagctaaattgttttactctaatcccttattgattctcccatgtgtcagtttctgtcaattaataacagagattaattttaaataatcgcttaccatgtgttgctcactgtgtttaagaatgcacatgtttcatatgtgttagctacatttaattctctcaacaaaaaatacatagatttttgttggtagagctagatgctaatattatcgcctttacagatgaagatactgaacacaatctcattggtaacatcaatttaattattgtttaatagttcactatgtgaatgtagtgatttacttcactatttttcttaaagaatttaggtattctttagtttttccactgtaaacaatggcaaggatttattttttaaaattatttcatgcgtaacattttcttctgtagttaagataatttccttaggataaattttcacagtataaatccttgggtcaaaggaaagaaaaattaagggtcttgatgtctattttcacattgctttggacaaagactgttctaatctgctcagttccaacttccttttagaactgtgaaatcacagttaacaacctgcctccctgatctttgtctcatccttccttgctcttttctctttaggttttcattcccctgtttattctgtgttgatcttattcttgcactgactccctaatctctattaagctttcagtcaccaagttttcagctttttctttactatcacttaattactatgttatttctttaactactgtatgttccttcagtaactgttaaaaagagatctttccaaatggcctaagcactttttgaggcttattctgtgtatcatattcacccatttcaagaataaaagttagtgatgtttagtatatttactgagctgtgcaactatcaccataagtcagtttttgagcattttcatgaccacaataagaactcttatgtctatttgctattaatccttccgacctccaggcccaggcaaccaattatctacttttggtgagtttaaatttgcctttctatgacatcttatataatcgaattatgcaacatgtggtcctttgtgactggcgtctctcacttagcaaaatgttttgaggtccatccttggtgtagcatatatcaaaacttcattcctttttatggctgaataatagtccattgtgcagatataccacattttatgttatctattcttaaactgatgaacatttagggttatttctatttttaggctcttataaataatgctgttatcaacatttctctacaagtctttacatgaacatatactttatttgtcttagctatggatacctaggctatgcatagcttcatttatctttatcttatatagatacctaggaatgaaattgctgggtcatgtggtaactcacatatatattccactttcagaactgccatactgttttccaaagtggctgcaccattttatattcccatcagtgatgtataaggtttcttcatttctttacattcttgttcatatttattattgtctagattatttattatgaccaccttagtggctatgaaatgacatctcattagggttttagtttgtattgccttaattacttttgatgttgatcagcttttcatgtgctcatgcaacaagtttttaaatcttttttgagactgagccagggtaatgattaagaatctgaagtttgaacatagtcagacctggttcaaagtccagtgcttcctcttatcgccttagaggaacatcctgatcatcctgagccacagatttctttcccaaaaagagaggagcacaatatctggctcatagcactgtggaggattaaatgatgtaatgtgtataaagtggccagctggttggacaaatgcagtaaatagtagttgctattcttccaaataagtgtatctgtacttatccgtttgagatgcttaaaagtagtaattctaagactctttggtctcaggactcctttacactcttaaaaattattgaagactacaaaaagccttcgtatgcagattaaatttattgatattttctgtattagatactaaaactgacatattttttaaaaatttgtttacaaattaatttttccaataactatgataaacccattagaagttaacataaacaatatttttatgaaaaataaatatatgtttagaaacaaaataatgagaagagtagcatttttttacatttcccaaatctatttaatgatttggctcaatagaaaacatctgggttttcctctctgcttctgcagtcaatctgttatactgcacttcatgcagcctctggaaaaaaatccacagttaactcatgagagcctaacagtgaaaaagacaaataaggtcttagtattattacaaaaatagtttgactttacagatcttctgatgggttctcaaggcccccctggaggccctggaccactctttgagaagcattgctataagagctatgagagaatttttcaacccaattaattaggccctgtttatactcagcactatattcagtgtgaatgattttggacttatttttgaaaaaaattattggaaagtaagtagatgtgaaatttttggaatattagaaaacataatcaaattataaaaataatgaattatagaatagacaatgttacaaaaaatattgtgtgaagaaagactattgtgggccactgggaaattcttgtgggatgttaataaggaatgtcttaaactatgcaataattcctggaggatagagaggttattaactctttgcaattctttttacataagcaaatattccaaagttattattaaatgactagacaaacggtggcaaaattttgggtaatcaaattaggtaagaagaaatatgtgctgggggtggagmtaagatggccggataggaacacctccagtctacagctcccagcatgggtgatgcagaagatgggtgatttctgcatttccaactgaggtaccaggttcatctcactggggattgtcggacagtgggtgcaggacagtgggtgctgtgcaccgagcatgagccgaagcagggtgaggcattgcctcacccgggaagcacaaggggtcagggaattccgtttcctagtcaaagaaaggggtgacagacggcacckggaaaatcgggtcactcccaccctaatactgcgcttttccaatggtcttagcaaatagcacaccaggagattatatcccgcacctgtcttggagggtcctacaagcacggagcctcgctcattgctagcacagcaggctgagatcaaactgcaaggcagcagcaaggctggaggaggggcaccccgccattgcccaggcttgagtaggtaaacaaagcggctgggaagctcaaactgggtggagcccaccacagctcaaggagacctgcctgcctctgtagactccacctctgagggcagggcatagccaaacaaaaggcagcagaaacctctgcagacttaaatgtccctgtctgacaggtttaaagagagtagtggttctcccagcacgcagctggagatctgagaacggacagactacctcctcaagtgggtccctgacccccgagtagcctaactgggaggcaccccaaagtaggggcagactgacacttcacatggccgggtactcctctgggacaaaacttccagaggaacaatcaggcagcaacatttgctgttcaccaatatccactgttctgcagcttctgctgctgatacccaggcaaagagggtctggagtggacctccagcaaactccaacagatctgcagctgagggtcctgactgttagaaggaaaactaacaaacagaaaggacagccacaccaaaacaccatctgtacgtcaccatcatcaaagaccaaaggtagataaaaccacaaagatggggaaaaaacaaagcagaaaaactggaaacactaaaaatcagagtgcctctcctcctccaaaggaatgcagctcctcaccagcaatggaacaaaggtggacagagaatgactttgacgagttgagagaagacagcttcagacaatcaaactactctgagctaaaggaggaagttcgaacccatagcaaagaagttaaaaaccttgaaaaaaaatttgacaaatggctaactagaataaccaatgcagagaagtccttaaaggacctgatgatgctgaaaaccatggcacgagaactacatgacaaatgcataagcctcagtagccgattcgatcaactggaagaaagggtatcagtgatgtaagatcaaatgaataaaatgaagcgagaagagaagtttacagaaaaaagaataaaaagaaacaaacaaagcctccaagaaatatggaactatgtgaaagaccaaatctacgtctgattggtgtacctgaaagtgatggggagaatggaaccaagttggaaaacactgcaagatattatccaggagaacttccccaatctagcaaggcaggccaacattcaaactcaggaaatacagagaatgccacaaagatactcctcgagaagagcaactccaagacacataattgtcagattcaccaaagttgaaatgaaggaaaaaatgttaagggcagccagagagaaaagtcgggttacccacaaagggaagcccatcagacttacagctgacctctcggcagaaactctacaarccagaagagagtgggggccaatattcaacattattaaagaaaagaattttcaacccagaatttcacatccagccaaactaagcttcataagtgaaggagaaataaaatactttacagacaagcaaacactgagagattttgtcaccaccaggcctggtggtgacaaacagagctcctgaaggaagcactacacatggaaaggaacaaccggtaccagccactgcaaaaacatgccaaattgtaaagactatcgaggctaggaagaaactacatcaactaacgagcaaaataaccagctaacatcacaatgacaggatcaaattcacacataacaattttaaccttaaatgtaaatgggctaaatgctccaattaaaagacagactggcaaactggataaagactcaagacccatcagtgtgctgtattcaggaaacccatctcacatgcagagacacacatgggctcaaaataaagggatggaggaagatctaccaagcaaatggaaaacaaaaaaaggtaggggttgcaatcctagtctctgataaaacagactttaaaccgacaaagatcaaaagagataaagaaggccattacataatgttaaagggatcaattcaacaagaagagctaactatcctaaatatatatacaccacatacaggagcacccagattcataaagcaagtccttagagacctacaaagagacttagactcccacacaataataatgggagactttaacaccccactgtcaacattagacagatcaacgagacagaaagttawcaaggatatccaggaattgaactcagctctgcaccaagcagacctaatagacatctacagaactctccaccccaaatcaacagaatatacattcttttcagcaccacaccacacctattccaaaattgaccacatagttggaagtaaagcactcctcagcaaatgtaaaagaacagaaattgtaaaaaactgtctctcagaccacagtgcaatcaaactagaactcagcattaagaaactcactcaaaaccactcaactacatggaaactaaacaacctgctcctgaatgactactgggtacataacgaaatgaaggcagaaataaagatattccttgaaaccaacgagaacaaagacacaacataccagaatctctgggacacattcaaagaagtgtgtagagggaaatttataacactaaaggcccacaagagaaagcaggaaagatctaaaattgacaccctaacatcacaatgaaaagaactagagaagcaagagcaaacacattcaaaaactaccagaaggcaagaaataactaagatcagagcagaactgaagtagatagagacacaaaaaacccttcaaaaaatcaatgaatccaggagctggttttttttaaaagatcaacaaaattgataggccgctagcaagactaataaagaagaaaagagagaagaatcaaatagattcaataaaaaatgataaaggggatatcaccaccgatcccacagaaatacaaactaccatcagagaatactataaacacctctacacaaataaactagaaaatctcaaagaaatggataaattcctagacacatacaccctcccaagactaaaccaggaagaagttgaatttcagaatagaccaataacaggctctgaaattgaagcaataattaatagcttaccaaccaaaaaaagtccaggaccagatggattcacagccgaattctaccagaggtacaaggaggagctggtaccattccttctgaaactattcgaatcaatagaaaaagagggaatcctccctaactsattttatgaggccagcatcatcctgataccaaagcctggcagagacactacaaaaaaagagaattttagaccaatatccctgatgaacatcgatgcaaaaattctcaataaaatactggcaaaccaaatacagtaacacatcaaaaagcttatccaccatgatcaagtgggcttcatgccggggatgaaaggctggttcaacacacacaaatcaataaacgtaatccagtgtataaacagaaccaatgacaaaaaccacatgattatctcaatagatgcagaaaaggcctttgacaaaatctacacccttcatgctaaaaactctcaataaattaggtattgatggracgtatctcaaaataaaaagaggtatctatgacaaacccacagccaatatcatactcaatgggcaaaaactggaagcattccctttgaaaactggcacaagacagggataccctctctcaccactcctattcaacatagtgttgggagctctggcyagggcaatcaggcaggagaaggaaataaagggtattcaattaggaaaagaggaagtcaaattgtccctgtttgcagatgacatgattgtatatctagaaaaccccattgtctcagcccacaatctccttaagctgataggcaacttcagcaaagtctcaggatacaaaatcaatgcgcaaaaatcacaagcattcttatacaccaataacagacaaacagagagccaaatcatgagtgaactcccattcacaattgcttcaaagagaataaaatacctaggaatccaaataaaagacgatacaaacaaatggaagaacattccatgctcatgggtaggaagaatcaatatcgtgaaaatggccatgctgcccaaggtaatttatagattcaatgccatccccatcaagctaccaatgactttcttcacagaattggaaaaaactactttaaagttcatatggaagcaaaaaagagcccgcattgccaagtcaatcctaagccaaaagaacaaagccagaggcatcacgctacctgacttcaaactrtactacaaggctacagtaaccaaaacagcatggtactggtaccaaaacgaagatatagaccaatggaacagaacagagccctcagaaataatgctgcatatctacaactatctgatatttgacaaacctgacaaaaacaagcaatgggtcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcaaaactccgtctcaaaaaaaaaaaaaaaaaaaaaaaaaccaagcaatggggaaaggagtccatatttaataaatggtgctgggaaaactggctagccatatgtagaaagctaaaactggatcccttccttacaccttatacacaaattaattcaagcttgattaaaaacttaaacgttagacctaaaaccataaaaaccctagaagaaaacctaggcaataccattcaggacataggtatgggcaaggacttcatgtctaagacaccaaaagcaatggcaacaaaagcaaaattgacaaatgggatctaattaaactaaagagcttctgcacagcaraagaaactaccatcagagtgaacaggcaacctacagaatgggagaaaatttttgccatctactcatctgacaaagggctaatatccagaatcttcaaagaactcaaatttacaagcaaaaaacaaaccaccccatcaaaaagtgggcaaaggatatgaacagacacttctcaaaagaagacatttatgcagccaaaaacacatgaaaaaatgctcatcatcactggccatcagagaaatgcaaatgaaaaccacaatgagataccatctcacaccagttagaatggtgatcattaaaaagtcaggaaactacaggtgctggagaggatgtggaggaataggaacacttttacactgttggtgggactgtaaactagttcaaccattgtggaagtcagcgtggtgattcctcaggaatctagaactagaaataccwtttgacccagccatcccattgctgggtgtatacccagaggattataaaacatgctgctataaagacacatgcacacgtatgtttactgtggcactattcccaatagcaaagacttggaaccaacccaaatgtccaacaatgatagactggattaagataaatgtggcacatatacaccatggaatactatgcagccataaaacaggatgagttcatgtcctttgcagggacatggatgaagctggaaaccatcattcttagcaaactatggcaaggacaaaaaaccaaacactgcatgttctcactcataggtaggaattgaacaatgagaacacagggacacaggaaggggaacatcacacaccggggcctgttgtggggtggggagagggggggagggatagcattaggagatatacctaatgttaaatgacgagttaatggatgcagcacaccaacatggcacaagtatacatatgtaacaaacttttaccttgtgcacatgtaccctaaaacttacagtataataaaaaraagaaatatgtgcttacttctttttcatatttcacaactgaccagtgaattgcctgttctatattttattttttgagcttggaatcatgtcccatttaaccaagcatgcaatatttatttgatggtaaaaattcaattccacaatatcatatgaacgtttctgatgaaaaacagcaggaggaatagcttgtaatatgggtccttgtaactcagtaatttaatttacagtccaattacttgagcttcatgacttacagggtattatataaagtaaataaagtttctttgaaattaatttttcagtctgaaaacactagaaactwttcaagtatatttgatataactctatttctgtgagaaaaaaaagtattaaatttttctcgtccagctatgtgtgatgcacattcactcattcgcccattgttcaactgttcgttcattctttcattttattttgacatacgatagtacttttgtagtaggttttttttttyccctgaaacatgttcaagccctagggtttctaatggcagagctgaagactggtgtaccaggcagtgccgcatgttatactccattatagactgtgrcagttaattttatgcgttcatttgagtaggccacagggtgcccaggagaaacattgttttggggtgttacactgtaagggtgcttctggctgagatttgcatttgaatcagtgactcagtatagtagattgcaaggcccacaatcacccctgccaaagtgattggtatcatccaatctattgaggtcccagaatagagcaaaaggcagaggaagtaagaattcatccctctttggctgggcgccgtggctcaccccgtaatcccagcactttaggaggctgaggtgggtgtatcacctgaggtcaggggttcgataccagcctggccgatatggtgaaaccccatctctactaataatacaaaaattagcagagtgtgatggcacacacctgtaatcccagctactcgagaggctgaggccggagaattgcttgaattccggaggcagaggttgcagtgagccgagatcgtgacattgcactccagcctgggcaacaagagtgaaactccatctcaaaaaaaaaaaattatatttatatgtgtgtgtgtgtgtatatatatatatatatatatatatatatatgtatatatgtgtgtgtgtgtatgtgtatgaatttatccctctttttcctgcttcactgcttgatctggaatgtctcatcacatttctcctgcccttggactgaaacttacattattggttctcctgggttctcaggccttcagatgcaggttaaattataccaccagatttagtgggtctccagcctgcagaaggcatattgtgggcttctcagcctccataattgcatgggtcattcctcatttatatacacataaaatggttctgtttctatggagaacctgagtaatacacagacttaagtaataaaatggaccgtgaaatttcaggaaagaaatcctgtgatcatcaagaaagacttctctatggacaagtctgagctgcactgattttagaaggaaaagtgagaattttcccagtaaataaagagttgaattgacaaggattcagaatgacttataatggtagaggagcacaataacatcacagctaggtacccttcagcatgctcaggtgtcttgtcttagctgccacttgatactacttaatctaacatttaaatatgatgtatccctaggtttgaatctcacatctgctacttactaggtttataacttgggaaaatgatctaagccctgttttgccatttataacatgacaataataatgctcaccttgaagctttcttatcaagattgaatacaatatgctaaaagctgtcagcacaatgtgtaacacttagtaggcctacaaataaaagattgttgtcattattgattcttaccccctagacacctaccttttggcagagatcacacttgaaataatattagcatggcacaatgtcaatattaaaagaatggctatctattaaatattaaaagaatggtgatgttagattcccattattgacattccctcatgggaaataattttcttttccatgtttcaaatcatctttcctgagtaagtaactggtatttctctcataaaatgattgaagttaagaaacaagcagagataacatcttagttataatgcaaggtgacataataaaatgagaaacaaatacatagtgtttataaattgacacataaaatgtaaattatggcaaattattcatgatacagttttaagaaaayttatttaaaagccaatcacaattcttttcacactctctttctaaatatcaatatacacaatggaaaaaattttaataatcatattatagggtcctaagaattgcacttgaagatttttaaarggagagaataagattagagataatatttttgagggaaaattgatagggtaattgattctagaatgcaaaatttgaacgacaatggcaaagaaatatatgccacatgtacaatgaaatttcaggaatttttcccctgaaggacatttctaaattctttaggtccttaacaccttaatgtatctattttagcatgggtagtgataaacaattgcaatctcaggatcattttaaatgttccaaaaatattttttgacacagaataagaaaagaaagtaaattttcctatcaaatttaggatttgcaataaatggttgtttccctactgtgaagaacatcagttccttatttaacacaatttattcactgtatgtgtagaaaattgatagcaggaacattcctatttgaacattcacagttgctggcttttaaacttttaatttcttactgttactttgcaatcaaatttagtgttgtcgctttgaaataaatgctgggtcacattcagttagttagattttgacattgttttccaggagtcaagaggtggctgaagttcctgagggcctaaaaatagttctgaaacagaagtgtacaccctaggggcttgattatctttgtgagcatgcagttgtattttcaacacaattagctgcctaactgtttgactaaacttttctatgtatttgcacatgtaagtaattatgacagaattaaaatctgaaaagctctctgcctactttgttttcccttatgaataagactaaaaacacatattgaaaagaattttattttgtaaactcattcactgaatgaaygaaatatgaaaggattttttaaaatatatttgttaccccccaaagaggaagatactagagactatgattaaacaaaaagaagttgcaacaatctgctagcaccctttctggtctgatctcccgctacccccaatacacacgtgaatttaatgtacatctattaatatgaatttataaatatacattaatttagtgtacactaacaattaatggccattacagtttatctttatttatagtttcagtttatatattttacccttcattgtattattttcctataacttatgcagcattttatatacattcactttttatatgactcatgccttatatacctatactgaacctaactctgaacacatttaatatgagttagtgtactttttgaatatgaatctgccctttctaccaatcccatagatggaggccaaattgtaaggtatttataagtastacctgtgccaaatgtcgagtagcatcatctgccttatatgaaactcttattggttatgtagatgaagaaggtgcataaagagtgatgagagcattgtaagagtgaagcgtaacatgtagatcaagtattagtgtccttcactttacccattcctgctgtttgatacattctgctctaaatgtcaaaaggatcttctaagttgtgtggtaaagtatcttgtaatccaatgtagtcatttacacccaagtattactttcaaaattgtaaagggcactctgcacttgtattagttggattgagcttgttcattttacaaaattctgactcagttctctaaagtttgcatcaattacgttaaacaatgcaggcttttaaaattgagtaatcatttttatcagccatttttcaacagtggctcttttcatgcatggttaagtgtgattttggctgttaaatcsttcttctcgaatgaaataagcattttaattcagcaatctgaaaatcatcaataacagacattgtcttgcccttttgctctcccaatttacctaatcagttctcattttttaatatgagcacataactatttcaaacagacaattttcagtcctagatttaatgtttctaatagcaggaccccacttagagtcccttggtagttcttgtggctaaacagcctcagagtcaagaaggcatgccttatgacttggttagagctgcactctttgcctttagatttgcttgcaggggagatgtagaacaggtgagcatcttcctcagaacaacccttcattgtcttcattgaaaasaattattaagaagctcattgttggccaggtgcagcggctcatgcctataatcccagcactttcagagatcaaggcaggaggatcccttgagcctaggagttcaagaccaccttgggcaacatagggagactcctcggctctacaacaaaaagaagcacgttattttttctgcaggcaagatatgaacaactcatcttgactcttgtttgctagtttctattctttgaaatggtaaaatcaaatctgtcattcaaagttttgcacatagaaggtacccagcacatttttaatgtttctttttctttcaccctttaatgtacagaaaacagtcaatactaaacaaaaaccgataagcatgtagctgagggactacagtcattactgattatcgttaagtgtatttgcactcctgcctttcgtgtgcctattcttattttaatgtttgcttttggtcccaaaagactcatggggatttctgtggtgatttctaaaattcttcctctgtgtagctccctcctctctgggacagtgcctcacaaatccagctatcccactcttgcaaatctgacctctctccacagctgaggaagactgccaggctctgtttgggtttacttctctgtgatttggtccagaaaatatctccaatgttttgttgtaaaattatgatgtcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaattatgatgtctcagaagttgtaaaattatgacagggtatcttcatttggctgtgcttggttctaccttagttccttttgaatctccatatccagtttaagcatgatgataaactaattaaagcaaactgaaggccaaccggcatgcatcgggttaaatgatggcttctcagagcatcttgtcatcatgaaactgaagagttccctgatcccccatgcaggacatggaacaggtttgtggctcacttgttcagttgccatcactgctcaaaccccttgcaggaaggggagcatgcagatgggcaggtgcagaggctggggccagtgctttgggctctggccctgtggtagtgtctaggggtgggtgcctgcaaccccagtgttacaatgctgtcttagccttgctgtctgcacatggctttaagtgttaaccagttcagtggactctctgcctttttgcaagggcagaaggccagagtgacagctttctgtgtcctgagctcttgcccactgtcctggaagaattggattacacatggacttgaaggatgaatgtgaggtttttttgtttgtttgtttgttttttgagatgcagtctcgctctgttgctcaggatggagtacagtagcatgatctcagttcactggaatctccgcctcctgggttcaaacaattcttctgcctcagcctcccaagtagctgggattacaggtgtgcgccaccacacctggctaatttttgtatttttagtagagatgaggcttcaccatattggccaggctggactggaacccctgacctcatgatctgcctgcctcagcctcccaaagtgctgggaattcaagcgaatgtgagtttttattgagtggtggaggtggccctcagtggaatggatggggagccagaagtggggatggagtggaaagatgatcttcccttggagttggaccattcagccactaaactcctctctgaccaccccaagccgaactcctctcagcactcagacattccccctcttccctctttctctgctgtgtcattctgctgttcatctgcttgtcttatatcctcatctgctggtcttttctggagcctgggatacaggatagggacatggcaggccaaaaggcaactttttgggagagaaaacagaaatgcctgttctcatttagggccacgggtgtccaggcttgagagtaggggctttgctggggaactgccctcttcttcttctttttttttttttcgtttgagatggattctccctctttcacccagggtggagtgcagtggcacgatcttggctcactgcaacctccgcctcctgggttcaagcgattcttctgcctcagcctccttgagtagctaggactacaggcatatggcaccacgtccagctaatttttattttttgtatttttagtagagacaaattttcaccatgttgcccaggctggtctcgaactcttgacctcaggtgatccgtgccccttggcctctcaaagtgctgggattacaggtgtagactgccctcttctacccagtatttccaactcctgttcatatcatcacaattaaatagaagtacaaatggcatgttaaaaaaatatattaaatacaacccttgatgattaagcacatttggtttgaatttataaaatagatacttagtgtggcagattaatttattgagacattaatttgtattttgttcttactgctgttggaattacatttacctcctgtatcattaaaaataawttttttaaaagggaccccgtaatgtggtcttttacctcagaggcttttgtgctgcaggtttaaagcagaagttaccagatacccataagccaaataagtcctgacttttgtttgttcaggtctgggctcatttatgggatttatgatgcacagttcaagcaggagtatgggagttcttggatttctaggaaaggtgactaactagagacttttgwgggcttataccagattggttctaggtccttgagagagtggaggttgaaaagcagctctctgctccctcacaatgccctggggagcggtgtatctagtgaaaagggacactaaataccaatgttttggtctccagtaagtcaccatattttgtcaaaagtctcttttcctaaggttgacacttaagtgcagctggcaacatrtattcagcaggattcttgttcttcccaaatgtccagaatggagatactcctgccaactccctcccgccaaccaggatttgttcttttcctggtacttgtttgttttgcaaggctttgtgtagtctcttctctgcatttacagctcagccaaagattccaggaaatctgtatagagatttctggaactcttttactgcatagtgccctcctctctggtacaatgccctacaaattccagctgcctcacctcctccaactgaactttgatttctgtctcttcagctaagtatgattggcatgccctgcttgggtttcctctgctcatgtctaaatctaggaagtgcctccaggcagaaatcctgggcgactgtaggacattcctcatttgttccactcctcattgcaaacacagttccttagtgtctgttttccagtgcctgaaaagagctgttgcacatatttttcgagttttccaatagtttatggctggcaggctgatctgctaccagttattctcaaagccagaagcagtagggtgatattttaaaaacagatataagtgtgtgattcctctacttagagctcttcaatggttttccacagaacttagaaaaagattcgaaatcctctgtgaggcctgttctgagtgtgttctgggccctatctaccagcagagcttcacctcagccactgtcattttcacccactagtctacctagtctcactttcagtgttccagggtgccatgcacattcccaaatgaagacctttaaatgccaacttggatataatccatctgactcatgtgtctactcctgaactatttaattgtagatgagagtgcaaggccacacatcacagcctggtcactaggacactcatatagcatacgcacatttccttggcttcagcataaagagtattatttggagctttttcgtagcagtggacaaaggttaaaatagcgagaattttttaaagtttattgtaaacacagtattttggcaatagaaaatacactcggagagtataaaaatatgttatatctttgtttatggaaacaatyagtattttgaaatttaaatcttggcatttaagtagttaccataaaaaagtattcattgcaggttttcaaaaatgtatgcaactaattatatttagtaaaagaatacatttaaaggaaataataagtggaattgttgagaataacttgaatgattctaaaacaggctaagagtttttyattagtttcactttctaattttatctatagttcactttaattgcacagttaagttacttcttaggatttccaccaagtccaaccctcttctacctccaacctttaaatatcagcagccccctaaggtataaatttacctttagtttttatgtttctttcggtaacttaatagaatggacaatcttgatcccaatggaaacatgacttttccaaaattatgttttgcagaaagctcttctaacatgttataactattttttttcaaatctatattttattttttacctattcaacaaagatggtccaacataattaaaaatcattgatcagttgagtagaagctggacttgggctaccatgtaaaactcaagggccactattcatatcataatctatgggaatgaggactcctgaagctgtacagagcataatctggctggctatttgtgatgggcattggtctggaaggcaaagttattgcatttaaagagagagttatttaattgcatgtttgatgtcttaataataataatgtaaacatgatttttaaaggccaaaattttggaagctgttgataacaacacatttcttggccaaaagaatattttctcagccactttaacaaaagtctaaatgaaaagcttcatttgcattactgttctttatttctgtctattctctcctttggcaacatttggcaatattttctcttttttatggtgttacaagaagcatctttaaattactaggtcaaaagtatttttacagatgtattagaagatatggaatattatatataaaaggaaaatgtgttttttattatcaggaacagaatgtctcaggctgggttaggaatgagagaaccaagacctgcaccaaagtcctagtgatacgaagacagccaacctgtcaatgtgtcatgctcctcagggcagcaagtggccaagggttgtggagataactcaagtgaccaggaattgacgaagctaaggcaagaatttgtaagattcacattcagtttacattggctgaatggcaattttgtttcagatggtatgcttggtaacactgacatatattaattaaacattatttaatgccaagatagacatcaaaaggagaaatttgccaactggctagaggcaggaaaaattagaaccaagtaggcaagaaaaagaagtgcataaatgtgtagggtaaatcaaagccaaagatcacaactagagggagacttagggaaattaaaacagcagcctaaagccagcaggagaataactgtgacttaccaaaagaaagaatattcaaaatgaagatgatagtgataagaatggtcatagtgatggtcgataagacttatatatcaggtgcgagactaggcattttatatgcaatgctgcgtaaaasctcacaacagccccacaacgtaggtataatgtaggtttgatgatgggtcaaaatgtcagctttattactggagctgcattggagagtgcaatgaattctgtgaatcaacttgaatcctaatgacctttctaaatagttttctctcagtattaaattcatccactcagtatctactcctacccacaggagaacaggaacttggtgattttaattcatgccctttcttagtctcacaaataaatactctcttcctttgaagagtgggagtaagaagtgaaagatgttttttggtgttttatgtttgtttgttttcttttatccagttacaaatygcatttgaatgctagtaacagacattccaaacagtagattaaccaatgtaattgttttatttttgtctaatgacaagaaatttataggtgtatggttggtggcattaaaatatcagggcaaaggattttgtgattcttttagattttccctggaagctaagatatagctgcttaaacaattatgttcatattctrtgttctagaaaagcaaaaggcaaagtgttgcaaacaagtttagtttatccctacatcccatcccctrtcttatatgaagagcttttctctgcatttctacccaaggacttctacgtacatcttactgaccaacatcacatggttatccctagctgaaaagtaggcttggtgtgtagattttaactgggcatattgcttccctcaattattgggattccgttaatgtaaagggagagtaaatattgaatcagtaagtagctctatgggacatgttactccaagagtgtttttctcaaggtgaagttctcttttgaaaacatgaataagggagaataaaacactaaacacttgattttttttcccatttgattatgatcaagtaattattcccatttttattattattcccatttatagttgtgatatccaaggctcagaagagctaagcaacttgaccaagttcatactttataaaagtggatttatattcaaacctaaaattgactcatttaataactcgatttcttaagtatttgctagctcctttctttctctcaggagtaactcaagggcttgcaatgcgtgaacgagtgctcttaaagtaatagggaaagggtactgaaccaaaaaaaaaaaatasttctacctttaaggtgcagtgatgtgaagttgaaataccactgtggctcagagaagttttatgcaagaaggttctcaaaagatatttctggattgcatgcatcagaattattttaccaaatatctagggacagagcctggtaactgcagcataattagctttgaagagcatttacatgtgcatactaaracttgggaaccactcagagagggtgagatcagtttcatctaagcatggaagaatttttagaagaggtggttaatctagttgttggagaatagggatgacctagaaacatggaaataaagtttcacttagagggcatggattttggcaatagcatggatgaggaaaaacatgtggcatatggatattggagaggaagcttggcgtgcacagagaactgggagcaatcagatcaaaatgagggaagaccagagtaattggtatctatggatcacaacgacagaatacaaagaaagataggtgcacttgtctcaaagaccttcacataggtggagagattactattgaccactgggattatagagtatgcattatatttagaagaaaatctcacttatccaaattcgcgtgcacacatacacacacacacacacacacacacacacacatatatatatatatatatatctcccagcaactccacctgcaaatgatcttactcagctgattccactaactattcatagatgacttggttgatctagggacaaagggcaagataaaaaccctgctatcccactgggccagctgcaaagcaagcttcattttgaaaataaagcttcatgggcaaaataaataagagcctgtacaaggagatggggctctgaaggttattttaaaactttcaagcaatgttttcaaccacataccataatgctttccmcctttttcatattttgctttgtcttttgtccatatagttgctggcatgcacttatttaataaatatccgactctataaaataaaaggagaatccattagtgaatgtaattaaatattactgttattgatttagttaatgaaaatcattgagagctttcagagatcattttcataaccttgacagaaaattcaaatgtcctttcctacaaaacaccatagaaataaatcaccatgcattcctttactgtttgtgttactgacattaaatcacactaatttgataatataaattataaaatttcttttctttttttaaattttttttaattttttgagacagagtcttgcactgtcacccaggctggagtacagtggagtgatctcagctcactacaacctccacctcctgggttcaaataattctcctgcctcagcctccygagtagctgggattataggtgcctaccaccacgtccagctaatcttttgtatttttagtaaagacggggtttcactatgttggccaggctggtcttgaactcctgaccttgtgattcacccacctcggcctcccaaagtgctgggattacaggtgtgagccaccacgcccggcttaaaatttctttttataagtatttctacgaaaactgtatcataaacaaacccaaataaatgaggaattatgtagaaatggcaaaacttgactaaccataaatttagtttgtggaaaaaaaattattcaaaggcatgtgctggccatcagatactgaacgaagaagtattcttagaaacatcaccattttctctgtattttaatgtattaaacttgcattaagtttccaaacttaaaatttgtattttatcttattgtctaactgatcattagactatgttaacaaaatttcacttacatttgatataagcatgaatgtctaaaaaaattatattttgaatgtaatgcgaaactgaactaatttgtttttgaatatgtgtgcattttatgaactttcatctatcttatgggtgcttttaagatcactaattagtctgctattcaattctttttaagtaaacgttttgtctaaattttattctgccgtaatcagttattgagaaaagttcataggttttggtctagacaacaagttaaatttatattacttgttttaaaacataattatctgtcaactggataattgaaattttaaataagtattagaagttaaatatagcaggtccttgaataatatcattttgttcaactcctgttgttataaacaatgatagggggagaaaatcaattcccacctgggccactgtctgtgtggaattcgcacattctctggtgtctataggggttttttcttggtactctggtttgctcccaaatccccaagatgtgcacattaggttaactggcttgtctacattgtcccaatcagagtgagtgtgggtgtgtgtttagtacttgctgtgtgtgatggaatggtgtcctgttcagggctggttcccttcttgtgcactgagtttyggggataggctccagccacctgtgacccagaactggaattaaaaaattaatgagttaattaatatatattactgtaaaataaaagttcataaagtagacaataatcccacaaattcactacataaaatgatgcagtgcaaaagtgctcagggagcccaccctgttcatgattgttttagaactgcatgatagaagagctgctctttacaattttcacttttgcgaatatttattcttagatttaacccactacctttaccaccactgtcactcactgattcaccaaaaattgggtaaaccattattttatttgtttttgtttgtctttcttaatggtaagtatagctcacatttatttcaatactcaatattgaaagtctctttgtcttatttagaagtttgttgatatttttgtgaccagaaacatgccatgggagcttaactcttgtttatatcaattaaccttcgttaaaattggttgtgttaaagttgcggttttcaagaacctatcaataatgttaagtgaggatttcctacaagttatgatgttaagatgaagggaataaaggtgtgactgactttaaaatcttttcagactggcttaagatagtattgtttatttgccttcatgttttagagttttatcatgttgtaggaaatatgggcttcagcttttccagttcctaagagaataaacttgttacctttgttttgaggatgaaatattacagaataatttctccttaggtcagaatctcatttaataagaaatttttaacatattgccttttatcagcctcatccttctctgtaacatctggcctgagaaataagcaagttgaaaatagtctttgtggtataaatctgaaataccagaaataattagcaagtgtatataaacaaaaccaagttacgatcagtgttcaaaccatagcacttatttmcacacacacacacacacacacacaagagaagtcagatttttagagccccttgcctctggattggttcaaacacagagccctttaatacttgtcattcaactcctttgagactttcattgttcataaaatgggtataagacctttctttcatggttgttgtagatactagaggcaggatatacaaaatctgtcttacatctctggtccatattttgacctaatatcagtcagctgtcattattaataatgaagtggggccaggatagaagatacattaagtcatcagggattgtggcgttagaactgggaatctggaaaccttagtaaaactggtatttacttaaaaatcatttgtagttaaggaggaaaattacttacttctagtagagaaaaaaaaaggagcaataagctatctcagtaaaatttattaataaagaaagaaccacggtgtactattacccttgaaaaatgtaacctttgcctccttcagttttttccatatcttcttggagatgaaagggtaagtccatgaaaaagtgaaaaagtaacccaccacacatcgtaagtttctttctaagaactgtcactttccttctattttaaaggggacttatttttgcactgacagacacaactgagtgcaaaagcagatgcttaattatgatatgatttttttaaaactggatttttactgttttttattcttctgacttttatccaagtgatgctaaagattggcttgaaatttataagtattgtgttcaatcttgtaaaagacagtttgaacactaaattaattgtttttatataaattattattgaaatgttagtacctgtgaagaagttctactctattttattcaaccaataatatctcaaattttataagatattgaagctcagagaagttgaaaaacttattgaagattctatattctaattggaggaaattgagatcttgtcaaagtatatttgaacttagagttttctctgccatacttcaagaatgtccccttgagggaagagaagaagaaaaggaaaaaagaatgatattggatcatgataattaggaactgatggtcaatgagagcataatcacacagatgttttccacacatgatattttaaaatttttaaattaatttttgctacctataattagaaagattttatatacaaatctaatttctagcctttttaaaaaaagatacatttggcaaccttgggccttatttcatcatggcatcatcacttatgaattagctaaagctggggtggagctgccttctttatctaggacatctagtcttrtgctcaatgctgtccctgggccagcttcactcattcatgttacctgtgcagctcccggggaagaacatgtgagctatgatgaaacaggggcccctgctgagatgtttcctatgactggtgaaggctaagcagcctgcatacactggtaatcctatgtatgtatgtatgagtrtatttatttttgcttcaattgtctgttagacctaaagtttctgggccagggaggatgagatagtttgtatgtctcaaattcaggaattaaaatagagcaaagaaatctgagggcctcccattttaccaaattcaccttgtagacaagggaaatatttcagtattcattatttttctgacccatttgccttcttgtagctattagagaatggaggagtttaagatgtaatgagtgaaatgtgtaccaggctctgaatcaggctcttacgctttactgcatatattcattcacttgtgtgttgagtgtctttatgtcattrtcatggcaattgctggagatatacacctaccctcacagcccaaggcttgagagaaagacaaataataagtaatcaagtaaagaagttgctactcatgcaaacagttgtaggaactatagctacgtggtcagagaaggcctctcagagtggatgacatttaggatgagagttaagaggagaaggagccagacactgtacaagctgggagaagagaactctaggcagaggatcaacagcagcaaaygccttgggaacacagtgttttatctcccagctttagagtctgaaaacaaagttaatgcaattgcagcctacttgaataaaaggaagatgatattggcaaagtggacaaaccatggtgaagagttggtaagttcattggaaactctcatttaatcctcccccaaacactgtgaaacagaagcaaatcttaggcaaaagaatcatccagactgatcacttactagctatctatcttggtactggttttaatcttatttgagcttcaaagataataatacccacatcataggactttttgtcagaactaaaggctatatgccatgcagagttttacgggaatgtccagcccataggaagtgctccgtaaatgataggttttattattttaaataaggaagggggaagatacactctctctcttctcaatctagactctcttccttttccttcgtccggtaatggtgaagttatgatttgtgtgatttcattttaaagtttatcatggtcaaggcttgtgtctaagaatttcagcaggcaatgtgtttgagctccctcctcacctcttcccacctgtaacattagttctttccccttctttcttctgtctgacaattggtggtggtttaaagaatctgcaatcccgccgggcattgtagctcacgcctgtaatcccagcactttgggaggccgaggtgggtgtatcacgaggtcaggagattgagatcatcctggccaatatggtgaaaccctgtctttactaaaatacagaaaattatccgggcctgatgatgcatgcctgtagtcccagctactcgggaggctgaggcaggggaatctcttgaacccaggaggtggagattgcggtragttgatatcatgccattgtactccaacctggtgacagagtgagactctgtctaaaaaaaaaaacaatctgcaatccatggactcagagtttctaaggtttataaccctctgattattttgacagccttcatatatactccccctcaatgtatttatacacacacacaacacaacacacacatacacacacaaaaacacacatttgtagattgggaaaggaatcatgaagcagctaaaaacactgctcaaaaatttctaagaaagattgttgcaggcaagttaggcatgtacctgatagctacccaaggcctaactacatagtgagatgtagaaaattttaggattcggaaactttgcctttaactgaatggcactgggaggtgggaaaggagaccagccacacaagcaagtgagtcaggagagtgtgtcatgaatattaagcagacactttttagatactagagtactaaaaaatgagaaaaatctatttcaattaattagatgaaaataattataacaattactaaaatagcctatatgtggctaattattataactacaaaagctcttaggcacacccttaatagtgatacgtagcagctttgtttagttgtaagttttacataattacaacattaaactatatgtagctatactttaccttctattattcaagtagcaagtcatctaccaaaacccaacatttagaagatagaacatggcttttaaaaagtcttatcatctacgtaagggtcaggagatgggagaagttaaaaatcaggaccctgaaattccccaggaragtaactatcagggagcaacgtaaaaaaaattattttcccatattccttttccatatacaagagttctatgcatataggagccccatgtagaaatttttagttgtggtatctttctgagtctaatattaaaacttctggcattactgtgtgcctaatgtattgctgtatgttaccattgcaggttgaatacacatcacacacgtggtggggttctgctggagcttgcgggtcaaggccctgtcactgtactaagtgaagtaaagcaccatgctactgttaggactgcttattcttgtggctgtttggatcactgtcatgtactctgtataagctgatagctgcagatggttccaccttctgattcctgtactgactactatgtcttaaaaatgaaaagtttagccacaaagacttcagaagctcagctattcagctttgccttacacctgggtgtgattctctctaactctctttatgctacttttagctagtgcaacttgccataggaaaaaaatactgaaaacctaaaatgaccrtaagagcaacaaactttctgatttctgtcattcttttaaccaagataattttgaaggtagctatctatgtgtttggatacttggttcctaattagtgacgtgctctccacaatctgtagaacatatattctttggatatatatgcctcaagtattctacataaggtgggcatatagttacctttttctagtgattctgggatacactgtacctacactttgatagaatgtggagcattattgcatttaggacaacagtctaggaaaaagtgaattaattcaacttccaaaagtaagagttatatatactcacacctgtaatcccagcactttgggaggccaaggcgggtggatcatgaggtcaggaaatcgagaccatcctggctggctaacatggtgaaaccccgtctctactaaaaatacaaaaaattagccaggcgttgttgtgggtgcctgtagtcccagctacttgggaggctgaggcagaatggcatgaacctgggaggcggagcttgcagtgagctgagttcgcaccactgcactccagcctgggagacagagccagactccgcctaaaaaaaaaaaaaaaaaaaagttatgtataaacaaatattattgctcaactggaatatggcctagaataatgggaaataaatatttgcttttttatgttaccctcttcaggcatgatgaacacagaataaaacattctagaaactgaatttagcatagcatggatttccaaggaatataggccaaatttaaagacacacttgatggaatgtacccagttttccagacaaattatcatctattattgcccaaataaaggcaatttatagaaatagtttagggtacagaaatggatcgtggggtactgaactaaatttagaattaggagagctaggctttgtccatatgatatcggataaatcaacctctgtgggcttcagatttcttcttttctgttaaaggtgacgaatatctctatgtcaaaatcacagtttactatgtaaatatgttgcagagtagaaagtggtaaagtcatgaaagatagcaccaaaggcttaatatctgatgtttgcaagaaaaaaatgtaaaaattattctaaaaaaggccattgagaatattattttttgcctttttttttctttttttttgaggtggagtctcaccctgtcgcccaggctggagtgcagtggtgcaatctcagctcactgcaacctcccaggttcaagtgattctcctgcctcagcctcccaagtagctgggattacaggctctcaccaccacgcctagctaatttatttttatttttattttatttatttatttatttatttatttatttatttatttatttatttattttttgtatctttggtagagacggggtttcaccatgttggctaggctggtctcgaactcctgacttcctgatccgcccaccttggcctcccaaagtgttgggattacaggcgtgagccactgcacttggccaaggatattattttttgtccctcatttccctatttccctatctatataaggttggaatctaacccttttttttttttttttttttttttttgagacggagtctcgctctgccgcctaggctggagtgcagtggcgcgatctcagctcactgcaagctccgcctcccgggttcacaccattcycctgcctcagcctcccagctgggactacaggtgcccgccaccatgcccggctattattttgtatttttggtagatggggtttcacagtgttagccaggatggtctcgatctcctgacctcgtgatctgcccgccttggcctcccaaagtgctgagattacaggcgtgagccactgcacccggcccggaatctagccttaatgacagaattttgagctccagagacgaaaaaaaaggtgttattagaagcgtctatttgtgtgtatgtctgtgtgtgtaactgttatgatggcacataatgatttcaaacactgaggtaaacttttggtgaaaaaactcatgaagcatttcaaataagagcagagtatatatagttctaggtctcatgtttttactgagaaaggttcataaactttacctaaggagataaaatttcctctaaaatgcctgcataaacacatttgtacaaaatagatcattagttgttcatcttaagtagacgtgagtgatagccattttactgttggtaaatgtaggaatttgtatagagaactctttttgaattagttgagagtatgggccaagtagaagaaatgcaaaggctgaaatagcatattaagcaatttgagttaacttttagataatttgccatttcccttaagtagagtaagaaacagatattaaggaagagcatatgtcaacttcaatttaagaagaagccaaggtgtcctgatgaacttcaagtcaccctgattaatttcattttagagctttgaaatatataataaaacatgaatttttatagatgtttataatataagcaaattagcctgtacaagggttagccaagaaaattgtcttcactgacataatttgcttttaaaaagacatgataaaaatgttttcatatattatgaaaaaatagtgatgattttaaatatatgtaagtatatcaaatgtgaatggaaacattttgtactactggaagccaaaataaaaagattgattcagaatttcataagcttgcaaagaattgataagtttttgtttttgtttgtaaattgctgtctttttcagatattaatggctaaaaatgatgccctctttcagaaatttatattccttactcaaaagtctgaaataaagtcatttggcatattggattcaatgcagatatacccattttcaaatcttaaacaggagtgaattctgtttttaagtttcaatatttagtgcttttaatttattgaatctcaaaatttagaaaaatatcgaatttgcagaacaaagagaaaaagttaaacctaatgtgaaatatgattatatcaaacaatgtatattaatttatgaacaataccaagaatgaaaggcacccaccttcaaggcctggctattttttctggaaccatataaatattttcataaaatgttatctgatggcatcttaaattttcatttgcaaaaaatgcagggttatagcaaaatgtttaaagcataaaaatcctgccacctacagtataaacaaagatgtgttttagacatgatgcttcagtgaaaaccctgctcaaatgagactttggtcttgcaaattagggtggcagtatggcaaccctgtcaacctctcttccaggtatgcctcaggmactactgcccactctggaaaatatttaaaccagcagagtggctgcttaatggagctgagcagcagcctgcatttcttggcacatttgacaagcaagttcagtctcagttagtaaaccttatttaagaaactaatgttctccrtttgtgtatttgcaaaggatatgttttagataatgtcaaaaaatgaattatcaggaaataaactaaaaatgaaacttaagtctttagatcaataaaatgcaatacttttgatttttatgaaattcataaygagtgtcacagtttgcaaatgagaatcaaccatttttatttattctcatcctaaatcaaattaaaatttggagtttgtcaatttaaaaaaacagctagtgggaaaatagcaaatcagaatttgtcagaagatattatgtcatctctctgaataattagaagtgttaaagatgactggagccacttacatattctaatatcaatttacaatatcacataaaagcatctttagaatcakgactaaaaactgacttgttcatgtttgtggaacaagtctaattttttaagtttcaatatacctttatttaaaatagttaatgtcacacatgcaaatgatatgtaacattttccagatactataatgataaaacttatttttagttcttaataatttttattttacatcattaaagagtgcagacttcaacatgcactcctttatgaatatatgaaaatcacatgtaaaaattactaacatggccattttacatacaggaagaaggtcacatgtttaacagaaactattcttgcttcctgttctgctctgtactagttatataacttcaaatctctgtgtcttcatmtataaactgggaatattaacagtatctaattcagagggctyttgtgaggattaagtgaattaacacataaaaaatgcttgccgttgtgcctgacacgcaggttcagtaactgttagctaatttttttgttgttagtaatttagggtccagaaagagataaattagacttcaattaacttttctttcagcctagttttaagctcattgcttattaaatctcttacttttagaagtataattgttctttttctagtgagtgtcgttccatgatgtacttttgtatgcaaagctttcagacatacgaaaaccagtctttaattctttttttcttaactccactataatcctttgaaccaaatattgctatctgtctggcaagggcagacaagtacacattttttgcagagcgtaagtactcgatggtcgttatggtgagatgattttatagtaccatctttcaattttacccttgcatatgccagtatgaaatcatacagttttgccctttaaatcttgttttattgttaagtggaggcagtatcaggcagtatggcttactagcaaaacaatagattaggcacagccataaattctaattttggcaccatcatcgattcactaagcccttctgtgctatagcataaagtgcattattgagaaacaccagcgttgaagctgtcatttggctttctatattggcagtaacactaagatactataaatttgtggcagttaaaaaaataaaagaagactcagaacagggaaggaccttattgaatacctagttaaactgtctgtctttagatgaggaggctgagactcagggaagttatgtgatttgctgaaagtcaaactacagaacacaaaatccaggtggctgatggccagttttgtggtctgtccactatctgtgcttccacatggaaccttcaaaaaatttagttaagtatctggacactgcgtctatgtattgcttaaaatctggatttttttctaaccctttaggtatgtgacagttttttattatttgcttggaatgtgggattatgtgataatctttgtgtagtaataattaataagtgacatatttgcaaaatacatttakttgggtcaggataggaaaagcygctatgtgactttggatactgttcactcaacattcttgctgagactttagatttatagmccagaataatcagctgcatggaattgataagtgaggcaaagtgcaagggataagagagagagaatttgcctttattaagtacttaactatgtgtccaccattgtaacaagggctttatatacattttccctttttaagaataagacaatcctctctgaatctgtagcatcagtatcagagttgtcattgataattgctctataacctcagatgaatcttttaacctgcctggaccttgacttccttatttgtaaaacaggcaacacctaaactgtctacttcatgaacaggaagacttcaccatgaaagcacctagaaaagtataaggtaccatcagaatttaaaatcatatatgtttactttcagttgactccttgtgctaattatattttgcttaaggggattttgaatcaggatggtggaaggaaggtaacacaggattaaagattgaataatgagccaaatgcagagtccacttgagaaaatagggttgactgcttcacctttttttccttattcttttcagtttttcatgtgtccctatgtgttggatacattattatcaacactgttttgtacaaattcttttatagaaatcagcaaaagaagctcaaacatgatatgtgtgtgcatatgatctaaaatcaataaaactacaattaatgaaacaaaagtaatacaactaataacttaaatacctagggagatagtttttgtcattctaagttggaaagattatgtttatgttgcatttcagaagagattcttgggtggaagcaagagaaattaacttggctagccgaaatcagggcttttatatagtgggggttagagaggggctgaggatgagcctgcatgtgaaaggcaggcatgagaagttgcgtgtgccaccagggagaggcagaagggagaggagccagaaccacaaaagttcatatgactgaaattttttgttttgaacctttgaaaactaggaaatatatatcaaacacaagagtaaatataacatatatgtacttaaaataytactactaataataaatcaagtaaatatctatgtacttaaccttacctcgtggtcctgtctccccactcttacttaatcactgttctgaaatttgtattgctcatttttatacctgttcctatacttttgttacacagtcaatacaacataatacttaggtgtgtgtgtatggtttatatgtgagtggtgtgggcggatrctcttgagtattatattgttgtattgtaggatcaaattttatttttttaatcctcttcaacttgctttctccacattttgttttcaagatacagatgctttaccccattatataaatgtatcgaaatatatttattgtactactgatgagcgtatggattattagtgcaaatctttgttcattctcatcctctttttctctttcctctttttctctttcttctgttatgtacaaagctactatgaacaatttaattctggtgcatctgttgcaaaagctttctaggatacatgcttgggactgaaggacagggccataggttctgtggctgttcagatttacgaggtcataccaaattgttttccaaaaggttttctgattttctacttcagcgaggagtgaaggaggagttcagatgtttaacaaccttctatagacttagattttttgaattgttggccaatgtgtaaatgagatatatctaaatgatatcatgttttcaatttgcattccttgattccctatgagattgagcttcttccccccaatatgtttgtcctatctctttatttcacttctttgaaatactggtacaacattgatccatttttctttggggttgtttttatttttctggatactatgggttgtatatatttcatcttttcttagtttacatttccttttcattctctttatgatgttattgttaaagaaaatttcaaggtttgtggttttatatcctttgctctactgaggacttaaaaattgccctttaaagttttcaagttttaccgggcacagtggctcacatctatatatcccagcactttgggaggccgaggtgggcggatcacgaggtcaggagatcaagaccatcctggctaacacggtgaaaccctgtctctactaaaaatacaaaaaattagccaggcgtggtggcaaatcgcttgaacccggggacaggaggttgcagtgagctgagatcgcgccactacactacagcctgggtgacagagtgagactccgtctctaaataaataaataaatttgcctttctcatttaagatcttaaccatttgtatttttttgtatattgagataagacttttatttttattcacttcatatgcctaaccaattayataaaaactttttaataataattgtttaaataaaaaagtttttttacccataatgatgtgcagagccagatacataatcaagtataaatgcattgtctgtgtaaaaatttgtcttttgttccaatagactatatgtctgtctctattattttactgtgcatcttaattattctaaatttaaaatgccatgataactggtaaagaaaattttcataactattgtttcttttttttcttccagaatacactgtttattcttaacctttgctctgggtttgttgtagtttgtacatttttttatttcttttttcatctttatgcttttaattaatgtgctggttacaataaccaaggcaacgctaaagagaagtgttgttagtgtttatccttgttgctattatcctattttaaaataaggcttgtaacattttacatttgaatatcacgtttgcggtaaatttttgtgaatgtgctatgtcaaattaaaggtgttcccttttattcctagtttgagtaagaaattatgtcacaaattcctacttgatttctatctgttgagaagcttatatctaatttcccttttaatctgtaaataagatgaattagaaaattaatagattacttaatgttaaaataaacttgtattcctgaaatggatctaatttgggcatggaatagtatctttcttttgtaatgatgaattttgccttgctaaaattttattaggacttttgtatgtttttacatgagagatatttggcttagaatctttttttaaactatttattttaaaataattttgtgtttacagaagagattcaatgatagtacagatagtaaagtgcccacatacctttctaccagtttcccttaaagttaacatcttacattatcatggtatatttgtcaaaactaattaattagcattggtgcaaggcaactgtagactttgttcaaatttcactactaatgtctgttttctgttccagaatatcacattgcatttagttatcacgtcttcatagtgtctttcgaaatgtgacaacttttcacagtttcttttactttatgtatattcttttacaaacacaatgctgtcatgattactgtagctttatagtaggtcttgaagtcaggtagtgtcagtcctctaattttgtctttcaatattgtatcaagtattctgggtcttttgcttttccctgttaagtttagggtcaattagtaaatacccaaaatgcctggctggaattttgatagggattgtattaaatattaacttgattgtacatcaagtagggaaagactgacatctagaccatactgagtcctatctaggcaccggaactcactctccatttatgtagatcttctttgaattctttcatcagagttctgtaattttcttcacatggatcttgtagatattatttttagatttatactaagtatctcttttttggtgctcatgttaatggcattgtgtttttaatttcaaattttagtttttcattgctggtgtataagaaatcaaaagacttgagttgtatcctacaagcttgctgtcattaattagttccaggactttttaaattgattctttgctattttctatatagacaatcgtgtcatctacaaagagatttttaatcttccttccaagtctgaatggtttttatttccttttattgtttattacattcactagtggtgagagtggacatcttgccttcttcctgatcttagtgggaagagatctagtttgtctccattaagtatgatgttaactgtaggcattttgtggatgttttttattaagttgagaaaggtcccttctattcctactttgctgagagttcttactatgagtgggtgtaggattttgtcaaatgcttttccttttaatattattatgtgatttttcttctttagcctaatgatatgatggattatagtaattgatttttgaaggctgaatcaggtttacatacctgggataaatctacttgattctttgtagatttatttatgactatttataataaaattatttatatactaaaagaattagtatataattccttttatacataaytcaattagttttgttaacattttcttaaaaatcttggcatttatgttcgtaagaaatattgatctgtaattttcctttctttcaatgtctttggttttggtaataggggaattatggcctcatagaatgagttggaaagtattcactctgcttccaccttctggaagagatggaaagaattggtataatttcctccttcagtgtttggtagaattaaccagtgagtctatctggtcctggttctttctgttttggaagtttattaattattgatccaatctcctcaatagctataagcctattcatgttatctatgtctgtgtatatgagtttcagtatattgtatctttcaaggaattatttattttacttaggctatcatatttgtgagtatagggttgttcatggtattttgttattatctttttaatgttcatgatatcagttgtcatagtcccttttcattactgatattagtaatttgtatcttctctctttttttttagttaacctggctacgggcttgtgaattttattgatcttttcagataactagcttttgattttgttgactttctttactgattttctgcttccaaattcattgatttttgctctaatttgtataatttattttcttctgcttagtttgaattttatttgctctttttctagtttcttaaagtagaagcttaggttatagactttaattttttttttctcatatataccttaccttgatacttttaaagagcactgggcaagcattttgtagaattaccttcaatttgtatgtatctaaagtgttcatgatttcactggaattacagattttagggaagaataccacacagatgaagtatctttctcatcatctagtatcaggaatccatatcaacatgacttatataactagtgatattaacttcaatcacttgtttaagacagtacttgccatgtttcttcagtataaagctactactccctttccgtgctctgttgtttagaattgagttaccaggtccagtttatactcaagtggaagaaaataaataatcctcctggtgccagaagtatcaaagaattttcaatacaagcaccaggatatttaataaatatggtttggcaagtattttcatgccttgcaagtgtactatttctcctaatgctttgcccagtaattttagcattcatcagtaaaaattatatctgtgatattctaatggtgattttaaaaaatttttcctcattgtaggccaggtgtggtggctcacacctgtaatcccatctcttagggaggctgaggcaggtgaatcacgaggtcaggagttcaagaccagcctggccaacatggtgaaaacccgtctctactaaaaatataaaaaattagccaggcatggtggcaggcacctgtagtcccagctactcgggaggctgaggcaggagaattgcttatacctgggaggcagaggttgcagtgaaccgagatcatgccattgygctccagcctgggcaacagagcgagactccatctcaaaaaaagaaaaaaaatttcctcattgtattttactatttctggatgtatattatttttatttttctattcttagttgttcaaatttcttaagtctggaaattactgtgggccttttagtaagcatatattcaatctgatttttattccgtcttctttattaccttctctttttgttttccatttctgttattctttgtgtttcattctgtgtagtttcttcaaatctgtcttccagtttacatatcccaactatttctctctgaatggatagtatagatttacttcatccaatgagtgtgatgctttgaaagttcaagctttatgcagtgaaggctaaatagttcagatacaattttccttcccactcatggtgcagacttttcatcctctcttttatgcatggttcattggaattaacctgctactttaggcagagttctccagggcaaacaccactcyagcacttactttctcttctgggattatattttttgtaatttctgaggatttaaaaaaattattcttctacccccatggtacaattttttaactatatttaatccagcatttttaggtttgtgaactcagaaaatctgagacaggtctcagttaatttagaaagtttattttgccaaggtcgaggacccacgcctgtgacacarcctcaggaggtcctaatgacatgcatctaagatggtgagaacacagtttggttttatatattttagtgagatacgagacatcaatcagcatgtgtaagatgaacattggttccgtctagaaaggcgggacaacttgaagcaaaggccagaagactcgcagcagggagggggcttctaggtcataggcagataagagacagatggttgcattcttttgagtttctgattagcctctccaaaggaggcaatcagatacgcatttatctcaatgagcagagggatgacttcaagtagaatgggaggcaggttggccctaagcagttcccaacttgacttttccctttagattagtgatttgggggctccaagatttattttcctttcgtaggtttcatatgttgtaaatgtttctctgaacaatatgtaacactagagaataatggaagatcctgtattcttctttaccttgttgcttcactagctcaagattcaaaatccgaggaaagacaatctttttggctgactagatcacttgccaactctctgtctatagatactatggggaaggagaagacatgatctctttggcttaaagagtgaaaggcaggtaccgtctcccaataaaatatccacgaaagggaaatggtgatttcctgagagaaaattcagggctggaagaaagggtgatggatactggggaagagaaatgtaagatataaccactgtaactctcttatctcatctttagcaatgtattttttatgtgtgtatatatatgtatgtgtgtatatggtatatattacatatatatataatgcacattacaatgtattgggtacattgctaagtaatgggtcagctattttatgattatttcattattttcttctaataagtttagtttccctacagtgttggtttgaaaccattactaactttattacttccaaatgccttgtgtctccttaatgaacccatctaagttatggtatgtgttcaaaatgaaagtttgtttaaaggcttgatctgcaagtgtctgccctttaaccttgctattttatcaactacctctatcttgcagagataaatactctaacacattttagaggctgggttctcccagtgctgctgctgctttcttgatttctgctgtggttgcacatacacaaacaatgaaccagacaggaaaaatagcctcctaactggttaattaaatatgcagtttattacaaattatggagtctagttatagggaaaattcactgagttatggcagtccctgtttctctctgcctaaattctgaaagccagagtaagtactcctattatactcatctgctttcaaattctacttaacttaccccatggctccatcctcgcaagctggacgtaagtgcccaaacagtcagtggcccaaacatggcaggaggttggatgagacccgcagtagctccaccatagaaatacaggattcttgtttcactaagtggttatctggaaagttggccttattgtagaaaatgatgaaaggttgcagtgactgcttaactctgcatgattacgtagacaataagaaacatctcttttgaaagccacctttatctgtgtagtgttttctggaagctcaaagcatcttaattttgaggctgagcatatttgagactctataaatgtaggatagaggacacgaggaagagatattgcagaaaaatgcaatgtttctctcagaagagagggcaaaagacagggtacttttggtacagatgtaaaatttaccttttaatatatataattactttttgaaaatatatgattaaatgtattcttaaaccagttttcaggaagtttctttccatgtatatagtcccataattttcccagaaattattttaaattgktattttatttattattctgtctcagcatttatgcccggcttgcraggatggaaccagggggtggttatgtggaatctgtagatccrtctttttcaatgattaacctatttcaaggatgaatttaaaataaataaatttatttttatctcttatgtgtgtataggactggattccttccaaccccccacatctactgccattcttctctttctagtgtaagttcacacataaactcatagaatctatctgctcacacattatatttcattaatgttttcaattcagtaaaatgatgtaacattttcatagtcttgttcagaattaacaaaatgtgaagtatcaatgttcaaaagaaagtggacaagaaaaagaaaaacagtcgttactatttttggcatggattttcagtggggcaaaaataacatgtctgattatttctctgctytgtatttagcacatccatcttttgatattgccccctaagtagttctacttttctttttattatttatgtttgctaatcaagctttcaaagccttgtggatgtgttaaagccagggggtaaagcatgacacaaccaacattttgtaaaatgtcacaacatttagtgaagtaaaatcttcttgaaatccatacagataatcctcccttggattataaacagtatacaatttcttctagtttccagaatcaatcaacaggcatgatttttgtgcatgcgtgtgtgtgtgtatagatatagatatatagatatatagatctgtgtgtgtgtgtgtatatatatacacacacgcatgcacacacatgtgtgtgtgagtttattttgttattctaaccttggctatttttaaaacacacttagggataaatacaaaatatgatgaccattttaaagagatcttgctatgtgaattgaatactagaagaggagacagaatttcgtgcttttgtttagaagacttcatagtcattttaatatggtgatgaatcagaaaatgaaattcctttatagttataatcaatttgagtaacagctgagraagtacaatagaaatcatatagttttacttttatcccatcaaagtcatgaaatattctgacagggmaatttyatctacttgcctcttcctataaatctttaaaaatctgttttaataataggctaatttccctaccacataaaccaaatatactctcagtggatttggaatttatccagaattatgtgtacttcttccattctggttgaagtaaaaatagaaagtgtaaaaaaataaaaatcagtcttggttttgattttgcttaatcattcaacatagatataccttaattattaactacaaaagttaggtatgcatcccctgcattaagaaagactaaggaaatcatccaatactaaaaagtgttattgccatctccaaaatttttcctactgaagccagagacaaaagagttaatgttaatacaaatacaccatgttccatattaccacttctgcagatgactgggacttctgcctgacagaacgtgggacaattatcttgtcctttgtgttcagagatgatgtgctgacaggttatttcctgagcggtaactaagatatgtgacctgctatctttaccaggagggagcctattttgtagttgacagcagcagtcactgaggaaaaagttcgacatttgtggccttgtagccttagggtcagctgagtctggttttgattccttcttcctggtatggtgtcctgatttctgttttgtcttggctttataaactgacactaccttattgcaagtaatctctgaaggtattccctctgtcccagccccctacatgtgcaatcacctaccatgtcctacaattacaaactttcaattctggtgccactttctccattttcttatcagggaaatacactgagtcccattctgaatgtagataggatctctgctactaagctttctttgctggaggttggttctgctgttattgcccagaaagagattaccaagccaacgattatgcatttcttaacctacgcttagaatgtttcagtaagatattgctcttacagtgcattagataaatgcagtttcattaacaaattctaaaaaaaagacaagtcttaggttaagtckctattacaatgtaataataatgtcaataaatatttccatcttacatttgaacagtaattttgagttccacagtcctttcacatacaatacaggtattcctgtaacatgacaggtgtcaccaaaaggatgaatcccctcttgtcttaaaagtctgtgaagctatcaacagagacacatttaattatgactaccaagttcctctttcaaactatagggaaattagcctaatatcaagcatgatttggcctattgccatggcttcaactgtcatcccaatgcaaatgtttaccaaatccttctctctctctctctctctctctctctctgtcctgactgtctaataggtatctggacttgaaacttacctgaaactcaacgtgaatagactcttattaacccatcgagacttcctttccttttggctcttttattactgataatagtttgcccactttcttctagacatcaggattagtcaataccttagtmatcttggaattcttcctttgcattacctccctgcatctaatcagcaataaaatcgtgaagtttctatctcagtaccaaatgtcccaacctgttcatttccactgccaacatcctcattcagatctttatgaactcttttcttctagcctactctaaaacctcctaacttgtcttcctgtttcagcttttctattttatacaagacttctatattcataatgtagagcaatgatttccagtctttttagtattacacaaccttttattccagtgaaactgaacttaaatatatagaacagatgaaaaagtgctgctgtctttgtaacagcgattgagtgtgggaactcacactattttcagtagggcttctcctcaccccctccttcttctctctctacccacagtgyttcctgagacactctcattggaacagagttgaaaaccactgttaaaacawcttctcagacaaattaattatgaccggatgataaaactctatttccaacatgctgcaaggaaataggctttagaaaaagtaaatttaaatatgtcctcttgatagagatgattcatttaaaacatgatgattagacaatcactattagattatatgcaactattccaaagattctcgttaacaatcattgggctattagcatgatggttacttgaggccagtctaatctcctagaagaggtcataatctcatgaaagtctattagaaaggtgcttgatttttttcttgtcaagaatgctgatgaccgggcwcggtggctaacgcctgtaatttcaacactttgggaggcagaggtgggcagatcacgaggtcaggagttcaagaccagcctggccaatatgttgaaaccccgtctctactaaaaayacaaaaaattagccgggcgtggtggcaggcgcctgtaatcccagctactcgggaggctgacgcaggagaattgtttgaaccctggaggcggaggttgcagtgagccgagatcgcaccactgcactccagcctgggcgacagaataagagttcatctcagaaaaaaaaaaaaaagaaagaaaaaagaaaaaataatgctgattaattcacagaaaaagtaatgaattacattgtacaggaaattttaaggcagatcaagtagcagatttactttctcactactagtcatgttagaatactactggaattttctaaaggccattaaatatctatcaaattaagaatagattctttggcttaaagtttaaattacaacttgttgtaatctaacttttagctttttttttccctgttttactacattgatagatattacaatctcaactctactttttctcattttaatgtctctgaagctttatatgattctcttttggcagttttgttattctgccttgtattctacagttagtaggaaacacaggcaaatatataacaggtaatatattgaaatcatattataaatacataattaaaatctacattttcagccaccagtagtttgttatgttcttgttttacctcaaagagattgttaaccttttaaaagctttataggacaattcttcatttttagaagtattttgtgattcattttttgctagctatgcagttttagacattaatacttaatctgactgaaccttagttttgtgatcatcaaaacttatacatatcaataagtaaatatctattgaaatgatttcttcctgcagtaaaagaaaaacacaatgcatagaaggatagaaggaggtagcctgaaaaaatgagatcttagctcatatctgtctctctaggcatctctaggcatcttgaggataataggcaaggtaatgaggtcttttgaggagaaagaagtaggtagatttaagattattagaattaaaaataacaaaattgcttatatatactttctctctacatttgcaggcagcctcatgatgatttggagaattccagaggtagaaataataaaatgatatgtgagaggttttcatgcctcaaaataaaaggttttcagagcattcttgctgactcagtgaattgatattagctttaggtattttgggttttatccttattaatcctcttaacttcagagctttgtccatcagtaatatactaaatgtactgtgtgtrcactattgaggcacagccaagaattgcagtggcagaactttagtgaataggaacagaaaaggtttgagaagcaaacttttccattgagagagacctacacgaaattcacagcaactgattcaatgataacttaatgataactcctttgaccttaatgataaagttagtaggtgcattaattaaaagacaatcattatatgttttacttgtaaaactgggtgagttatgatgcatagaagttagatcattgaattgatagaacttgtgctaggtargcatattcactcagtgcataattactgagcatctactatgtgccagaaacatatttgagaggccgaatcagcaggacatagtgattgattgattgaacatggagagtgggagatacatgaggagagagaagagtaaatttggtgggagaaactgatgatacgaaacatatgtgtttacacataaatgatatatatgtgtatgtatatatatatgtgtgtgtgtgtgtgtgtgtatctgtatatgcgtgttttatataccaaatttggtgtgtgtatacatgtgtgtatgtgtatatatatctgtatgtgttccacatcaaatgatatattgaggtatattataatatattgatatacaatatgagatatattataatacatatatacatataagtacacaaaagtgtttggtatacacacagaaacacacacatatatagacacacatatatatgcatacacatatatataatttatgtgttcacacatataatttggtgtgtatatatatgccaaatacacacacatacacatacatatatacagacagatatatattaatatataaatacacatatatataatttatgcacacatatcttctaagtatcttccctttgtggaacatcaaatagggtgacaaacaataacaactattacaataaaattccttctttaatacaatatgggaagagcacagagaatactaacctactctaactgaccgagaactgcatcaccttccctcttctcagatgtaactggacgtttgaacaaattcatggttcttttagcaacaatgttggtagtgagtattcggggagccaaccaattgtatctgctaaaagtgattctcaaagatgatccctggactagcagtatccacatcagttgaaaacttgttaaaatttagattcttctgcagcactttagacctattgaaccaggaactccatgggtggggccttaatgggcctttctggtgattctgatgcatggtaaagtttgaaaactactgtgttataataaagtttacygagcaatgaatttactgtttgcacaggactacagccttgtaaaacttcagagaaaacacaatgcatataaaatgcaatgagaaaatgcaatcagggaagagacccccaatcaggaagtttgatgtcaagcctcaacataccacacattactgctttcacacgtgtaaatcactagcaaaataactggtacttagtamgtgatcagatgtttgtcttctcttatttccaaacgatcagatattatgatggacactgtcatataggttatcataytttgtaatcctgatctgaggctttctgtctcaggaataaaatgcagctgatacaagtcactttcattttcacaagagaatatcaatttacatcattagcatttttgtttctaaaacaagtgttggaagttcttttgcctgataaacctgaatgaccatcctacaagaagtaactcactgttgacatcaatttcgaataatttgtgactcacttctgtcaaaagcyatgttgagatcrtttattcatttatgcattgactttctctctagaattcaaatcaagacctatttctgtatgtyatatcaggtaggtgcaaatcaaaactctagtactttaactctctgcagacgataatctgatattgtaaaaaataaatagtcttatgaagaatgcttttgcattttcttaacatcatttgtaaagactattgttcattttattatttaataaccaataacataaataaatacatgatacatttattcctcttagtatacagcattgagaaggaaaagtcttttcaagtatatcctgatgaaaatagaaattatcattttcatttgaaaatttcaaagtgcttaggttccttttagtaggtaatatgaaccatataacccattgcttcatttttgcctggacctcaaacaatcaattttatacttaattgctgtaccttaactctaggatttttaatgtaattatatttctgctccctaactttgattatgtggctcctgttggccttgttttaaagcttattgcacacttgactcttttttaaaagctgcttttaattcacttttgggggagatgtaggagagttataaaaataaatctctacttctctttattcacacatcgtattatctatgcatctatccacccaacttctcctactactatccttctttccttttatccacccacctagccatccagtcatctacccaccctctcattcttccatttattcttttcaaatgaatttctgcttgtaaccagatatagccagagaaaataaatacaatgcatgtatgattgtgaagaaacttatggaatcagagagtaactatgctagaggagaagaactaaaccaactttttcattttatagaagggaactttagctcattttgttttctgatgtttcataatcatagtttacatagattcagaaagtttttggatttctataactactttaaacatgcttagcatggttataaaacttcattttcttgtatagacttgtttaaaatagtgtctgtaaaccaacatgtggaaattcagctttaaaaagaaaaagaaattaggaggtgaaatatttatgatagaagttacttcagttgccttaaatagtaagctcccctactgcatttaaaacaggagttttcttcattcattcaacaaatattattaaaagtaataattcagttcaccaaactctcacagccaaaaagtttacaatcaatttctattcagatttctagaaaagtatgttacatgagttaaacatgcttatatgtttaagccgtattaatttgggctccccgaagttaatatattgggtgtaatagtaggaggattcataataaactgaatatcaaatacaggaaaaataaatctattctttaaaaatctttcttgtttgtttccaaagtgctgggattacaggcatgagccaccacgcctggcctgttctttaaaaatcttaaccttgtaccccttgcatataggaagctcttatgcttccatgggaaatacagctaatgcggaaaataaaatcacaactatcaatgagattgaatccataatcttttactgtagtattacaactccttaaaattaattaacagttttgttagaatgaaagtaacaaattggaactgaaattccagacactgttaacatatattgcaattagtacaatttcatcagctgtagaatcccataaacttcaagggattaacacaattaatatggcaaagagataatctataatttctcaaactacaaggaaaactatgttttttgttgttaagtagtcatctatatttataccaaggaagatacatgttgaccaataaagctaagaattgtatcattagataggagctaaaatacaattttgcaatagcccagggcattttgaggtgccagagagggtttctttagggttttttaactcatagtagtgagatatacacagaatcaaagatgataccgatatcactcatccaacattaaaccggtgccctgcagaggacaggtgcttcacaaataattgatttgcaaatatttgaaatagtgctgtccaatagaactttttgtgatgatagaactgagctatatctacactatctaatatggtagccatatgtggtgggctagagtgactaaggaaataaatgtttaattgtattcatttatagtattttaatataaggttaaatagcagcgtatatctggtggccactgtattaaacaacacaactttagaaaatagtgaagtatgagcaactcagtggtgcacacgttaaaaattttaaacatattcattcattcatttattgctatttgcatttggtgttaggtttcctctccccaactccctacccttgttgattgaattttattttttttattgtagaatcttaaaaagtttacagaagtcaaaaatgtacaaaaactactctgagacaaatctatcttctcatatcccttctaccttactcttaagattccttgtatataacaagtcttcttattcctttatccttaatgtgaatcttttttaaaaatgtgtgtgaagataggcaaattaagatgtgttttcttatttctccttcattcttgcacaaaaataatacacatatatatctgtatatacaatttatgtttatatctgcatataaaattatgagttcaagccaacatcttcagttcagtccagtcccatggggttcatctttgtcttaccacagcagtttgtcattccttagcagtacctccctgtttacatagtgagaaccctggctctcaaatatatcacatgtttacatattgtctcaatactctctgggtattccttatactgcttttccaactccactatttcctcagccccacgttttgatcttttggattcacctcttgttttaagagtatgtgtgccaagtgtcttcctgacagttaatagaaattaaatattctgtgtacttgaatgtctgaaataatgccatcattcacttaactgatggattggttggatattgaatttcaagtttaaaataaatttttcttagaattaaggcattattttatgttttttcctttggtatctagcctttctcatgaaaagtctaatgccaatctgattttaatattttgctgataatcttttctctcttaaagatgtagctcttctctttatcctaagtgtcctgcaatgttttgtgggtatgtctcagggtggttattcttacatccaagcaatagaacatagtggctatgggcacaggctctgagtctgagtgcctaattttgaattcttactctactacctactactttcctgaggaaacaaagtgacctgacagagtttatactttgagagctttctgtcaggattttagaagtggctgagtacaagaaaacacatacagtaaagtaagagacataggagctttacaaaaaggtagggcagaggcaaggggctctcattctgttacccaggctgaactgcagtggtgtgatcatagctcaatgaagccttgaactccttggctcaagtgatcctcttgcttcagccttccaagtagtagaaactacaggcacatgccaccatgcctggctaagacacaggtgctttaataaacgtatatttcaggcattagcgtgtccaagagacaggatttcctaatatacttggaggcaagtgtgggggtgctgattgagggaagtttcgcagagaagcttatgtttaaactgaatctgatttcaaattacatgaaggtattaagttatcatatgtaccctcaaatatgtacatctattatgtatcaataaaaaataaatttataaaagtaaataaataaacaataatctgaatctgaagaatgggcagaaagataccagatagacaaggttggaaaaatggttctactctgacacataattatagacaactgtgcaaagagagttgaagtttgtagaggtaagatcaattctatttattttcagccaaggaatccccagcaatatgtgaaggaccaccttcattcaacaccactggtcaaaggaagatacatttctcctactagatgtgatcccaccctataaacctctgtaccttttaaacctctgcacctttttactctagacttctttccctgttcctctagttcaggataccctctgagtactgagcagcattttgctaacactacagaccttggagcccttttacctttctatttttctttaactttttccctgttgtatgtttttctgaatggtagaaagtgaagaaattaagatttgatcttgagcaataggatggtgagtgattctaaaagaggaagatttaacagtctaaactcaagatgcaggagtagattttttaaaaaatcaaagtaatccctagtcttaactagcagaaaccagatccctggaagagatattaaaagggaacaagagaatatactctgcagaaagctaaaaagtaaaagatggtatgtgccaaatattagggaagatacagagcaactagaatatttaggcattgttgataggggtaaaaatttttccaaccacttaggatattgttgatgtttactaatgtgaaatatatggatatactatggcccagcaagtctactgatatgtatattccctaaaaatgtacacatatattcaccaaaaaacatctactaggatattcatagcaccatatatattatagtcccaaactaaaaattatgcaaatgcccatcamccatagactggataaatacattttagtataatgacatgctatacagcaatgagaatgaataattccatatacaacttacrtagaaaaaaatttaatgtttagtgaaagttgatacaaaaaagtatatgcagtatgattctatttgcatgaaccaaaacagttgcacgaacttcttattcayatgcttaatgccactttctactattaattctctcccagttaattaacataacataaataaaaatagtattgataatttaaacatttgagaattcttactgagaaatgcaaagaaaaccaagcaatttaaaaaaataaaatttattaacaatttaaaataaataaaatttataaagtagtacataaaagaacaaaggtcatcatagaacattacttggttcaggtccaactttgaatatttaagtagtcacatttgtgtaaatgattactrtgatgtaaacaaattagaaaatgatgtgaggaaaagcatgaaagagcttaatcttcatcatattaaaaattcattggatacacttttaatataattaaatcagaaatattatttattaatattaacccattatgtagacatatgaagattttttaaattaagctacagggaaagaagatgagtttctaagtcactggagagactcaaaggtggacactcaggctaattaaatgattagcgtttcatatgtagaaaacctactctgccagagggggaaaacataatgtatcagcttcatgaagctatatctaagtcctttctctctagtattttattttttactttttgaagatattccagatattcttgaaagatagagtagagtataacacagaggtcaaaagtgctgctcttgttaaccatgtgatgtgtgataaaggatcagagtaggtcagtactttgggacatatcatttgaaaaatggtgaaatccttactagtcattgatttgtatgatatatgatctatgaggtaccaaacatattcttgatacataatattggctccctaaatattaaatatatatgaaccacaataattagcatttattgaataaatgaaaaaaagaagagtataaagtggtatttgtagaagtcatttatatgcttaatgccactttctactattattaattctctcccagttacttaacataacctaaagaaatgatgacttagcattatgtgagctttcaaaggcaaatttctttaccaccagtaattttcaaaggtaatggtataattagaaatattttaatctgggctttattaatggtagaaaacaatttggtgatatcatttttagatcattattgtaatgagtctgaattcttttctgacctatttaattccataataatgtatcctcacctactttcaaatgcacataataartttatcaaggattaagaagggatgaaatatttttgggctactaccagacagaagctcaaggcctaggagaacttggctgtgtaggtctgttaactgcattgtcagaaaattatcatgaattcccccaggagagcagcaattcagaaaccccatggactttacttatcaaaagaaagcagtgcagatttagggttcagagagctggctctatattctcaattaccagccaatctcttattaactatgtgacctcagtttcctcataggtaaatcaggatagtaatagttcctgccttacagggcttccgtgaggattatgagacatgcatctaaaatgcttagcacagtgccaagatgagtgagaatggtagctattattctgtctattctgaataaagtaggcagagaaagtataggctgcaaaagagttcagaactggttctgaatttggctgtgtaaaatagacaagatactttgaagtcgccggggtgttgaccaaaaggccgcytttgtttgatmaatctacactccaaagttcagaacagcttatcctacctggcatttccattgattagaatggatgtgtttaaggtatccctctctttgatcaataattctatagcatgattgtatattaatgtctaaacctcattttctgaaaacctaggtagattatggagtaaagacaggcttgtcaatttgctattcttcctaaattaccataaactgattacttatttatactcattttgtattttcttgaaagcattaaaaaaatttactcctagtttgatccaagcaaccatatgtccatagtgtaagtaaagtacacccacagctgatgtttaagctaatgaaatgagaaatgaattacatatcagctttgaatagttcatttatgttgttagagtgagaaagtagtagtttccatctgtacttcagaaattaaacatttgcttctgaaagattttattttaattgaagctaatattaatttattagtaaaaggcccttagaggagttaaaatgaaatcattttgcactaatgaaaaggctgtgttgtatttttttgtaagattccttaaatctttcttgcarttacttcacagggcagtgaaaaacagatctttacatgactttaaatttttctttttttgccaaaatctacataggaagatggtgggaastgtatcaataatagcagattgaaagtattaatagacagaattaaattattactgtattgcacacttgtttggtatatgagaaaaagcattttttagtggggatgactatgaataaagttatgtagccgacaggtccctacaggttttgaggacatatctctttttacttaactatgtctttggagtgaatagagcatatcacagaggctagaagccattttgtcctgttctttagagtagtagttttgacggttggtttgctgtmtactccagaacctgaaggaaatgtgaaataactggacacattttcttagatgttccctcctcttttaacactacaaaagtaatgattractcattaagcagatttgaatgttcctataagcctgcataaatatatttttggagcttttcagttgttaacaaaaccaaaatcacatttaaatgcaagctggacatgtttcattgtacctactctttgcttgattttacatattaattmattcattcattcattcatttaatcacttaattcattcgatcatttatttactgcatgccaacctatgcacttaggatataaacaaagaaaagcttcaaggaacaattgaaaacttgtaaacactgtattaacatgatgtgttcataaaacaacttattgagtgtccatcatttgagagatactataatacttaatgctaagagcaggtgccattcataagattayacttaaaatgaacctgagaatgagcagaatttagacatgggaagaactatgctgtggatggaaatagtagatgatgatgaatagagacagtggggctaaaaattctcaatgkatttgggatatatttacatagtagagcagatggcacttagtaggtatttggatgtaaggaataaagaagtataggaggtcagataaaacacctgggtttttttcatgaatgactcagcaccaacatagaatatggtaaaggaaaattaggtttcctgggtagaaagaaatgtatttagatttagatagaatatgtttgaggtgttataaaagattcaggcagaattttgccattgtcagttggatatacagttctgaaattaaggagaaaggtctagattagagatatactttgagagtcacatccatatataagagaattgtggtttgagattgtttctcctaggcaaagtggtatgagtttgctctccctcttgctttattattccgtccgctgaaagggagactgtgatttgaaggtttctcagtgcaaagtggtatgacccaatagaagtttctgttatcccaaaagttaccctgatgatagccatatatccactcttcaaaatggtaatcactagtcacatgtatgtgttaagcagttgaaatgggatgagtatgactaaggaattgaatttaaaatttgaggctaatgaatttaatttttaatagctatatgcagctagtagccaccttttattagacaatgtgcctagagaatagacagagaatargagcacagtggataatgtcagcaggtatggtggctcagaagtagggtataagtgatacattttggcagctagaggaaagaaaggaccagataaaaagagtgcccatgtatatcatcaaaatttcctmatatcaataacatggcaggcagaattgcaagagatggtatgccatacaagcagatacaacttaaatgtagaaaaataacatttattgatatttttataccagtcaaaatatttctatcttccaggtttataattatttcttctaaaaattaatctttttacccgacatcttcatatgggcaagaggcttcctcactatgatatagtagattagtttgagtgtaaagtgtaaagtcccaaaaactgcattttgggactctgagttcacatctctaattacacattaacagaatgaatctgtggaagagtcttgatttctctgtgtcctagttgttaaactattaatactcagttaatactggggttaagatttgaatcacattgaacacttagaaaagtaccttgagcctagtgaagagataataactgttaatatcattaaccttaaaagtaaaattgaagaagcgtttttatttgaaactattttgaagccttaatttaaaaagataatccatggattggcttactgatagaagcatccctatagtcagtcagtgttttgttattttaaagatagttttcatatgagaatgccaattccttttcactaattttttttattatagagaaaacatcttactaaaaggaagtttacratatttttattatttctataaggcagaattactacttttarctaaattttcttctgtttagcaactcaattgctttctttctttaaatatctttgtgtttacaattccaactgttttacacaccaattcctttttgtaatgtcttgtggtttatattgaataggatgagaaatgattgtatggtcccaaggttttgtaaaaacaaagatgatataaaggagaaagataatcttttaaaacatttatataataatgcctttctctccagaagcctggggtttagaaaaaaaaaatgcctttaattgtctttgattcgttttacttttcagagattcaagataatcctgctaaaatttgtgtatctctatatttaaaaaatacaattaaagatctattaatcaaatatttgtttaaaaccaaattctacatttcctggaaactactgtataaatccaaaaatacaaagaggacaatcttctccttattctttattttaacagtaattcctgaatttgtaacacaagtgaatgttgccttggaagccttaagcaaaarctcattgaatgtgttggatgataatcaatttgtggacatctcaaagaagatctatgatacaattcatgatatcagatgttcagtmatgatgattcgggtaagtttgcttttccttccattgaattattgcaatgttcttcaccatctggaatgcctgggatgactgcaagaaatgctttatttctatgctgtaatgtcaatgctgaaatctattaaaactttagaagttcatatgtatccccaaagtcagatctactgtcacaaacaacacttttacttatgtatttggttataacttacacaaatgagtgcattttactgctgcgtgtgcagaaaagataggatttgttgggtgcaggatttgttgaggtgtctcttagcatgatcagaagccaaagaaaaatacataaagtaatttgcttttttatttttgttgaacaaaaaggaaagaatctttcttatcactgtagtggaattgataggaaaacgtggtattttatggccaaaccctctcatcctagatcataaaatcacagagtgttctgcaagaaatctcacttggagttgctggcaacaacaaacacttcaagggtcccagtctgggagttgtctgtttggggacatatattccaccttcccaggcgtgagagcacaatttgttgcaggcacactgtatatacagaaaccaggattgttttccctcaattattaatgtaaaatgttcttttaaatgttaccaaaaaatgcacattctttggaaaatgcatatgtaaagatatggagataccttaagtggattcacctgaagacagactctgaagtaaggatttgtgttatcaatagtctatttaagagaaagtgagacaaagtgaggcagagaggggaagaaaaccaagaaggtgtaattatgggtcactgcaggcaactggggcttggggcttgatcctgctgttaaactctgggtagtactgcagaatgcacctcagcacttcagaattatcttacctgacatgaacaaactggatatttagccacctattcatcctgggtgaaaagctaccctcagaggtgtcacctgaacctcatgttcagggccaatcaagcttttgtggccaaagaaagtaattctcaggcagggtagcaggtgcttgctgtaggaagattcagtgggactggtgaatataatttttaagtatgaatagaattcaatttttaagcctctggacttaactgtyagtaagtctgtaagatggatatagaagtgctgagaatrtatgagtggagcatcagtagtattaatatctgataggcctgaatgtcactggctatactgagcagtccataagtcatttgtggaccttgtaaagaaaagggccaataaatattayggagtctggcagggcagcaggatgctgtggaagagcttgtaagacaaagtctaaaggtgtcaagacaaagaatctagtacactgaggcttgggaaaacctgaaagcaaaccaattaccatatcaaagagaaacctcaggataaatacttgtgagcaacctacaactatttctaagtgattagaaaatgtggccctgtaccaatgactatgtctgggcagcaagaaactttaccaattttcttgttgcaaaatttttaggccttacctctgtggattagtggactagtaataacccaaagctgagaggtagatgaatccataaaagaaacattaaaagtgtaaagaaggcacatgaacttcaggatatagtcttgccagagtgaaacctctccattttcactattcctgagtggatatttgagaatataaaccagtgagatagcacaggggaaccagggtacggaatgcatttttcttcttactaaagctatctagggatggaaaaaaacatcttatagcttctcccagttagatgttccagtatttttacatttcctcattatcaagatagcttacttatagcaaatcaaattatcttgccattatttttacatattcctcatatacagtggtcctctgtagggcaggagaacaatttattgtaattattaatagcctttgagagcagtaattttctcccatagtcatctctttttcaagataaatacttccatttctgttaactttttctcataagaaaaatttagtattttgtgttcttcactagtctttatttaattttcaacaaacttctcaaaagagactatcaagaatacattcaaattagtgcctgtccaatgtcaaataaattagaagacttgttcttatgttatttctaccaatatagccaactgctattagcctatatttttttccatttaaacattatatttattggatagaggttgacttccttttccttttttttatcttgtatgcctatgtatgcatcctttattttgatttgttctgttcttgtttttaagtcctaatcctattacactgtatatgattcttcatatgatttatcagattgttttctggtttggttgttgaatttatcaagttagtatcaatcagaaacatgaaatgtagagtcttagcttcttcaactaaataactaataaaacattaaattatattggtcctttatctgactgtaatcactgctagagagattcagttaagagcattagtgttaagaacctttagtatctgatgttccatgcaactgagaacatgtctctaagtacatggtttgaaagagtgttttctgagttttaaggcagatatattatttctttaagtacactttatggtcaaaaagataaagcaaataaaatcagagctgctgtacttgaaaccagggaggaatacccagagggtcatcgtctctatctctatacccccagttccctaagcagcctctaggggaacctctacacgacttctacagggattccttggaaaatgatccataaacttatggacttaatcgctaactgggttatagcataaaaataaattctcacttaggtgcaagtaaatgaaaatctatccgtttttttcttaaagactgtccctttttcacagaagagaataaacttgatctggtataatcttctttttacaaggtcaaatttaatgttggccaatattctggccttagaactgcaaagtatttgatcctttcttcaaggtatctaaaaagtgtcaacattaaagcaataaatgtgtaattatacaagctcagggagggataggctatgctattgaggatatttgtaagtgtatcagaatcccattttatgtctaaatttttatgaatactcttcagtgcctttgaaacaataaaatactaactcaagatcagaacttggcattttatagggttttataaaaatatgattatgtctttactatttgttttgatcaataattatgctagcagttgtttaaaattctaagatatttagaatgtcactaaatactgtgacatttagtattgctatttccactggactcagtgtgtagacaagtgaggttatagactatcatacttagcacactcagagaataagcagtattaaatattttgatctgtttgatatttaatatacatgtgtaaattatacaactattaagagtgcataatataatggttaaaactaaagcaagaaacaaatcttacttagcctcaatttcatcctttgtaagatagacatggtattaaacctacttcaaaagattattatgcttacatgagttaatagaaatgaaatgcttaataaacaataggctataataagaagatagctactactactattattaccacatagagttagtacttactagacctactgaagctacttaatatttttgtatatcttgacgaatattaactacataagcatgcttgtagagcaacatgaagggcaaagtcctaaatcaagaaatctcttcttttataaggcaatgtttaaataagaggatacttatgcttattaacatcaggtatctaaatgatagactgttaaatgcaaattatgcttttgaacctatattaatttaaggtagtattataattctgcacataatttttatagaccccttaaaacataaatgagaactgaactctcaatgttcatctttttttggtaaaagacatttaaccacaaatggaggaaattttaaaagagtacataattgaattgagagagagggtagtataagtggcccgcagtgaagtatcctcacaaaaagaaacaagattcaggtaaaatttttcctataacgggcattcagaatgtagatttcacatgttttgtttgtgaattttcatatgtgccttatcaaaggcgcttcaaaaatatagagatactttccaaagccaagtgtgtagattttcaggtccataactcaagtttgcattttctgtgtcagttttctaactctatatatcagggaataggaacatattttrcatatctgacttgatgaaggttaatttttgaggaaacaaagaaaaataagataaatttacatggcccagtttacattaattgtttttacatgaatcatttacatggcttctagaattgggacacagtccaatatamaatatcagcttatataacaatccaatctttgggtctgattctatttcacctacaggaatgaacagatttatggcttttcctggaattaaatataactttctcaattgagattacctgcagtgtcacaacttctataaatttctgtcattttcttccttaacattttttttttcttggtggccttgtagacatcttttctttatgtgtcttccaggctgagcttctggctatttgaagtttcatactcaaactgctaaagggaaagacttttacartttcagwtagtcactaaccaatgtagaatgttatcttatccaattacaattctctggaattaagtttggaaatggtccaataatgaaagaatattgtgtaaaatcagaagacctgagttcaagtctcagctgtacatgttaccatttatatttttactttacatgatgtcatcagtttcttccctgcaggggaaaatggaagaacactactgaatttctacttttaagtatcattgtatgtaaaagtaaaggactgaacagtgtttcccaagatgatgaaaaaaatgagactgtccatgcttcaaatgcaaattagggccaagttcagtggctcacgcctgtttgggaggccaaggtskgcggattgcctgagctcaggagttcaagaacagcctggccaacatgatgaagcctcatctctactaaaatacaaaaaattagctgggcatgatggtgcgtgcctgtagtcccagtttctcaggaggttgaggcaggagaattgcttgaacctgggaggcagaggttgcagtgagctgagatcatgccattgcactccagactgggtgacagagcaaaattccatctccaaaaagaaggaaaaaaaatgcaaattaaataagacatggacaatagagaaatacaatgatacaatgaaactcaaaatatgtatttcaatgtagtagcaactaacaattagaaaatattatttataaagtagactatatcacagcatccaaaattataaaataagcggtaataattttaacaaaacaaatataatatctatactctgaaaattataatacaacattaaaaaaattaaaaacacctaaatatctgaagggattgatcatattcctgaagttggagattcaatattaagatgtcagttattcccagattgacttacagattgatttaycactgtcttaaattctcagcagactcttttatgaaaaccgatcatttgaggtggttacattggaggatacgtttgccaaaactcatcaaactgcatttaaagttgcatgtaaattagatattaataaagttcattaaaaaataatcaactccatagccaacacctcagaaaatagctaattttaaatagataaaatcataccaaattacaaattagggctaattagaaaaacttgcatggactattaaaaatgctgatatctcaaatattataaaattaataatacctttctactttataagtgactgtttgccaaacatttctaatgtatggaggttctcttttattttttatttctcatatatgtgaatcattatttactattttagatcagcaggtggcatattttggcctttgggtcacgtttgatccactatatgttttgtatggcctgtggcctaagaatggttttaatgtttttaaatggttgaaaaaattcaaaagaagaatatgatattgtgactcatgaaaatggtataaaattctaattttactgtccataaaatcatattgaaacgtgactcagccattggtttatatctatgactctgtgctacaatggcaaggttgaggagttatgaggagactataatggctcacaaagcttaaaatatttactacctgaccctttacagaaaaagtttactaaccttgccttagagattttgttttagcctttacgaaaatcctgcctggcttttccaagaatccactcacctttttattagttttcctttatacatctaatcatcccaaatatttgaatattagaattgtcttttcttcgaggttcctggagctacacgaccacctagaatgacttctgctaaccctttctattcacagtctagggtcccaggctgtactctccaccctcctctactcttcttttcaccctcatggcttgccattcatccaggtactctttttctcaccctttcttttctggatcaaactcttgtttttttgttttaatttccaaattttatattcatgccctgatgcttttcaaataaagttgtttaattaccagaacccacccttctccaaaggttgcaagggagtttttacattccttttgatatttttgcattatttgttcaacacgtaaaattaaattttagcctcgcctttgattatggtatgttttgaaactcaatttttaaggtttatagaatgttgaaattcatcaactgtattctgtcatgtcattttgttgttgttgtttcatgttatagagaagtagacatccccttattcatggttttgattttcatggtttmacttatctgtggtcaaccactgtctgataatattaaataagaaattccagagttaaacaatttataagttttaaatcgtgcactcttctgagtagtgtgatgaaacctcatgctgttccattctgtcctgcctgggatgtaaatcatccctttgtccatcagatccatgttgtctgtgctcccctcccattagtcatatagtattgcagttcttgtgttcaagtaacccttattttacttcatgatgaccccaaagtgcacgtagtgatgcaggcaatcctgatatgccaaagaagctgtaaagtgcttcctttaagtgaaaaggtgaaagttcttgacttattaaggaaagaaaaaaaatcatatgccaaggttgctaagatctacagtaagaatgaatcttctatctgtagggttgtaaagaaggaaaaagaaactggtattagttttgctatcactcttcagactcaaaagtcacagccacagggtatgataagtgcttagttaagatggaaaaggcattaaatttgtgggtggaagacagaaatggaaatgtgttcggactgatggcaatcagattcattactatccgaggtttctggcattcactggaggtattagaacataacccctgtggataagggggttgggggcagtgtagtattaattgtgtctgaagattattgggattacaaatgagtttacataaaataagtatatgctaagtgagtttaaaatatagtgacaggatgagtatatatatgtatggcttggcttgcacaggacagtactggattatactgccttttacttttaagtgcccaatttggagaataaattggtaagctcactagtttctgggtcctgatggtactgcttgaggccctgtggtgcattgtctccacccacagggcgacagttcccggtgcttggcactaatgatcatagttccctgtcaagccagtttttctaaccccagggaacactttctctccatagtcctaacggctatcaaatgtgcgcttctccccttcatgcttttctgatactttgttgactgtggagaatttattcaggcwccatttccaatttatttaatgtacaaagacttcatagcttttcatttttcagtgttaggcagatttcctaagttcatctaagttactctgctcttcaacctcacaggactcatggaatgccagttaaaacactttgtcccttctggaagtaatatgactcttttctagtgtcaggaccagtttgtaaagaaaccacctaccagggggattcctaagggaacttcgtaaaaggccaatagcaaagtaaccttagttttatatgcaaatttaaatcaaaccttagtggaaagaagtctgtaacagtactcttgctgcttcttctgaaaacagagtataaggtagggaaaccttggaaygcctgctggcactggtcagcaagaagtcttatgctctcagcacatttaatggccctcctcttgtgtatcccatttgaagaaacttttgactaagggagcagaggtgactagagtaagaaaaagatattcaggaaacgtgttaagctacaaaagccgcgctagttagtgatctcagttgctcattctgagagaaagatgttcagcttgaagtcgttctgggaagtgctctttcaccaaagggtcaacaccactggactggcaggggagtccatggtccaataggactttgatgcagtctagtcctgcactcagagagctctacacaagtgcagctcagagcttttgactcaaagtagctgaatataaggmgccaagcatctccctttgaaaacatctccaggtgttcaggggaaatggctaacattgtgaatggaagggtaatatggggaagacggttacttgcagaatcttagagtttttggtttgctttttgttaagtgaattattaaatgtcatactattataaacttgtataagtattaaataagttagatttatattaagtattcaatctagtaagttttattattttggtacaaaaacttgtttttatcctaaaaactcttaaggaatgctaacctcttcaaacataaagtttctctgcatatctacatttcaaaaacaacttttggagagttgaatcagccttctggagaaaataatatgggaatacaacttataaaatgatgaattttagaaaacagactttgatgtagctaatggagggagactgggaattttataactccagtatctgtaaactaaataatggagtttcaacrggaaaaatattctggagtctgatagcaaaagttctctaagtgaatagaggcacttgaggtcctatactggtagggaaagtcacagcaagagattcagggtcttcaggcacctgaatgcctgaagaacattttctcttaccataggagaatacaacagctcaatgtttttataccatgggagcctttagactccatagacttccctttgttgatggaacagttataaacacataaatctcaagaatcactttttgggcaatttgttaaagagcacttatcctactactactcttccctgctccctgagattcagacacattggcctgctggctgttcccctaattcctcagacaggcccatgcttctggcatctgtccacttactgtgctctctaactgtgatgctctcttccaagactctgcacaggaggcctcttcaggtcagcttcatccwtgccttatccaacaccctacacagatcctatatagagccacatctaaaaatagcatctcccaccgcagctactcttcatcttcttgctcaattttatgcttgcgtagcgtttgtcatgatgattgacgtattacatatttattcatttatttatctgttttctttgttcccacaaaagaatgtaggctatatgaaataaggaagattcagacctttaaaacaaagtctgtctgggtacagtggcttatatctataatcccagcactttggaagsctgaggcaggtggaatggttgagctcaggagtttgagacaagcctgggcaacatggtgaaacccccgtctctgtaaaaaacagaaaaattatccgggcatggtggtgcatgcctatactcccatctacttgtggggctgaggcaggaggatggcttgaccctggggggtcgaggctacagtttctgccactgcactgcagcctgggtgacaaagtgagaccctgccccccccccmaaaaaatgttatagtgttctgcattaaataaagtggttgatttggtttccaaattggacatttgttcaaaatgtaatcattagaccccaaggaattaaggacaagaacatgcgatgttactttgttaaattttatactacaaaaattaaggacagtagaaactaccttgagatatattttcacaaagaattaaatttgcttgatctcttatttaagatggttttaagagttccaaggatgtgtactaagcattgtattttgtggccactaatgtaattatgaatgcacagtacatgtctgtttgatgctatttgtcttcgtagaagcttctgcaaagtcggatccgtgtggttgttttaaaagttcttcatttcacctagttcaggtgacaagattactctttaaagatgatggcaattgtagaacagcccggatgagactttcttagtgtatgtattagtggytgggttatgggaaaaaaagatcctaaggatagagtttgtggaatgtgccggagtgtattttatgcacattatcctctattatcagtcccttggtgttataagctctaaaaagtcacaaaattatctataaatttaatgattaaagtgtgttttatactgtcttrtattgcaatgtttggaacagaaatcagaaatttaattaaagtcataaaatatagaaagatcccataacaaaaattatttgtaacyttaaaaatggctgtaaaatacattttaacaattccatagtggtctgtttactaaaaaatataaaattaaaataaaaccagggatttttatatatcttcttttgtctctaaaattaatggtttgggattaaattcacgactccyatttaccaaaaactcacattgacaatgcatttacaaatagctaatctcttccagtggattttgcttatttaactcttagagtacaaacttattttaggtttgcctccgtcttcaaggaaattcccattctttggaatatctttgtaaccctatgtaagtcatgtagtcttttaacttcagatttgcatttgtaaaatggggataacaaagatacctacgtaaggatggttcatcagagtttaaaagggttaatgtatgyaagccatttagtaaaatttctagggcattgtaactgcttagtgagtattagtttttgtagtagttagaataacaaatactacttgctgtaatacaacccccagatctcagtagcttattgcaatgatggtttatttatcaaccttacrttggtctgatgccagcctgttttcctgaataggtctctacaaggtagtgactcaatgattcagtatctttcaatcttgtgattttgccatctgtataagctggcctccatgtcactgcagaaatgggagagagagtagataattgaataggaagtttggtggccagacctcaatgcaatgtactttcctctacatctcattggacaaaatccatcaaaaggacytgaataaactgcaaaggagctggtgaatgccctcttcctctgtgcctaagaagaaataggactgatgaacacataaacattccttgtcacactctttgttccagttattattgctgcataacaaattactccacacataatggtataaaacaaccatcaatgtatcatgctctcacattctatgggtcaggaatttagaaagggtacagactccttcttgtgcatgtctgacatctggactaaggagtagaagactgaggaaggtgacatttagcctcttatggggcttggctttctcacagcatggtagccactggatagtcgggctttttgtgtgacatttcagggatccaagaataagttacagttaacaaagcacacgccatattgccttttgtatcctaactttggaaatcatagagtgtcacttctgtcatagtcttggttacaagcaagttaaaagcctcccggattcaaaggagaggagacacgaaccccatctttcaatggaaagagtgtaaaggtcaaaaggagcatgygagatgaggaataatattgtatccatctttagaaaatacaaagtgacccacttctgtcatcgtgctcttattatcatagtcatcatcatcattattatcatcatcatcatcatcattttcaacaataacagttattttttaacaattatgtgaccataagtcaatttaaacagtcttttgcttattaattagtaaaataaaccaatccaaagagtcttaaatcacttcagataatcatttgtttaatgacaggtaaagatttagaggtataattagtcaaatattttagtgaatagaatattaaattgccatactttaatgtcttttataaatatagctgctgccaatttaagatattaagctatacataatctttttgataccctcttctaaataaaaccctttgaaataataatagctagaaagtataaaacagaaaaaagtcttgaggagggtatgtggaatgtgagattatcatgaacatgggaaacatacaatgaagaagacatcatattgagaagtaattttctatcctgtacaggatacagtcaatcacttgaaaaatggctgagtattttctatcttttaatcactgtgctaggttttaagaacgcaaacatggttgagtcatgatctttgctatcaagtaattggcattctcatagaataaagaggtacataagcaaatgacaggaatacattgtgataagtaatataatggaagcacatggaatcatgttttaaaatacagagactttaaattctgccatggagaaaattatgcaaagatgtagccatttgttgacattccagttgggctttgatgaatgagtcaagagttggatagttggaattatggctcagcacatttgcaaggatacrgaggtcaagacaggagaaagaactacaattaggtgaagggtacctggaygccagtgtacaggtggaggaggagtagaaacataagcagagttaaaatttttaagagtcttcatgcatgtcaaagaaacatgaccttgctaaatggcgagaggaacggaattactaggcttagtatagagtgttcaaaattcatcctgtatggttgggatggcagcatagtcatccctttcagttcctcagtcacctgccttaagccgcctaatatttaaaaattgagattctttaagcaagagagaagggataagaaattatygmatagatgacaaacaatctcytacaatatatttactactaaaggaggatagaaatttcaatcaaatactaattataccatttatgcctcactaaatttactgatcaaatgtaattttcagggatttctctttctcaggatatggaatctctttaaaagtgacttcagaagagtgatacaggtaatactaataatgatactaacaataataatagaaaaaaatgaggcttgtatttggaacaagcgtttttgtatttgcaatgagctgaagccaagcatatgtcaaaagtatttctaaccatctaaaatctcagaggagatttaggaaatcagactggtagtcaggcatgttcactactagagcagccaaggtgaagggattgaagtgctgtctcaccagtttcagggactcattgagtctgttccaaggtataacatgtctctgattacggaaaatgttggtgttaaattgacagaagtaattgctaatcaaaatgcaagtaggagatgtaaatgcaaaaacatatgaactcaccaattaatgcatagagaataattttctccttcaaatgccttatttattaaatctgaagccttacatttagcttcaaaagaaccacatcaatcagagaaggctgaaagacagtgtgttaggctgtggtgagcacaggattagaaatcagaagaccttgatcctggtctcagctacgtgttatagtagctctggagtcctgggtttctccctttgatgcattgttacatggtgttctaatatacaagggaggggattatcacacttgccttacttatggcacgttttcagagccccttccttccttccttctttccttccttccttctttccttccttccttctttccttccttccttccttcctccctctctttctctcccccccttcctctctctcttttcccttcttttcctccctccctccctctctccctccttcctttctttctttttcttttatccatttattgtctttttattcacttattttgttgttttattgagtacgtactacgggccaataaatctatcgaacacttagccatatggagatagataagacagataagatttccattttcatggagtttacatttttgtagaaagagacagggagtaaagaaagatatggataaagtagttatgatgagtgataggaaggaagcaggatgatatgatgaaaagaaaattggcctaagagataaatcactttcagtcaaagcagtcttttacactctgaggagatcgaattttagttagttagtaaggataagagtgtggcagcaattttaaaacactgaaggaatgtttcaggcagagaagagtaattgcaaagatgctaaaatttggaattgcttgttatacctaaagaacaggaaggaggcactgtttctaaaagttactgaatggaggagtagagtggtaagagtttagaaaggaagacagacaataagttattttgacattttcatacatgctaggctrtttgaattttgttccaaagcattgataactattgtaatagctttaacaggggaggggcatgatccaatttgcattttaagaagtttcctcttgattttgttgaatgttgactttccaaaagtatgttaatcaagcagtactaccactaagacttagtgtgataaaggagaataccaccttgaagtgagttacctacatccatgtagctaattaatgtcaaagctgggattagaattcaggtctcctgactccaaattcagtgtacttttggtgttatcacaaccaagtaaccataataggtttgttggccaatatgtggataactcaaggtgggaaaattagagaagcattttaaagcctgtgctgagtgattttaaagtgtatcttgcaagagagagaactggttggattgtggtgataagtagatttggatgagtggacaaaatgaattgaaggtttggtagtaaatcttaatgagcttactagtcttgataattggtcagtttaactgtttcagttttctcttctaggagcaggtatttcctggagaaagcagctaagtattgttttgcttgctcttagtattattaacacaggagcaggaaggtctgcccagttcctgtccctgtgggacagaggattatgtcgttttcagttctcaccaatccataggaagtatgttattggaaatggaggatgggcaagaatagatgtgaggataccagatatgagtctgttgtacttctccaggcaacaggtaatgttgccatatactagagctgcactgtccgatatagtagttacatgtgacttatcaagcacttgaacttcggctatgtgaaatgagatgtgccatgtaaatgtacgacacacaacaaattttgaacatttatcaaggaaaaatgatataaaatatctcaaatatatttatattttacatgtcaaattaatgtcaataatatattttaaccaaatatatccaaaatattatcactttgacttacacaaattatttttaatatgactactagcaagttaaaaattacatatgttgcttgcattgtatttatattagtaatgcactagagaattgcagaagaggtaaacaaattcaaaacatattttagaggtaaaattgactgaaattgctgggaatgaatgtgggattgaaggaaattgggaaacaaatgtggctttggggtttcttgttttggggcattgtgtgtgtgtgaaagtaacttatggatttaaggaagacttggaggaatctgtttcgggtagaagtctcattccaatttagtggcctttagatattgaatttgctcatttcatagttatattatatcagccattgggtatatgattttggaatttagagcataagtttgacctatgataggaattgtttttttcttaggatgtaataacatatagacagggtatattagagcagaaaatatgatatagaagcaaacacatttagaattcatgttgaagaggaggagctaacaaaggagattggcaagaaataactgggaaagatagaaaaccgagaracggctgtctcagaaactaaggcaagtgtatttaaattgtgcacaatataacttagaagacttaaaaagataacaagaaaatatgttcattgcatctgggaatatagatgatcaaataggtaatgtatgtttagatattcagtgaattggtgtcagggtttcctggaattgatgactaaagctgtagctggcaaaaagagctaaacactctaattgcaggttgagaaaactgccagcctgtgaggaccagcatacttccactgggcttagatataatgagaggatttgggacagggagaggggattagacttccaaaatgtgcagtgtttagagaggttaagctgttctctcctttctctttgggttactttatgttgtccttacaatataataaaggaaaacaaaagatactctgataccctgacaatgactgaacccatattctgtaaagtggtctctttatactttatataagcataaagtgacacaattgtaaacagtatagatagtgttatgataagaacttctagttgttaatgactcttagtgtgtctcaaatctagcccagtcttttgttgttgttgaaatatgttatattttcttggaaagcctcttctttcttatatccttatgaatatctgcagggagccattagtctttgccttgtgcactttctgaaaatattttctttagatttttttggagagacttgctttgttccaatatgctctgcagaatgcttccccctgctgtgttctgttacccccaatgatggcttttgcctagctctctcagttctttctctaatgtaaagacagctctacatgtgtttcctcttccaaccgtatgtctgttatcataattagttttcttatcatagattcaatgagaataatagtttcaaatcactttgagaagaaagtatttctgcttgggtcacagcttaaacagattcacccacggtctacttcaaggcatttcctgtgtgaggctaatgaaccttcctccacttcagtcatctctcctgtttataactttaagtccagtatgtggtagattacaaagccacattgaaaaaaaaccttatatacataaaataaatatcagttaataaaaatgtttaaagtaatattcctattataagaataatacactcttgttataccaaattaaataatataggacagtttatagtacaaattttagcctcactacccctctagctcagaattttctcttccagggctaattgcttctcaataattttgtatgtatcctttaatatcattttctacataaatcatattcatttatgtatatgtatctttggttttgcaaaaaaaaagaccattctatggctgttgttataaaacttgatttgatttttataattttacaataagtcatacattaagttctcttagttaaaaccccaaataaaagttagtgtggatccataccaactactgttgacacagctccttcttgtaagcttttccttaggtaagcaaaacatgaaagaataaaggggaaagacaaaggcaacacaccagaaaaaaatgaaaacaaatagttatttgaaggtttagatttaaaaatatggaaaaaccaatataattttattaatggaacattgtgatgctgtaaaagttgcatcataaaaccatgaaatgataatgctaagttgagggaaaaattgcctatctcaaaatccttggagggctttgaggccttcagaagtgaagtgagttacctatatccacgtagctaattaatgtcaaagcyaggattagaattcaggtctcctgactccaaattcagtgtacttttgatgttatcacaatcaagtaaccataataggttttttttgcccaatatgtgcaaaaagtcaatatgctgagacacgaggttacagcagagaaagaggtttaatggttgggccatcgaaggagaagatgggaaggaacctcaaatccatctccccaggtagtttggggctgggtttttaagggttttggagtgkgtcaaagtgtggagattgttaattggtggaagagtacagggggaagtcataggatggggagaggaagaaaccatctcatgttgattctgttcctctgtgggggtcttcaaaatggttgtcatcagctgtttcactggaattggggatccgaagaacatctttaagcaattcttaaagaaaagccttatgattctgatgtcagagattctatctataagaacagtgggaatggggatacaaatattcaggatctagtgactttcagttacaaggaagtgggtcaaagtgcagcctgattaatacttacttatagccatatttctgtccagaattcttgttaacccctgagaatgccttcaaccataagttcatactaacagaaagacaagcaaaacacgttatattaattaaatacaattgtaatacaatgtgtttaatacaacatattttattaattaaaggcaatttgaaaaatattacttaaagaattgcatttgaaaycattggctaagaataggaatataacataaggactggaaaaagagacaagtgacaagtagcttggagggaaggtcaaattagtttctctgtaaaagaagatgaggtaggaagatcaagggaaataatttaaatgtactgaatttacttaagaagtgaagcaaagagaaaatgcccttcagtttaaaataaaattcccaacagaagctgagaagatcaagtaaaggtaaaagttatacccttgagctgctaataatgaaatctagcctgagggaaggaagttttgttgagagatcactacctgacaggaacttcacatacattctctcattttaccttaaagcaacccttgaggaagggacttggaaaaccattttatggataggaaagaaaacaaataacttaaaattactctcccaaagtcactctgatatacactgttccaacagggtgaagactcaggtacttttgtcttggccgcaaagtctgtcttcattgtgcaccacgtactgcctatattaatcaggaaggtgaaatgatctctatgtcagatctagagtttctgaatatggaagtgtgagagattaatttcaayatatatgagctatccttaaaattttgaaaatataattaaatccaattataaagatacgattaagaaaaaaatgatggtttataggacattgcatacacttttacaagtgttctgtaagtagaaacttcctgtcatttacctgttctgctttttcctgctttgactctgtttaaagcttgaagaaatttgagtaggtaagacataggaattaatagtgtagggaccaaagggaaaacttcccttttgtcctctgaaggtttactgaaaaatcaactgacaaatggcaaattaattggagaaagggcatacagatttattaatgtgtacacagtgagaatcacggagtgattacctatcccccaaatagggtttagaagcttatatatcatcttttgtgggtacagaaagaatgggaacttagktcttggcaaaacaggttataggagggaggaaaagaggaattctgttgacaggcaataaatgacaactagggagaatgaatggattggagggcagagatgattaactttaagatatttctccatggaatttgaatgagcctgagagacagacattatcttgtgaaagggtctattcaartgtggttacatttttggcctwcttttctgtaatagataatgagataatagtaaggagaagaataaacagttgttctcctggtggatcagtactttaggcagataaagggacttcaggcaacaactcatcctgtgctttgggagagacaatggggaagtgagaggtcagagagaccttgaggtttcttcagttctgcatatcgaagcatgtattttggggtatcagttcctaagccccaacaatagccaaggaaaaaagcaaagcctgaaaagttgcttttcattaaggtttctaattgcagctcaaytctttcgtttacactctgattttgcaggtgggcccaatatagagacttggagtcaacatgggttagaaatagactctatcatagaacttgtctattttcccacaattctgataatattttacacaaatacagacatgctttgcagtcagttatgtaatagtcaatatagtgaggcattggagattgcagcagagaaagtgtttaataatcttaggatagccacaggaggagatgagaggaaacctcaaatcctcttctctaaagaatctggagctaggtatctagggtttgaagtagactgaggtgtgggaatcactgagtagttgaagagtgcagggtgaagttatgtacttttgataatagggaggttgaattacttctaaattcctcagataagaagttttgcctctggatggcctgcttgatagtctccaggtgatctttcctctccttattttcttcctgaaaatatcttggtcaaatctttgaccctttgtgttcccccatgctcatgtctacctgctgcctattacagtctcaagaaacagaaaatagcacagtgaagaggggccccaggtctgtctggttacttcctgctgaaaggggatagtgagtggataagttgtatttttccttttctctctgttgtcatgaagggaatgaggatcatgaaaaacttgttcatggggagaagaaacgattccattaagaggccccatgtaaatggaagttgctgttgcaggccgatattgggattgcatagtcatctgtaggtggaatcgtaacctggatgatataaacttaatgagagcattaaaaaggcagagaccaaagattaaaagaagagtaacaaggaataaaggtccaagtaataggagaagccatgtgatttttagaaaccaatcagtagaggttttggcccagtagtggttactttaggaaagtgtgtatagccatgtggcttgtttgaaaatttttttggacattagttttcacttctctttttccgcattcctgtacagaaaagagaagtggaacatgttttattgatgaacgcacagactccttttttagctagggggtaattagcagtgaagcaaagccataagatcccaggagggttaatatatttttaaggtttcttagactaagagggctaccactgctaaggctcttaagctgggaggtggggagggattcctaggatactaggtctaaagcttttgaaaaatatgctgtggggtgcttagagggccatagatcttaggctcactctcaaaactatcccccttcatttgtgtamgtaaaaaaagaaaggcttagtcagatcaggtagggctaaggctgggactgagattacagcctgtttttaaagtgtttagagcatgcttcacattattagtccacgatagaggttgttcctcacttccctggagggcttcatataaaggttttccttttaatccaaaggaaggaatacatattctgtaaaacacagccatacccaaaaaggacagaagctgttgtttagttcctggagttgtcatgtttaagataagatcttcaggagcgctagagaggctctttgtaccaagggttaaaataaggccccaaaagtgaatgctttctgtgaatatttgtaccttagaaggagatactttgtatccacagtcagcaagtttgtttgatactaacactgtatttttgtctaaaacagccttgttaggactacagattagtagggtcatccacataagggagtagattgctgtcttggagaagctgcagggtagacaggtttctagctagggcctgtccgaaaaggtggaggctatctctgattccctggggcagaattgttcaagttaagtgttttgccattccctggggcagaattgttcaagttaagttatttgccattcaaaagcaaacaaaaattggctatctgattgtacaggaatgcagaaaaagtcatccttaagatcaagtacagtaaactaagctgtggtggagagagtctgtccaaaaagggtataagtgtttgggacaataggatgaatcagaataacagcttcattaataattctaaggtttgtgctagctgataggagccatctgattcctttacagctaaaatgagagttgcaaggtcagttgcatgggtgcaataatccatgggttaaaaattttgttattaggggctgtaactcttttcatgcttctggtttcaagaggcatcagggagtctgaagaacttattgggaatctgaagctgaatgaatacaagagcagctgatattgattgaccaggaagagaagtattccaacttcaaatggcacttgttttagagtttgagtttctgtagactgcagttgctcttttagtgaagtgtgagttaatacagctggaaggtgagggcttcgttgtaaattagcatgtaattttgtgttaagtcatggcctaataatggaacaaggcagcttggcacgactaaaaggaatgaggaaaggaatagccttccattttacaagggagtggcagtgtaaaacagcctccttggggttttccatcaatacctgtgagaaaaatggaggactggcacattgggccatagtaaatgtttaaagatgaataactggcccctgtatctatgaagaacattatctcttgtttagccacaatcagatttactctagacttatccatagagatggaaaagataggggctggatggcctcaaggccccatcagtcatctagaggatgaatttcagaggcttgattataatccaggaatagagttagaagagcttgtccttggcattgccctcgtccccattctgcaggaytcccttgttaggtagrttgataaggctgtagctgtgacagcccagaaggaagaggtgccccacctcatgagggagagagggtcactcgctcttccgatgaccctcttatttctagtgaggacaggctyccagggttggcttgtaacctggaggttaggaaccttttctactctagtgtccwggatttctgcagcaataacaggtccccattctgttagtagcatagggatgagccctgggtttattagttaatgaaaaagaatgtgccagtgctgtcgccatgtaattagttggcgacggcattttttctcctccaatttacgctttttttttttgagacaatgtctcactcttgttgcccaggctggaatgcwatggcacaatttcagctcactacaacctctgcctcccgggttcaagcaattctcctgcctcagcctcctgagtagctgggattacaggcatgtgccaccatgaccggctaatttttgtattttttagtagagacggggtttctccatgttggccaggctggtctcgaactcccaaactcaggttatccacccgcctcggcctcccaaagtgctgggattacaggcatgagccaccgcgccccaagcaccttttttatttttgatatttccttccaattattgaaaactggaaaggctgcatttaataaagtaggaaaaggagtttgtgggtcttcctctaatttttggagtttttgtctgacgtctttggatgcctgacttagaaagtgtacagccagaatggattggcctgcagggctttgggggtctaaatttgtatatttttgcatagtgtccagcagtctagcttgtaaaagggcaggattctcagatggctcctaactgacttctcataatttagaaaaattaacaggttttcttacggtctttttcattccttccaacaaacaagttattatataatctcacctgcccctgcctctgtctgggccaacattggtggcctggtgttgccagttgggttctgtgtcagggacagcttcttccctggctatattatcattaggattacgagcatgagtttcatccacctaagctcaaactaaaggcaagatttttcttcgcgggaacatcaactagttaataccacaaatatatcttgccacgttaaaacaaaggaaatagttaaggcctgaaattcttgaattaacttagagtgctcctggctaaatgaacgcaactgggatggaatttgcaaaagatccaatattggaaatgtgcatgaactcgaatttttcccaaatcttcatttgccaccttatggacaaggaaaacattttggaggttttctgaggactctgtactagtggcttatgtaactcctgtgcaagtatatgaggaggataaagtatctgtttatggggagagggtgatgattgggggatgaagcagatggaaagggtgtaggtaaagtgggagcaggatgaggagagtgtgagaggcaaatggaaggatcatctaagacatyagaatcgggtagagaagaagttctttggaagattatgcaatttttatgtaattttacgtatcagataaagcccaaaagacctgaacatatggggtctctgaatataaaagtttaaagagyttgtgggtcaaaatgggaccactttataagaatgcaacccaagggcaaataggatagaactgaagaatgagttgaacccatgttgggtttagatacggcactataagattcctgaagtgcctgcgagggattttgacctcccttttccctttgctcactctatctgggggtgcctaccatggatagagggcctgcccttgcctggatgagcagtctaggcctgcccttgtttgagtgatcagctcaaacctaatgtgaaggagaacttgtccgtgacttgcgatgtgatgtctgtgacaaagttcaattcaaaatggggtccacaaccagcagattgtgtctgtgcagagttgattttgctgctgctcatttccaaggcacggtttacagtgttaaagtgaaggtggacttgccacycttggaagggggcaatagtaaatttgcttttttgtcttggcctttggataataccaaggagtgcactcagccagaaaccctcaattgccaaagagtacttaagctggttcactggtaattcaaaaatggaaaagaaccctggccagtttctcggccccaagggcagagacagacagatactccttctctagggcttcaggatcccactgaagagtggcctcagccaaagatcattggtttctaagagtaaagtaccagactgttgagggaagcagagagaaaaaagaagggagaaatcccartaaagtcccaggatgagtcaaaaagatgcccrgcagggtgtcagagccccagcatcagaragtggttgactctcaggttggcaagaagaatttattgacaacagtataggtttgaaaaggaaggttttattagatagaaagcatgctgcagaagagtacagcgaggcacctcagcaagggaggactgagtgtgaagcggtggattttccttaggggtttttatggactttaaagtgggagcttaagggtattttgaaccgtattagccatgtaggtcatgaggaatgattacatttrtagatattttggtgccttgatgtcagcaagggttgcacaatgagtttcaatatgcatacattccagagatctatagaaattctagttacttacaaagttttgggaaaagagcttggtaccagatgcatgcttttgataatagggaagtcaaattacttctaaattcctcagataaggagttttgcctctggatggcctgcttgatggtcactaggtaattttcctcgagcaagatgccttcatccttcagggagtgtatttagtagtgttgtctgtcttgggaggtaagattgttgagaaaagtctcagggaataggctttcctggaccatatagggaaagcagagaaggcatctgaggctccacatcctcttccaagatgagcacttttagtgggtaataccaaaatccaagtgggaggcaaggcctataaccacagactatcatcatttgagtgataatttgtcatctatgctgaaatccttcttttttcctcttgcaaccatcagagatagttgcccgcatagtccctggaatatgcacaagggactctctgatatctccagattttgttcctttctgttggaatcactataaggtcaagttcctttttaataattcatgacacttattaacttcccacccatccmaaaagcaaaagaaacacacagacacacaacgtgcacacacacagaaacacacatrcatacaccacaaagacatatcttgaacacctaaaaaatgcaaaactattgtgaaagaaaccttcatagcaccagtactgtggtgcacamagtttaaccagtttgaggtgcctgcctgctactgagatacagcagtgaactcttctaccatttcaatgagatatccttctgagttctcacaggctgtttaacttccatctaagtttataattggatagtgtaggtaaatggagttagaaggattccagtggccatacagaagcttgtggtatagtaaaatgaaccttgagatctaattagaacatatgatcaaagcttgaaaaaaagagggagggtgagaaaacaaagaagaggcctgcaggagccttttgaagagatgtattgtctttctgcatctgcttggccattacatagaatattaatgtgcatttgcacttggtggtaatgataggggtgttgacatagttgatcaaaattgttccaccagctatgatgatggattgctcctgtcaggagagccagttagaaatgtctacatcagatgacaaagggaaaaatgtatcattgatttgaatccagataataatcttgtctgaaagaagacatgttgctctttagacagcagaataaaaagtatgttctaaatgagtagaaattatggtgaaaacaacttcattctgtgtgcaatccactaactaccctcccttaccctcttcaactgagactttaggcaaattatgtaaacagtttgtattttcagctagaaaatgcatacctctctatctcccaaaaagttgttctcagattaaataaagataataaatatgaaaacgatttaaaacaaaaatgcagatttaaaggaatgttaatatttacctgatggctggagccagaaatgtggccatcatcctccgatggttccttttcaaattattcaccaagtccttccacctcttgacactcagtaattttgtcattccactagacccgcttyactttatctataataatttttattcgttcttsgttctttgtttggatgccactttcttctgcaagaattttctaaacccagtttacgaattaggtattcccatatattcacataacaccacatacctgtacatgatagcattgattacaatgtttatcatattttgtgctagaatttaaggtccaaaggaaaccacatccatgactttaaatctcttttcttcacttcagcattataagacttgacacatagtaaataattagcagctagttgttgactaaagaaatgcataattgtctggctctgaaattaaaaatgagaaagaaatataagaaaatgttgattaaaagtaattattttaattagaaattgactaaaatatttaaacatttgatgcctaggcaaataaacttgaaaatatgttctcttcctgagaggagcaagagtcagctaaaagaaaaaaagaaaaagaaaacaaaacatacgttgtcaagctaaaaggctgtatctgatactttgtttaaccatcatagaaayatttgggcaatgtaaataatatayatatcattgtcttttttactctcatcaacactgccttcttttcaaagttgcccttaatatatrttaaaacttgacatatgtctcaaagaagtgactctgtgagattaaattgatggttttcatatttcatagactgatcttaataatggttaagagtatggtctctagatcaaactgcctggagtttaaatcctggttccaccacttagtagttgtattatgttaggcaagttgcttaaactctctgtaagtgtttcctcatttgcaaaatgrggatgataaatctcccactgaggattaaatgctccaatgcaagttaagctcttggaaccctggcacaaaktaaatacttaatagttattatcttattatttgaacaatgttgatatttctaatttctgagctatcatgttaaatagagtaattagcacttcttatattctaaaaatattttgatataatgaaataccatgaaacatttattatatagctgtaatattattatatgagccatattactattgatattttctattatgtttcaatttggtcttgtggaaatattggaatttctggattacaagaggttggctcagtggattttactctactataattgccttggtagaaatattcaatattttgatgccaatttagccatgaataacttataaaaatgtaactccaatctaattttcaagggggaatttttggaaactgataaaatgactaaaattccatcctaacaaagcaaaatcaccaaacgtctaagaaaaatcagaaagtaaaagaatatgagaggcattgtcaagtatcagatttttttttttaatttcaaaggtataatcttaatcatttggtattgcttcatgaatacaaagactgatcagtgtaagaaaagagatgtccatggaagagacactaataaatgaatgttttagggcaggccacacaagatggctgcttactacaatactctttctggagagcctctatgtgcatgacattttcagtttccttctaagaggttcctggtgcatggatcactgtgtttagttccatgtggttctgcaagcagagccagggattattggagcaggaatcacctctcattcagtcaatcatctggaataatcaatggtctacaaggcagggcaatatgagaggtatagaacatacagtactaacattctccacttcatatggtaactagtcaattcaatcagatcctttgatggtctatgttaccctctagaaaatggccacatataaatagcagtaatatttgagaagtacagaagctaaaagatagagaaaaagcagtagtacggtgacattattagacagaaaaagctaggaagaagcataaattaattccagaagcatttgtcatgtcaagagaagaaacaatagaagcatagacaaagagtagttgagtagctatagaatattgaattgggtagcaaaagacaccactgataatgataaaacaacaaggttactatagctgcagtgtatccagatgctataagaaattttgctcctgccgttcaaaaaaattattatttttaattgtagagagtacatagtaggtgtgattatatatagggcacatgagatactttgatataggcatgtaatgcctaataaccacatcatagtaaatgggatatctgccttctcaagcatttatccttggtgtcataaacaaattgtgtactcttgtagttattttaaaatggacaagtacattattattgattatagttactctgtcatgctatcaaatactaggtcttattcactcattctttctattttttgtacccattaactatcctcacttccccctaagtccccaactacccttcccagcttctggtaactattcttctaccctctatctccacgaaytcaattgatttaatttttagctctcataaataagtgagaacatgtgaagtttatctttctattcctgactcatttctttctatttctgactcatttcacttaacataatgacctcccagttccatccatgttgttgcaaatgacaggatcttattcatttttatgactgaatagtactccattgtgtatatgtactacattttctttatccactcatttgatgatggacactgaagttgcttccaaatcttgcctactataaataatgctgcctactataaagtgaagttaacactttaacatcctgatttccattcctttgggtatataccttgcagtgggattgctggattgtatgttagttctatttttagtttttgtttgtttstttctttgtttgttttgagatggagtctcgctctgtcccccaagctggagtgcagtggtgctatctcggctcactgcaagctccgccttatttttagtattttgaggtttgaggaaactccaaactatttttcatggtggttgtactaatttacatccccaccaacagtgtacaaaagttcccttttctccacatcctcattagcatttgttattgcttgtcttttagataaaagccattttaactggggtgagatgttatctcattatagttttgatttgcagttctctgatgaytgatgatgttcagcaccttttcatattcctgtttgccattgacatttgtatgtcttcttttgagaaatgtttattcagatcttttgcccactttttgatcagatgattagattttttcctatagagttgtttgagctacttatatattctggttattaatcctttctcaggggggtagtttgcaaatattttatcgcattctgtggttgtctcttcactttgtggatagtttctttgctgtgcagaagattttttaacttgatctgatctcatttgtccttttttgctttggtttcttgtgcttgtagggtactactcaagaaatctttgcccacactcatgttctggagagtttccccgatgttttcttttagtagttttatagtttctagtcttagatttttgtatatggtgagagataggggtctagttttattcttctgcatgtagagatacagttttctcagcaccatttattgaagagactgtcttttccccagtgtatattcttggcaactttcttgaaaatgagttcactatagttttatggatttgtttctgggttctctattatgttccattggtctatgtgtctgttttaatgccagcaccwtgctattttggttactatagctttgtagtgttaatataatttgaaatcagataatgtgagtcctccagttttctttgttgattttctgcctggaagatctgtccaatactaaaagtgaggtgttgaagtgtccagctattattgtattgaggtctgtctctctctttagggctaagaatatttgcaatttatatctcagtgctccagtgtttggtacatataaacttacaattgctatatcctcttgctgaattgacctctttatcattatataatcaccttctttgtttcttcttacagttttcatcttgaagtctactttgtctcatataagtatagcaactcttactcttttttttggtttccattggcatgaagtatctttttttatttcttatttctgtctgtgtttatctttataggggaagtatgttttttataggcaacagatcattgtgggttttttaaaatctattcwtctactccatgtcttttttattggagagtttaatccatttacatgtaatgttattattgataaataaggacttactcctgctattttttttctgttttttttttatgattttctctttcttcttttcttccttcctgtcttccttttagtgaaggcaattttcattagtggtgtgatgaatttattgctttttatgttttgtgtatctgttgtatatttygatttgaggttactatgaagcwtgcaaatactatcttataatctattattttaaactaatgacaacttaaagttgatggcataaacaaacaaatgagaaaaaaactaatagaaatgctacactttatctcactgccttttaactttttatgtttttatgtattcttgtactatgtcttgaaaagatgtaatcctttattatttttgattggttcatcattgagtttttctattacctaatacataaaataggagtttataccctcaaattacagtgttataatattctgtgtttttctgtgtgcttactattactggtgagttttgtatcttaagatgatttcttattgctcattaatgtcctttccttttagattgaagaactccctgtagaatttcttgcaggatgggtctggtgttgatgaaattcctcagcttttgtttgtctgtgaaagtatttatttctcctttaggcttgaggatattttcaccagtaatactattgtagggtaaaagattttttccttcaacactttaaatatgtcatgccactttgccctgcccataaggtttccactgaaaagcctgctgccagatgtaatgtagctctcttatatgttatttatttcttttctcttgctgcatttatgatcctttttttattttcaacctttgggagtttgattattaaatgtgttgaggtattccactttcagttgcagctgcatggtgttctataaccctattgtacttaaatattgatatcgtagattttggaagttctctgaaattatccttttgaattaactttctaatcctatagaaagtagtgaagccagtcatgtttgtgtccttctcttcaggatagcaaattcccctaaaccccaggcaggtccagcaatgctagctgtgaaccagggattagagtcaaaacccttagaaatctaccacatgttctattttactgtggctaagctggcactcaaaccacaagacaaagttccttccattctctacttcttcttttagctcgataactcttagatttggcctttggaggctactttctaggcctaataggtatgcttcaatttttaatacatttttttcatttatctcctctggttgtgtattttcaaacagcctatcttcaagctcagtaattttttttttttttttttttttgagatggagtcttgctgtgtcaccaggctggagtgcactggcacagtcttggctcactgcaacctcctcccgggttcaagtgattctcctgcttcagcctcccgagtaactgggactacaggcacccaccactacatctggctaattttttgtgttttttagtagagacggggtttcaccgtgttagccaggatggtcttgatctcttgacctcgtgatccacctgccttggcctcccaaagtgctgggattgcagacatgagccactgctcccatcccaaaactcactaattcttctgcttgatcaattctgctattaggagactatgatgcattgttcagtatgtcaattgcattttttcaactctagaatttctgcttttttttttaatttcagtctctgttaaaatcatctgatagaattctggattccttctctatcatcttgaaattcattgaactttctcaaaatagctatttttaattttctgaaagtaatggcagtggctgctccagattgcctgctgttgccatcatgccagctgcagcaaggaggcatggccagggctgcattctccatggagcagctgggagctggggacaagcaggagccctggcccttgcaagatggggcaggagctcccagggtactgctgcagccagccaaactgtggctgcagactccaacctccagctccatggagccagcaggagccccaccccccaaccctgggcgcagttgtggctgcccaaatcatggctgcagacttagacatccctgcactcttggggtcccaggaaggcccccctgccctctcaggatcagaagtgcctgctcctgctgcctggcttttccctgctctcagtgtggtgcccactctgatcttggaggaaagtcagggccaagcccaggcaccatgaatgacagcaggaggtggacagattgctgggtggaagggggtacatccctggtgaggccccacytttgggccatagagggcctgaaagctggggcctgggctgccagtcccacagactagagtgggaacttgtggtgccttttctgggcccaccaatggtykcccatgagccaaatcagtgcacacttcctcccatttgaggcccataaaagccaaagtctcagccagaggtgagcagacaatgggatgaccagctgcagagagtagttaccttctctgctgagagtgggagatgtcagtatgaccagaacctgaraggagctgcccactttatggcctcctctttgctgagagcttcagaaacttgcagagaagtcaggactatcagctgtagagaacagcaacccactccagggccttctctttgctgagaggtacaaaatgatggcatgacctgcctggagaggagcttcccactccttggtctcttctgtgctcggagctgaacactcatcaggataccctgcctgcagaaaggagctaccctctgtgggacttctgtgagctgttatattgctcaataaaattccccttcatcttgcttaccctccacttgtctgcctacctcatttcctcctgttgcaggacaagaacttgggagccactgaatggcagaactaaaagagctaacacaaacagggctgaaacatgtcccttgtttgccatgttgcaggagaagagaagaagagctgtggcccctcagggatcccagacctgggagctcccagagtcagggctgtgactccctctttgggtttctgtagttccttgtgtctctgagcttccgggcaccaatgtgcttccagggccagccagggaagctgcttgcagtgtgcctggttcaactatgccttgcagagagccagcacctgtagctgtctgccccactgcagcagctggcatgtctgactgagcagtggccggaccccacactcactcacccacccctcattgctctattgctgactcacccttggcaggcatgggatctaggctggtagcgtgagctgagcacagcctgccaggcagggtgggaagaatgagcccagtgcgcccaagcaaaacttgggcaaaggcgccaccaggcagaggtttcaggccagaaaagcaacaccccaaagatcccgtaacaaaaggtcacatatctctctttctccaggattggtctctggtgtcttatttactgtgtttggtgaagttttcttggctggtstcaatgcttgtaaatgttcatctgtagctgggcatttaagagttaggtatttgttttagtcttcacagtctgccttgtgtgtacccatctttcttgggaaggcttttcagatattaaaaatgacttcgacattgtgatttaagctgtatctgctttaacggggaccctaagcccagttacactagggttattgcagcctcataaatgtgccgcctttgttgtcttggataagatccagaagaattctcygaattaccaggcrgattgtttttctcttttcttactttctctcaaatgttgtttctctctgagctgagccacttggagctggaagtgggatgacacagggccccactgtggccacatcactggaactgccctaggctagacctgaaatcagcacagcactgrgtcttgctcaaagcccactgtaactactacctggctactgcctatgttccctcaaggacctagggctctacagtcagccagtggcaaaggcagccatgtttrtgtccttcccttccgggtggaaagttctgcgcaggcccagatggagatgctgtctggaagccagggattgaagtmaaaaacgttagaaatctacctgatgttctattctactgtggctaagctggcactcaaaccacaagacaaagtccttcccattcttccctacctctttccataggcagaggagcctctccccaggtccatcaccaccatcagcttgtggagagttctgccaggccactgccaatgttcatttaagacccaagggctctttagtcagcttgtggtaaatgctacaaggtctgggactcaccctttagggcagtgggctcccctctggtccagggcaggtccagaaatgctgtccaagagtgtaggcttgtattggggacctcgagagcacacttggtgctttaatccactgtgactgagctagtacctgaagccagcatgtctcaaagtctcacccaaggtccatggcatactacctgggtattgctgctggttattcaggacccaagggctctttggtcaacaggtggttactgggttcttcccttcaagggagcgagtctcaatcaatttacaagtttattttgccaaggttaaggacacgatcatgactcagcctcaggagactctgaaaacatgtacccaaggtggtcagactataacttggttttatacattttagggagatgtaaaacatcaatcaatacatgtaagatgtacattggtttggtcctgagaggcaggacaactcaaagccggggcttccagatcatagatggattcaagtattttctgttcggcaattggttgaaagaatttatctaaagacctagaatcaatagaaaaaaaggaatgtctgggttaagataaggggtttgggagaccaaatttcttattatgcatatgaagtttccaggtagcaggcttcagatagaatagagggcaaatgtttgttatcagacttaaaaaggtaccagacttagctaatctctcctggatcaggaaaagacctggaaagggaagagaattctctacagaatgttgattttccccacaagaggcagctttacagggctgtttaaagatayatcgaagaaatatatttcagggtaaaatacttcaatttcttacagggcctggtatatgtcattttgtgatgtatctgattgccacaaagagtctgtttggtcagtcttaagatctcttttttaatgttaacactgatcaattgtgcctgaattccaaagggaggagggcataatgagatatgtctgacccctccttcccatgatggcctgaactagtttttcacatttactttagaacatcattggctgaaagggagatccattctatcagttagggggcttagaattttattttaagtttacactgttcaattgtattaacatgcctcaagaatatttatccattcttctattaaaggatgtttagacttttctcattttatggactattatgaataacaatgctatgtacctacttacacatattatttcatggaattcaagggaatttttatttctcctgcttaaattttattgttagtaatgaattgccagggtgagggctaaatatatgcttaatttaagaaactcctctccaaaatatttgcacgattttacactcccatgagcaatacataagggttctgactggtccacatgtcaacatttagtgttatcagtccttttgattttactcactcttataagtgtaaaatagtatctccttatggttttaatatgcatattcctggtcatataggatgttgagcattttttcattgcttatttttttatcaataatttttcatatttttacttttggcagttcttcgtatgttcttgatagcagtcctttgctgaatatgcgtactgtcaatatatcattttcgtctccaatctgtgtcagtggcttgcttctccattttcttaatggtgtcttttaataagtgaaaagctgattttggtgaaatccagtttagttttatttttaacggttaatgctgtttttttctctctttgtattaatctrttttctgttgtttcaggtaacaggatacctcaaactgggtaatttataaagaaaagaaatttattttttacagttatggaggctaagtccaaggtcaaaggtccacatctggtaagggtcttcttgcagatgagggctttctgcagagttctgaagtggcacagkgaatcacatggcaggggggctgagcatactcatcatcttaaggccccacctcttactgcygccacattggggattaaatttcaacttgagttttggaggagacaaatattcaaatcatagcagtcttgycctaaattaaaaataataataattaaaacagaaaaactggcagctccaaggttttgaaartattctcctgtattttgttttaggagtggaatggtcttagatttatatttggttatrttagatttttagtattcccatgtatttggagttttctaacgttattttaatattttaatttgattttacataggttttttgcttaggttaatatttaagacaattatttaggtcttaccccttttcgttttatttggcaacctctggtattcaaattcatggtttctttctatagccatatcattgcccagttaagtagctcacgtgaggaggtgggggggctgggggtggggggatgtttaattgttcttttctggccacagtcacataatagtctcactgtgtttgtgaatctaatggcttttgattatttctcaatttctcagttttctgattttaaatgatttccgattatattctcctaaggtcttaatatcctcaaagatatgttgtaagaccatttgaaggaaatttgtaagatttacttaactttgtaattggaacaatagctgagatgattgaaaaggtcaacctttattttccttaattttttaactttctattttgagttactttgagattcacaaagagttgttagaaaaaatatagaaacatactgtgtatcattcaactgtaacatctggcataactatagcacaatatcacaatcagaaaatcaacagtgatacatttcattgaccttactcaattttgccagttttacatttacccaattgtgtatgagcatttattttgtttttttttaacccttttaagaagacaattaatatttaaggttttgtttgtttgtggttgttctggttcagtatgaatgagtttgaagggctcatttttcttcttctctacctgagtttctcattcttatgtgtaaggcaatccatgggtcactacatgcaaaacattgtttttgtccttatttttatttgaaatccttatatttctatttcctaaaaacttgttattttctccctgactaaacggtttcttttcttttgtaaatcacagcattgacaaattttatttaatactaaacaatgtttttccattacttaaaaaacttttgaggttgcttagattactcttaccactgttctttgtttacatcattcaatatatttatttactcaaaattcatcctttggttcttgatgtctctcttctttgttatcaaagattttctcttcatttttagcttgatgtttttaagcarcattttcagttatccctgtttttcaaactttccaatatttagagatgtgaggtttctgagtttgctcccaatctctatttttaaaactttatttattttttgttagmaaaaaggttaacaaagagcatctgttcctttaattttgtagtctgttcctttaattttgtagtactatagcgcatctggtaacccagtaggctatttgtttcttacagggatctgtaggtattataaagactattatttgttttgtccggctagtacatattcagaagcccaaagatgaaaacacgtggatgatacaatgcttaaggttaagataactgtgttttataaacagaaaaaaagtgtgataatttcaaatgagccgtttacataagttaatgttgatgttagagttgtgatttgcatttcccgattttggttcttcatytgaartgttattgatttatttccatagggctttacttttagaatcctggagtttcctaagaaaatagaaaggtagaaagtggcaattatagcccacattcctactaagcagctataaatgcwaaaatatgctgatatatcaattaccattataataaaaatacaaaaatataagttacacaatgtaggcaatgtatttgttaacacttatggatatctataactatagatatagattaatctatatagctctagattattatatctataccatagatatctataccatgtagatccatctatatggtatagataaaataaattggccagagttttctactttagtgtttatagtttcttttttttagaatagtgggcagaggaatttaaactaaacacattgggcaaagataatgtataggattttgtgtcaaggaaaaatgcccaatttaacagttaagtagcctagtaacatatgccacagcaacatgtcttgtcccaaacaatgcgcatagttgaaagagaataygaaaaaaacaacaaaccagtatcaatgccacctgaaactcataagggaaatgcttaaaatgttccatgtaaaacatatatgaaatatgtccacctcaaaggataatttcaaagtaaactgtgaaatgctgctagtgttgtaattatagcctcattttatttctgaatgatgataaagtgcttttgtttttgttgatgttgttgttgttgasagtgcctaatctattaggctttttcaacacggtttctgaaagaggctatcgaaagacaattgtagtactagtccattgcaaaagtgaacagtctacccactgattttaagggtaatataccccagactggggagcagaagattgggcataatcataccttagcttttttcaatctccaaagttaaaagaataaaagcagaagactagcatacwttatattttagaattaaaataaaatgtaattaaatttaattaattaattatattttagcattaaaataaaatgtaattawttgtaaaatcaattgactaattaaatgtacttaatcaattaattataaaataaaattgtaattaattgattaattgattattgaaaactaccatgtttccaatactcttataaatatattatagttcttatttcttttcctttgccattgcttaactcttggaccatattatatacttctgatagatgctgtcatatataaccctgtatttcatttgtcatttcatttactgaatggcattagagtttctttgttgattctccattaactataacctcctcataaatacaaaccatattcatcttaccaaggtattactgacagtatttttyacattggaaaacaaaggatgcttacttcatggtcacataaaacaattatttttcttaaaaattatccagtaatgcatgtttataattgaaacattagaaattatattttaaaaatgtaagaataaaatcatttgtagtcttatcacccagagataactatttcaagtgttttctgtgaagatatwtgaaaaaaattatayatatatatatatttggacatttattagtattccaaaatgggatcagattatacaaattattctccaatctgtttttactcccatttaagtctgccacccataccctcattattgctctctaagttagtcatcgcatgctatttttactgtgtatttcacaaatattatgaaggcaaatcttttattggctgtctatacaactatttctggaatctggtaagacaagaaatttgagtttacaataattttttttgtgacaacctgataatttcaaataactattatactgaaattctagatttctcataaaataaacgtgtctaaaacttatctgtaagatgacactataacattataaaataattactatcaccttcagcttgtacagtgggttcctgctcattaaagatcccttctttcagacttgagttatttaatatttataacctgatgtacccctctccccgcctcagtaagatccaaggaagcaggagttggatatttaaatttcatcacttttgcttccccaattaaaagaataaaaagcaaaaactatagggtgaacctgctttatattttggatttgaaataaaatgtaaytaattaatagataaatctatcttttaaatatggacttgtcttttccttcaagtagyatgaatttgattattttatatgttgaaataagcatagtttctatgacaatttagaaaaaaaatttatcatttatagcaaatgatttgatttgaaaatgcatagaataaatttattttcttagamgaaaccacagatgcaagaatttgggaaaataactcattgtaataaatgataaacccactgtaccataatgtcaagtatcaaagcattgatatggactttgtatgattatttagaattttaaatttagttaatacaagacttgactaatgtgctgtgcaattttgtaaattactgatactttgaaaaaaatggttataagacacttttaaatgattggtttattygctgccatttttatggttggaactcagtcttacgtagccctaaaaggcaacttctgaatcaccactattgtaggtcattattgcaattgtaatactacatattcacaccccttttaaaaaaaaaaatcacaaaactctattatgtacttggtgttctgagaaaagtacaaagcaaatgttgaagccaatcatgcttcaaattgcttagaaatatctcttgtattaaatagtcagcatttcgggccaaggaggatcgaataacaaaatatacacgtcatcatgtaaagccattgcttgatcttaacaattatgattttatttctttcaaatacaacaattcccctgatgtttcaagtagcaagccacagaatgctataagaaaattgggaaggcacaaacctttgctaatattgtacattacttttctattggtgggtagagaggaagccatcctgccttccatatacatattcagtggttgaatataaaatctctttccttttttataattgtggatatagatttagatatttcatattctttttttgggttattattatgatcattagtttttcagacatgaccttgctctgttgcagtggtgtgatcataagctcatggcaggcttgaactcctgggctgaagtgatcctcttgccttagcttcctgagtagctaagaatacaggtgtggatcaccatgcccagctaatctttttaagttttttttttaatttttagtggagacatggcctcactacattgcctaggctggtctcgaactcttgggctcaaaccgtcctctctccttgacctcctaaagtgttgggattgtaggtgtgagccaccatgcctggctgtatttgaggcttttatcaactatatgcagctagtatgtatgaaaaaataaactttcaaaatcaacagctaaacaaatcctaaatgaacaaaagcatgttggaaagataaacctggaaaaatattttttctttgtatctcctgtgtattttttctctgaaaacccrataaattatcataaagttgaagagggtgggaaaacaatttcagaaacaaaatataaaattgctactgatttgatgattttacattttccttaaaaattatggatagttctgactttagatttcccaaatgcaatrtattttataaaaacygacaggtgacattccctctaaaaagaakaaattgtgcttcctcaaggaaacctaccaaaatatcttacagattaaatattactaaatatttagataattgtggcagcttcaaaatatattcaatctgtctatttcattgccacataactagtttcaagtgtagctttcctgagaatttgtatgcttgctatatgtttgtatcttgtcatttttgtaattggttggtctaattctgtaagacaactgatctaggaaacaagataaaagtaaataaagaagagatactttattcataagaaaacttgtgtttagttctgacttatctttctttgagcttttctrtatctcattgtctccgtttgttcctttgtttttccattcttacttttcctaatttacaggtattaagggaagataaagatacacatctttgtcttcttctcaatgagactacaaacaacccaaggggagagacttaaaatttcctttgtcttttccataggtagagtgacctcattttccaaaaccaaaaatgggaaatggatgtgtcaaaagtgctactatgagaaaatagacgtgagaaaaaatgtttttagtcaaatcatccttaaaaaataggacagatggacaatttattcaatgtatatgagcattctttggatcttatagacaatgataaatggacattaaaataaaacataatctgaaatcttgctaaatctggccctacawttgtcagattaatagctttgttcatttttatcataactatctgggtatttgcctttcacackccaatatcggatatgttcatggcrgatctattttcttatttacttgcttccartttaactaaatatgtgaccaaactacttagaactatccacgaaaattctacaaatatacttaaaattagttgactcttctttggaatgtgaaactagtcacttaaagaaggcattaggtagctttgagatataattaggctatgattatatgtggttattttaaataacaatgatgattaataaaataattattttatatgtcaatttattttatatatcaggataaataattttataaatccataagttggtattatatcttatatgtaatagaatattaataaaactataataaaatacatttaataataaatttatagttatttttaataccatagataatacctttaaaaactaaaaattggaaataaaattttaaagcatgaaataaagaagcagcacaatttgatatattgtatacttcttattttttactatgtaacattactaccaaatttagtggtttaaaacaacgatatttattacctctcattttctgtggatcagcagtctgggtataatttggcttatcctgtctgaggacctgtcacaagactgcagttaagatgtcagctagggctgctgtctatctgaaggctcaacaagcgaaaggtctgcttcgaagcttacgtggtcattgacagaattcagttcttctcaggctgttagactgattgttggacagagactactttcacttccttgtcatrtgtgctgatccaaagaacaggacacagcatagcagatggcttcaattgcaggaatcaaatgagaaagtgagaaagagcctgtgaaggagattaaagtcacagtcttttrgaaggtaatctcggaaatacctctcacttttgcttcattctgttcataagaaacaagttaatagttcaagcctatactcaagagaagggagttttgcatagttgtaaataataagaggaagggatctgtgggggccattttaaaattgagttacwacaccttgcaaaataacagttgattctcatgatacttttcacctgccttagggatgtaggtcaccatttaaggatttcctacttcatgttgtcagtctcaatcaaatacttgtaacacaattttataaaaattagatcttttatatcagacacgcaactacaaatcatatattatgtatgtggggtgcataacaaccrtaaaagtttctcaaagatcaatgttcaatcatccttcacacacatatcttgaatccagcaatattttccaggcatgtgtgtgtttggctgtatgtgaatgtgtttgtctgtgtgtatgtktgtatcttcaactctaaggagcacaggagtcctgctgtttagtagggggagacagattcttgttgaagaaccatacctgatttatgaccaaatatatatatttttggattatttatttggtaawcatgttgttgaagtgtaacatatgtaaaaagaagtgtaaaataaaaaatataaatgactttatataaagtgaaaacacccatgaaagcattcatggattaagaagttgaatattatcagtaccacaagaaatatactttgtgtgcctacccagtcattaaccttttaaaaaggagtcatttttccctatcaccacaaattaattttgcctgttattttttagttttatataaatggaacagagaacatatgtacatttttacaacaggtttattttattcaaaatagtttgtgaaattcaactatgacattttgtttagtaaagattcatccattttccttactggaaaagcattctaagtttttaacaattattaataatgctgctatgaacatycttatacatgtgctttaacacacatttaagtacattttcaattccacctgggagaagagttcttagatcatcatcaagyataacatatttagctttagaagatacgkcaagttccaaagttttatatatatgtttaatccaccagaagtgaaatagtrttgctttttaagttggtccacattttggccaacactcaatgatatcagtccttttaattttaactattctagtctatatgcagtgctggagcactgtaatatgcattttcttgataaatatggaagttgagaaccattttatgtgtttattgatcatgtaaatttctattttgtaaagtacctatttaagacactcataaataagttatctgatttttaaaattgatttataagacttttacatattctaaatgttattcattggtctgatgagtgtaatgtgaatatcttcttctactctgtggcttactgttcacttggtagcttattttagaaaaataatttttattttaataaaactagtacatcaattagatgttccctttatggttagtgatttttgtgtcctgcttaaaatataattgctaaactttaaggtcatgaagatactgtgtagaaactttattgtttttcctttcatatttaaatgtatcatacacctgaaattttttttttttttttttttttttttttttttgaggtggagtcttgctctgtcacccaggctggagtgcagtggcgcgatctcggctcactacaagctccgcctcccgggttcacgccattctcctgcctcagcctccccagtagctgggactacaggcgcacaccaccacgcccggctaatttttgttgtattttttagtagagatggggtttcaccatgctagccaggatggtctcgatctcctgacctcgtgagccgcccgcctcggcctcccaaaatgctgggattacaggcgtgagccaccgcgcctggcctgaaattgattkttgacagatgttgcagaaggtaaaagttaagatacaattttccccatgtggatatcctatagacctagtaacaattatcaaatcaatcatcttttctctttttacttcaaggtcaactttgtaataaatcaagtgattgtataaatgttacactatttctgctcctggatatatttttaaattccatgtaatgtttgtccttgcactagtatcagtatatatcttcctcctttgttcttcctattcagtattaacttggtcatttctggatcttttctacttaaattttaaaattattttttaaatttgcacagaaaagtcctgggatttttatgtacattgcattgaatctattgactaacttgaagagaactgaaatctttaaaatattgaatcaaaattgtattagttttaatttacttaaattttaaatttattagttttaaattacttaaattttaaaattattttwaaaatttgcacagaaaggtcctgggatttttatgtacattgcattgactctgttgattaacttaagagaactgaaatcyttacaatattgaactaaactgtattagttttctatagatgtatagcaagttaccacaaatttatcagcttaaaacaacataaatttattatctcatagattttgtgggtccatagtttaggtgcatattgtctggggttcctgctcaaagtcgaactagactgaaatcaaggcattggacagtgtctgattttgggggaagttattactctctttaggattaactctgaaaacctcaactstatgtaattagaacacactgtgggttgtatttcattagatattcttggatctgtatcttctgtttagactgggaaattaaatttctgtttagatggtgaaacagaatttaatccttagcagtagcagtatagcattgagatagtttattcagtaatactaatttgatcttgtaaaatcagagagtaaggaggaggagtagagagagaatgggggctttgtttgtcagctaattgtgaaactgtcagctttctcattgttggtattcttaaaaatacagctaaagcatacacatgtctgtggataattggataataattgctagtctatttagttttgcatttagcttctctagtaaagagggaggataaaataaagtaactttattaatttaaartatatacccattcccagatattttattttgttttccctttaccctgaaatgaatgtgctgactaaaaccactaattacattgtataaagctatcttagtgtataatgagggaaaacagcatcaaaatcaggagccaagaagtcaagctccacttggatcaggttacaatcttaaacctccatattctggaaggattcccccttccccatgaaatgtttcagagggacaactgctagatattagaatatttcaaatgacttcatcaaaggaaaaaaaagcactttacgattcagtaaatcttatgatttttttttctattacgaaatatcaaaaaccctctgaggcatagatactagggttatatagtatcatatatgcatatagagaaaatgaagtgtctggccaggattgtctgcaagccaagaggagctttccactgcagaaaaaagaaaagcaagagatcctcagtagtccacattcccacgatgaatactcacactcctactaacaggagagmttcacagccattgcaggagctgagtcaagtatagagagctgcctggagtccatgcaactgcattgtcccagaaagaaaattcacattgggtcctcttcacctccaaagacccaagctgccacagcatggccccatttttagagaagagccaccacctgagtttattcttccctggggcccaatagcccctgcacctccatatccctggggcttgctgaccttccacctcatctaccaggaaagctgcagcatcatgacaaaagatgaacatagtggtgcagctgtaactttgttaccagagcccaggcagagctctatacatcagggcataaatgatccagcacactgggaaggcagccctcaggacatagtgacctgacacactcattccccagaatccaagagccacctgcccagggctttccatcaccatcagggaccctgcttcatccaaaatggggccatcacaagactgtgcacrctctccataaacttgaggactgtcccatgaggagcctgtcaccrccacaggcaatcttgacccctccacaggcaacgtgactgtgcacctctgtgggctctcctggagaccaaggaccaaccaacctggcatccctgtccccagtaaagctctgccacagatttcacaaataattgcagcctagaccrctgatgcactctcagacactgatgacattgattacagctttagaaatcatatggataatatacaacagtgcccacctagaaccttaaccaaagcactctatccaacccacattattgaaaatatctacaggaaaaagtctttccctattaaaactattacataaaattggaagaagggactgtcctacaagatcttaaatatcaatttaagaacaggaaaaacatgaaagagcaaagaaacatggcattttcaaagcaacatcataattctcyagtaacagacccaaatttaaaataatgatcttaagtaaactcagtgagacatgagaacacaaatagacaatccaagaaaaaataatagcttatgatctgaaagagacatttagcaaagagatagatattgtttaaaaagatccaacctgaaatcttgaaattgaaaaattcaataagtgaaataaaaaatacaayagaaaaacttcaatagtagaactgaattaagcagaaaaaaaatttctgarggtgaatagagaaattacccaatgagacaaaaaagaggagaaaagaaaagaaaaacagaatgaaaaagaatgaagaaactctataggatataagagacattattaagcaaatacatagttacattatagaagttacagcaagagaaaagatgctaaaaggcagaaacctatttaatgaaataatagctaaaaatgtcctaagtcttagaagagatatggatatccagattaagaagctaaaaaaattacaaataaattcaacccaaacaggtgccctctgaggcaaactatactgaaattgtccaaagacaaggggagaatctaaaaacagcaagggaaaagcaacaagtcacatacaaggaaatccctatcagactaacagaagatttctcagcagaaaccttacaggccaagagagaataggatgatatattcaaagagttgaaagaaataaaaaaaacctgtgagacgagaatattatactcaggaaagctatccttcagaaataaaaaagaaataggatcttttttagacaagcaaaaactaagaaaattcatcaccacgagaccagccccacgtgaattgcataagagagcctgacacgtggatgtgaaaggatgatatctgccattatgaaaaamcacaaaagtataaaactcactggtacagcagatgcacaagtaagaaagagaaagaagtaaaatgatctcactacagaatacctccatactgcaatgttaaacaataagaggmagagaagraaacaaagggtttacaacacaaccagtaaacaattaacaaaagaacaggagtaaattctcaacattcaataaaatctttggtaaatggtttaaattatcaaattaaaagttttgctgactgggctatatagatttwaaaaattgacctaactatatgctgcatacaagaagctcactttacctggaaatacacatgcagactgaaagtcaaagaatggaaaaagttattccttgtgaatggaaaccaaaaatgagcagaagtagctatacttatatcagataaaatactttaagtcaaaaaacattaaaagagacaaagttattatataatgataaataaattcagcaagaagatatcacaattataagtatatatgcacccaacaccagagcacacagatatatgaagcaaatactattagaacgaatagaagaaatatactccattacaaatagtcggggacttcagcaacccactctcaacattgaacagagagtggacagatttagacaaaaaatcaaagaaacatcaaacttcaactgcaatatagaccaaatagacctaatatacaagtagagaagatttgatgcaacaactacaagtacacattgttctcatcagcacaaagttaggtcacaaaacaaatcctaataaatttaaaaataatcgaagtcatgtgaggtatttttaaaaaataacaatgaaataaacatagaaattaataacaagaggaacttcagaaactgtacaaatgcattcaaatcaaacaacgtgcccctgaatggtcaattagttaataaaaaattaagaagaacatgaagaaatttcttcaaagaaatgaaaattgaaagacagcataccaaaacctgtgagatacagcaaaagcagtagtaatatagaaatttatggcaaaaacacatcaaaaaagaaagatttcaaataaacaacctaatgatgcattctgagaaattagaaaagcaagaacaaaccaaacccaacttagtagatagaaagaaataataaaattcagagcaaaaataaacaaaacaggcacaaaaaatacaaaagatcaataaaataaaaacaatataatgatagtgttttggaaagataatcaaaattgaacagttgttagtgagacaaacaaagaaaaaagagagatgacccacataaatcaaaaatcataatgcaggcattacaacagataccacrgaaatataaaggatcacaagagaatrttgtgaacaactatatgccaataaattggaaaacctagaggaaatgaataaatttttggatacatccaccttcgaagactgaaccaggaagaatttgaaaatctaaccagaccaataatgagtaaggatgttaaatcagaaataaaaaatctcccaataacaacagcacaaagcctaggaccagatgacttcactgctaaattctaccaaatttttaaaraactaaaatcagttctcacaattttgcaaaaaagtaaaaaggagtacaaactttcttactcattttataagggaagcattaccctgataccaaaaccagacaaggacacaacaataaaagaaatctacagaccaatattttgaatgaacatagacgcaaatatcctcaacaaaaaactaacaaatgaaatccaacagcatatcagaaggattatacattgcaattacrtgggattatttttctaggaatgcaaggatagtttaacatatgcaagtcaataaatgtgatacatcacagcaacaattgaatgatcacctcaatagtggcagaaaaagcatttgataaaattcaacattacctcatgaaaaaaaaaaaaacacctcttaacaaattaagtatagaagtgtacctcaacacagtaaaggccacatatgacaaaaccacagctaatatactgaatggagaaaactgaaagcttttccttgaaaaactgggataggacaatgatgcccactttcaccactcttatttaacatagcactggaagtcctarccagaataattaggcaagagaaaggaataaagtgcagctgggtgcagtggcatatttgtgtagtcccagctactcaggaggctagaatgagaggatcacttgagctcaggagtttgaaaccagcctgggctacacagtgagaccctatctctttaaaaaagtatatccaactcaaaaaagaggaagtcaaattatccctatatggagatgacatgatcttatatataggaaaatctagactccaccaaaaaaaatcttagacctgataaatttggtaaatttgcaggatacacaataaatgagcaaaaataattagtctctctatacaccaataataaacttagtgaaaaataaattaagaaagcaattatgtttataatagctgtaaaaataataaaaaaatacctaagaataaattcaaccaaggagttgaaaattctctacaatgaaaattataaaatattgatgaaatacattagagtggacacaaataaaatggaaagacatcccatgttcatggactggaagaattaatattataaaaatgaccatactacccaaagtagcctacaggtttaatgcaatttccatccaaacttaggacatgcttcaaaaaaaaaaaaaggaaaaaaaatcctaaaatttgtatggaaccacgaaagacctcaaataactaaatcagttctgagaaaaatgaataaagctagaggcataatactgcttgtctccaaaatatactacaaakctatagtaatcaaagcagtgtgatactgatataaaaacagacacatagacaaatggaacagaatagagaacccagaaataaatccacgtatgtatagccaattgatttttcacaaaagtgcaaagaataggcattgggaaaatggcagccttttcaataaatggtgctgacaaacctagatatctgtaggtggaagaatgaaactagatctctatctctcactatatacagaaatcaactcaaaatgggtgaaaacttaaatgtaagacccaagtctataacactacyagaagaaaactagagatattggcctgggcaaagtttttgtggttaagagttcaaaaacataggctataaaagcaaaaatagaccaatggattatataaagctaaagagctcctgtgcagcaaaggaaacaacagagtgaagaatgaagaagtaacctgtagaatgggagaaaatatttgcatactactcatttgacaagggattaatattaagaactcaaagaagtcaacagcaaaatayccaaataacctcatttttaaaatgagcaaaatatctgaatagacatttctcaaaataagacatacgagtggctaataagtatatttaaaaatgttcaatatcactaatcatcaggggaatgcaaattaaatccagagaggtataatttttccccaattagaatggctgttattaaaaaaaaatcagaaatrttggtgaggatgtggagaaaagggagctcttatacactgttgatgagaatgtaaattaggacatctattttgaaaaatagtataatgtttcctccaaaaattaaaaatttgaataccatatgatccagcaatcccattacttgatatttacccaaaggaaataaagtaagtgtatcagaaagatatatgtatccccatatttattataacactattctctatagtcaagatatggaatcagcctaattgcttatcaccagattaatggataaagataatatagtatatatacacgatggaatactattcattcwtatatatatatatatatatatatatatatatatttgaataaaatgaatgaaatcctgtcattcttggaaacatgggtgagtctggaggggattakgttatgcaaaataagtctagcacagaaagattaatatcacatattctcactcatgtgggagctaaaaacttgaccttatagaagtaaaccgtgaaaactgtgattattagaagctgggattggtaggagggaggaaaggatagagacgttggttaatggatacaaaattacagctagatgcaataaaggaggaataggttatagggttctatagcattgtggggtgactatagttaagaatawgtcaatgtatattttcaaatagctagaagaaaggattttaaatgttcctagcgcaaagaaatgataaatttttgaggtcataaatataattattctgatttcatcattatgctttgtatatatgtattgaaatattattttgtaygacataaatatgtagaattattatgtgtcaattaaaaatgaaaaccaaagaaaaaaatgagattggacttagaaaataaagaaaatcacagttacaaactaaattgagactgctttcaaaaaactgtaaggactatgaattttagtgtataatgccatttaattgctatataagttatcttataaaggaccttctgagatttctatgtttggttcgtattttaagaaagccacatccttccttttggagtagacatttcttagtacttaaggaagyctattagttaatgtatagatgaattccttcatttcatcttctcaattacattagacaagttaactgggccagtgagaattggatcagtgtctgactcatctacgcccttcttgtaggaggaaaaattgtaagagaaaatttctaccttaaagcaaatattttagtatcatattcttgtatttcacgttgttaccatgacaagcaatataatattatatgacatttctaaataccaagccttctggagaaagtattttctataaattggcactacctggtgtggtggaaaagcgtggagtataaaatgtgtcaggcattagtttgaatctccactggataaatctttgttgaacgcttcctacttgtattagtcagagttctccagagaaagagaaccagtaggagattgtttatatatatgaagatttattamgagaaattggcttacatgggagctggtggtgtaaatcagttggagtttgaggacctgagaaccaggggagkcaatggagtaaatcctactcccagtgtctgagaagatatgagatgcctcagctcaaacagtgaggtaggaaaactgtagtgaatttcccctttcttgctttttacatttttatttatttttatttttttagagacagggcctcactgtgttgcacaagctagtcctgaactcctgggctcaagtgatcctcccatctcagcctcccaaaatgctgagattacargcttgagccactgcacccagccttttgttgctttttgttcaactcagaccattaaagacttggatgatgcccaaccacattgtgaagggtaagctacgtaactgaatccaccaattcaaatgctaatctcatccagaaacaggctgaaagacacaaccagaaagaatattttatctggcaccctgtggtcaataaagttgatacataaaattaatggtcataccactaaatattaatgtggtgatcttgggcatgtataccaagccaataattgacaggctgggtaacttatacttgtaaacctcacttttcttatgatgtcttatcagtgcttattaccattttcaaaattcaaaacaaacaaatacctctgaaaaatagaaacgaatcttgtaaatcatttggtggtaaatcttgtgcaaataagaagttattgatagtcttttaaaaatcctatttagtgtgaataatcataacttttgcctttgaacgatgaacgtagtagaaaaagaaacacatgaattagttttctaaaatctgaaggaatataaattcaataacatgttttggtctgaagggctgctataaaaatgtacaaatgtacaaatacttaattttcataagtaacccattacctaacatacttaggtagtttaaaaatgctaaacttcctttctcctgcttggcattattctttagacatgtagagttttattccttacttattttccctcgtytatattaacttttcctaatgtccagaaacattacaaacaaaatattgtccaaaagatgcatttcagggatgttcttaaaggtcagcttaaggaaattataaacattttgttaaggttttctgtttgtttgtttgtttttggtttttgtatcttagagcttagatgataatttgagcacgtgaactttgaaacccaaatatctaagtatccacactctaaatacactaaattatataaataaaacaagcttaggacaattattacaaagcaactttaaaaaacaagagtatttgaccagttgaactttgtctagaagagaataaccttatagaaaagaattagttttatttttaagcagctgctttatgaatacctgcaacgttttagtgcctacctttcttttctttctctttacttttctttccytttctcttttcttttcttttccttttctttcatttttttctctctcccccttctcccttcttcccttccctttccttcctccctcccttccttcctccatccctcccttccttactctcttcctctcttttctttctttctttctttctttttctttctttctttctttctttcgttctttctttttctttcyttctttctttccttctttctctctttctttattttcttctttctctcccttctttccttccttcccaacttaatacacagtaagtactgaaatattttttaataaatgcataaacacatgagtgaaaaagaaaataacagaataattttgggtctatggtcaaaattacagtgtttgagttaaacaatattgaagctaatagtaagtagctatgcagagaatgtgtagacatttgcatgagcaatggccctttctacacttatcaaatacagagtagtaatgactcctggttatacgctgtgtaggggtgggtgtcatttccataagattactgcaaaatatgaataaaaacaaaaagtgatgtagaagtaaaatcaaagaagaaaagagaaatcagactaagagagttaacagaattgatgggtacatgagaaaggtagagactgctattttctaccaaatctttcaagactctgaggagaatacccataatcaatatgttttatgtcatcaaagtgaaccaattttaattaaaataataaagatccaatgacccattgattggccaataacctaagtcataaaaatgcaaggcccttttctgtaattgtacttaagctagaagcctctcaccttctatctcccttaaggcaaatcccaaaatgcaactcaattacttccaagcattgcgatttgattctaaatacaaggtctttgtaaaattatacttgactgacaaattgtagcaaatacacacactaaacatgacatgagattcccccgctcccagcatgttacattgccttgttaatacattcaaaatacttgcttttaactacagcttctaaaagttaactgacctatcattcattcattcatctagcattttgttgttcttgtcattgttaaatggaagtatgttctcaattgcctgaaaactattactaagttatatttggttgaatgggtaacacagtgagatttagtaatagtagtattgaatttaaagtgagtaaaatcagagatggaattgaggccagctcactgctgttgaagggrcagaggaaagagcactagttgttaagatctcagtgcagttcccatgctcttttgacttaaaaattaagaagcttatttttttctgcagggcatccagaattgatctgagttaccgtaactggcttctgctaacatgaccacatrtcacttacataaaaatcagaatgcttgtttatgatacaggtcacaaataccagctagcttagaaacaaataacaggtagctagtgaactgggccttctctaggaaaatttatgagttaagccaggttataattagatggtgtctttgtgaatgtggtatcacaaccagatgagctggtgtaattatttaatgtcatcagttctatgcaatccttgataagattagacactggccaaatgaattcatattacctggtcagaatatgtgctctcctgaatagtataggagacacacttacagcttcttttgtttgctattttcctccaaaagtgatatggacagagggcagggaaatactgggtagaagcgggcgatccctggcgagggccctaccatcaagcctggacccacggcccaaagtgagaactttacatccctgttttctggcttgaatgttgtctttttcaaaaccactctggcccacctcaccccccatcctgtacctataaaaatcccaggctccactggcagcatgtggcagagaaggagagaagagaagcagcttgatgttggtgagaagcagcttgacttcagagggacggcttgatggtgggactgtggagaagagtttggctgccctgaactccaggggaagaccaccttcccactcccctccctttccagcttcccatcctgctgagagccacttccatcggcaataaaatcccccacatttaccgtcttcaattcgtttgtgcggcctgattcttcttggatgctgaacaagagctcgaaatacagagggctgtcacaatgagctgttaaatacttaagccgtccgtagacagcaaagctaacagaccacactgtatcacacaccctcttcagctccaggggtcgcaggtaccctccaaaactctgccacggggccacacagagttctgcccctgctggcgcccagaagcactcatcccagcccctgcaccctctcaggggttgagaactaccggctgagtaaacaagtcagagaaaatttcctgtttcaaaaggatacacttcaatatgttagagatatgttctacaaattataatcacagttcacttatgcctttctgaaacaataattstgagcatctaaactgtgcttaaaaccacattttttgggaaaaactccagttatttctgtgtcagataaatcttacccatgtttctgtgtttgtggatatctttattcttcttcttmttattattttttgagaccgagtctcactctgttgcccaggctggagtgcagtggcgtgatctcggctcactgcaacctctgcctcccgggttcaagtgattctcctgcctcagcctcctgagcagctgggattagaggtgcgcaccaccatgcccagctaatttttgtattttagtagagatgaggtttctccatgttgaccaggcttgtctcaaactcctgacctcaaaggagccgcccgcctcagcctcccaaagtcctgggattacaggtgtgagccactgcacccagcctttattcttaagtcttattaatcacagtagtagtttcctattgctgcataacaaattaccccaaatcatagtggcttgaaaataggacatttattatccaaaagtttctgtggatcaagaatgctggagtggcttagctgaatgattttatctcagttgtctcatgaggtttcaatcgaggtgttggctagaggtgcagtttcaaaaaagaaaaaaaaaagacttaattgggactagggatctgactctaaggtttctcatgtggctgttaagaggaggattcagtttttcaccatgtgggctacttacatcatgtctttctttaaagcaaatgatgagagagagagggaacaaaacggaagccacaattttctataactgaatctcagcagtgacacactatactattacttcagtcacattctattggtcacatagactgatcctaatacaatataggagggaccatgagaagagtgtgaaaccaggattcagcaatcactgggagccattttggggcctggatgctacagtttttcctctatctgctgatgattcatatccctcccacactgaaaacacactcaccctttcccaaggcccctcgccacccacccccgacaccccacaaagcctcatcctattacagcatcagctcataatctagaatttcactatatgaatcaggaccagttatgataagttttcttgggtgcagttctgtaggtaaagctccagtacgtttatcttgatttatagacctgtaaactcaagagataagttatctgttcccacataaccaacatacgaaggtgggacaagcatatgaataaccactataggtatttctaataagaaaggagaacaatggaagttacaaaggagtctttgttcctaggaagttttaaattcagtcaggaaaaatttggaagtttcttgattaggactctgtcctgtatctgcccaggagttattcatcaaagtcaaaattctatgaacagtgtgtaaaaggctctttaagatatcactagcagtcttctcaaaatctttagagtttattcagctccattcattaggtggttccaaagccactcttacattttaagtttttattttggcatcactgcacttttgtgtcaaaatatatatttgctgtgtatgcttgagtaacaaataacacaaaacttagcttcttaaggaatctggcagtgtcttagctagttgagtttggcttagggtctcttaaaagrttacagttgaagtgtttgctagagttgtagtctctgaaggcttaactggggctgaacgattcactttcaagtttgctcatgtggtttttgcagaaggcttcagttctttagaactgagctcgcctatagggttccttccaacatgacttccttcaggccatatgaagagagacagacagagagaaagagagagagagagatgaaaccacagtcttttacaacctaatcttggaagtctaccatcacttctgttttaaactattgaccacacattctaaacctagaaaaatgtgggaggggattacacaaggctgtgaatattgggaggaggcagggatcattggggaccatattgaaaatattgcaagctggctactgttctagaaaaaaacaggttcttgtcatatggcccagaaaatttaggcatgcggacacattgcagggtgagtaggacaggyttattaggtgaaaagaaaaaaggaaagaggaactttcagcaaagtgagagactcctgttggcaggtctcctgcctcacagattgaatcccaggccaccacacaggagctggagaggcctggctcctcccctctgaaaacagtttaagcttctcctggctccagctccttcccctagtgcgcaggtgggcattattcagagagaatcagttaggaggtgacagacttcatctggtacccgcagtctggtttttcagtcttcaggctgccytaggcttgaaggtggagtttcgcyggacctccygctatctcctgtctctatccctaccacagccatcatggatactgtttatccaaatatagtaagtactaaaataactaaaatacagtggttaaacattaatccttttggggggagaaaatggcagtttcttaaaaacaaacaaaaataaactaaatatacatttaccatatgacccagcagtcataattctagatatttaccacagaacaatgaaaatgtatgtccagatgaaaacatttacatgattgttcatagcaagtgtatttgtaatagtgaaaactggaaacaatcaaaatgtccttcaacaaatgaatggttaaacgaactggaatatccatcccatacaatactattcatcaataaaaaggaacaaacttgatacatgcaacaatttggatggatcaaaggtattacacaaagttaaaaaaagttaatatcaggaagttatatattgtatgactcctttcttttttttttttttttgagatagagtctcgctctgtcgcccaggctagagtgcagtggcgtgatctcggctcactgcaacctctgcctctcgggttcaagcaattctctgcctcagcctcccaagtagctgggactacaagcacccaccaccacgcccagctaatttttgtatttttagtagagatggcgtttcaccatcttggccaggctggtcttgaactcctgacctcgtgatccaccctccttggcctcccaaagtgctgggattacaggcrtgagccaacgcgcccggctgtatgactccatttatataggattcttgaaataaaactatagaatagagaacargtaagtggttatcagggtttagaaatggttggaggagagtgtagttgtgactgtagaagggtaatatgagggagatcttcgtgataaggaataggtctgtattttagctgtggtgatggtagttacaagaatctatacacaagataaaatggcatgaagctatacacatkyattgcaccaatgacaacttcctggtatttatattgtaatgtagttatgtaccacagaaccattggaagaaactgggtgaagggtgtaggttcctctctgtactatcttgcaaattcttgtgaatataatatttaattattttaaaataaaaagcattaaaaaatggctcctcaagtcagacagactgtgtttacatcccaactctgttacctattaactgtgtagctgtggatgcattgcttaaccattttatgttagttttttaaaaatccagttaatttgttatgatgcttggtagtaaaaacaaaacaaaacaaaaaccttttatgctgttctgcaatagctagatmtgtgcaaatttatccccaaagtctaaggaggctaagaggccaaaggaagaggctgacatatccagttcctcagaaagaaacatttactatggatttccaaagagaagccctagtcatgggtgacagtgagacatgatggtggatccccacacaattacctgccagatccaggtcttatataccacagtactgtkgatcttgatttgtagacctgtaaactaaagatataagttgtctcttcccgcataaccaacatacaaagrtcggattgaagttgacagatttccaagggaaaagcaagaatgctatgtaaatttgcctaaggacaggatttatggtcaaggatgtttggcctaagggcaggatttaccctaacaacagacaaggtagaactctgagaggctttccctgaacaggggttaatcaagagtcaacacggcagattagcatccaagatggatttgcattagcctccacatacaatgaggccagtaataaaataactgaaagtaaaagcacaggaggcttgagagtttgccttcctttgctttctacttctgaaatctgtacaaaaagggaatggagaggtagtgtgagagaagcagagggagacagtgaaattcctccagaatgtaattgttaatgccaattgacaatgtcaagacatgacttgtgccttccaccttgggcagcattcttgaaatctttattttctttcttgggtgtaatcatgacataagcctatgatacctaaactccactcctccttccatggttcttatttagtgctattaataatttcattgtgtcttatcttaaaccttatagttttcttttaaatcatgaatagctaacaatctccctaccaccatcttagctttgtgtattaacagttactatatattgttctatttataaattttgagtaatgacactccttcctgctcttggtcttctaatattgatttgcaatgtaatgttttgatttccagaattcccagagatggagtcattgtatattttcatgtgtgacaggacagtgataccagaagtgggtagtttcctcaaatacttgctcttaaatcatcagtttcatcatatgtaaattgggaattataatatctaatttaattatagggatcacctgaggtaactgatgtaaagggcatagcacgttgcttgggttggctcaaacactgaaaaaatagtaactcaatatcccagcatctatttcttcccctgctgatgttcccttcagattkgatcatgcacgtgttgcttcctacaccgcctcctggtggcatccagtgtccacagttgagccacatcttttgaatattttcacctctcattggaaaccatcatccctgttatttcttgttccttactctgtgcacatgagattccaatgaggactgaaatcaagtcttccttttttttcaagtattagtttatatttcacaataacagaaatttctgcatatctatctatctatgcatctatctatctatctagtcatcaaccttggaagttttttcagtgagtgtctttttttcctaagacttactcatgagtcatgagtccatagggaattgggttgagagctagtttgagggaaattctttatatatactgagagtctcctctaccctcaggcagccacctggcatttttcaatggggattatgcccatcacttcttttttacttagaatatcctaggaagctgctcagttcctctagctaatagactaaaacggcaaagttagtatgtccctttacgaaaccagaaggaagagtcattttctttctcttctcattttgtgttcagaaaatccactaattaaatataatatatattttttctccctctctttcctgaaatatttaaattataagccttatgtagaaaatcagaagctgctctaaccaaatagctgtcttataagacaggagacaacctrtacttctaggaacaagaggaatacatttccttgaattgtccaggcagcctatctatatataatgaagtaaaaataaatttaatatgacaatacgattcaatatacaatcacaaataacrtartaaaatatacttaactaaaattttttgtccttattgtctgtcttgtgaaaaattataatatatgctgtttctccattttatatgctaggtggagatgtaaccctctgcttgcagttacacaaatattttgtatgaaggaaaagcaagcacaacttaagcaggtgtgactgcatgctgcagatttcaatgggcaccttttcctttgtttagcagggaagggtaatgttaccctgaagacagccaaagaggtagaatggttgctacctctgtgtgtttggcaggctgctagcatccctggcaatggagcctctgctgaatctttttttcttatcgtttttgctcatgttgactgctgaacacaatgcctacaaacacaatcctttcaaaattacacagcctccagtgctctttacaatgtttttggctactatcaactaaatccccaatttctgctgatttcatattttaagtgactcttttaaaacaatttcctgaattccactttcttgaagcacttctaagggaggaaacattttccttctaagaaattcaggtatggctaggggccaaagcataaaaatctgctttgcaaagcagtagcctactaccctttcttacacattaaacgcattaatgtgaattgagaatttaggcacccatttcccccttaaatatgtcttacaatcgtaggcactaggaaatactgtgaaataaaaggtttgagagtctcaaattagttcatagtatgtgatggttgagtccaaaactgatttaggaggccaaggtaggtcaatgttactgatattggcaaggtggtttcaatatttcttctcattagcttagctcatactgtattataagataataatgaaatatactggatataatgaaaatatactggagatcatctgcttatatctattttaagtactagtacaatgttctaacttttccctgacataggaaaaaatgtagcgtagtcagtaattcatctagctagtatgatatataaattaaccactatttgcttttaaaatatttaaatctataatgctatagtcagatgtatcaaagcaaataaagaaatttggaacactaaatgggacatgatgtagtggggatttttttttctacactcatcttcaaatatgaggatacatgatattataataaaatattttgcccatttaaatgtaatctcaatatcctatgaagttataagtagaaaattcagtaaaaagaaaatacctttaaattaaagcaaaactactttaactgtaaaactttggagagagaatatagtaaatgatattgtaataaatgtaatacattaatatgtcttaatacaacaaatttgtgtaacatggggcaaaaaggacatttctttctttctttttggagacaagagtctctctaccacctaggctctagtgcagtggcatgatcttggctcactgcaacctccgcctccaacctctgcctcccaggttcaaaggattctcatgcctcagcctcccgcatagctgggattacaggcatgtgctactaaaactactaatttttgtagttttagtagagatggggtttcgccatgttggccaggctggtctcaaactcctggcctcaagtaatctgcccaccttggcctcccaaagtgctgggattataggtgtgagccaccatgcttgcccaaaaaaggacatttcttatttttagctatctcttaatattttcctgaaagaaagctacactgaaatgatattaatacataattcaaatactaaattaaaaatcttttacaacagcacactactgaaagcatttgccctcaattactttgttgcaccctcttcaaaagcatcaaaaaaaagattaagcagaaacacaactccgaaatataaaagtaattatatttattagccaaaataataagaaagttaaaatagaaataaaacttctagggatgctaataagaaatgtttaaaaaattaacaacagcaaagtaacctgaatatttaggttctggctaagaaatggagaggttttaaaatccttaaagcacacatgtataacagattactataagtattattaggctgaggcattaagaaacaatagttgctggctgggcgcattggctcaagcctgtaaacccagcactttgggaggccgaggtgggtggatcacgtaaggtcaggagtttgagatcagcctgaccaatatggtgaaaccccgtctgtactaaaaatacaaaaattagccaggcgtggtggcgggtgcctacaaccctagctactcaggaggctgagacaggagaattgcctgaacttgggatgcagaggttgcaacgagctgagatcgcgccactgcattccagtctggagaaaagagtgagactctgtctcaaaaaaaaaaaaaaaaaaaaaaaacccaaaaacaatagttgctatgactgcaaaggaaatgttagacatgcacaaaagttataatctgaaattggttcaacaattcttgaaccacataatcacatccatagagagggacagtagacatgagagaaggatttttgaagaaaaacttgcctgttgggtccctccgattgcaactctgttgtggaattggctggtgtttggtgttccccatcatcgtggactcccacagtaaactccacctcttactaccaggaactcttatcygggcatgttgccctcttgggccagcctgtttttaaatggctccacactgaagattctactgcagatattagggttggcttctggaattcatcccctttcaatatctaggtgaaggggttgcttttaaactcaaacacaggcttgtactcggtactcactggcctctttagctttttcagatgtgaattaggctccaggccaaagcatcccccaactgcaggtagctcattcaagctttttttgtacttgcagagaaatcttagttcagggttagggaactgcttcccagtcttccttttttgttatactcacagcagagctctctctaaaataattgcttcaaggatgctgcccatatctgctgtccccatatctggagccctttagagcttttgtgtgacaaaggttgaagtgtaacatyactcatatgtagtatttcagtttttatgtgctgcttgaagtctagcacctcctttggaactctgcatccattatatgttcacgccttggccaaaatgtccatttgtgaattcctcaggctgctgtcttttcctgtgttgatggtgttactgttgcaactgtgctgccgtttggaagcattctgggaaggtagctagctccaaatttacattggtcataaatcaggcaattcattaatggtacagtatgatggaatgttcccaaaacgttgcttccctgagaattaccacttagtcctatagatgcccccagagagctctctgtttatgggaagtgttgtttctacaatttaaaatctgagaacatttcagagtatgtcagccacccaagaactgtggctttctatatgtacaaggtggcctaggccccaaagagatgctataaataattctatcattttcagtagatcacgttctaaacacaattgtaaactacatgtgaattattttgtaaactttatatggctatgttgttttttgttgtttactccatttgcttagcatcggattttatatattttagcatacactgatatctttcttacattacaaaaacacatattatgctattttatttaatgcaattttaagtggtacgttaacataaatttaaatttctgtaaaagtaagagtgtacctaaatgtatacatttatttatgtatcaattgaaaaaaaatcttatcgaaacaatagatttaccctggaattatgaaataagccttgctataaaggaagtctttctcattgctaactctaatacattatttacattatgtaataacttgggccttttaattttcctgtcaggattaaaaagtagtactcccttatttctcaatgcaagaaccctggactcaattgatgtgcaattatttagagtaagcaaagactctaaatcagatgcttttgttatctcgtttgccttagtaaattataggaagtggttccactatcattgccattttttccccatatcagctgtgtgttgaggtcctgcttcttggcatacctaagccatttcttcccatatatgatacagtttatttttaatgcctaaagattccttatcatacttacccttattttactccagctggtttgtgcaatattgttattttaaatggtcaattaaaaattaacccaccctgggtattatgtgtgttcgatgcattttcttatcattcattgttcagcaatatatttactgtgattttaagatccgagagccagaagggagcaccaagtcagagtaaagccttcttagccactacatttcttcttagtgctctctctgtctctgcctctatctctgtctctcttacttttgcatataagttgcttgtaggatagacttaaatgtttatgttaaacactataggaaaggcataaatacgagctactacacatacatgttttaacctaatgtgagaaacacatgctaaagttttccggaggacacatggtttactgtcctatgtcccagatttctttataagcagaaactagcttattactataaaatatggcaatatgaaaaaattggcttatccctgactcctctatttttttcatgctcttcaaaacatgtcttctaagatccttgtaatctctgactgcgttttctactctattttgtttattccattaacttcctcacattgaccttccttactgttcccttaacacgctggctatgatcctgcctcggggctttggaactagcttttctctttccatactccagatgtatgcatgacatgacctctctctcaccttcaactcttttccaaatgtcaccttatcattgagatgtaccttaggttccctatttaaaattgtaactgactcccatcttgttctctccatacttcttaccttgctataattctatatcatttactaatttatttgtttgtctttgtcctcactagagtgtaagcttcaagagattaagaattttgtcttttttccactgatgtatcaccaaatcttagaagagtcatgacataaagtaggccctttacatatttgttcaatgaataaatgtrtgactcatggcagaaatgatgttattactttaactggaaaattatttaatgtattgatatatccagagcttctaaatggcaggttagatatagccagctcattagaagatggggatagtattggaggacttttaaaaaatatgcatttgcataaaaatatactatattgtatttatacatggtatattttactataaatataccataaaatatatactcattttacttggattgagtattcttaggatggttttggtgggatgcaatggggtacattgaagtggaggagactaaagctatccactccagtgtcccctgggccctttggtgactargatggaagaaatcctcatgttattaaaacagtggtacttatgtgagaatgtggagtgggtgaagtatatctgcggctgagggctgagggctggtggtggtcgtcatgtttaattatatatttgaaacaatgtttacatgcactgtaaatgtaacagaaggccataaaatgtcacttttcaaaatgtatactgactttactttctacccatttataaacttttatataaatctcttctttttaagttcctttcaagcgtgttcttgattttctttctcaaactattttggaaaggtttatttttttaaaatctattcactgaagatgatagaagcacccatggcgatatatgtgtggaaactgcacagtactatataaatgctatttattttagctattactatttagtgacaattgtattatggtttagttaagttttaccatgttgtttctagtatattatcagcctaggaatgctgctaaaatgatgctaaaatcatctgaggttgtcctttctctttgtaatctatttcctgttaatatgtaaagggagtggcattggcaggtttagaattcttttcgtttctctttcccttgtttgagtagctacaaaattactaagtcctgtacaatctccctctctctctgtctacttaattcttaccccgsagatgagaaaccaagatcattagtcgttcttcaccttttcctgagcctcatctattgcctaggaatcttgaaactataagtgggttggaaaattgagccctgataaaaatgtttttgatattctttcttcacattttctcattaaacattatagagaagttcactgatgctgacagagtagttgattgtgcctggaagaaatattgtggtggcaagtacaaattagatcatggtggactagtttgtattttgctgtttcagcttctgtgaatgactacagcacaatattttttttattaatgtgagtaaataaatcaggtagaaaattactttaaaagcagtggttttggcattgcagcaccatttcaattcaaattagcacaatagaacaacaagaccacataatcattacaagccctagtccttctgaaactcaaatttatatatttagaaagcgattattatatttataagctatcagtaaaattttgcctactccttttctcacttctgccataattagcttcacaatgtaaaacgcaacagtttttaaaaatgttggaattgttatttggcaagatagatacttaaattgatgacatgtctagaagatgggtttatttgggggctaggaataacatgagagcaaagaatatggctaagacatggataatgcttgggaaaacactccagctgttttatggttattgcggatatctcaaacatgggtgaaaaatatattgtgtattttaaatactgtttttctttggcaaaaagaaacacttctttctttggttgcatattatataaaggaagggtaccaatcccatacagtaaatatctcttctatgacggacctagacacatgttttgttttataaaatatgatagataagttttaagaatgttacccaattgcagcatgacttttaaggatcaaaatacataccttttagaagtatatctatatatagataggtagatatcattagatagatcattagatatatatctatatattaaataaatgatatattagaaaagcttattctttttcttccttagttagtcttataatctttctcttttaaagtgaattgtgttagataatattcatttgcactcactgaatcatacccagttctgagatgctacatggcaactgaatatacatgcacatcctcttatctgccaagagactgccattagaaagcattagacactaccaaggtataattttgttttactaattatattgaaaagtttagaggagggagagtgaatatacatttttaatagacagtaattaaaaggcaggctgttgaggtaggcagatgctggtcagtctgattctaccccttaaagcttacaaaagagtagttaggttgtgatacatgcccatgaataagaaacaccagaaaatataagccaatctttcattttacaaagaaaatcttctcttaattggccagtttaatgacaaaatcttctaagagtgtagatgatatggccaaatctctgcaaattaattaatatatgggttatatatgtttatgttaaaattatataaaacctatgaagtggtttctgatcacatttcatgaatttcattcccttgtgttcttcactggtatcttgagatatcagtagcttcatcttctctgagtcctcttaaacagttttctagaggataacactctgaaatactcaagtgtatgaatctatgggtgatattatcactggraaatttatttcatgagtgttgtcccacgaaattaggccattcccgttcactcatttattctgtagacacatatacatgatctctacaagatagctgcttactctgataaggcagtctttgaaaggtttatttgaaattaygtccaatagttaacaattattagataatatcccagaaatagtgactaagttggtgttatatttccttgactttttcttttaaatgcatataggttatcgctacaattaccccaagctatgattgatggattcttccctaagtatggtgatcaaaataaaataatttagagcacacctagtaaaaggactaaatttctcacttctcacttctaagtaatatttatgtaacaaaagtacttctcttatarttgagtatatccactaaatttttggtcaaattagagggtaatgatattgctgatttttctggagtgtaacaaggtttaaattgacataatgtggttagttcagtgccttgtacataattaggacttgaacatagcaaataaatggtgacgtttgtatttataaaaagaatcaccaattttatattgttttttctttactattcttaaaagttctgttaaaagatgtacacataaataactcagctacacataatgacaggctttatggataaatggatcattttatattattataagtcagatcgcaatgaatttaaaaaattaaaaaatgatgacgctggtatgcatcaattaacatacatttaccaaattttaaagttttatttcaaatgtgtttataaatggaaattgtacctataactgtttttaaattttggtttacattttgtgtatgggtttttttctattcctaccttgcatacacaatggtgggtcttagttttcacacaagttagattctagaaatccattcttaagttaggagttgagaacttaagttatagaagcaaaatgattgaaggtattctcttccataatctgctcaatccacattattatcaaaatagtggtgtgtataatgaaaaattacaaaatatagtacagcaagttctcactaatgttttcagcaagttcttggaaactgygactttagtggccctcaaataatgttgttttattcaacattgttttcttacaatgttgatgattttwaaaaaatkggtgtcatcatacattgtttcaattaaagtcacagtttccaagaactatggaagaatttaaataaggacttactgtactatagaaattaaacataaaggaataagaaatagatattcatgttcaaaactatgcctggaaaaaaaatcaagcttaattagtggacagaaaagtgaaaaacaacatttttttgaacattgtagagcaggctttctcagcatgtttgtaagcttgacatattgctgacactgatttttaagacaaattttatctcaaaatttattactttcttttttattgatattgatagattcttagcttaattctgtggattggtaataaagcrcagtcttcatttctgccattaattatataataatatgtgccattagttatgtatgtgtttcttcatttgtcaaatgcatattgggcttccaccaggtgccctggcacatgccaggcacttgaatagacattagtaattccagcaggaataagctgtagttcctgtactcagactagtaagaggagacagacatttaaactgataaattccattctacattccatartcttaaaagtgctataatagaagtatgaatggatgtaagtacaagggaggaagtggtcacctttgggtcactaagagcacagggatactmgtcatttataggtgccaggagatagtattaattcctatgaggagatacacgtctggagctgaaggctggggcagaatcttggaggacatttgtagcatgccaaaactttagaaggtttatcttataagtgacccagaaccattgaaaggtttggatcagggaaacactcttgcaggtatgtgagctttagttctttaatctgtaaaataaaggaggttaacctgatattttctgtccctttttgttccaaaattttgtgatttctcagtcacattgggtcattattcttttgaacagtaagggagaggggagagactgaatgagaaatttagatgtgttgactggttaagtcagctaccaggtaacattgtcaaccaaagaacacttcactgctatgtggagtagcctagaagtgaagagatgaagtaatgtgagtagttcattttcattcttttatttaaaacaactattttagaagaatctactctctgtgaaagagctcttattgagcttttggagtgtgatgatggtatttactttttattcacgcttggtagctttattaaaaataaagatgacaatgtgtctgtaaaattgatcatagtcctacctccaaatttgggcctagaatttgtggtttttagatgctgaagatagagtagtaaatgtgaaatacgtggtctctactagaatttatattcttcatgggggtgtgtaaaggtgaacaagcagtaatatgaatataaaataacattcatcattaggtctctacagagaagatagagttagcaaataaaaatacaaaaccttgatttacatttgaatttcagttaatgaataaattatgctaaaaacataataaaagtattttgcttggtaaccctaggtgttcataatttttcagatgggttaacaaaattaggtaattgtagacatgatttttaataaaattttctcctttattaaagaaaaaaattaattataaaaacaatgttcaaagccagagcatctttctttggtgatgtttcaatatttgaggttaagcctatgttataattatggcccttgttatctttttttttgtccactaagattactctataatatttccataattactcctctgtttacatgggagtgagaacgctccctgcattacccaggactttttgaaaactcagaaaaatcctttcagaaaatctgggcttatcactattcagaaatatattttgtaatatactttgaagcatagccgcattttgaagtattatttatggctgttagtttatacttacaatcttgctcattttataatgaaattcatttagtctttatattgttctctaaatggggattgacttggattctttactgattcatctaacgtcattaatgatttcccctttstgttctgaagcatcttattgaccttttcaagtgtggccataatgcttgtttctcattaatggttggatcttctatcagaaaacagtgatggacatagatctatatggttgatcctggtccaaacactaaagttttgtttgtaatttttaatggtttgtcccatgaagcgtagcttagacctcagcagtggagaccagtagagactttatttccttatatttacatttctagtccatacagtgtgaaaagaaccccacactaaaaggaggaaaccttgctaaattagattcatctgagaaaatctatgaactaatatacatttagtacatgattaatgagtaattaattgatatcaccttaaaagagtttaaaatctcacccgtaagactagcagatgtgcctcagggagtgctcacaaaagatgatgagaggaaagagaagtagtatggtagaagagtcagagtttcaaggaaagaaaatgaaaatattgccagacaaacagcacaaaatagtcaaataagatttttaaaaaatcaatggtttaactaaaagtgaagaaaagtttgattacccagtctggtagaagtaaaaatttatgttataggtgctgttaaaagaaaaaccggagcaaaactacattcagaagcgtttaattgagcaaagaacgatttacaaatcaggcagcctaccgaaccagagtaggctcagagactccagcgcagtcacatggtagaagatttatggacagaaaaaggaaaagtaaaacacagaaattggaagtttggtacagaaacagccagattggttgtaccttggcatttgccttatttgaacatgattctaacaacagttggccacatttatttagccaaaacttggtgattgacacaagaggaggctaccgtctgtttacaattccatttaggttttagttcacggtgtactgagaaacctttagsctgaacttgatttaacagtgttgaggggagattgtatggaactgtgaaataaaagcaatgtaggatgtttgaaataaaagagagtacataaatgttaaacaatgatttgtttaaacttttgcagtaggtgcaatagctttctttggttaaaaatagatggcaaggccaggtgtggtggctcgcaccataatcccagcactttgggaggccagggtggctggatcacctgaggtcaggagttcaagaccaacttgggcaacacagtgaaaccccgtctctactaaaaatacaagttagccaggcatggtgccaggcacctgtaatcccagctactcaggaggctgaggcgagagaatcacttgaacccaggaggtggagatcacagggagccgagatcacaccactgcactctagcctgggcaacaagagtgaaactctatctcaaaaaaaaaaaaaaaaaaaaaagaaaaagtaaaaagacagcaacaatcaaatgagtataaacaaccaaaagagttgttataactgtgtgttctatagcaagtctaaaagaaacagcaggcaagctttggaaatataggatatacatattctaatagagagaaataagggtattaccgtaacaaatattttgaaatacggagagagtagataaaagaagtaacatcacgtggctgatgtcttctgataacttctgcttttgagaaaataaaagtgggattttggctgttggaggagaaggattagatataggcctattggagaattcatcagaaaagcaatacaaaagtgaataaaggaataccaattgctaatgaaactctggttgaaattagatgtcgaaatttacagcagggcagttcttctgccttttgccagtaacattaacaccaaccgaaaaaggtggtaggaaagattcaggatcaactattagcaacccagcaaacattgggaatgatgatggtgataagagagggaaaaaaatccttaggaaggcagacagttagtgaaggtaataatgatgcaactaaactgaatatttgtctgggtagtgagtaaagaacagtcagaattaagctagataagtaaggatatatagatatttatgtggataaagtagaaatgtattaggtaatgagaatgggattaaaatcacataagtttatagattttggagatggagaaatactgagtgataagtgctgttatgaagtcaggcagtgtagtaagcaagctaaagaaactgagtttcagggtgtcacatgggtcggcaacactggtttcatggtgtcagtaacaatggataataagaaaaatactaatctaaatgctggggtcatgagaagataggctgatttggatttcttaaatcattatttgtaggtgaaatgttttctacaaagtgcaacytaaagcaatttgccttatagcaaaatattgcctaagctttagctattaaattatattttatatgctgggtaatgtttaatacaaccagatttcagtaaaatgctataaccacagggatgtgattcatatgcatgtttcagaaataggaggattgaacagaaatataaaaggactgcccgtggtcataaattagaaattacatcaaggaaattttatcggatacattcgcagtgcaattctgaagagaagtccagtcattgtgacactctcatccatattttatactgaacttcatcatagaacttaagtcatcattccaaaactggctagttcagtatttattcaaaccgcttcagtacatttagtagctccagtcctatctcaaaatgtccagaacccttgcaagaactggcggtcaggtaatcactacaggttattttacttttgttcatgcttcagaaactgttcattctgttgaccttggtggtcttttttcttctaattgtattcttgcctttctgccatttctcactggagtttatatgaaacactgttcccctggtgcttaagccttcccttccctctcctcccctcccctcccttcccttcccttcccttcccttctctcctcttctccatgaaaccactttcaggcgatttcttggaaacaacccaggcctgattctcttcaagacaatatatgagtgtgtgtgtgtatgtgtgcgtgtgtatgcgtgcatacatacatgtgtgtacatacatgtgcttctttgtcacttaaaatttgtagaaaggtgtttaaaatcaatcaataatatgccatttatctgaacgctacttcctgttcatttgatgcccataggaatttagttaaaaagataactattggctgggcgcggtggctcacacctgtaatcccagcacttcgggagaccaaggtgggcagatcatgaggtcaggagatcgagaccatcccagccaacacagtgaaaccccatctctaaataaaaaaaaaaaaaaaaaaaaaaaaaaaatatatatatatatatatatatatatatatatatatatattatatagccaggcgtggtggcacacgcctgtaatcccagctaatcaggaggctgaggcaggagaatcacttgaacccgggaggcgaaggttgcagtgagccgagatcaccccattgcactccagccgggacggcagagcaagacttcgccttaaaaacaaaaaaacaaacaaacaaacaaacaaactatttggtctgaagtgtagtgagataatatgtctgatagtttttatgtcataaaatgaacgtaggataaaatgtaaagaccatacatacatagcactgaagttttgttgttcttttttttttgcttgttaaaatgtgtgttagtatgacactttaaagaatatacacaaatgcattccctttgtgtgcttaaaaacaaacaaacaaaaacacaagagtcaactaccagaaaggaagtatattaatttgggcagctggtatttcgtgagagtaggttgaaaacaatgtactatgttatattataatgcttttaatacagtcaatctttgaaattttttatgtaaaaccattgatgtttccactagctctatgctaactgatttagtaagagcacctaggatcacctttgaatccagcctcctccgagaaggtaagccaaggatctagtgccaatttagaaattcaggctggaaaacaaagtagggagtcatgttagcatcaaggaacattattcccgtgatggaaacaactcttcagcaaaaaaggaaaacttgtcttgggcaggataaaaggcagatttgattttcaagtgctggctactcacacttattcctaaagcagttgaaaaactactctatcatcttaattatctagaagtccagctgaatgaaaacatatttcttcaaaaccttcaaaaggaagaataagatccagcaatattatgtgttctcactaaaatgatgaagacaatgcaataatcatgaagttacaatgttcgctcataggacttttggaaaatatattacataaagtacattgtatataattatatatgctatacatttttggatagataatttttatttggctgaggaggtttctctttgtttcatatttgctaagtctttaattattaatgaaygtagaatttaattgaaaactattgggaagatgtgtttttctttataaatatggtaaattttttatagattatctgatgttaaataatcttgtatttctgagatcattattattattcacagtctagcagattcaatttgctagtagcattttatttaatatttctgctgtgtacctaagtgatactcatctatgtttttattttcttgttttcttcttgtctggttttgctacaaggactacaccrattcaccaaattaatcaggtagattcctcttataattaatcttccatgaaagaatttgcaaaactaagggttgtccttccgatagtttcagatgacagattatatgcagattaaacttggctctttcttcagatctcattaaaaacgctttgaaaaaatatatcaacacaagagaatagaattaaggaaaaaagctttccttggatgagagatgtcaatacaatttggaatattgaaaaaatgtttgagcaatccccacacagagagaaataaactgaaatttaattgtctttacacagggaaacaaaaagggagatagtaaaatttgctttctcaatcctcagaagaatcagatgtacagttagtctctatctgaggaacaaaagatgaagcctttattttcaaccctatttttctcctcctacaaaaaatgagtcacttactaatgatttttattcacctttgcctccttagagttattttcctgtatatttctctcgtatgttacttcttcctatcatctctgaattgaaatttttattttttcaagttggtaagcataggtctttctgtatcaccttaagcctggaggcttacatgaagctggtgtttgtcttaggaagaacagcgcaccataaaacagckggccyttactagtcttgcttttatttccataatccctggacctcaaatgaaactaaaattctttgtgacatgtttttgagaatttctacttaaggacattcttcttggctttcactggcctcttggtctctaggaagacagaaatctgatatcttgtccacatattgatttatattactaattaatgggaacattttatacattaatagagtatactttttttgcaggtgattattcttgttggataaatgaaggtataattgaataattagaggttagttatgataaagttatgtgatagagttatgtgtttgtctaggtttatgagatcaaagtagctgatcatttcttttgcatgtatgaacctggagagcaacgtggatagatrgatgatagatagatagatagatagatagatagatagatagatagatagagatttggattgagttcttaaacgcatttgttttatacatcagagtttgtaaaacagtaacctatgggttgagtataactcataaacagatctctttttagtctacactctgttttgtttttttgataagccaatatttagaaattctcttttatgtaaaaaaactctagagatccagtttgtaggtgattattctcactgggaaaatgaaggtatagtctttttgaaaaattggaaagtcaggtgacatagaccaatatccttgcatggtagtagtttcctagagctgggtagcagcatgctgtcttatgttcttcacactttccacactcctcatgatcactggatatgtgttagctgtaatttgtcctgcctaacataccaggttcaattcatgagcctgctctgatttactcagcttcatctgtctactgggcccccattcactagctcatggaggatcctggttgctggtgtcaccactgcagctgaatctacctcagattctaacacttctgtgtgtcttggctgctactggggtgagtaatgggcttcctggtatggcctccattgctccgttctgcctgccaggagccataatagctctggccatcaacctagtcagatttaaagaggctctccattctattcttactttactcatgtaaagtgtccttcaacaggacatgagatttggttttctcagaagccacctaaggggccaggtgatgtaacctgaaagtgagrgagttagttcctgagttaatcctaatgtgaatcagtaagggagggaagaagacatctagagttagcaaataaattccattcctttacttcctctgatatacagaggcatggagtttctggttggcttccctaaagacgtgatgtcctctatggccaagcaaccagttgggtcttttcctgaagttgtggccagataaaccttgactttgcctcactttttatgcctctctttcctttccctgtgcttgctggttcgggattgcagctctaaataaagtattagcacgtaagctttgtctaagattcttttctagggaaaatcagcttggattcctacttttctcattaatgttatcttgctagactttatagatttccaaatgtttaacctttgctttatattctcttaaactttctttcactattttttgtcattttacaatacactctgtatatctttccaatttggaatcttattataaaccccattcttttaataactacatagaatttttatgtaaacattatattattttcttttaataatttcctcgtttgaagcatttagaattcttctgatatgmatattcttgctaagaacatccaattgctttgtgtgtgtatgtgtgtgtagctaagaaacaattatagatckatatttttacacacaaatggcagttctttaaaatattaatttatagttcactactgtggcaatggctaacatgtgttcacccagcaggatgttgctttttcagaatctgttaacattctgtatatatgttcctcttaccataaaaatagaacttgtgcccaaggcaacatatgcaataaaaattagtggagatattgataatgctccattaatctcattctaccttaagcagcatagagacttactcctgttgacagctttccattgcaataaaggaaagattgaaataaaatgcattcaaagacttgcccaagtttgctctctcatgtggaaactcctggaccatctggtctgcttctgttgcagcacctggtttattattggtattgaataaatgtcactacactgctaactgagacagggctattatgtacgtatctccaaaaactatttgatcataacaatacaaatgaattagtctgcaataatattcattttaatattatttacattatccatgatatcagagagtactcataatcttagctaaatgtaaatattgcctttttaatctttcctttcctatttatttcacactggtggtatatcatatagcagctgtaagattgcattttagatagttctgattgatgagaaagtctcaatgaacctcttttcagtagtgttatatatagagaaaataaagggtcatctttttttaaacaaaaaagatacagggaagctcttgatctgttctctaaatcccagtgatatctagttgcagtgacatctgtaggctccatttatcagtggccaatatgatcaagctccttttagttttattagatattccatctaaactaaacatgtatatgcccaagtctacctaaattatttaatgtcattttgaaagtatgcatgcagatacagcatgaagtgaggcatcctcggttgtacttcatacagcaaattaagttatttttatgcctagaacaaagttcattcctttgcattgattgcataacataaaatatactgagggattctcttcacctttgtggtggggaaaaggcaggatagagcctgattttcaacataaatgtatttaacctggttcttccagtgctggtctagaaaaactaggcttcagctggtgaataatgaggtgctgtgaggacccatgtctcatggaccactgtatgaggacagagaatagaatgtatgtacaccataaatctgagaaaaaagacacagtcgatattgtccttttccatatgtctgttttaaattcttgtaatgtgtaaatttcactcaatggtaagtttgtttagtttttatttatttaattattttttgagatggagtctctctctctgtcaccaggctggagtatagtggcatgatctcggctcactgcaacctccacctccagtgttcaagcgattctcatgcctcagcctcccaagtagctaggattacaggtgcctgccaccatgcatggctaatttttgtatttttagtagagacgggcttttgccatgttggccaggctggttttgaactcctgacctcaggtgatctggctgcctcggccgcccaaagtgctgggattacacctgtaagccaccacacccagcctgtttctatttgaaatctatccatttgggcacagcaaatgtttagtgagaaatgtaggcataattattttactgaaatattttacaaagaaaaatgtgctacttttgtgctatttttgtgctgttttaaaaagtgtctcccaggtcattcatgtggcccaaatctgtggcctcttaatgcattgctcataccttgaaactgttctctgcatttagatgatcaagttttgaaaatctctctggctgttccataagcatactgtttccagaatatgctatgtttaaatttacatcatttttttctttctctctgaaagaagacataatgggttatattataattatattcacagactatccaagtgctatttggctgtgtatggacaatatattcttgagtttaaaaacttagccttgcagcacttctgtgcccgtaattcttattgatttcaatgagtattatgcactcacaagagctatgagatggattattagcaaacagagtatagcccaggatatgttgccatgctttttagaaagaaatctgctatgtgttgtgctttcatactaggaagtatgaaataaagccaagcaacaggaataaagataactgaatggattactaataggtaattattttgggaagcctctataaggttcacatctatactgtgctatattgtctaaaaatgatattagacaaaattgcttattttaagtgataatttctgaggtgaaaattcttttagagtctgtagttcagcattgggtctgagctttgctgattatatatggcttcttctcctttagctgtcatttcaactttcactatagctgctagtgaccactggttgctaaatccaatgcataattttcagtatttgccttgcttgatctttccttaggccctccatccctgttgaaacagactatccacttgctccacaacaccacagtcttatggtttttgtcccagcaattgtatttattgtcggactcctttgcagcagcatacttctctggccaggatctttctctgaccagaaaaaacctgaaggtttactctctgattgaaattgtacttggtttgtgtgattatttgattaattgtatctcttctactagacattggtttcttgagaataaatatcatagtttattctcagtccctcttttcattgtaccttctcccaatagaccttgtaaatggctttcgtgaatgctgataaacagggactcacaactttgttttttctaagtaaatacttttctgacttatttacaaactctattttccaaaattattaaggccctacatgtcagacgttatcctatatactgggaataaaataggtgacataaacatatggtccctgttctcagggaacaaatgtctggtggaggagatacaattaatcaagtagtcacacaaaccaagcataatttcaatcaggattaacaattttaagtaaatagaacttaagtgtaaggcaaaatatatgcaaagaaatttatttataccaagctggggaaatgtaaaaaaatgttttgggaaaggggtaaagaaattgcaaacatcataaagtagaagaaagagtgttatccttgaataaataaaggcaggctggtttggctggagtttaaagcacagggtagtgaaactagaaatgggagcaaaggtcagaccatccaaggtttttgtaacacatgttaagcactcaagtacttatcttaaaagtacaggaaaaataatttttaatttatacatatgcttgcttattctctataacttctgagaccattatgaacttgtggagttcacttatcagcttctttcttaccaaattaaaatgacgggaatatcaacacagattaaaactttggagtgatttttctcaaggctcttcttattctgtagcactcaaatatttgctgaatgtgcacatatttgcacaaaacacatttctttgttgtaaagtgttttctatgtgcactcaacctatagaaaatatttaattcttgggagtaaatttgtatgcatgtatgtgtagggtgtagttctgctggcgggggagtgtgtgaaggtattgctagaaggaagagccatctcagaattttaccactctggggtttttactgttcagatctatcttggtttgttttgtggtctataacagaataccaaagactgtaatttataaagaaataaaatttatttctcagagttctggaggctggaaaatctaatatcaagaggctgtcatctggtgaaggcctttttgatgtgtcatctcatggcagaaggcaacagagtggatggccaggggactgaaactcacttaggataaacccattcccacaagaaagaacccactcctgtgataatgacattaattcattcatgagggcagagccctcaagacctaatcacctcttaaaggtcctacctctcaacactgttgcattggggattaattttccaaaacatgaactttgggagaaacattgaaaccatagcaagggccattatggatagtctgtccccaaagaagagtcattttcaatagccagaaaatgagccatagatccatgatcatgaaagaatgtctcagaatctgagtgtctaggctaagtcaggaatagagatatacatgggtgctacaggagtttttttttttttttcaagtcatacagttcacattgaaatacaaatgtgggcagtgccaatctttgaacagcactgcacagcagaggctgctagtaatgacggaagtacacctatgggactgtagaaaacagattttaaagtttctgcatgattaggcctttttgaagaaagaaacctggtaattgggttaaaggaatcaccttggaagttaaaggatggtaagatagtgacaggctattctggagagattcacctccctgaggtatgtgtttacattacatggagggatgaaacacaggaccatggagacattttaagggttgtaaatccagaaggattgtcttattttattcctggagacccttatttctgttccaaagtgttaagaagccaagaacctagaatctctcttctcaagagaatttatttatcctacagagcaaaggtttttctacctttctcaaaaatatgtatataagttcttagatttagaacctctgggtccttctttgttagtgtcaaaatgctcttttgaatgtaaagtcctgtccacctgcctyttgtcacatcacactagaaagtataatattctgacttgatccagaaatctcactttttgcattcaatataacatgaataattctggattaatgatcatcttcctcaggcatacaattcccagcagtcttgtgggatatactttctgaaggtcatccgctagggggtcattgctatttacactcaagctatgaaagtggagggtcctggtccttcagaaaggtaggcaacatcttttgggaaggtgaacttgatttattcactcaattctttttcttttgaaccactgagagacaatgatgggccagttacttgagtgtgttatcctgctcagaatcaaatcctgtgtaagaggttacaggatgagaagacgtagaaagatgaggagaggtagaatgctacaaacgaaacatgcataagggacaaggaaagacagaacagattcaaactcacattttgctgacttgcatataggcaaatgactcctcaaagatttcttatgaaccatgtccaggagacattaactgagtagtggtttgtgaggaaagcataattaatctactaaatagattaattatctagtccactcagaccataaggcttccagactgatgtcaatggcactctatatctcagagtagcagagcattctcaggtctaaaagactactcttccaacagacacacactttcgtttccatcagttgaattatatgtcaactaagattcaayactgttcccctggatgaagaattcttgtttgacaggtttgtttttatttctctgccccaggactttgaccttgtcatctcattgtattcctgcctctatggtttttgatgagaaattgcctattactgttattgaagatccttcatatatgataaatcacttctttgctactgatttcaagattctttctttgttttggctttcaacagtttgattacaatgtgttactgtgtgtctttttaaatttatcttaactggaagttgttgagcttcttggctctgtagtttcacatgtttcttcaaatttggaaagtctttggccagtatatctttaaaaattattttcctttttctctttctcctctctttgtgggactgccattttaagtatattggtgcactctattcagaaaaaaataggccataaaaatgaaaggaaaatttaagacaataccagataaaaaattagagaattactcatttgtagaccttgtcataaaaatattaaaggaagttctgtgggctgaaaaggaaagaatacttggcagtaacacaaattcatatggaaaataaaggtaacatatacctaaatataaaaatacagtataaatttatttttacttgtaattatttttcctactatgtaatttaaaagaaaaatgaagaaacaatatatatatatgtgtgtgtgtatatatatatgtatatgtgtgtgtatgtgtgtatatatatatatatataaatctatagtaactaaaacagtatggtactggcttgaaaacaggaacatagagcaacagaacataatagaaagcccagaaataaaactaagcatatgtagccaactcattttcaacagtggagccaagaagacacaatggggaaataaatggtgtttggaaaactgaatatccatatgcaaaagaatgaaattggactcatactatacacaaaatcaactcaaaataaattaaagacccaaacataagacctgaaactgaaaaactcctagagaaaagaggaaatgctccttgacattggtcttaacaatgtttttttttttttttttgatagaactccaaaagtgtaggcaagagaagcaaacaagtgggagtaaatcaaactaaaaagcttctgcacagcaaatagtcaacaaaatgtaaaagcagcatacggattaggagaaaatatttgtgaaccatatatctaattgggtgttagtatccaatatatatgggaattatccaacttgatagcaataaaaatgaaaaacctaatttaaaaagtgagcaaaggacttgaatagacatttctccaaagatgtaaaatggctagtaggtatatgaaaaggtgctcaagatcactaatgatcagggaaatgcaagtcaacaccacaacgagatattatctcacacttgttaggatggcccttataaaaatatcaagagataagtgttggtgaggatgtggagaaaagggaamcctgatatactcttggtgggaatttagattaatgtagccattgtggaaaacagtatagctgttccttaagaaactaaaaatagaactacaatatgaccgagcaatctgggagtcattacttcataatgatacctacactctcctgcttattgcagcattatttacaatagccatgatatggaagcaaagtattgttacccattggataagtgggaaaataaattgtggcacacacacacacacacacacacacacacacacacagagaccccccctccccccacacacacacagaaaatggaatattattcagcttttaaaaataagaaaatcacctagagcacattatgctaagtgaaataagccaaatgcaaaaagacaaatatcacctgatctcacttatatatggaatcttaaaaaaaaaaacaagaaagactacaaagaaacagagtagtatggtggttaccaggggtgagggtggggaaatgggaagatgcaggtcaaagggtacaaaattgcaatgatgcaggataaataagtctaggaatcaaatgtacaacatgaggactatagatagttaataaaaggtaagtatgctagtacacttgatggtatcttttaggtttctggggcactctgttcattttcctttattctttttacttctgttgtcaggttaaataacctcaattgatctgtcttcatgtttgckgattcttttttctctccatttaaatctggtttggggcacctctagttaattttcaagcttagtgatagtatttctcaactccaaaatttctagttggtgattttctatattttctgtctctttatttctaagtctttgttttgtgagacttacttccataattttctttgaacatattcaaaattgcttaaagtctttrtttagtaagtccaatgtatgagcttccttagggacagtttctattcactgctttttttctccctgtgaatggccctttatttgtttttctcataattccttattgaaaactagacatcttaaataatataatttgctaactctctctgcctccttttcctatgattggtttttgttgttgctgttgctgttgtttatttgtttaatgactttcctgaattagttctgtaaaattagcattctttttatgggtggacactaaactttcttattggttaacttattagttagctaaaaaattgatagagattttcttacaggctggaaccaataagtctcccagcttttgctgaggagctcagggtgcacgttgtggtacaccttcaattcccagtcaggctgcttgcaacaccactttaggcctcacttcctgcttgcacagaagctcaacatcatctagagatgacagcatgacagcatagggccttctctagtttttcttgggcatacacaaacttgtaagcgttaagtgtggcattctagattcccaggattatcacagaacttttctaatccacctatgaataactcattcctagcttttccttttttgtggttgccttgttgttttttcctaactgctgtcaccagttcagctaaccacaatatttaacaattgctgctaattctttgtagtaactgcctacagggaaacagctttctgcactggataagctctgacttagctcaagtaacaagttttgcacgtgggattttccagggaacaagccaaatatttttgcacataggattttccagaagcaagtcaaataatgacagttgcttgggaattagattttggaggagctctaaatctattctgctccctccaggcattgctacacttctggtttttactatgatcgttgaactgctggttttcaaggcaatcacaggcttggagagagggagacaatattggggcaagttaaaacatcacaaaacttcatgttttaccaagattcagcgattatttttctaataaacattacctatataattgaaaccttttgcttaatctccagagtcctaaaaaagttgaagttcaccttttttttgcagtgttcttgttgcttttatggagaagaagatttttggaagtaatattgggattactgctgcccacaacgacaccaaattcttgatagtcttcattgatgtttaacattgtttgcacaagtagttaataacaaatgtcctgaatgccttttcttgactggataaaaccataaaaccagtcttgacaataacctgagttcagataattttatttctttaaattatatttcagagtgagaattctttaaatctcttattaacatatgaaatgttgatatatcttatgataatgcagatgaatttctaatttaattcagttggaattatcaatgtgaagcatcaagtatttaagaaaatgatgaagattttctttaagcatacacattttaagcatacttatcttcttaatctctccttaagacttaaattataacactgacatcactagtgaatttttccaaagttgaatttttactttaaaattgtaagctttccaacacacactcatctctctctctctatctctcacacacacacacacacacacactcacattttattttgtttttaattgacacataataactgtacatatttggtacagtgtgatgttttggtacctatatacattgtgtaatgatcaaatcagtgtaattagcatatccattgcctcaaacacttgtcagttctctatgatgagaacattcaaaatctctcttctagctattttgaaatacacattagttcagactatagttaccttactgtgcagttaaacactagaacttattcctcctaactataactttgtaycyattgaacatatatatttttatatgtgtgtatgtgtgtacatatccgtgtatatatatgtgtatgtgtatatatatatagagagagagwgtgtgtgatgagagagagatgtttgtgtatacatatatataagtatacatattcacattgacaatatactttatttgggttcttatctaaatattagataagacattttaaaaaatccacaactacccttcaaaaaaatctgtaaagtattacccatatataatttttactttttggcttgtaaacttcagacaaactttttttaattaaataatacattgagacactcaattttgatcatttctgtaaagctgaaaacctacaggaacctgggactttggaattcattagattcactaatgtggtaacattttagacaaattttgcgtaggagagcaagcttctctgtgaataaaatacattactgaaatcttgatattttcagacagattcctgatgtaaagttttatgtctttctgtcatttttsgtgcagtattattatatagatttttttcaaatgcattgttttcatgaattcatttataacttttaatagctcatttcaatattttgttacttatggaggtacaaataatgctctttgaagcatttttaaaaggtatcctaactattaagtgggggtaaggttatatctgaataatcttcagaacttttatttaatattgctctagattactgttgtctctggtatttaccatcctccaactctatctactaattgtgttattcaaaagtgatgtttttctctatttatttaccgaaattgttattgctattgtaaataaaaacctcattgtttagtacattgtttctaacttagtaatcaactaatttagaagattcagtaggaaagataggagaggtcttatatgttatacccagtcaatagctatgctagtggtgagtgctatgcacacagttgcatgggacatgacaataattacttcatttagaaagtttagagcaaggccgtacaaaaatactcttccagtgaatattcaacaacagtctaattcatgkcataacagtgttgttctgcacatcagatttctctgaatacaaatattaaaagtaaagagataaataaaggtgtatctggtgaacactacccataataatacttatgtagttaggacaaaatgcattagtaggaataaagagtatgaatgaagagagtcaatacataatgataagaggtttgatttgacaggatgatataacaattttatatctgtactgataagcacaacattggctaaaagtatacaaaggaaatacrgaattaaaagattaagcattgtcacgttgttccaatgagaacagtctgaaataatagagtccaggaaaagactttcatatctatggaaacgtgatttatagtatagagttaacgttgcaaaacaatgacgaaagatagacttcttaataaatgatgctgaaaaaaattggttatttgtataataaagggatttatctctttcttagaactgtacaacagtagattctagattatttaacatttttaggttataatatggaacaatacctatattacctcagaggcagagaaagttttactaaacaaaatataaaattgtataccataaaaataaaatttaggtaagtttaactacattaaagttaaaattttctctttttttgtttttgagacagagtcttgctctgccrcccaagctggagatcagtggtgcaatcttggctcactgcaacctctgcctcccaggttcaagtgattttcctgcctcagcctcctgagtagctgggattacaggcgcccacccccgcgcccagctaatttttgtattttttaatagagacagggttttgccatgttagccaggctggtttcgaactcctgacctcaggtgatctgcccaacacaaagtgttgggattacaggcgtgagccgtaaaattttcttttataaaaacctcatacacaaaatacaagttataaagtgagaagatatttgcaacatataattgataaagaggtagtatctagaatatattaaaaaaacaccttcaattcaataaggtaaaaagacaagcaaactgagaggaggattggaaaaagccaaaaaattgaataggcttttcatagaagatgaaacacaaatggcaatcaatgataaaaagataattggtatataattggtatcaataaaacccacaaaagattccttttactactaaccaaaaagaaaaaaagtcacaatgtcaagtgtttaccaactatgtcaaaaataaatcaacatttaggtaaaaactctcgaaaactgctgcatttgtaaatcaagaaatatgtacaaaaacattcatagaaacattactgagaaaagccaaagtgttaaccccaacccaatgcccattggcatagtataggttaatttttattgatttgtataattgaatagtccatagcacttaaaaagtggaaattgataagctacacttatattcagcagtatccataaatctcagaaaaaatattaaatgtaaaaacaaggctccaaatgatatattcaatttaattccattatacaaagttataccttcacgataggttggattttattgattgaggtaagagaaatgcatatctcatacagagaaggcaatgaataaaaggagacagaagttatatacatatatacaatatgggaacacatgggcatggtgtgtccactgaactttatttacaataaaactttatttacaaaagagatagagagccagatttggcccttggcttatgtctgtccaaatcctgtgctagggcatggactgtctaaaggtttgttctgtgctgtttttcttcctgtgagtagtttttctccagttgatatagtagccattttgtgattttggaatataaatcccctttcttgatggatttcttccctcctctccgaggaaatgtgtgaaaagtcctctgtgatagtgaacactctgctgggtgaggcctctggagccagactcccgagtgagagtccatttcatcacagtgtggtttaaagaaaacgcacatttaatgttacgttcaccttcacgattttgactcagggtaagtttgacacataatagagtaagtaataaataaatttaaattattatagaccatggtttcagtcttgtgactgactttgttgttcacgaggatggacattttgctttcattttaggatcttaaattatttcttttaaaaaaaaatcatctttttttggcattaagatcctgggagtttggccatgttgttaaaaagtagacagattgagtggaaaaagaaaattccacacattggaatgccgtattttgaagtacatgggtcttggcataatcagtcttaggaaccacatgagatgttcttatttagaaataaatgtatccggccrggcgcggtggctcacgcctgtaatcccagcactttgggaggccgaggcgggcggatcacgagatcaggagatcgagaccatcctggctaacatggtgaaaccccgtctctactaaaaatattaaaaaatagctaggcgtggtggcgggcgcctgtagtcccagctacttgggaggctgaggcaggagaatggcgtgaacccgggaggcggagctcgcagtgagccaagatcgcgccactgcactccagcctgggcgatagagcgagactccgtctcaaaaaaaaaaaaaaaaagaaatgtatccacaagcaaatgtatgagcattcttaccttaaattggagatcattcatgactttgaggctcccatacttgattgtaagagattatatttacaaattacaaataaatgggaccccataaaatcaaggattaagtatggaatgggaattgttttattatttggcctgtgttttacaaatacttgttaggatatcaacaatacagattattggtttgtggattatcataggacatttttacacaacattagcaattgcaaaattatctatatttccagtttgaacaatatgatatcatcctgttatttcaagcaataataataagcctaaggggaaagtaactggatacaacaataatgaaaacatgcctaatggtttggggatttttaaaatattatttatttaaatggctttaatgtaactgattagtatgtcaaagaactataatttggaggtagatttaatctcttcttaagcataccaactcaaaaaccaaataaataaaaataacaattgtaacactgaaatgtgaatattgtacacttgtctgatgaatttagcttagtaaatacttctcagggtgtgttcagtgtacttagccactgtgcaaataccatttgcaggtatgttaatgagctttttaataataatggggcttttacaaatataagctttcaggttagcactctggaaggaactgagggtgggagtgtgtagctttggacaaataactaaaaattatgccaagagaatgagcatcaaaggcctagcattacctgtcatttctattaacaaagaaagcaataataataatagagccccaaaagttattgtattatttgaaggtgaacaatgttatgtttttgtattttagagtttaagttctgaaactgtgttacattttatttaataactgacaattctgcaaattggcagcacaaatccaagtactgaagaaaattttatttcatggtttacattaagtagaaaatataaatgtgattgaactaaaagataatgaggagaaaacataaataagttaacacaacggttactttcttttaaatttagtgaaagtttatgaatataaatttctcattttgaagtccacataagtctaaatgactttttactttgcttttgtactcatagtgttttgagtcagcacacttacctctaagtgatccctgaatataaattttcttaccatcagtcaaatcctctttgcctttttatacttggactagaaatggtccatttggatgacctagtattttcatatggtctttaatttatgatcacaacttgtatttatgtaagtggccactagatggcagacctaccactaaacagaatttaggccggaagtaaattcttcaagtaatgaattacacagcagagtagtgtttcacttcaagcttagctcagattctcaggctaagcactctctattgttttagggaggcatgctaatgaagatgacgtaacatttttacattcacttaaggtttaatagtttacaagtttatgtaacttctcagaataatcttttcagactgataagcactgccatattgcggatgaaaacatgagtttcccagggcgtatggcaaaggttatttcttgtgaaaactgcaaggagacaactttgaagaattttgcttcagggctccagaatttaatgacattactttttgagatgtattctgggagaaattggttttgtatctgatatatattttctgcttatgccctctacctttatgtttccaaaagaagttcaatccctctaggagcccggagaatcaattagagctacaaaactcttccctcctcaatgatactgacctctgacatctttatgttctcttgccctttggattttggagcagaattatctttatccagcttcctaccatttcatcttttgtattcactaaaacctactgtcaccatcacttagattgcctcttgatttctgatgttcagcactgggctccagctcattttcggcttttgaaaataggccagcagttttctaaagaactaacagtgatcttttgcagaaattagaagtgtgtttatgtatctgtgtgcacacacacttccagccaagcaaagcgatatgaaatgattcctgatgctgcttttatctaattggcagcatacagccataatatgccgccattaggtcagcatctctagggttcagaactaacacttttaagttttaaaagcaaacttaattttttataaatttctaagatagaaaaaaagcaaagctggcacatctactattcaacccatactctttattcaaattacaagtttatactctagctataaaataccctgaccacaggataaaatttttcataatagacagatggtgaatttagaagttgcctctcatatatagaacattgtattgatgtgaacacaggaatgaaactgtatcttaaaaatattttagattacaagcatattatattttgtctttcttattaccacagcartataagtttcccgtagaaaaacttaaaaatttaaatgaaaaatggaaaaaaaatctcaaaaacctagaagagctttcctttgtgattgcctttatggagatcctttcagagcttgcaaattatttatttagccatttatctttaagtagatctatttattttgagataactatagatttataggcatttataagaaataatatggagagacccaacaataaataacaccttgcaaagcgatagtacagtattccaaccagggtgctgatattgatacaattaagatacaggcgattttcatcaccataaagattgctcctattgaccctttatagccacatatamttccctccaactcccaacccttcctcaaccagtgtcaaccattaaagtattctctctacaatttttcatacagtatatagcctttttggattgactttttttcactcaacgtaagtctggagattcatccagattcttgcatacgttagtaggttcgtttttttaattgctaagcgagattccatgatatggctatactgtagtctgtttaatcattcactcattaaagcatatcaggatgtcttccagtttggggctattatgaattaagctattataaacattaatatacaggtttttgtggtgaacatagcttttattttctctgggataaattcccagaaaggcaattgctgattatgtaatagttgcatggttagtttttgtaataaagtgccaaactcttttccagggtggttgtgtcattttacattccaattagccatgtatgagtgacacagtttctgtgtcatcactaacattgggtgttgtcattattatttattttagccattctgataggtatgtaatgatatttcatgtggctttaatttataacttcctaatggctaaagatggtgagcaaatttttgtgtgcttactattcatatattctcctataaattatctgctcatgtattttatccattttccaactggatttttttaatgttaagtgttgagaggtctttatgtattcttgatactagtcctttgttgatgttgtggtttttaaatatgtgctccaactctgtagcttgttttttgaatcctcttaacagagttcttcacagagtaatataatctaatttggatgaaatccagtttatcaatttttccttttatggtatatatttctgctgtcaagtttaagaactcttaaggggtgtgtgtgtatgtgtgtgtgtgtctgtgtatgtacctctctctttctatatctgtgtgtgtatatatatatatatatatatatatatatatatatatatatatacactttcaaggtttgtagttgtatgttgtacttaataaactatatccctatatatgtgtatacacatatatatgtgtctgtaatatatacacatacatatacactttcatttcaaggtttttaattgtatattttacttaagaaaaaaaatagaggaatgtatacctaatccatctctctagcagaagtcctgcaaatttgtttttattttacaaaagagaagctaatttatatttagtttttcaagtatgatgtcttcatgcataactggaaaagttgaaaaaaggattcaaaatcaggtaagagtttataaaataaaattgtaggatctttgcattaatatacccagtatcatatcattaaaaataaaaaatgttagctaggcataaacattacttcattgaaatatgcctgccttctggacatgataaatgttcatgaaaaaagaaaacaaaattatgaaaagaaatatgcctgccttaaactaaattttaccaataaccaaattgaatatagtttaaaaaagtaataatcaaaaatgtttcttatttracaaatagttggaatgtttacattatgcatagattttttarttacccatcgatgttctaaaggcactttttatcaaaatggcctacttctgactagattctgggtaaatcacagaatatttaaaacatgtatataggtacccagtagaaataattcatattcatataaaatgctcacttacgttttggtatgtttagtataaaataactgctactgtttgtaattagaacggtaaaattcttcagtctagggctgccaatatgttgcaaagctcatttttaaaaaatcattaacaaaatcgctttttatcgttcgtctagaattcaaaaagggagattatattggtctcttttttttcaaaattgtgatattttcttccctgaaaaaartagatccctccaaaaatgcagtgttgttcttgaaataaagaacaaaatttttaaaaatctggtgcatttagatgtatgtttctactcattttttggacctagtgaatcaaaactgattattttcttactttttatgaaaatatcttctctcatttttgcttctaaccttaaaatccaggaaatttggaaaattttatattgatttctttttcttcagtttatgtaaacagatttttaaatgtatatttgcatttcagtgaaaataaagaggtcaggaaaagcttaaaaatctttagagctttctggcacacttccccaaaacattcaggttttcagcagtaactggttagatttaggttgtgcgtgggtgcatgtttattctgcattgtgagtgttacacggatttaagcctttagagaattatgttaccgtctgatccctccttcgcttagttctctaagttcaagagttccttttaagtaagaacacttttttttttcccttaagaaactatttgcagtttcctaagacttcagtgatttaaaaatatttcacaatcatgaggtcagaacagggtttatgtaagcctctgccttagtctgtttgggctgctgtaacaaaatgccataaaccgtgtagcttataaacaacagaaatttatttctcacagttctgaaggctgggaagtccaaaatcaaggcatatttggtgtctagtgaggttctactttctggttcatagatgacacttcctggctgtgtccttacatggtagctagctctctggggcctcttttataagggcactaatccctcatgacctaatcaactctcaaagccctcaacttctaatactgtcatcttgtggggtaggattttaacatatgaattttagggggacacaaatattcctctgctttttgtgaatttttgtgaattttacatatatttaagacttttaaagaatagtaagttactatctgatctctccattgttcaattctctaagtttaatagttccttttatgtaagagcatcttttttcataagaaactatttgcagtttccaaagacttcagtaatttaaaaatatttcaaatacataaggtcagaacaggtttatgtaagcctccatttgcgtgtctaaatgatggttttcagaagcattatcctttctccttttctttactttcagaccatcaactgtcacattctcttaagaatctttttacttcttcatttaattgtataattatactctttcacaaatacatgtgcrcacacgtatgtgtgtgcacacatgcacacagacatcaactgaacttgttttaaagccrgtgctatggccacaatgaaagggctmtgcagatttctttacaattataatgattatcaccaattacgtttcctgaaatacagaaaataaaactgttcacattttatgattaatctccagctgactgtgatagaaaaattacctaattataaaagctgaatggaactccaaagaattcttgagcttatccctgtgttagactattgtagagttgtcagcgcagataattttgtaagcatgtttttcattgggtcagcatcagcataagtttaacccatgataattcttttgttatgaggcactttcataagaaatttctgaataatggcatttttgtggttctttaaataaatatggttaatgaatcctgagtgttagcatcagtctaaaggccagcacctggaagggaaattaatctgcagaaagattagctgacagtaaccatatagtctccattgtgactggtgagttaagcagaaaatcttgtccattgacaataccctcctctcaccaatagctggtgtttccaccaaatgtctcaagctcctacccttttgttatttgtgttaactgcctcaaaagcagtccttcaccctgactttttggaggtacccacaccactgtttacccagctctacctggtcagtgtttggtgatatccctgtcttttaaatgcatatccctacactgcatccactggtgttgactcgactctattttctctgaaatggtattttatagtaacggaagttgcacattctacttctatacctattctattcatagtctgtatctttcttattgtactctgcttattctattccctcagttgtagaagaaaagagatatatacactccttgcaagatctagaaggagcatggatatgagcaagtcagttaacctgtcatggctttagctgagggttgtgagtgtgtgtgtgtgtgcatgtgtgtgttgattctgtggggccgacatagcagttgccacatagggtcattgttggggcaaaataagatatcatgtagcttctaccccaaggaattgaaattggtatatgattagctcatggtgaaaatgaaatcttgtaccttctttctcaatatctgaggcaatgacacattgattatcatttacatatattttatctgacatggtgttctaggccaagcattactactgcttgtgtgtgtaactttaagcaaatcacttaaattcacgggttgaatttttcatttgttaaatgaaaatgtaacaaagttcatgctcctattggaaatgcattgaagaacaaaggagatagcatatgtgaatataccttttaatgtatgaagcactatataaatacatttgtccctcagtatacatgggggattggttccaggacccccatgtttaccaaaatctatgcacactcaagtcccacagttggctctgcagaacctgtatattcaaaaaattagccctccctatcgaatcctatcaggtttcacatcctgcaaatactctattttcgatccctgtttggttgaaaaaaagttgacatataagtggacccacatagttcaaacccatgttgttcaagggtcaactgtatgttaatttaattaaaatgataaaagtagaaatataattgtacataccttctttgaatgcctactatgtactagatgcagcgtcagtgttttgcacataatttaaatcttgataataatcatatataattgtatatatttaaaattttcagttatgtaaaaatgcacaataatattgtaaagaaatatattaaaaatttggtagtagttattgctaggtagagttattttctttgttatattttaccattttccaaactttttccaaaatgtctctaaataaaatatttgcatagtattatactaaataagagcctgggccttgggatcaggcttccttagactaaaattccaatccgcctttttctagctgtgtgagcttgggaaagttacttaactttgctatgcctcagtttctttacctaaacaatgatcagcatagcaatatgtcacaggactgtagtgggtactaaatgaagtaatgtattgaaagcatcagagtgcctagaacagagaaagaggctatttttttgagactagggacacggattttgaagtgagactgcctggctcctaatcttggcatcttcagcttaccagctgagcaagttacttaaaatctttgtacctcagtttctgcttcttgttgtatgcttataagagtacctggaacatagtaggtgctcaatagatgttgaatgcacaaataagttgtagctatgaatataaatatggttatttaaatattaaaataaaaaatatgtacctaaattctctgtgttccttagccctcccattaccacatttgctctctcaatgtactgcaacagtcttttttgattttttttgagatagggtctctgtctgttgcccatactggagtacagtgacatgatgatggctcactgcaccctctacctcccaggctcaagtgatcctcctgtctcagctttctgagtggctgaaaatagaaatgcataccaccatgcctggctaatttttttttaatgtagagatggagtctcattatcttgcccaggctggtctcaaactcctgggttcaagcaatcctcctaactctacctcccaaactgaaaaactcaatattctttgttaccacattaaatactaaatcttccatttaaatccttgttgatcacctagaacattcgatattgctagacatctcctcctccattgaactttcttgtcaattggcttttatatctgtgttgtttgctgggttttctcaaaatatctcatactctaccttttctttttctaccccttcttttgcctgaatgcaaacatagatgttttttaaggttccacaactcacttatcatggtaaatgttcaaatgtattattcttattcacttagtgaaacccttctaatagattaggatgtacatgaaaagatgtgctttttcataaaattccctttgcttctcctcaactctctcacaaccacctctgaatttccatagtcctttgtatattcccctttaaactccctctctcaggctccactgggtcagtgtatgcttttactgtcttcttaattgtgcattatttgagggctgtaaatttgttgtatctatctcggcatcacccaagacagctattataatgccttgttcaaattagatgccaagttgtttttattgttgttgtttgctcgtagatgtgtttgttttgaacaagtcatctaattaaaatgatgaaattttttgtagctcagggtttagatatgaatgtgaggacaagctagctgcaacacaggctccagggttcattcaactaatgggttaaggaccattttcttcttcactgtatatgaattcttctgaaggtgattgcttgataaaacaggtatttctttcctaaagaaataccatcaatttatcatagatgcaatgaatgaaaaattacctggaaattttctcgcaaataatggtcatcaaaatcaaaaaatcataacaaaatgtctgaaataaacaagaaaaataaatatatatacacacatacataaaataatatagataaaataaacaagaatgttaagtctaaaattaaaaacaaacaattacataggataatgtaaaacatattcaattattcaggttacaaaagttctataacttacaggcagagagttaattgagccaaatactaaattaagttttgtaattatacatttactgcaggaaaacaaaggctttgctaaactaatgaaaagatcattacataaatttgtgttttctatcaaatatagaaactctatatttttaatcatatctttcacaattatggtttaaaaaatagtgagtttcttgctgctctctcatttggtcatatacttaaactttcaggaagcatataacatcaatcatataaattagcttttcatctcataagggatacatgtaattcagggcaacaaaggacaagcaaagtactgtgaagaagagatcaaacaacgccagtgtattttatcaataagtgagcatacttgctctttgccacctgattttgttcctaattccattagcgaaattcatatgagatattagaggatgatatagatattgacactgataatagaagttaagtctgtaatatgaaaatgtttccagctgcccagcagcattgatgattttttttaattttttttgttccctcatgatttcatggtttaattgtactaagtatgtaattaaattttcaataaatccagggtctgccattcttcatcacaccacctgcaaaatcatggctccaagtttcagctaattccatcattagaaccagtactgctcgatttcttccatacttggctagtccaaacctggatgagcctaaccaaacaacagtttttctagaagctttgccaagcaggacatcataacgaacacatgcttaaggtccatagattgtgcacatttaatttatgtcattttttatattaaattttttttttttttgagatggagtcttgctctatcacccaggctggagtgcagtggcgcgatctctgctcactgcaacttccgcctcccagattcaagcaattctcctgcctcagcctcccaagtagctggggttacgggtgcccaccaccatgcctggctatttttttattttttagtagagatggtgtttcaccatctctggtgatccacccacctcagcctcccaaagtgctgggattacaggtgtgagccactgtgcccagcccaaagttaggatttttttttttaaataaaggctagcatagttagttttttgtttgctttttaaaattaagattagcctaatttacaaactttacaaggacttacacatattatggttccttattttctttcaggtcattgtgagatatttcttttttttggagatagagtcttcctctgtcrcccaggttggagtgcagtggctccatctcggctcactgcaatctctgcctctcaggttcaagtgattctcgygccttgtcctcccaagtagctgggattataggtgcctgccaccacacctgctaatttttgtatttttagtagagactaggtttcaccatgttggctggggtggtctcaaactcctgacttcaagtgatccacccacctcggcctcccaaagtgctgggattacaggcaagagccactgtgcccagccccttgttagatatttctttcagttttttcacacttgctgtttcatctgctagaaggctcttgccttcatatgttcctaactacatacccttcacttttacccagtaacttttttttttttttttgggtaaacattgctttctctgaagcatcttctctgatctatataactagactaagccttttatatgcagttttccctacttggtgccttttttcttcaaagccctatctcagtttgtgatattcrtttctttgcatattgtgtatatctctctttccaagtaaacactaagtctgtaaggattttatctgtttggatctgcattgtatctccattttttcaaaacattgcttggtgcatggttggtatcagcagacatttgttgaccaaatgtagtaatgttttattcaagaaaattctaaaagatcttgatatgtaaaacttcaaatttttcagaagcatgcaatctagtgttttattatttatgaatttgtggaaataaagttctagagaaattgccttcttgaatgccatatttctgttgttccaaagtctctgttgttcagagctattctaccatctaaaaaaaaaaaaaaaaaaaaaaaaagacaatgaggaggagaatgcaactggattctcatctctcaccttatacaaaaatcaactcaggatggatcaaggacttaaatctaagactgaaactataaaaattgtagaagataacatcagaaaaacccttctagacattggcttgggcaaagatttcatgaccaagaacccaaatacaaatgcaacaaaaacgaagataaataagtgggatttaactaaactaaggggcttttgcacagaaaaagaaatagtcagcagagtaaataaacaacccacagagtgggagaaaatcttcaccatctatacatctgacaaaggactaatatccaaaatctatggaactcaaacaaattagcaagaaaaaaccaaacaatcccatcaaaaagtgggctaaggacatgaatagaaaattcttaaaagaagatatacaaatggccaacaaacatataaaaaatgcacagcatcactaatgatcagggaaatgcaaatcaaaaccataatgcaataccatcttactcctgcaagaatggccattatcaaaaaataaacaaataatagattttggcatggatgcagtgaaaagggaacacttctacactgctggtgggaaggtaaacagtacaaccactatggaaaacagtgtggaggttccttaaagaactaaaagtagaactacaatttgatcccagcaatcccactgtaggtatctacccagaggaaaagaagccattacatgaaaaagatacttgcacacgcatgtttatagcattacaatattcataattgcaaaaatgtggaaccagcccaaatgcccatcaaccaacgagtggataaagaaactattatatacaatggaatactactcagccataaaaaggaatgaattaatggcattcagagcaacctggatgggactggagactattattctaagtgaagtaattcaggaatggaaaagcaagaattgtatgttcttactcaaaagtgggacctaagctctgaggatgcaaaggcataagaatgatacaatagactttggggacttgggggtaaagggaaggaagggagtgagggataaaagactacagattggcttcaatttgtactgttcaggtgatgggtgcaccaaaatctcacaaatcaccactaaagaacttatttatgtaacaacaacaacaacaaaaatagacaattaattggtacatgagaaggaatgcctggagcaacttaagaaagaatagatgactgttaggaggtgagggaaaagtaatttctaagcaattagactgtactttctatttggactataatctctagtgagggaagaaatcatatctttgaattctcagacccattatagcaactgaaatatagaagtcttcttttgtcaattattattcaacaaatatttattgacttttagctgccaattgctagtctagatattgattatatggtagagagcattagttctatgattttccagggacacaaatctacaaagactggagaataacaaaatgatattattgcagttactagtaagtactataatataaaaaagcaccagtaattggatagctgttgttggatgacaaggtgctagtttagatgagctgatcaaccaaagcttcattgaggtagtaatacttgcactgaggtctgaatagtgtgagagtccaacatgtgaaaatctaaaagaacattccgggcaaaggagagtatagctattactattctgaggttataatgagtttggcttgctcaatgaacagaaaaaaaccactgaacgatagtgtacagtaagccataggtgaaatataaaagatgaggttgaaaagttaggcaaaggccagactatgtgtatttttttaaaaaaaataataaatggataccttaactagatgagtggacggataattcagtggcctactagaaacggtggcattgcctgcctatagctgtggctctcattatctttcaggatgtcacttcacaatatggtatggggagtttccatttgtgacacaatataagaactacaaagtaatagaagtattaaattccagtagaatagacagctcacagttatatattgttcatcaaaaataaaatgccaaaagctctttttaatgttgcatgagatcatgtccagccttaagcaaagtgactctggcacccataggaatgcacctcttagatctccaaccacaaggagggcaattggccaagagctccagctgtcatgctctgaaacccatgattgcatctatgctgaggctatgtctacatttcccatgggctgtgcttagccgatgactaggtgtatctgggatattaaggcaggccaatttctggacacacttgatgcctctggtggctacctgtgccttgggactcctcagtaacttcacttcattttcctcaaactgcacagcagtctaggaagtttgtacccaatcatcctttcttctctccttcactcaggttaataatttcatcatgatctgactgttctcttagccttttccagcttcctcctgattttaatcccatgagatgtctgcttctcagaggayatagattaacaaagtaataaagtagatcaacttgtttttgatgtctctttaaataactttctaccttgccaaaaattaaagtaaaataatattataaacattcttattttccatgattttgatttaacacaattattagtcaattaaagatcctacttctaagtaggaacttcaaaagacgttaaaatcttttaaaacgattcatttgtacttggtggtctattaagccccagtgatctctagggcagatacaaagacattgtaaatctcacaggaaacttaacgtttgctgtcacatttgtaaactatttagtttttctaactgcttcaattcttatagatttgaagtatattctttagtaatctaacatataattttttttctatttgcctccttttaaaataataattgttggcagaaaggtggaattacctgctttaaaagtagaacattttatcacacttaatctctcctcttttttacatacagcacagtgtcctatgtccctttctcttatttcatggtaccttttctttctgagaggcatatgtgactattttgtttgtgaaaggcatattgcatgttacaatacttcagtttttagaagcaaatgaaattccttcaagtctaaattgctctgccttactttccagtttcctttataaagtgacatcacctttttcttcacacctctccaacctcccattgtatctccaaagctccactcctcccaccaaactcaagcttcctgaaatgtcccttactgttacatgaactctatcgacacctgttcctgttttatgtatcctttaggacacattgaatatttttctttttctgccatcatactaactgatcacactaaccttcattcaccccttcaatttaatcctattttaattttttttgctgttataatagttaattatgtgattacttctctagttgtttcatgtttccatgttttgattatgcctcccacattgtcacatgagatgcaaacttcgaaaatatgttatgtaccacatagagatttggaaacagctgaactgagactagattctacctctgtgagttaccagttttttgctttttgtttttaaccatagataagctacttaatctttctgaaacttcttcttttttttttttttttttttgagacagactgtcactctgtcccccaggatggagtgcagtgcagtggtgcgatctcagctcggttcaaactctgcctcctgggttcaagcaattctcatgcttcagcctcccaggtagctgggattataggtgcccatcactatgccttgctaagtttttgtatttttagtagacaccggtttcaccattagtagagacaggtttcaccatgttggccaggctggtcttgaactcctgatctcttggactcctgatctcaggtgatccggccacctcagcctcccaaagtgctgggattataggtgtgagctatcacacttggcctctgtgaaacttttttcttaaaaaataatgcagttaccttcttgaaggttttgtttgaggttcaaatgagataatttctgtgaaagcatttttgaaaataaattttatggctgggtgcggtggctcacacctgtaatcccagcactttgggaggccgaagaggatggatcacaaggtcaggagttcaagaccaaggtggctaagatggtgaaaccccatctctactgaaaatacaaaaattagccaggtgtggtggcaggtgcctgtaatcccagctacttgggaggctgaggcagagaattgcttgaacctgggaggcaaaggttgcagtgagccaagattgcaccactgcgctccagcctgggagacagagcaagactccatctcaaaataataataataataaaataaataaataaattgtattgtgtatattgaaggtatacaaaatgatgacacatgcacatatataataagatggtaataatacttcactacagtgaagtaaatgaacatctatagtgccttctctttgtaaataaatactatatatttcaccatttttcctctatcctatatatgagcttttgagaagactggcattaggrctcattgggtttttagaaatgatgactaaccaacaccatataaatatttagcacatactattttcttttgttttttataatttcagcttttattttggattcagagggtacatatgcaggtttgttacctgggtatattgcataatgcaattttacttagagtaaaattgatgtatgattgatcccttcacccaggtagtgagtatggtgcccaataattagtttttcattccttgttcccctctcttcctccacccccttcactctagtggtccccagtgtctactgttgccatctttatatatggcatatgagctatagggtccccattctttagctgtatgaaacctattatttagctctcacttttaagtgacaacatgtgatatttggttttctgttcctgccttaattcacttaggatagcagcctccagttgcatccatgttgctgcaaagtacacgacgttattcttttttatggattcatagtactccatggtgtatatagcacatattattttcatttagggtattgtattctgtatttgatcttgactaatatgccaagtgtcagataggaacagaaattttccctttttcctttctttctttttttgaataataattagaaactactcccaaatataatgtgacctacagaagattcatttaaaaaacggcaaatcacatttgttcccctctaaaatgatacaatttcatgtaaatagaaccagtgttggaaggatgaatactgatttatgttttagtatcacaaatttgatcaattgatattattaggtaagaatctctcatgtttaaaatcactattctagaataaagacaaatttcacatagaacacaaccatatttttatgtattgtgtcaattgttctataattaaataacatttacagagattttctttctttttctagttcacgttgggattatttaacttaattctcagacagactctgtgttgttaatttggctcttattgctatgtgtctgaggggaagagggaaacatctaaaaaaaaaaaaaacagtgtccatatgtccaattccatgtggaaactggttagctgttcttggataccttcctattcctgaatcaatgattgtggccaggagaacaggacactttggcaatctatgacctatattcccaatagtgcaatacagagagaagagaagttgcccaaatgtacaaatgcaggacaaaaagcagaatatatctactacaataacttccactcaagaaattagaaaataatagttctcattaataggtatcttgatggtatttactatatacatcatatttgggtttttaattttaaaattaaaataaaatgtgattggcctgcaagttagaaaaaaatatttaatttttggttacagacaaattttatagtgccttccctgcccctacaataattactgatgtgtaaatagtaagcatctgagctatatgacattagcacgctctcaaacagtttttcaaagtcactagagtatgaaccctcttaaggaaaataatttttatgctttctcccatgttgcttttaattgttttcattacaatgttactcaaatatgtaccaacacaaaaatgacatagcaaacacttccatggtacttaccatgtctcaagctatttgaagatctttacacatataacacatttaatcccaataaaagccttctgacttgagtgctattattgcaccatagatcatatgaaaacattgaagatgaaagaggctaaataacttgaacatggtcatgcagctagtgattgtcagtctgggtctggaatccaagtttttaagcatcactgccaaaaaatataatctccttgtgcatatagcttatatataataatataactgaaacccagaagtaagaagtgaaatcaactgcaagaacaaaccagcaatcccaagaggacccagagaccctctgaaggaagcagactgctcctgcaaaacgtgggagacactgcaaatactgtgagtgtcctaactgaagaagtgggaaagggagaccctcctctctcaaacacgcacccccactggagaacctgaaggtctgtttgcaggagaaatttctgactttacctggagatgagtcaatttagagaaccaagagaaatacaggggtagagaaagcagcagaaaggccctgggagctcactgggtcccctagcagcctattccttcctggcaccacagagatccattgggagggtggccagaggagcagggggtaaaactccacagggaggaggaaatcactaacggaactttgtaaaaatttgaacagggtgagaagcctcctggccagaaatggggagagggtgcaaatcctgtgtgcagactccacaggagggggaataaccaagcccttttctttcatagctgaaaggcaggtagcctggggcaagttttcaagcccatctcgcccttcacctggaaacagacttggggctgttgcaggggtaccatgggagtgagaccagcccttcagtttatgtgggagctgggtgaggtctgtgactgccagctttccctcacttccctgacaacctgcatgactcaacagaggcagccgtaatcctcctaggtacacaactccagtgacctgggaatcttacccccaccccccacagcagctgcagcaagacccgcccaaggagagtatgagctcagacatgcctagccctgcccccacctgatggtccttccctactcaccctagtagtggaagacaaagggcatataaccttgggagttctagagccccaccactgtcagtccctctccatactactatacctgatgctctctggaaatggccacctcccagcaggaggccaaccagcacaaaaataaagcattaaatgaccaaagctaagaaccctcatggagtccatagcaccccccgacccagcacctccactggaagaggtgctggtatccacggctgagagaaccataggcagttcacatcacaggactctgtacagacaacctgcagtaccagcctgtagccgggtagactcgctgggtggctagacccagaagggagacaacagtcagtgcagtttggctcacaggaagccacaaccataggaaaagggggagaataactacatcaaaggaacattccttgggacaaaagaatctggtcaatagccttcagccctagaccctccccctgacagagcctacccagacgaaaaagacccagaaaagcaaccctggtaatatgacaaaacaaggctcttcaacatcccctcaaaaaatcacaatagttcaccagccatggatccaaaccaagaagaaatccttgatttacttgaaaaagaattcaggaggttagttattaaatgaatcagggaggcaccagagaaaggcaaagcccaatgcaaggatatccaaaacaagatacaagaagtgaagggagaaatattcaagaaaatagatagcttaaagaaaaaaaaaataaaaaattcaggaaactttagacacactttcggaaatgcagaatgctctgtaaagtctcatcaatagaattgaacaagtagaataaagaaattcagagctgaaagacaaggtctttgaattaacccaatccatcaaagacaaagaaaatagaataaaaaaatatgaacacagcctccaagaagtctgggattatgttaaacgaccaaacctaagaataatcagtgttcctgaggaagaagagaattccaaaaattcggaaaacatatttgggggaataattgaggaaaacttcccctgtgttgctrgagacctagacatccaaatacaagaagcacaaagaacacctgagaaattcatcgtaaaaagatcattgcctaggcacattgtcatcaggctatacaaagttaagatgaaagaaagactcttaagagctgtgagacagaagcaccagataacctataaaggaaaacctatcagattagcagcagatttttcagcagaaaccctacaagctagaaaggattggggccctatcttcagccttcttgaacaaaacaattatcagccaagaattttgtatccagcgaaactaagcatcatacatgaaggaaagatacagtcattttcagaaaaacaaatgctgagagaatttgccattacctagccaccactataagaatggctaaaaggagctctaagtcttgaaacaaatgctggaaacatatcaaaacagaacctctttaaaccataaatcacacaggacctataaaacaaaaacacaagtaaataacaaaagcaaaaccaaaaatccaaagtacacaagtaacaaaaagcatgatgaatgcaaaggtacctcacatttcaatactaacatttgaatgtaaatggcctaaatgctccacttaaaaaatacagaactgcagaatgcatgaggactcaccagccatctggggccttcaggagactcaccttacacataaggactcacataaacctaaagaaaaggtgtgggaaaaggcatttcatgcaaatggacatcaaaagcaagccagggtaactattcttatatcacacaaaacaaactttaaaacaacagcagttaaaagagacaaagagggacattatataatggtaaaaggccttgtccaacagaaaaatatcacaatcctaaacatatatgcacctaacattggagctcccaaatttataaaacaattactcatagacctaagaaatgagatagacagaacacagtaatagtgggggactttagtactccactgacagcactagacaggtcatcaagacagaaaatcaacaaagaaacaatgaattaaaactataccttggaacaaatgacttaacagatatatatagaacatttcatctcacaaccacagaatacacattttattcaacagcgcatgaaactttctccaagatagaccatataataggccataaaatgagcctcaataaatttaagaaaattgacattatatcaagcactctctcaagccacagtggaataaaactggaaatcaactccaaaaggaaccttcaaagccatgcaaatatatggaaattaaataacctgctcctgaatcagcattgggtcaaaaacaaaatcaaaatggaaattaagaaattattcgaactgaatgacaataatgacacaacctaacaaaacctctggaatttttagcagaggcggtgctaaaaggaaagttcatagccctaaacgcctacatcaaaaagactgaaagagcacaaactgatattctaaagtcacacctcaaggaactagagaaacaagaacaaatcaaacccaaacccagcagaagaaaggaaataacgaagttccaagcagaactaaatgaaattgaaacaaacaaaaaatacaagagataaataaaacaaaaaacgggtcctttgaaaagataaataaaactgataaaccatcagcaagattaaccaagaaaagaagacagaaaatccaaataacctcactgagaaatgaaagaggagacactacaactgacaccactgaaatacaaaagatcattcaaggctgctatgaacatctttatgtaaataaactagaaaacttagaagagatgaatatattcatggaaaaatacagctctcctaggttaaatcaggacaaattagataccctgagcagaccaacaacaagcagtgagattgaaatagtaattgaaaaattaccaacaaaaataaaatacaggactagacagattcacagcagaattctaccagacattctaagaagaattggtaccaatccctttgacactaattcacaagacagagaaagaaggaatcctccctaattcattctatgaagccagcatcatgctaataccaaaaccaggaaagaacataaccaaaaaaaaaaaaaaaaacagaaaacaaaaaactaaagaccaatatctttgatgaacatagatgctaaaatccttaacaaaatactagctaaccgaacccaacaacatatcaaaaagataatctaccatgatcaagtgggtttcataccagggatgcagggatggtaacatatgcaagtcaataaatgtgatataccacataaacagaatcaaaaataaaaatcacatgattatctcaatagatgcagaaaaagcacctgacaaaatctagcatcgctttatgattaaaactcaaagcaaaattggcatacaagggtcataccttaatgtaataaaagccatctatgacaaactcacagccaacattatactgaatggggaaaagttgaaagaattccctctgagacctggaacaacacaagcgtgcccactctcaccactactctgcaacatagtactggaagtcctagccaagcaatcagacaagagaaagaaataaatggcatccaaattggtaaagaggaagtcaaactgtcactgtttgctgatgacatgatcatttaccttgaaaaccctaaagactcctccagaaatctcctagaactgatacaagaattcagcaaagtttccagatacaagattaatgtacacaaatcagtagctcttctatacaacaacagcgaccaagcagagcatcaaatcaagaactcaaccccttttacagtagctgcaaaaaaataaaaataaaaataaaatatttaggaatatacctaaccaaggagtcaaaaggcctctacaaggaaaactacaaaacactgctgaaagaaatcatagacaacacaaagaaatggaaacatgtcctatgctcatgaatgggtagaatcaatattgtgaaaatgaccatactgccaaaacaatctacaaattcaatgcaatttccattaaattaccaccatcattcttcacagaattagaaaaaacmattctaaaattcatatggaaccaaaaaagagcctgcatagccaaagcaagactaagcaaaaagaacaaatctggaggcttcacattacctgacttcaaactatcctataaggccatagtcaccaaaacagcatggtactagtayaaaaataggcacataggccaatggaacagaatagagaacccagaaataaacccaaatacagccaactgatctttgacaaaacaaacaaaaacataaagtggggaaaggacacccttttcaacaaatggtactaggataattggctagccacatgtaggagaatgaaactggatcctcatctcttaccttataaaaaaatcaactcaagatgcacacctaagacctgaaactataaaaattatagaagataacatcggaaaaacccttctagacattggcttgggcaaagatttcatgaccaagagcccaaaagcaaattcagtaaaaacaaagataaatagctaggacctaattaaactaaagagcttttgcacggccaaaggaacaatcagtagagtaaacagacaacccacagagtgggagaaaatcttcacaatctgtacatctgacaaaggactaatatacagaatctagaatgaactcaaacaaatcagtaagaaaaagcaaacaatcccaccaaaaagtgggctaagggcatgaatagacaattctcaaaagaagatatacaaatggccaacaaacatatgaaaaaatgctcaacatcactaatgatcaggaaaatgcaaatcaaaaccacaatgcgataccaccttactcctgcaagaatggccataataaaaaaaacagtagatgttggcatggatgagataatcagggaacacttctacactgcaggcgggaatgtaaactcatgcagccactatggaaaacagtgtggcgattccttaaagaattaaaagtagaacttccatttgatctagtaatctcactactgggtatctacccagaggaaaagaaatcattattcgaaaaagatacttgcacatgcatgtttatagcaacacaattcacaacttcaaaattgtggaaccaacacaaatgcccatcactcaatgaatggataaagaaagtgtgattatctatctatctatctatctatctatctatctatctaymtaymtatctatctatctatcatctgtctatctatctatctatctatcatctatctatctatctayctacctacctacctacctatctatgatagaatactactcagccataaaaaggaatgaattaacagcattttcagtgacctggatggaattggagactattattctaagtgaagtaactcaggaatggaaaaccaaacatcaaatgttctcactgatatatgagaactaagctatgaggatgcaaaggcataagaatgatacaatggactttggggacttgcgaggagtagtgggagggggacgagrgataaaacactacaaataaggtgcagcgtatactacttgggtgatgggtgcaccaaagtctcacaaatcaccactaaagaacttactgatgtaaccaataccacytgtaccccaataacttatggaaaaattttaaaaaaggaaataaggaaagcaaaacaaaacaaaaccaaaacccaaatgcaaatgaaatacaaaactgaaaatcaataggttacgtcctcctcatcagtctgttctcaacaagacagccatagtcaccttatttaaacacgtcagaacaaggcaatgccctattcaaaattatacatgatccctctccctcagcacctttcacacacttagattaaaattgagccttattatgagtgaaggcactatatgatctggcttcccactatgttggaactcaaaatcctaccagtctccacctcattaaccacactttggatacaaaggcctagttactattctttgaccatgccaagaccactcccaatgccatatgtgaaatatcatctcctctatctttctatatgttcactactgtttttttttccttcattttcaccacttgacatttttattgtttgtttattgtctgtttccctaactagattgcaaacatcttgaagagatggtgttggcattgctcactgcttatttcctagcwtctataattgtacttggcacacagaaagcattgaataaatattttaaattaactttctaattttaactgtatattcacctgtgaatttaagaagtaatagaagcttcacaaatcctttactagttttttcctgatggcggtatttgtaaagtgtggtccaacatcacaacaaaatcacaggacatttacattgatagagtcaagatatagaacatttctatcatcacaaggatccctcctgtttcctttctttagtcggttgcaagcttctttaggcctgtggtcagcttcttcagctccaagtctgggatatatgagggagaataaaaacccaggtaattcaccatcatgctgttccttgggtcccaagatgcctgaccagtctaacttctgtctacctttcagagtttcagcatacrtaatctattctggtggatgtgtaatggtatagcatgactttaatttgataactaattaacttgaagtcttcttaaaatatactattttggccatttggatatattctttgataaagtgtcttttcaatcttttgttcattttttctgttgtgtttccttttccttactgattttttttgagttctttctttattctggraaacgctcctcacactgtggattcattgactctattaacaatgtcttttaaaaaacagaagttcttggcttttatatagttcaatgtatcaactttttatttgccctaagaatatggaattgttctctaatgtttgcttctaaaagctttattgttttatattttacttttatataacacatttttatgacattaacttttgtgtatggtgtgagatgagaatctagatgatgtttttctcatacatatatccacttgacctagtgcaatgtattaagatggtcctcygctccccacagcaccaaagcttcatattattgttgttgctgtagatcaggaacgtgtgtgggtttgtttctggacttttttccattgatcagtttgccatttttagccacaggtatttcttttattatttcctgattaagatataacttttatagaatggtgccacttttgaaatcaaaatgtgacatgaagtttagtttatttaatttggtggcacaagtataacacagatactgattttccagttgagtaggacagcagaaattccataatttgtatctctcgccaagtgtcttmgtcacttggcttatggaatcactgaaataatgagttctcatatcaatacctaggaagttactgttaagatacaagagttaagttgcctttaagatgcaagagttctctctaagttatgagtctctgtacttctgtctgctttgggacacataaaagaatgctggagaagttcaatggcaaattggaattgtttcacactatactcttgagcaaagattgaaaaactacagcccgcaggccaaattgcctgccacctatttttgtaaataaagttttaatggctaattttgtgctacaatggtaaagttgagttgttgtggaaaatattgtatgcctcacaaagcccaaaatatttactgtctggctgtttatagaaaatgtttgtcaactctttgtcaaacaactctagagaatgtgcacatattcctctaaaagaactgtttggttaccacagctgtactaggggcttaaacaggtcatcttgttatattgctttctagtgagtgttaaaaaattaataggacattttcctaatattgagcttcatataaattgttcaagggaaatatatatatatatatatatatgaactttttcaaaaagtagagagagaaaaagatgattgccagaaactactacagggagtttctaaaaacgaaatatactatcacttgcctttgacgaaaattgttggtggaagccactgtcattgtgagtagytttcggcaaatgggaaaatgttgccattaacagtagcttgcaagtaagagccacagctaatgtaaaaatccacccttgaaaatgaatatcaagatatttttaagacccactaaaacaaacatcctttgcagcagaagatatatttgtaggctgtcttttgtgaatgtgctatataagtaagattccaaaagacctgtcgtagtatgggagagggtgggtagtaggtatattttactctagttgctcaatgttaaaagagctgattgtttaagtctacagtagactaatatccttgataaggagacctgagagtcaggagtaatttaaaatataagtccaaagaggatttgctggattataaataaaagagtagaaccaaggattaagtaccagaaataaaccaattgaagctggatatgtttggggataagaaatatctccaaaaaatacaagtcttggacaataattactaccatcagtagtgactgccttatttatttgctgaatattttgagctgtgtttaaaggtatgggtttaatcttgaccttatgagtgatgatagagattgcagcccttcagattaattactaaaagttccatttctggtatgatagagtaaggagtaagtttcaaatggtccagcccgccaacagatcacaactataaacaaaaaaacttattatgtataatttatattatataggtatgtgtgtgtgtgtgtgtgtgtgtgtgtgtgtaaacaaattattaagtatcagaggcagatttggagatgatacaaaacttggaagacaggaccagcataggatacgttttcattttttagtcttagtgtaaggacagtctgcaggtgcagtggactgcaaataactaacactgtggtagagaatctatcctcttggcatccaggaatgagcctgggataactgcaggtactagaaagtaaggtggagaggcatctcagaaaagagaaatccagaagataagagcccccaaattggtatacaaactttgcccaattctcaggctgacaggtgaattgagcatgtctgcagcagactcaaaacatcctgcagctaaggctaaaagaacaacactgagattttggctgtctccctccataggcacacaaagtatgtaatttgagcctaaccaattaattgccttctaatataaaaatagtawctttctttggaggaatattagagaatgcagaaataatgacttggatacaatacagactggcttcacattcaaagaaaaaatatatgattaacagagtccaaccytgagacgacccagatgttgaaatttcagataaagactataaatcagccaataaatctatgcttaataaaataaacttaataaataaataggaaatctcagtaaagaaattgaaaatattttaaaagaactgaatgcaaattataaaactgaaacatactgaaacacgcatatttgaaaaagaaacattttatgggctttatagaagaatgaagatgacaaaggaaataattactaaactttaagatagatcaatatgaagaaaagagaaaaaaagttaaagatatcaacagagcccaagttgtctatgagataatattaaaacttttaacatatatttaattagagtcccaggtgagagtgagaatgaggcacaaaaaatattcaagaaaataatggcttaaaactcaaactgaacgatgacttactgaaaattatttacacattcctggagctcagtgaattggactactttcaataaagagaaaggataacaaagtttcagtagggcactttagaaggctggaaaatgtagtcaaagctcatggtagtgtacagcattgccagaagaggtgataataggaaaragtcatactttcttttttatttcaaaaatgctcttgagggtcataggcatagtttgcacagcattttgaaaattaccaagaatcttagtttaaaaacttatacactctttctcatcttaaaatcatttttagttattattagactttgattaatgtctataagacattctgatacagtgaattcagaatacatgttgttagttttctttatattgtgaaagtatacatgagaatttttatactttgtgttgttagaacattcttagttttcattattttactttttgtcccattatgtatatctgtgcttcctgttttggaaatataatttagctaatgagttgtattagttatcaacttccatcatagtatatcatttacaattaatatctgtattatcagtgcctgtatctttattttctggtatttttccaagtgcttgtaaaattggatgtatatttaactttcatggttattctagcattctgcttattcataattcaatatcttgaaaacatcttctgctgtcttaatatttctgtcaagtttagtagaatgtttttgaatggtacttatttttccttctttttacagcaggaatgaaatgattctgtgtcaattatgtaaaaataatttgtcatggttatataaacaagaataagcatagatacaatatgatttccacattcttggttatttggattatctgaaatgatgatttataggactccttaagttccctggcagaaatgtagccacataaattttatttctatagcattcaatctatgtgttccaatattaatatgatccagatgattatcatttctagttaaatcaatgattaagctataacttattattcaacctaattttaaaaagaattgaagcatgtatagaaagtgactgaggaattggttggtgcttttaactctggtgtagcttaactcaaactttaatatgtcaagacatttaaagttattaggaaggtgcatgatatcatccttagggatgagcttgtcgttcttgtttcccttcagtggctgaagaacagaggcaagtatatctctttttatcagatatttacaggagatacttctatctttagtacattctagaaatccaaagatttgtaagtgaagaaatcctttcttgctaaatgagtcacgtgtgactcatttgttatgaaacttttgaatttggtctttttaaatttcatgttaccaaacataagaaaacaaactgaagagcatcagaagtaaatatcctcaaaattctatggatattccatgtgtcattataactcctaatatttgcacatactattatcattttttagttaaaacattttcctttttctcttttaagaaagtctctgaaagctatgtcagatgtgagcttcttcgtgaaaactttatcttatctcagccctcctatcacacttccttcaagctagaagtaaccagtccttcataagttgtccccatagtactttatctaaatatcaatttagacatgacattctgaattacaattaagtcttttcttgtctatttctgccactagattgaatacatattatattaccaactcttgaaccaattattgacatcttatgaaggaataaaacatatttgctcaagtgatgaatcaattttataattgcattttaaaagtttattaaatacagtttatacttcgtaagagaaatgcaaatatataaattagacaaggacctaataatggattgaagccactgaagggaaacaactcaagaaatacagtcccatcccttattaaaaataattgtattgtacacttacaatgctacactgtatagcataacattattcctcagtaaaagtattaaaagataagtttttaccttaagaaatcaggtttaaaacaaaaatatgtgattataatgaactagaaaatcagctaataaaaataaatggaatgataagtagttttacctgaggaataagtagtgttcaatagcattatagggtaactatagttaataataatctattatatatttcaaaatagaagatatttagaatgaccccaacacaaggaaatgataaatgcttgagataatggatatcttagttaccctgatttgatcattacacatcgtatgctggtatcaaaatattacatgtagcccataaatatgtatgactattatatatctataaaaattaaaaataaaaaaatagaaaaaaattaagctatttttttaaaagaccrtaatagatatattttggcaaacaccattgtattagtctgctttcacactgctgataaagacatacccgagacgggcaatttccaaaagtagaggcttaagggacttacagttccacatgcctggcaagrcctcacaatcatggtggaaggcaaggaggagcaagtcacatcttacatggatggtgccaggcaaagagagcttgtgcagaaaawctcttgtttttaaaaccatcagatctcatgagactcattcactatcacgagaacagaccaggaaatatccacccccataattcaatcacctcccacggggttccccccatgacacgtgggaattgtgtgagttacaattcaagatgagatttgggtggggacacagccaaaccatatcaaccattatggaaaacaaagaaaaaccaaaataagttcattgtggattagaaagattatgaaataataatccaagtccattgttaactcaaggacatttagaaaccataaagaaggaaaagaaaaacttttattgaagtktggaaaaacatattgaagaatatttaccattacaaataaatacaagggcctgatacttttatggtttaattttttttgctataataatgagatagtttattccattgttwttaaagtgaaakactataaaaatggatgatactcagcttaatttaatttataaagaactgtaattttaataatctgaaaaagatrcataagaatgtaaactacaaactaattttacttatgattaagaatgctaccattctaaataaagtaaaagtatatcaaattttacagtgcaataagaatatcatttgtgatcaagaatactttattttaaaagtgtaagggtgttcatacattagaaaaactaacagtataattgataaaaacacaataaaagaagaaaaatataattgtatagtgaattccacaaaatgatttgattgaattcagtacccatttaactaatgaagttattagttaatagttatggctggcttaattggatatttacatggaaaacaaaaaactgacagctacttacaatgttcaataataatttttaaagaaattaataatctaaatgtgcaattatatatgttgactttaatcttatgtataatgaacattccttatatttaaatatacatatgcatatattttaatgatatggctaactatgcagttaactataaatatagagttatatatatttatatattatatattataactagttataattaactatatagttaactatatttagctttatatatacatatatatgcgttagatatatatgcatttattcatatttagatatatgtgcacataattttactatatagttaactataattgaactataaactataacaagtattgttaactacgtagttaaattacagttaattataactatgtagttaaattatatacataaatatctaaatataatgcatgttcattacatgtaaggtcaaaattaatgtatataactgtacatttagatttgtaatctatttaaaacttattgaatatgataagtagctgtcagtgtacatatatacatagcatataaatatatatttagttttaaaagctagtagttactatttgtgcaacattttataaatacatacacacataatgccttagcctgaacctgctcctgctgctataacaaattactttagagtggataawttatttatttatttctcatagtcctggaggctgagaagtacaagttcaaagacccagcagctctggtgtcaaatgagggctctctccctgcttcagagatggcactttctcactgtattcctcatatggaggaagcaggaagtactgtatcctcacataatgaaaaggggaatgctgtgttctggcagaatgagccaaagggactccttcagtcactttgataagggcactaatcccatcctcgagggcagagacctcacgactaatcacttctgcaaacatctcacctattcataccaacaccatggggattagatttcaacatgaattttcgaggaatacattcaaaccatagcatatatatattatttttaaaaactagtagatactatttgtgcaacatttttgtggtgagatttttcttaaacaagccaggactggtttacataaaatataactaaaaatataggcaatactatactataaacagagtaaaagaacaaaaaattgacaagaaaaatgtttttattgtaaatgacccgacattaatgcccataatatatgacaagctcctgaaaatactaagaaaagcaaatgattcatcagaaaaatggaaaagtaaattacagagaaggaaaatatttgagcaataaggatatgagtttcaattctgtttacaatcaaggatataggaaataaaacaataatgagctgccttgtatcacccttcagaagaacaaaaatggggatagcatctagtgtgactaagtatatggtgatgtggattttgataaattaataaactagcagtctctatacaaattaaaattgaatccagagttcaatttttataaacacatcttacatacttttataagcatattaatatacatacatgctaatataaacatarcatactatacatacatactatacatactatacatacatactatacatactatactaaacataatatgcatactaatataaacatattttacatacttttataaacgtatcttacaggtataaaacagccactaaatatagatatatattgaaaggtatttttctactgttaagagcattggcgcaacaacgacaaaaaaaaaaaaaaaaaaaaaactgaaagcaacctgagtgtccctcaaaaggctgtctgaaataccatggtacagttattctatggagtattatgtagcctttaaaaataaatgagggagagtcatctgttgttctacaaacaaagasatgatactacagatgcataaaacacctggataaaatgagaacactatatatcatatcattttgattatacttcagagactgagaaaggaggacaagtggtaaaatattagttctttttaatctttgcaacttttgttacaaacaacatgaattatagctgtactttaaaaatctaatagaaactttttttaaaaaagaagaatattgggcatttaattatatttcatagaatgattgtccctgaatcatattaccgataagttcactattacagagataatttcttaatacttagaagagagacactttcttctatttaaggttaatcctgtaaattcttctctggtaatggcactgttccccataccccagatttaacaagagagatataaatataataataattaaaacatgaagcaacaaaacagcaaccaaaaaatttcaaccttcaagagcaatttagaaggtttatatcctcagaacaaaagcatttctttctgactttctaaccagtcaaaatttgcatattctacaggaaaacttttcatattatttcaacaaactgccctttactgcttctgcctctatcagatctcctaagtactaatattttccctggttaaaaataccaggtgtggtggctcatgcctgtaatcccaatactttgggaagctgaggcgcgtgaattgcttgagctcaggagtttgagactggcctgagcatcatggtgaaatgctgtatctacaaaaaatacaaaaattagctgggcatggtggtgcaggcttgtagttccagatactcaggaggccaaggtgggtggatcacttgagcccaggaggcagaggttgcagtgacctgagatcatgccactgcattgcagcctgagttacgagagtgaaactgtggctcaaaaaaccaaccaaccaaacaaacagaatacatgctttattaacagagtgccatttgtcttatcctattgtctgtaattgtctttatgctggaccccaactcatattcctttagatcctatgtggtgtccagagagtgggagaggtctaatgaatacttgcatgaaagtttggagtaactcctgttaaataaagtatctattactcagtgtaaaccagatcatattctactgaggcaggtctagttctttttattatattagatttacactgttgtattttattcagtagaggcagttgctactcctggtttgactagcttcagccatctgaaaatgacctggaagggccagtattttgaattttactaagactcaaattttcacctcatagtataaagctgagatataaaaaagccacttcggccgggcacggtggctcatgcctgtaatcccagcactttgggaggccaaagcaggtggatcacaaggtcaagagatcaagaccatcctggccaacatggtaaaaccctgtctctactaaaaacacaaacattagcagggcttggtggcgcgtgcctatagtcccagctactcgggaggctgaggcaggagaatcgcttgaaccggggagatagaagttgcagtgagcctagatcatgccactgcactccagcctggcagcagagcaagactccatctcaaaagaaaaagaaggaaagccacttagtgagtgagtgcagctgataaccagcattcatgtctcattttgattctgcatctctatgtgtatctatgaataagcagcaatgcttatgaaaaaaaataaaaaacacttaatgaagagaaacaaacccagatgaccctggaggctcattcccttccctgttacttgctttgcaataagctggctcagcaggtccaagttagtgcaatgaaaatgactgctgttatcaggcattgagaaccagtggttacctctttccacaagaccattttcttcaccaagaaggacctatttttacatagtcatttagagtagagaaacccttccccactttctctataaatgatatatagagatatttgggtgtcaggaactctttcctggagtcctttcaatgatatatttaaagcaactatgcccactggggcaaagcaaacctctctggggcataaggacagcttcatgggcctctctgctacttccatatctgtaggctttctctattccactctagtttacctgtacatgatatggtgctaatgtacattcccctttgtctttgtgtggagaagggccttggaaaggaaagccatgtgctagagctgtggagtagcccttacaggttttagagtcttgaacggcatatggatatacttcaaaggatggctaaaaggctattcttttgattcctggtaactagtaataaatacttagtagtttgtagggtctcctttatgaatgaagatgtctatatactgatatgagttgttcataaggaaatattattaaagaaagcaagggagagaatagtgtatatgcataatatagaagctactttttatacaaaagtaggggtatacaaatatgcatttcattacattttcctaagagaaatactgaaataaataaactagttatagagttccctaaaagtatgcatatgtggaaggggagtggatactggaatagaaggcaattttggtattgagacttctccatatatgtcattttatatagcattaactgacattaatgcctgcctattaaaaaattaaatagaaggctgggtgtcatggctcacgcctgtaatcccagcactttgggaggccaatgcgggtggatgatctgaggctgggagtttgagaccagcctgaccaacatggagaaaccccgtctctactaaaaaatacaaaattagctaggtgtggtggctggtccctgtaatctcagctactcaggaggctgaagcaggagaatcacttgaacccgggaagcagaggttgcagtgagcggagattatgtcattgcactccagcctgggcaacacgagcgaaactctgtctcaaaaaaaaaaataaataaataaatataaattaaccagccaacaccatatatttttcttaagatggtcgaggctacaaatacattattaattaaattcctaacattttcagaatttagtaatgtttcctaacatgctaagtttgataaaaagataaaataaaataagcaatacatgtataaattctgcatagatttgtataagtgactgaaaaactattttcttgcataaccatggaaacaaaacataagtatttgtgtaatctgatttcaatttaagaaaaaatgcatgaggtagttgcgataaattccattttgctctcaattctatgcccaaactgtaagaagagattttagagatgctgcagtaaaaaaagaaatcacagaaatgcaataaaatgcagtgaagtcacgaaataacaaaaataaattgtcttagcaacaacaaaaaatagaattctatcagggcatagaattattttgtgtgtatttaaaggtcccatgggggaaaacagtacaatcattagattatactatgacatattttaaacttataattgagttattaataaagcagccatccktttaattaagcacctaaatcaagattacatttttacattagaaatgtcatatggtttaaagttttaagataaatcagactctgaaaattgtaacatatatatctttaaaattcacattaaagtgtctgtgtggcaaagggaatggaataagtggaaataactggtcctgggaccacctgcggttaaggtattactttggtagtttaattgaaatctcattggtccacccctgtctcctcatcctcagaacttcttctacagaaatgttttaaaaggaattagaggaagtaatgaagcataagaaagtcatttcatttatctctgtttaagttattgtagccatttaaattaaatttgatttgtggtagctttaaacattttagttttgcttaattaattgtgagtagaaacaagatttgtggcagaactgctgtgtgtaatagacagagggatgatatatttgacgaccaaactggaaagtgacagttttactttatcagtgccataagttctcctgggacctatttcaatttttcagcaagaaacttaaaaacaattatggaccagttagccctctgaagaaaattttttaaaaacctgattttaattttataaagtatactcctttctatttcagcggctattgcttggtatcataatatcaagctttaaaaacactgaactaactctatgcttttttggtactgtaagcatattttgatcaataatgcatatgtattccaatttttcaggatagccaatttctgtcaaatggttcatatttttataattgagttccataataatggtggtggtatattctattaggaaatatatgagaccagatatattaaaatatttttccaataaaatacataaagtattgtatattacactgtcagaaatttagtgtatttaactgcttaaaatggattgctattctggaagcagagccagaaatcagaaacatttgagatgatctactaagtattattcaccgccttaaaaagacacaatccttttaacttttcttcctctgcaactgactttttctttccatatgcttgtcttatttattatttttatactctgctcttttcctagaaaatttctgccagtaatacctatagcattagaattcactgaagaaaactacccaaaaacaagtattatgcattgtggtgaggtctctaattcttaaaatgtctttgaaatatatcagttttaacctgtgatttatggtkgtttaattgctgtcacagtgtcatagcaaaaggttaatgttggagctgaacagatcttgtttaaatcctgtttcaaaactggctctattatttccaacttgatctacacattcagtgtaatcccaatcaaaatctcagaaagttattttattgacaaaatgacttgaaagtatatatgtagagttaaaagacctggaatagacaagacaatatttaaagaaaagaaaaaagttggaggaccaacattgagttcaagacttaccataaagcttccataatcaagacagtgtcatactggtcaaataatagacaaataaatcaatggaatagaatacagagcccagaaatagacccaactaaataaagccagctgaccactgatgaaagagtcaaggcaaaacaatggtgaaaagatagtcttttcaacaaatggttttggagcaactggatatctacatgtaacaaacaaatgaaaagaatttagacacagactttatatgctttacaaacactaactaaaaatggataaagacctaaataaatatacaaacctataacatttctaaaaggtaggagaaaaatctaggtaaacagctttggcaaagacrttttaggtacaacaccaaagccacgatccatgaaagaaagcattgataagctggactttattaaaatgtaagctttctgctctgtgaaagacactttcaagagaataaaaagagaatccacagacatggagacaataattgcgaaagacatatgggatatatctttaataacctgggctatccatcttctctataaggaaacatctgcctcagaatacacattatcatcaatttgttggcaatgcttgaattcgaatagacagtgttttgcttgttttactgttttcagtgactctctaagtacaattttaagtcaacctctcttatatgtgctgttattttggggatattttgtcactatcagatgaataaattatttatcrtttatataaaatcaattcactggagtatgacaaaaacaataaaactttaatctatatttatctgtacctcatccctccaaatctcacttaaatatgttgaggcaagttaagatacatctgtcttaggatggagattttctccataattggagaatttttatgtctctgatcttggcaaattatatgttgattttacagtttaacaattgtttaactgtttgaggatatcttcattcaatcctaaattctggggagtcatctctttgcttttttttggtataaataacaatattctttaatgtaaattttaacctcaaacattcttgaaattttaaatattaaactaattactgttaagcaaactatactgcaattaaacattttctcagaaatttttctttctttctttctttttttttttttaatctgagacagagtcttctcactctattgccaggctagagtcaagtggcrtgatctaagctcactgcaacttccacctcctgggctcaagcaattctcatgcttcagcctcctgagcagctgggattacaggcatgcaccaccatgccaggctaatttttgtttttttagtagtgttggagtttcaccatgttgcccaggctggtcctgaactcctgagctcaggtgatcctcccgcctcggcctcccaaagtgctgcgattataggcgtgagccagtgtacccagactcagaaaattttctattgaaatgttcttagattatgatgtttcttaaaccctgcttctcctcaagtatcatcacaaccaacagcaacaacaatgacaaaatctcttaaataaaaacataaagaagcatagactaaagtaagagagaagatactctccatgaactatccaagcaattaagaagaaaagtcagaactacttctgttataacaaattgtttaaaaataacaactggcacttcctcacataggtcttttacaaatgagttggctgcatttcctttttagccatgcaatgtgggatttgcagaataggacagaatgttcctaaagagttattcaggtatgttgttcaacagtgaccaataaacaataggtcattttattgctaggagagaacaaatacataaagacaaatggaaaccccaatacctaacgacattatgaatagggcttaaatcattagaaagataaaattagagaaatcgtaacatagatctctgttcttcaggttaattgtattataaaatgtcaggagactaaattttttctctactttgctcgtggattgtttatactcttgaaatgcatcttaacattaccttcctcagagttcactatacctcaaagataccagatacgattacattggtacttaacaacattcatctggaaagaattgaaaggaggagggattaattaatctccttgaagggggtttactrttaagttaaattgcatttcctctggttctctgcttttggtgcaaaaatttgaaggatgaggaacaactaataggttttctctctttaggatttctaagctctcttcatgttatgtggcgattagttagttagaattttggtccctactctgtgcataaatggagctgctcaaaatctcaacatatctgaaagttttatagctgctttaatgattgctatgcaacatgccagacatggagcgtgcagttacaagatactcatattcactaatgaggccaccttcaaaaccacaaaagcccccattgccacatacccagttgatcctcctagtccctttacaaaatcatcaggaaaagggagaaccggacgaaggcaaagtctctttattggagttcaacccaggatattcccttcttgtttgacctaaacatcatctcaggatgactgaggctggatttctatgtacaaactacaggcctgtctgcctgattcccgcccagagctgtataatgcttgcagtgtctgtccatgtccttcacttgaaaaatatgacacaatgagagggmcaattatgatggtctattgtagtgtgagaaatgtcataatttgaatatttttataaaaatayatataggagaaaaggggggaacacaaccctcactctcaaaatctaaaagtgacttgtaaaacctagaaagcaagagttgggaaacctctgaacacacataaagaggctttctttgaagtcattagcagggtgtgttattaataataaattgaatcaagagtattgtagtcaaagaagggccttgcatttgacagggaaaaatccaaggcagtacatggttgtaagccattcatatgacatatgagtggctcttaggagctgaaacacaaagccatcaaggtataaatggcatcaggggtaatcttgcctataaatattttcaaatttatagccttgggtgggaagaacatattgtgtgaggaaatacagtgtgaataaatggaaattgtgctccactgaagtaagaaaggggaaaatatagttttatttctcgcctaacatttcggcatcatgatatccctaagcgtgcagccataaatctaagaggaatcttaggaaatggtgtaaaagatttcattgctaatctgtcagattttagaattcccttcattgagtcaggagaaaaatcacacagggcagaggcaaacaacatgaccagaaagcctgggggaaactttggctttcctggtcatatagtgcagaaatttgaaattgtgaagaaatgaagaccaatgttaaattactcttatttagagagagtgatgtgtaaaggtccagatgtttgatcattgtcaatccatcttttatttttatttcatttcatttcattttgaaacagtctccctttgttcccaggctggaatgcagtggtgcaatctcagctcactgcaacctccacctcctgggttcaagcgattcttctgcttcagcctcccaagtaattgtgattacaggtgcatgccaccacacctggctgatttctgtatttttaatatttttgtattttgtatttttagaagtgaaaccaaccgggtttcaccatgctggccaggctggtctcaaactcctgatggcaggtgatctgcccacctcggcctcccaaagtgctggaattataggtgtgagccactgcgcccagcccaattcgtcttttaaataaggatttttatcatcaaatgagcaaaatacataaagaattatcatgaataagcctactattgttttctttgcctcaacaaaatacaaggccatatagaaacaatttttctttgaccattatggattgttggttatatagcatgatatcattgcccaaagatagtcagtattcaaagtytgttatctgtaacaataagaattactatgtcatcatgtggttggaggcattgagataatatagataaagtaaattgccagattcttgatccacacctgttgctcaataaatagcaactaaaataattgttctggattcaaggagaaagtttcaaactttgtctttgaaaatgcaaattttaaatttaatgcatacatatatacatatatttgggtttattattatttctttcatatacttttcaaagactgcgggcttttattttttctttggagtaattttgttcttttacttagatttaataagttttactattttattttctttgttttttctctatatagatatatatcatttattgttatttatatatctatgcacaaaattttgttgttattttcaagacaggatgtggctctgttgcccatgctggagtacaatgacataatcttggctcactgcaacctccacctcctggactcaagccatcccccgacattagcctccagagtagctgggaccacagggacgtgccaccatgcccacttacttttttgtaaattttttgttgagtcgggattttgccatgttgcccaggctaatcctgaactcctgacctcaggttatccacccacctcagcctcccaaactgctggggttaaggcatgaggcaccaaacccagtccacaaacttatttttgctgttccgcgtatctcataaaatcaatggcattctccagtataacctcaatattattatacttaacagatttaatgttgatattgtattatttaatatatggttcatattcaaatttctctaagtattgtttttagttttaaatttttttctgtccctgccccctgccattgtatgtaattgagattcatgcattgggttttcttgtcatgcctcttggttttctttaatccagaacagtcctcctactttgtttttttacatttggtattccatgacatttataattttgaagattccaagctagagggctttttgaatatctaacattctggattttcctgattgtttccttataattaaaagattaaatatcttttgtagaagtgctatgaagctgatattgtatcctcattgcgttgcacaggagtcacgtcaaagcagtggtttgctggaagctgattgctaaaaaaaagtctcaagaagtctctgagctagttgttaaacatggtcattattaaacattaaattatgtgaactaggctgggcgcggtggctcaagccactttgggaggctgaggtgggcagatcgcttgaggttaggagtttgagaacagcctagccaacatggtgaaacccatgtctactaaaaaaatacaaaaatagctgggcatggtggcacgcacctgtaatcccaggtactcaggaggctgagtcaggagaattgcttgaacccacgaggtggaggttgcagtgagctgagatcatgccactgcccttcagcctgggcgacagtgagactctatctcaaaaaaaaaaaattatgtgaactcacaaataataagtattaagcaaatgtaatagatactaaaatttcattccttcttaattattttaccaaatttacatctgtcatggagataatacaacacaatgctgtgttgtgttactctcttctaaactccgctttcagtgatgtcacattaatagctggaagtaggccattgtgcagtaattacattgcaagaattggcaaatgctacacatcagarcatggtttatgatactgattgtcagaaagtgatggagaaaagtgttaataatgtagactaaacttatattttgctgtgtgtataacaattaccttgtaacaccaaaaaaaaaaagtgaagaaattactatttagtgtttgaaaactattatccaatttartaaaaagtagcttatgccatgattaagttctggcatacatctttattgttttttgttggtcttactcattaaggtaaacaaacatattaaccaacatccatgttagaactacacttattcatcacttaacaaccaaaacatgaattgaagacaatttggcaataaaactgaaaatattctttgagaattgatttattatatgcagtttacaataaagagtattatatgttatttgtaaattgtgttacgtggcctggcgcggtggctcacgcctgtaatcccagcactttgggaggccgagaaggacggatcacaaggtcaggagatcgagaccatcctggctaacatggtgaaacccccgtctctactaaaaatacaaaaaattagccaggcgtggtggtgggcgcctgtagtcccagctacttgggaggttgaggctgcagaatggcatgaacmcaggaggtggagcttgcagtgagctgagatcgcaccactgcactccagcctgcgcgacagagcaagactccatctcaaaaaaaaaaaaaaaattgtgttacatatcgtttctattaatatttgtaaatattatataagcattttgccctttttatatgcatgtgttttagagtcaattgttaaacatttagcagaacaccagtgcatgcaagctattttgtttcagtaatgatagataggttttacttagtaaaggcggtgtctgcaatatctccgcattgtgaagaaacactttttcttttgttcttaattatctgcttgaggatacttagagatcatagtaacatccttgttgttcaacaacacttttacctaatgaatttagcatccattgatgattcttgctttaatcaattagtacattactggtagcaaaatagtgattttattttattctttctatatgttttagctgtgayttttctacaaagaaaagctgtttcaatttctctctcactgttacagatgggattgatgaaatgrtttaatacattaacactactgaaatcattaatttttttagctaatttgtcccaaacatttttaggggagaacttttaaactagcttctctgtgtttttagtcatgatctctaggtttggggcagtttttttgccttctcgcccaacaaaatattcaacgttcattgcacacattaccttagccagaaagaaccatatctccaaacagttctagttccttgtagtgaagaattatatttagtcatcaaaacctcggtgttatgtgtttttgttgcaattgaggtgtcattcttttactgttactmgctaagaaatattgcattatgaaaaataatacctcttattcaaatataagatcaagaatattttcttatcatttttcattccagttcrgtatctcttcttacattaagaattctagttctccaatacaacaatatctttaaacattcactctatctacaatcacacaaaatattttcagaatcattttaccagtaccattaccatgtaaagttcaagattcttttgttataatatttccaaccaagartgtacagagtactgtgatcaaaatttccttgacttaaatctttgtttttctctgttaataactattaggatcaattcttatttttatatttaatttatggtttgctgtcttaaaaatgtgtatttattttgtgacattttgacctttatatgaataaaaaatcaccacagatacaaaygcatgcttgcacaagtctgatacccattcttaattctttcatccattcacacctgcatcttgtagttaaccattttggttaatgactaattatctaccctatgtttctgtttgaaagcaaatattcttaaatttccttctttcatacagaaaatgcttctgatacctatatattcttatacttgtttttcccacttaattgaacatcttgaatatcacttctaattatctcatacaaatcttcctcatcttatttttagtactacatagtaaaccatgtaatttgtttttaatattttctataatatctacaaataatgaacttctcatacagattttttatagaaattgccaaagattgatttgtatcttagaaaaaataactgttacaatctaaccaccagtgcatgaaagtgctatttctccacagccacaccaacagagtgtattattaagattttaaattttttgctagtctaacagggtggaaatgacatatttgtggagtcttaatacctcttatttaaaatgaagatcactttaatgttcttttttcttggtttttatgagttttttatacatttagagatattagctttttatcggagttgcatgttgtcgatattttcttctaattatttatagtttgattttgactgtggtgtttttgtcattcaattaatgtttaatatgcctgtagttgaatttatcaatcttttatttcattgcattgcattttgagtctttgctagagtttacccaaatgaggatgtaaataatttatccagatgttcttctatttctgtatgttacttttctattaagttagatttttaaaaattcatgtgaagtttattctgctatagagtatgttgttcacatccattttatgtcaagcctaatgagtatacagttttcctaacctcattcatttaaaaaagtctacctttttcaaacatttttgagatttcatccttattacctgccaaatatagatttatttctagactttcttttattgttacattgtgctgtggatatgagaaccagtatagactgatttcagatcacctagtgtatattttcatttctaattgggctaatcccgcttcatcgactttttttttttccaggatattcttagatgctttctcgctttatttctctctttcttctgttttttttgttttttgttttttgtttttttttttaagacagactctcactctgtcgaccaggctgtagtgcaatggcgtgatctcggctcactgcaacctccaacccccattcaaacaattctcatgtctcagcctcccccatagctgggatgacaggcggctgccaccacgcctggctaatttttgtatttttagtggagatggggtttcgccatgttggccaggctggtttcgaactcctgacctcaagtaatccacctgtcttggcctcccaaagtgctgggattacaggcattagccactgcacatggctagatatttttcccacaagttttattccagaaaagtatcttgtagtatttttattaggataggattcaactatattaacataggagaatttacatatttgtgatgtttatttgtagatcatggggtgcctttctattttttttcaagtacattttgtatgttctggagttttaaaaaaatgttattttaggtgctggggtacttgtacaggttgttatataggtaaacctgtgtcacgggggtttgctgtacagattatttcatcacccaggtactaagacaagtaaccaacagttatttttcctgatcctctccctcctgccaccgtccaccctttggtagtccccagtgtctgtcgttcccctctttgtgtccatgagttctcatcatttagctcccacctataagtgagaacatgtggtatttggtttttggttcctgcattagtttgctaaggatagtgtcctccagctccattcatgtttctgtaaaagacatgatctcattcttttatatggctgcatagtattccatggtgtatatgtactgcattttctttattaaatctgtcattgatgagcatttagtttgattctatgtctttgctattgtgaatactgctacaataaacatatgcatgcatatgcctttatggcagaatgatttatagttctttgggtatatatccagtaatgggattgctgggttgaatggtagttctgttttgagatctttgaggaatcagatcttccacaatggttgaactaataatttacactcccaccaacagtgtataagctttcctttttctccactaccttgccagcacctgttattttttgactttttattaatagccattttgactggtgtgagatggtatctcattgtggttttgatatgcacttctctaatgatcagtgatattgagctttttttcctatgctcattggacgcatgtatgtcttcttttgaaaagtgtctgttcatgtccactttycaatgggattgtttgcttttgtcttatagatttgtataagttccttatagatgctgactattagacttttgtcagaaaatatttgcataatttgcaaatatattcctcaattctgtaggttgtctgtttactctgttgataatttcttctgctgtgcagaagctcttagtttaagtagatcttatttgtcaatttttgcttttgttgcaattgccttcagtgtcttcgtcatgaaatctttgccccttcccacgtcctgaatggtattgcctaggtttcttccaaggtttttataattttaggtattacatttaagtctttaatctattttgagttgatatttgtatactgtgtaaggaaggggtccagtttcagtcttctgcacatgcctagcctgttatcccagcaccttttattgaatagggagtcctttccccattgcttgtttttgtcaactttgtcgaagatcagatgattgtagatgtgcggccttatttctgggctctctattctctattccattggtctgtgtgtctgtttttgtaccagtatcatgctgtttttgttaccatagtcctgtagtatagtttgaagtcaggtaatgtgatgcctccagctttgttctttttgtttataattgccttggctattcaggcctttttttggttccatatgaattttaaaatagtttttctagttctctgaaaaatgtcattggtagtttgatagaaataacattgagtctacaaattattactttgtgcagtgtgatcattgagcatggaatgttttcttcattagttcacatttattgatctgcatatgttgaaccaaccttgcatctcaggaataaagcattcttgattgtggtgggttagttttttgacgtgttgctggatttttgctggtattttgttgaggatttttgcatcaatgcttatgaaggatattggccggaagtcttcctttttgttgtgtctctgccaggttttggttcaggatgatgctggcctcatagattgagttgaagagggggcacctcctccacaattttttggaaaagtttcagtaggaaaggcaccagctcttctttgtgtgtctggtagaattcagctatgaatccgtctggtccagggcttttcttcttcttcttttttttttttttttggtaggcaatttattactgattcaattatagagctcattattggtctgtttagggattcagtttcttcatggttcagtcttagaaggttgtctgtgtccaggaatttatccatttcttttagattttctagtttgtttgcatagagttgttcataatagtctccgatgattctctgtatttctttcttttttttttttttttgtttgtttttgagacggagtcttgctgtgtcaccaggctggagtgcagtggtgcgatctgggcttactgcaacctccacctcccgggttcaagcaatactcctgcctcagcctcctgagtagctgggactacaggtgcgtgccaccatgccaggctcattttttggctcgttttttgtatttttagtagagacagggtttcaccatgttggccaggatggtctcgaactcgagacctcacgatcctcctgccttagcttcctaaagtgctgggattacaggygtgagccacagtgcccggccgattcttygtatttctatggagtcagtagtaatattcccctttctgtttctgatcgtgtttgcttggatcttctgtcttttcttttcattagtctagctagcagtttatcttattaatttttccaaaaaaaaaaaacagatcctgattttgttgatgttttgaatggtttttcrtgtctcagtcttcagttcagctctcactttagttatttcttgtcttctgctagctttggggtgggttttctcttgcttttctagttcctttaattgtaatgttaggttgtgagctggagatctttctaactttttgatgtaggcatttagtgctacaaatttccctcttaccactgctttagctatgtcccagagattatggtgtgttgtatgtttgtggtgggtgcaggactatgtgtgccctctgcatgtgttcatgctggcatggtggccgctcagggctgggggcaggtcactgttctgtgtgcctagtttagcactgatggcagtgttggcacaggggcaggatgctggcagaggtgaagcaggcaggtttcatgcctgccaatgctcctaggacaatggtggtgtggtggggagaagggtggtggggtaccctcatgcaggcagtagtggcatggcatagtgcagggttcatgtgcactgtcggggaagtaaaagcaagatccaacccaagggcacacataggcactggctaagtgatgtgggggggtgcctatggtgtgttcatgcaggcacagtggctgggggaggctgcagtgaggggaggacacagatggcctggtgtgtgtcttgggggccactctgcaggagcactctgcttatcaggtgcagtccacaagagcaggagctatgatgcagacacccacaggtacctgggggctgcactgcaagcaggcacggccaggctggggccccagaagaggccagtagactgagggttgcccaggtctaatcaaccccatctcagaggcaagaccgccctgcagagttcacgttcaacagttctcctatggctaaagtctcctatggaagcaagtcgagcttaaggtgatgggtgtccctggccatgctgcactacagacaatcccacaccaaaccctctgggctccaccctggctggagttctgatcctaccacttctctaagcagctttccctggcaactccaatgccatggtggttgaggaatttcatcctgccagtattccagaggcccaatgtgagartaggttgctgcttgcctgtaccttaatagaagttttttgtttgtttttgttttttgagacagagtttcactcttattgcccaggctggagtgcaatggcacaatctcrgctcactgcaacctccacctcccaggttcaagcaattctcctgcctcagcctcccgagtagctgggattacaggcatatgccaccacgcccagctaattttgtatttttagtagaaatggtgtttctctatgttggtcaggctgatcttgaacttccgacctcaggtgatctgtcctcctcggcctcccaaagtgctgggatttcaggcatgagccactgcgcccagccaagttttttttttgttttttgttttttttttaaacagactattttttaggttcacagcagaattgaataaaagttacagagatagcctccacaacacacacacacacacaaactcacacagcctttcccgttatcaacawcctccaccagagtgggtacatttgtttcaattggtgaacctacattgacacataatttttgcccaaaatctgtaccttacatcagggtgtattcttggttgtataatttatgagtttggacattaaacaccatcataatgtaatgaaagtagtttaactgccctaaaagccttctgtgttctgcctatacatcccctccctctaagccctggcaactgttgatctttattgtctccataatttgcctcttccagaatgtcatatagttggaatcatacagtatgtagccttttccgactggctttttttttcacttggtaatatgcatttaagtttcttccatgtctttttctggcttggcagcttttttttcatgcttgtgtcactgaataatatctattgtctggatgtaccacagtatatctatttattcacctaccaaaggagatcttggttccttccaatttttggcagttatgaataaagctgctataaatatatgtgcaggtttttatgtggacctggcatatttgaaagtttttctcagagaaatttagctcattttttccaaatttatttttaaataagttgttatttctattgcatttgtaaacagattattttcttttctctatattgactaagtgattattgtttgtgtatatgaagattagtaacttttgtatgttaatgttctaccttgttagttcctgaattaagaaaatactttatcttataaaacagttctaactgtttttcttttctttttttgagatggagtcttgctgtgtcacccaggctagaggacagtggtgtgatctcagctcactgcaacctctgcctcccagtttcaagcgattctcctgcctcagcctcccaagtagctgggattacaggcgtctgccactacgcccagctaattgtatttttattagagatggggtttcaccatgttggccaggctggtctcaaactcctgacctcgtgattcgcccgcctcggcctcccaaagtactggaattacaggcaaaacagttctagttttacagaataattgagaagatagaacatagcgttcccatatggcttatacccttattattaacatcttcattcatatagtacttttgttaaaaattaataagtgcacattgtaatattaagttcatgatttattcagacttctttagtatttatctcatgtccttttcctttcctagccctctatctaggatattacattgcgtttaatagtcatgcctccttagtcttttcttggctgtgacagttcttagactttccttgtttttgcgaacttgacagttttcaggaatacagataagagattttgtaggatgtcactttattggaatttgtgagtttgtccttatgattagtctgggaatatgtggttttgggaggaagaccagtgagaaaaagtaccatttttatcatatcatttcaagtattgatattaggtattgctgttgatgttgacattgatgacctggctgaggttgtagtatctacactataaagtttatttcccttttttttttttttttttttttgagacagagtcttgctctgtcgcccaggctggagtgcagtggcgcgatctcagctcactgcaagctccgcctcctgggttcacgccagtctcctgcctcagcttctcaagtagctgggactacaggygcccgccaccaagcctggctaatttttttgtatttttggtagagacggggtttcaccgtgttagccagcaggatggtctctatctcctgacctcgtgatccatccacctcggcctcccaaagtgctgggattacaggtgtgagccaccgcgcmcggccattttcccccttttctacactctaccctggacagaagtcactatgtagcccacagttaaggagtggaagttattttccgctccttgagggcaggctatataatactttggaattatttggaatttacttggaattgcttttcagggtatatttgtatatgttcttcaatttatttatatattcagtcatttatttctatcactatggacttatggatatttagtttatacattgggttagaattccatattgctttgtttattttactgctcaaattattccagatatggctattgacaactctttcagtgtgtacttgcagatttaaattttttagttcttccttattttttggcagtatctaatacttcaggttctttctatatatttccttcccagtcgtagaattagcatttctctaaggagccctggcccctttattggtgaatggtatcagaaaccaaaatctgagtgtcagccatgcttgttgctgctaaggtgtcatttcttttaggtgacagctgacagagcaagggaatatatgtgtgcatactaactaaggtaaatccacatgtccataaatgtttctacatctgtatctatatttagctaaacatgaatttatattctagccttcttcccttgttcatctataaacttctattctaacaatgaaaaacctgactcccatcaccatcatttgtttacctaactgtttaatttcagtacactagtataacattatgagaatcawtaacctgtacccttatggaaagtagctttatcaagtgcagcatattgcttactggtaattccttttgacttcagtcttatggattacattaattttcaaagtttattagatcagcaacttttccctctccataccccatacagtgagattatttgttacaatcagaacatgtgtaaataatgttgtcaaactttgcattctttcctaggatcctagccctcctaaatgattttttcaaaacttacataattgaggtttactctttgtgctgtaaatttctatggcttttgacaaaggtatgtcatgtatccaccattaatatatacaaaattgatttaccagtcaaaaaaggcctgygcttcacctattcaatcctcctcctctcrccttgaatcattggcagtctctcattgttttactgttcctctagttttgttcttttcaacatactgttcaattgggatcatatagtctgtagccttttcaggtgggattctttcacccagctataagcatttaaagttcatccaggtgttctcatagcttgatagttcatttctttatatttatgaagaatactccattctaagcatgaacatctctgtcttttaaatgatgctgcagacctttcacatttaaagtgattattagtatttctgttttctatgaattacctctgttgttttcatttcttttttcttttctaccttctctagttttaatcattgcatatggtttctattttgttttttattgtcagcatataacttatacttttcttaaaaaactgagtacttgccctagagtttgcaatatacatttacaattaggtccactttcataaaactgctttctgggtagtagggtcatctttcaatacagtattctcaattcctcccctcaactctttataatattgctatcattcatttaatttacctcaatgctacaatcatacaatatattgttactagtattattttgaacaaatgttacatattagatcaattaaaaataagaaaaaaagatttaattttaccttcatttagtgcttctctgatgttctttttttagatctaagtttctaacacatcatttcccttctcactgaagaacttcttttaatgtttcttgaagggcagatgtgctggtgatgaattttccaagatttgtttgtctgagaaagtttttatttcttcttcgtttttgaagaataattttgctgtgtgtagaaatgtagagttctttttcctaattgacaattcaaaaaatttactctactctcttatttggtgatatggtttggctgtgtcccctccaaaatctcatattaaattgtaactctcacaattcccatgtgtcatcggaggaacctagtgggaggtgatggaattaagagggtgggtcttttctgtgctgttctygtgatagtgaatgagtctcatgagatctgatggttttaaaaagaggagtttccctgcacaagctgtctctctttgcctgcctccatccatgtaagatgtgacgtgctcttccttgccttccttcatgattgtgaggcctccccagccatgtggaattgtaagtccattaaacctctttcttttgtaaattgccccatctcaagtatttcttcatcagcagtgtgaaaacagactaatacagtaaattggtaccagtacagtggggtgctgctgaaaagatacctgaaaatgtggaagtgactttggaactgggtaacaggaagaggttgaaatggtttggagggctcagaagaagacaggaaagtgtggaaaagtttagaacaccctatagacttgttgaatggcttttaccaaaatgctgataatgatatggacaatgaaatccaggctgaggtggtctcagatggagatgaggaacttgttgggaactggagcaaaggtgactyttgttatgttttagcaaagagactggcagcattttgcccctgccctagagagatttgtggaactttgaactttagagacataatttagggtatctggcagaagaaatttctaagcagcaaagcattcaagatgtgacttgggtgctgttaaaggcattcagttatataagagaagcagagcataaaagttcagaaaatgtgtagcctgacaatgcgatagaaaagaaaatcccattttctgaggagaaatgcaagccagctgcagaaatttgcgtaagtaatgaggagccaaatgttaagcaccaagacaatggggatratgtctccagggtatgtcagaggtcttcatgggagccccttccatcacaggcctggaggcctaggaggacaaagtggtttcgtgggccaggcccagggtccctgtgctgtatgcagcctaggaacttggtgccctgcctcccagctgctccagccatgaataaaggggcaaatgtcgagcttgggccatggcttcagaggttgcaagcctcaagccttgtcagcttccacatgatgttgagcctgccagtgcacagaggtcaagaatttgggtttgggtacctccacctagatttcagaggatatatggaaatgcctggctgtccaggcagaaatttattgcagggtggggatcccatggagaacctctgctaggacagtgcagaagggaaatgtggggtcagagcccctatacagagtccctactggggcactgtctagtggatctgtgagaagagggccaccatcctccagaccccagaatggtagatccactgacagtttacaccctgtgcctakaaaagccacactcaatgccagcccataaaagcagtcgagagggagcctgtaccctgcaaagccacagggacggagctgcccaagaccatgggaacccacctcttgcatcagcatgacccggatgcgagacatggagtcaaaggagatcattttggagctttaaggtttgacttccctgctggatttcacgcttgcatggtgcctgtagccccttcgttttggccaatttctcccatttggaattgctgtatttacccaatgcctgaacctccattgtttctaggaagtaactaacttgcctttgattttacaggatcataagcagaaggaaattgccttgtctcagatgagatgttggactgtggacttttgagtcatgctgaaatgagttaagacttttgtggactgctgggaaggcatgattggtttttaaatgtgaggactgagatttgggaggggctggggtggaattatatggtttggctgtgtccccaaccaaatctcgtcttgaattttaactcctcaattcccacatgtcatgggaggaacctggtgagagttgattgaattatggggccaggtttttcctgcactgttctcatgatagtaaatgagtctcacaagatctgatggttttaaaaagaggagttctccctgcacaagctctctctttgtctgctgccatccatgtaagatgtgacttgcttctcattgccttctgctatgattgtgaggcattcctagccatgtggaactgtaagtccattaaacatctttcttttgtaaattgcccagtctttggtatgtctttatcagcagtatgaaaatggtttacacatggtttctgattataagtatcctatcattcttatccttttttcactgacttcttcaagatgtctttggttttctgtagttgaatataatatgcttggctgtactttcttggtatttatcccgtttggtcttctctgaggttcatctatctatagtttgttatacatcatgaattgctgaaaacratcagccattatcatttcaatgtttcttttgcttcattttcttttttctttcttctattacatgyaatgtatgttacaccttttctaattgttccacactccttggatgctctttattaagtaattttttttctcttcacatttcaatttgggaagtaggtaatgacaaatttcaagctcactgattctcttctcagctgtgtctagtctactgatgtgcctatcaaaggcactcttcatttttgttacagtgattttgaatttttatatttccttttgatttttttcttagagttttcatctctctatttatattacccactaccttttgtttgttatctgtttttccattctagcctttattaagagtagtattttaaattctctgcctgataagtataacactggtgtcatgtttcaatctggttgtgtgggaagttgtcatttatgtgattaagtatttataacaaaaccatagcaatatgttttaatttgtaattggaaggaaaccatgaacatcttttgtaccagaaacaattttactggttgtctaagagcaaatattttaaaaagttggtaaacctcagcaactttttttttgagacagggtctcactctgtcacccaggctggacaggtggagtgcagtggtgtggtcttactgcaacctctttttccagggctcaagcgatctatccaactcagcctcacaagtagttgggaccacaggcatgtgccaccatgccttgctaattttttgtagagaggggtttcaccatgttgcccaggctgctcttgaactcttcacctcaagcaattcacttgccttggcatcccaaagtgctgagattacaggcatgaaccactgcacctggctacaacttttttcccacatgattattccaagttttgatctgttctaaaataccatgtgatttattaagctagtatatataagatagtgtgtgtgtgtgtgtatgtatgttgtattaaaaaaagaaactgaggaaatactgaggtggtgcaattttaaaagtctggagcttcttttgaaggaatacatagctaaaagaaataaagaaatacctatttctagctacaactagcagtgttttaaattaggtaaagagatttataagcaataacatttagtgattgttaacttccattataaattaacaaaattaggtcaaaggctaatagggatctttttcagtgaagaaacttgacataattttaactcttaatttctatgcttgagcttctgtgttgtacttagtctctcaaagaaataactcagggttctgatcactggtttgagagaaggctagtaggcaagatttttgtttcctagcttcagttgcattacatctccatttcatgttatgtatataggacacctgatttagattttacatggaaaaggacatcacggagagaagcttgaaatgtatgaaaaccattggccttcgcacctgggttattttcacagcttctgttgcatacttccatgtgcattaggggacaacaaggagtgcacaatcttcccattctgagtcacttcttgtgtcatttcagatctctcctgctttcttttcctctctttggactttcctttttgcctatacatgccttttaaagagaaaatagttttcagtttttaaaacttatttaaactttcactgtctgggtacaacctagcttctctaaaagttacttcttagtgttttcaattatctaacaaaacaaaatgtgagtgaaagtaaaaaagcaataatatttttaaatttcttaattgtgttagcagctgttctccaatttataatcatattatttataatcataatgctttaaaaattttcayataacttactactgcaaacttcacagtgccttgagatacaataaatccattttgcagaataaggaatctagactctaaaagttaacaaaaaaagacataattaaggtcacctagtcagtagataactggaccaggacaaattttctacattatttatttaatgtaattctaacagtattaactagacagtatacttaatatttattgacataagtcagaatgacatgayagctaatatttactgarcatttattgtgttcttggcactatattcagtactttacattactgtcatatattcctcacaacaaccctataagataggtacatcacaattgaaggaatttaatatgattaatgctacacaacttcttatccatggtttatcataatttaaaattaattatttgaatgtgcatggtatcaacttatcttctacactaccatcttagaaaagaaaaaagagaaggaagataaaatttttagtgagaacctactgtgtgctctgagctgagttataaaactagtttcacacgagaatgaaaagtgtgccttacatagtgtatattcagagttgaatccacatccttctccattgaccatacaaagtttacaatgagaaagaggtaaaatatagaacataaagaaggcagagacagctatctttattttwcaatatatgaaaccagatgccaaataagttttccagagtaacagaataaataaatattagacaggaaagccctttgataccacatgggctctttattggttcctcatcagcaactaccacagtatctggcatattaatgagtgcttatttaataaaaaaaattgattgaatacatgaacgaatgaaaaacaagaatgagaacctaattatcctgtctttttacctaagaatgactgaatttaccccttactcagttcaatatataatataagttatcttattttttcattatacaaataatccatagttaaagcctaaaaaagctttacaattacacagcctaatcccctaggagggatcaaaaagtgataaaacagcatgaggagtaaaaaatatatgtatacatttgtctgcaagatcctagaaaatcttgaagagtactctgctgttcactttagcactaagctataacaatttgtaaacattagagtgagagagagtaataggaacagcttgtagggtgtctagcaaaacaaaccaaactgaacactttgtaattaaatttaacaatttcatcttacaaataatactgtatgttgatagaaaaatgtgaacactgtttcaatattcatgaagttttgaataaaacagtacacagaacttgggcaatgttacattagcttcataatggtggtatcctcatctaatttatgacagtcccaccatacctagcatactgtacttcatacatagtaggtaatccatgaatacctgctgaatgtaatctgtatctatttaaaagttctctgttttaaaatttaataaaaatcaatgttttatatctttaaatttaaaaagaatagtgtggctgggcatggtggctcacccctgtaatcccagcattttgagagacagaggcaggattgcttgagcccaggagttcgaggtcagcctgagcaacatagggagaccctgtctctcttaaaaaatagtaataataaatataaatataaaaagaatagtgtgacacacaaacacagtcattgcggttaattcaattaaaccaagctgatgcttggttcaattaaaccaagtagatagaatatggcatgctttttcatcttgccacattgataacagtgatccttttccaaagtagatcagctctctcattgtaaaactaattttaaaacaaagtcacctttacagagacaaatgattattactggtttctgcatagtggatgagatctgcagggagaaaaagttctaagacagaacaatgttagaaaaaacattgttgacatactaaattactttgaataggtggaaagataagaatataaggtgacggttagaagggaagaaaagattattccaaaagagaggacagagcatagctaaagagtgcctgggacttatttcggtcatgttgtaaaaagaatgattgattttaagaatagtatatgttattattagttttctttagcatataccttcagggttgtaatcagatggtactaatcttgttcatcaagagatagcttgagtaggttttgaaaacaacatttcaatctatatatgcatggcttggccctggtgacgtctaagactactggataaatccaaagggagtagtaacagagagggaggttcctaaaaaaaaataggacaaagcaaagacataaggaaagctgatgaaatccagtagatgccacctgtacttattacaatgattatttgtaattgctttattattacttaactctggtatatttttaaataaactatagtcaaattagtcgtatataagaggaagtataggtgcataattttcttaaatcctccatgtttaactaaaagttggtccatgccaattcagtcagacataatcaaacatctgacggtaactctcccaggttacacagcatggtggtccctcagctgtggtctctctcttgggctgctttagaaggcgggcagggccagtggcctgatgatccagacttcacactgtatatccacacacaccagctccgtggtgttatggcttacttaggatagctccatagtactcttatatagttgtcaataatattggcattctataattttattaaaaatggttttactacttaaattacttttgaaaaccattgacttaaatgaaacttgctttgatatttcataaacactataaagtgataggagaatcacatttgctgccatattgccagccttattagtggtcctttcacattcacatccatatagaaaagcctacatttggtagcatgcttactaaaagctgcaatgtttcttgatctctaagttcctctggtgagaggactcatgaacaaggtgtctctcaactgaagctcatctttcattactcaacaacaaaatatgtggtcccctgctgcaaaatcaagttcattttttaaaatagaaaataagtgtgtatattaattgattaaaaatgatcttgtagcattactacttcttttatgtatttattcaacagaacttcagctatactatattatattagtagcatatataatatagtattttgccaaacaatgttacactatgtaataagagttcatataggcatttcacatttttgacagcattgaggcataacatttaataaaatgcacatttaaaatatacaatttaatatgttttattggcttatgtataaaaccccaaggctatcaccataatcaagataaggaacccatatatcaaacccaaaagcttactcataccccttcacaatctgttcactcctcccaccaactctcaaataaccacagatctgatttctgccactacagattgactggcaagttttagaatgttatataaatggaatcatgcagtgatatggtttggctstgtatccccacccaaatttcatgttgaattgtaatccacatgtgttggaggaggggcctgggggggtggtgattgaatcgtgtgtgcggacttcccccttgctgttctcgtgatagtgaatgagttctcaccagatctggttgtttaaaagtgtgcagcgcttcccccttggctctgtctctcctgctccatgtgaagatgtgcttgcttcccctttaccttccaccatgattgtaaggttcctgaggcctccccagccatgcctcttacacagcctgtggaattgtgwgtcgattaaacatcttttcttcataaattacccagtctcaggtagttcttcatagcagtgtgagagcagactaatacatacagtatgtgtttttatttagcttcttttactcagtataattatttttagatccataaatattgttgctttaatcaaatttattcctttttattactgaatcatatttcattaaatgggcataccatttgttaaataattcatctgttgattaagatttragttgttctcactactgggatattacaaataaatctgctataaatatttgtatacaagtctgtgtgaatatgtgtttctattcctctttggtaaatactaacaagtagaatgactagattctatggtgtgtatatatttaatatttaatatgttaagaaatacatggacattttaaaaaaaacaattctccacattaagtttgtttcctcatttgtcctaattcctttggtcaggacaagtctgtgtagaaacagcacaatgcatttgccatgagctagtttcacagccacttatatctgactacatcttatacaatgatgtattcacttgcctctacaaataggccttttagttttggaacttaaaaatctctttaaatacagagcataattcttccttaggtgttgtccaaatatttgttttgtcgcattctagttttctattttatatataagctgccaacttaagctactttaatttagcagtgtagggaattcttatgtcccataaagcaaacttcaatccagtaaccttgaataatatgtccaaaagtctaatatagatctgaattactgtcttatggagcaacacccccctacagtaatgtgtaatttctttcatatttttttttgaccagtgaaataggagtgtcagttttggccgtcctgcttatccttacttarcatccgtgkctggaacacagcaggcagttttttgctttattactgtgcctaggattactttgcaaatgtwaccagatgaatttggttaggattgktgatactatacctggcagcttaacgatttctgaaagtaaaagacatcgtgtcagtttatatctctatctctatctctatctctatctctatctctatctctatctctatctwtctatctatctatcatctatctatctrtctatctatctatctatctatctatctatctatcatctatctatctatctatattccccattgggaagtcaaaccacaacatctctttccctcaaaatctttgttatggaaaacttttgtaaaaccactttccaagacactgaaaatgtaatacctaaaataatgaagtaacagcttttacgcatccacagaacaaaaaagaccatacaaaacagggaaatagcatgggacctggtaagggacacttctctgtatctgctgtcaccaccccctttaatgtttgctctgataataaagacatacactgcaattttcctcttgtcaatcgaaagattttttctgtgtccacatcagcttcaaatatcatgcaacgttgatagacctattgcaaggtgacaaggccagctatactaccccactgcagattttgcaatcttgtcctttttgtattgctgacacgtccttgaaatggtacgttcaaccttaagcagattttcctataacactcattgcttgttttttttccttatgataaaagatagaaaaatgttttgtaacaacttagagacaaatcaactaaaagaggaaaagtcacttataatattctacaacccatagatgataattaataaaatatgttgatatattttcttttactttttctttttctttttttttttgagatggagcctcactctgtcgctgaggctggagtgcagtggggtgatcttggctcatggcaacctctgcctcctgggttcaagtgattctcctgcttcagcctcccgagaagctgggattwcaggcacgtgccaccacgcccaactratttttgtatttttagtagagacggggtttcaccatggtggccaggatggtctcgatctcttgacctcgtgatctgcctgcttccgcctcccaaagtgctgggattacagatgtgagccacygtacccaaccratatatatatatttttcattttattttcctctttctcacacacatacacggacaatatgagttttaaataattagactatatatatatacatatatgcacacatatatacacatatatacatatacgcacatatatacacatatatacatatatacacatatatacatacgaatatacacaaatatacatatatacacatatacatatatacacacatatatacacacacacacatatatatacagatattcagttaacaatatttcaagtgcattttctctgctattagacattctctgaaactcttattttaatatctatagaatagcatttttggaaaagaaaaatgaacaaattttaagttagactcccttttactgtctagtctaaggataagataaaaaaaatcacatatgtagagtttatttggctatagagtttgatgaaaaaggtgagattttcctcactaaaataaattggaataggtctgatattcatggcaccggtgttctgatttttgatccgacattcagacataagagttgaaggtcagggtgtgtttctagccatctgctgctactgttgctactactgctgccaccaccatttttagcattccccccactactgctcttattattattgcatggtttcaaccacctccccccatagatcaagaagagtaatggtattgccacaattgtcaatggcatcagcaattgctgtgcgtgaagaaccctcacatcatcctacatagtcctgcataaaggaagtttaaaaagctgtttctaatttcctgagaagttaacaatctataagagatttgtgatctaaaattgtattcagcatgttgaataaaggatatgctgacaatwcaaagttttctgaaatagatattcattatctttcctgataccttgctaaacctatcataaaattctaaagttaataaaaatgactgaaattttataaataattagtccaatcttttcatgtaccactgaggaagctgtgttctcaacaagttaagttcttgttttaggtcacaagatattaagggcagcgtttgaccttgaatctggatagtcaatcctagatattatgttctaccatagttccagccttatgttgtaakaagttttgcaagtcacttaccatagattttctgttcctaatttggaaataggatataaactcacagctctgtctcagagcatgtttagtaggtgtgcttattcgtagagcttaattcaaacaattaaagaaaaaagaataacttaggaacatcttgcaggtccactgacacacttctatgcatgctataggtgaaaattgaattcatctcaagcttagtataacttagagccagagtaccactaatcatcatggacatgaaaaaaaaaatacaatgagatatcacttcacacttcttaggatacctattatcaacagccacagaaaagataagtgttggtgagtatatgaagaaattggagccctagtactctgttggtgggaatgtagaatggtacaactgctttaaaaaatagtatggaggtttctcaaaattaaaaacagaactactatatgatccagcaatcctacttctggttatatgtcccaaagaattgaaatcaggatctcaaagagatatctggactcccatgtttatttcggcattattcacgatagccaagatgtgaaaacaatctaagtgttcattgacagatgaaagggtaactaaaatgtgataaacttgtaagatggaatacaattcaaccttaaaaaaaaaggagatcagtcatatgcaacgacaagtgtgaaccttggggacattattctaagtgaagtaagccattagcagaaaggcaaatactgcatgatttgccttatatgaggtaactaatgtttttacactcctagaaaccatgagcagaatggtagttgtcaagctgaggggaggggaaatgaggagttgctgctccaaagttatgaaatttcaattatgcaagataaataaataaagatcctactatatatacagcattgtacctataattggcaatactatgttattcacttaaaaatttgttaagggtagatttcatattaaatgttaatacaatactgataataatagtgtaaagaaaaataataacaaaatagagggatgctaatggttcctggaggcagttttgaattatattttaaaagattgtaagaagaaaagtcaccaattcttgattttgacaaatagagacatacatcttatttgcatcttcatttattcttctgttgcattaactcaataaaatatgtatttactgagtactgactgtgtgccaggcaccgttagacacttgggttataaaactgagaataatactagatgccttctccctctggtggctataacagaaagatatgtgtattcaggagattaaccctattttgaattgatgtgatgaattagagtggactatgtttcaatcaactgaactcaacagatttaccgaatcttcactagcgttgagatctctcagtgttgaggaggtgtttgatccagcctaatgtttgtcayagccttattatgttttcagtttaagcatcaattcataaaaactgaaaattcaaaggatttacaaaaattatcagttttacttacttctcatcttcattttaaaggtcaaggaatttaagcataggaaaagtctgagattggcctaacaaaaaacaactagtttagttaggacacccaagtatcctaacttcaagttccattaatatcccaccgtaacacaagcctaccagctttctggcgatataagaaatatcttcccagtttttcctcaggtgctttacactcrttcctctcttctgcctgacacatcccaggaaattttttcatctctaaccactcaacttcagtctcaaatcatataactctatggaatatctttcatctccatctaatattcttaccctttatctctcttgagggcaaggattgtgttttatttccttcaagattcccagtatctagcataattgttcctgtctacatacggccatgccgtgcatgacaatgtttcattcagtgatggactgcatataggataatggtcccctaagaaggctataatggaactgaaaaattcctatcacctaatgacattgtattatttgttctcacatycctataaagcactacctaagactgggtaatttataaataaaagagacttaattggcacacagttccacaggctgtacaggaagcatggctggaggggcctcaggaaacttacaatcatggcagaaggtgaaggggaagcaggcacatctacagggcaggaggtggaagaaaagagccaaggaggagatgctgcacacttttaaatagatctcatggaaactcactcactatcatgagaagagcaaggaggaaatctgcccccgtgatccaatcacctcctaccaggtccctccctcagcactgtggataacaattcgacatgagattttgtccggagcacaaatccaaaccatattagatgccatagccatcttaacatcgtgacacaacaccttaccttttctatgtttaaatatgtttagatacacaaatatttaccactgtgttacagttgcctatagtattcagtacagtaacatgccatacaggtttgtagcctaggagcaatgggttataccatacagcctaggtgtgtagtaggttataccatctaggtttgtttaaatatactctatgatacttgcacagtgacaaattcatataatgacacatttctcaggatgtgtcctgattgttaagcaacatgactgtatatgtaagacaatcgaatatgttagttgagttaacttgagttgattatataatcaagcaaacttagattagcactggatatctttagataatctcattatgaataaaagataaaaacaagatcagcagaatgaaagcagcttattaaattctggtattaagatgacaaacaaatgatagaatttcctttttttaaaggctaaatagtatttcactgagtgtatatgtttgtgtgtgtatatatagagagagggagagctcacagtttctttattcattcatccaatgaaagacacctaggttgcttccatctcttagctattgtgaacatggaagtgcagatatctcttaggcatattgatttgaattttttttttttttttttttttagacagagtctcattctgtcacccaggctgcagtgcagtggcatgatattggctcactgcaacctccrcctcccaggttcaaatgattcccttgcctcagcctccctagtagctgggattacaggcacacgccaccacacccgtctaattttttgtatttttagtagagacggggtttcaccatgttggccaggctggtcttgaactcttgacctcaggtgatccaccctcctttgcctcccaaagttctgggattacaggcatgagccactgtgcccagacccttttgaatattgttttcaccacaaaaaaatgatacatgagtgaagagatagatttgttaattagaatttaatcatttcataatgttaatatatactgttgtaaacatcacagtatgctacataaatatataatatatacaattatcaattaaaaatttaaaaaacaaattttaaaaaaggctgcaagcaagtttgtagttttttttttttgtactttaagttttaggttacatgtgcacaacgtgtaggtttgttacatatgtatacatgtgccatgttggtgtgctgcacctattaactcattttcatacattttctgatatcttcttccagtagtctggttaagactaaaatgtcttctctcttttgtcttgtaaacataatgttattatatgggatatgactttcagtttacatacttatttgcaagtaaatttatttttaacttggctcatgggaaatttaaatatagtcattcttgggccttcccttactcctgctacctatgttgggccaagtgagccaaaattcttgagcaatggttctcaagtgggtgattcctaagcctccaaatttccaggggatattcggtaatgtctggaaacatatttaattatatctcatgacttgagagggtccaaatgtgtgtggtagatagaagctagggttggtgctaaacttcttacaatacacaaaacagattctcacaactggaattattcagatcaagacgtcaacaatgctaagactgagaaacacttctcttgaggctaagtctgtctctggaggcttgggctgcatcaagatgtcagggagtctcaccraccctgtcatttacccacactggttgccaatgagacatccattgtcccagcccatgtaaccctttcaggtctaccactgtttccatgacaagtttgtggcacggggctrtggtgagatttgaaacactgktctgggcttactggatgacattttctctgaagtcttttttatccatattggattgtcaaggagtagggcaagttagtactgattatggaatcataaactttttagtcctccacatctgagaatctcttctgagcttatggaaaacctttctctacacaaaatctcatctctagtttccataggatttttttaaaattcaagaatatttgcatatacttttctttaggcaaggaattattgattcaatacttattaaaagacagaaggcaaagsattatacattctccacagctcaaaaatgttcccatgattttcttgtgaaattgatcaataacaaaagcttgtcagtaattaaattgtttgctcctttattcagctaagaaatagaaaaattgagacatactatgtgccatttcatgagtggaaaacaagacaaacaacatccctattttcatgtaagttaagttctagtagggataaaataaaaaatgtaacccacctgccaaaaaarggaaaaaaatgaagaraaaatataattttaggtgaaaatcatgaaaaaggacctaaagaaaatatatacactaatataagaaataaatgaaatggggaaaagggttaactttagttagactggccaggggagacttctctgagtagagagcatctgagctcccatgccgagaaggatccagtctgcaagaaggggtaaatagaaagacacaaagagtcttaagtggaaagtgctgacaagtgggacatgtttgaggaggagaaaaggggtcagtgtaacagaaatgtcactgatttcttgaatatttataaggtagagtgccagtctcatggtcaaaggtgtggggcaggaacttcagtgtttgtttgtgtgtgtgtgttaaacaagggccatgtcttaattttctttattttggcattgtgtcattgatatatttttattttttaaatgtattttaattgtgatctctccattttgacattgcaaaatcatcctacgttactacctcagctggaatgaaatcattgaacatgtgacgttagtctcctgcttgggatggacattcatagcatgtttcctaagagcttctctgagtgcgagaccactcctgacattactgtggtggttatttgattttagtaagtcagtgaaagctagccagtgaattatatttttaataagtcatgtgtatggtttagaattcaaacataattctgagaagaagccaagcatgactcytgttttccacagtatttttaatactttttatttcttttttattttcttcctgtgtttttttctctcttctttaaaatttagcaaccacaaatttcttttttgtattttaatattaaatatttataaagtctgcgcaagtgaatttttaattgtaataatgccacctgtttcattagggatcctgaaaggattagtgagataatgtctatagaaaggattgaactccttgtgggaaaaaggatatatatatgaaatgtattgtgaccctgaagtcttaatgtattactactatgtcattgctgtcctggcttctatgtaaacacctcagcctgaatgttttcagcttcaacttctatatttgtttttggcttcttttgcttgaatcaagtgagatagcaacagtaatgataatctataatattcataaacaatattaataattcagtatttcccagtcaccgaataatgttctagtccgtcatcttgttttatctttacaataaccctaaaaattaggtagtatttgtgctattttacaggtgaagaaactaagcctattccaaatcacttttgggctgcctaaggaagacaccataataagccagaggtaaaataggaaaatatgaaatatatctccacaattctgatatgagaaataacgttaatgtctgcattgattaacactttttctgaaaaaatgggctctcttcatctttgtctggtttagagacagcccagcttaaagaagacaaattatttccatcatccctgagaatcatgctagagtgaatctttgctgaggccagtttaagagataatttcgctgttagacatgattaaagtccaattaaaagagatctcttacatggattttagaaggaagcagtgcatgggtaattatattaaaccctgtttagcacaatgacattagataatcaaactcaggtaactgtaactagaggcaactagtaaatgtaccatgtcaacccaaaataatgtctgtgtagaatctaaaggacagaracattggtggcttatccaaagttccaaatcaaaaataaatttggattatactggattaaaattattaaatttggaataaaggtgattaaaatttggataaatttacataaatgtttaataaaaatataaaggtgtatattgggatgaggtataaggtagtggagaaagaagaggaaaagcaacaaacagaaataaacttttgccacaatccagctaggtctgtgggctaagctcttacccaaagcatcttagtgtaaytgagcctcacaacaacttttgggattaggtattattatccgaattttattctgagggaaacaaactttaaaagagaacacatattgcccataatcactcattagaggaccagaactcaaattcaggtctgcattactcaatattatagggcctttctaatatataacactgcctctaagatagttaatctttcacagaatgaaattgattagaaacacacacacacacacacacacacacacacacacacacaaacacacacacacacaaaacttccagatgtttaccagataggtagaagcagacaattttaagaaggcatgatctagggtactctatcatccctcctttcccaccccatttttttttctttttttttttttgagatggagtttcactcttgttgcccaggctggagtgcaatggcgcgatctcggctcgctgcaacctccgccgcctggattcaagcaattctcctgcctcagcctcccgagcagctggggttacaggcatgtgccaccacgcccagctaattttgtatttttagtagagacggggtttctccatgttggtcaggctggtctcgaacatctgactcaggtgatccacccgccttggcctcccaaagtgctgggatatttgctgtttctattatttgtgtttagtgctgaaggagttaatgtattgccctcaaaattattagagtactcctttctctttcttagtttccacttaaactgtagcattttgtatttaactatttattttcacaataccatccaacaccatgccttacagaatgtgaaatgctgccagcaagtgttttgaacacttccccactgattttgttcatgaaaagaagaggtcagtttttgtagctttgcaagaaaactattaatcctgtgttaaacacaaagaaaaacacagaagtatgtgggtgtaaatggtaggcttatctcttcgtacagcatccccaacaaaaatggcacttgtgacttctgatagcagcaattgttcttagtttgttactttatttgggggttgaataaactataggagtggatgatgaagttatttgtcattgcatgataggatataacccaagtaataaacagcagacatttataaggaatagatcacagtagggacaccagacagccttcagttgcaaaacaacagggcacaagaaagagaatttgattaactgaatttgttcaaatgttatagggcytggtgatataacaaggagggaaattgcaaagatgctttctcaagaatrctgtgacaagaatgcacaaaaaggctaataatgcgatatatgattgtatagaaattacatcgtaatgaacttgtgctattaatacctaagaagaaagaataaattgtcctragataatagctgcatgtagttgcagcaaagaaggattgcaaagagatcaacacggagataaaaaatagcacattgaaggctttggcgagaggggggatgttaatatctgataggaattggttgaaataaatgcaaaatgctcttctgcaaagggatgggtattgctcagtgcaagtgtgtgagaacaaagaaagtgctgtttaaagatctatgagatgagaaagaatctgaagccattaatgaataggaaattggtagttttgctatataatatgagctaatcatcaaatgtccccatctctggagtgctcccaagggatgaaaggctattggcagccctgacaataaacagaatgtctgtgtgtaaagcaacgtttaaggcaaaccagagctagtctaaggagatgggctctgcccatttccagtcttcagcagccatatgtgcatgaaagatgcaggcccaaggacatcttctacttcgtttttggttgttttctatgaaacctaaatacttattttctgggtttgtcaccaggattttgtagcaaaggaatcatacagagtggaataatggacattggagactcagaagcagggaggatgggagagagattaggaatgaaaagctacatattgggcacaatgtgtactacttggatgaagagctcactaaaatctcagacttcacattcatgcatttcatctgtgtaaccaaaacccacttgtatccccaaagctattgaaataaaaaaaatatattaagttgagaccttgtgcactaaaacaaatactaggctaattcttgttaagcactttgacmtgtatttgcaaaaatgacaaggaagacatgtccctgcctcacagaatagacaattcaacaattagctgcctaattcagcgatgatatattaaagtataatgatcattatggcagataaagtagagggggctaggaaacacttggcagggaatccagcccagtctagaggattcctgagcaagacacctccctgagaaagaggcatttaagctgaaattgaaagaaggaatggaagttagctaactctttataatagacactgaatttcaagttgaattatttattaagtccctaaaattttaatttcttgataatttctggtggcattttgatgatatatgattttaatgatgattatctaatgcatttatcaactgtaagcatcttggtttgcagtaaccacatagtgggtagccaaattgctattcactgaaataaaattttccctgtgatcatttttttgctttctttttctctcacaatttattgggatataattcatataccataaaactcaccattttgaagtatgaaactcagtgttttttagtatattcagaagggtttgtgatcattcctactatctaactgcagaacattgttatcatctcaaagagaaaccacatacccatcagctgtcattgcccatttcccctttcccctagcacctagcaaacactaattaaatctctattgctatagatttgccaattgcagacatttcatgtaaacaggatcatacaatatgtggccttttgtggctggctcccttcacttaggatgatgttttcaaggttcacctgtgttgtggtgtgtatcagtattttgctcctttttatggccaaattatattccattgtacacatgcaccacattttgtttatccattcatcagtaagcatacatttggtttccatttgttagctatcatgactgatgctcctgtgaacatttgtgtatacgtatttgtgtggacatatgccttcctttctcttgagtatataactgggagtgaaattgctgggtcatatggtaactttatgattacccttttaaggtactgccgcgttgttttccaaagaagaaatgcttttacattcccactagcaatgttttgctttctttttatagaccccagaggaactggaggatgtttctgaccttgaagaggaacacgaggtccgcagtcacaccagcattcagaccgaagggaaaactgatagggtatgtcacttcaactggtgggagaaccatgtactgtgtcactgaaggctgtgccctccctttgtcaatctaggcagcctctaatgggtgggactcctggatctggagctagttctgtgaagcacatggagaaaagccttagcattaagggaaaccacatgaggggaattattttcctctatcttgagagctcacagtaagtccatttcaggtcatgtagtgaatcactccatactgcttttgatctttataggagtcatgggaatataaaagtgaaatatgtacatgtttgcttagactagaaaaaagaaacgaagaagttgtaaatatactcgggaattctagtggagaagaaaactcgtctgagtcaataatctacttttctttctctacaataacttctcctgtgcctgcccccaaacacacacacacacaccccaccaccaccaccaccactgccaccaccaccacacaactccaaatatgttattctaatttctgaattactctgagatattgtacttcactttactcccacccagtgcctgggtatctgtgaaagtttggcatcctagccacttatcgcttgcaactacagaccagacaacaaaccttggatctgaaacccacgtagtacagcacagtgcctaagccttcctgggaatgcatgtgcatctgccacctccttctggagtgttacttgggaaagtcaattagcttctctgtacctcagttccctcatttgtaaagcagagatactaatagtatccttcatatgaggattactgtgggaattaactgagtcaactaacagaccacttatatagtgcctagttcatagtaacttctcaataactgttagttactatcattcatagtagtaatagcagcagcaacaatagtaggattatcatgatcatcattattaatattattattaagttagttaaattcggtgacataaaatttggagatggaagcaaattcctaacctttccctctgttttctggcctcttatggttgtatctgatgttgaagcacttatattgaaaggctggcgcatactctgtttttgtagacatattgttatacaagctctgcagaaacatttcaagcaaagacccgtttggttaactccatgtcacaatgagtgttagtgcacatttccttaaaaaaaatgttgatattcctcacatgttttgatattctattgtaatctatggcttgtggaaactgatttgaagaagaaaaaacaactttagtccttaccaaattttacctagaatcctytggatttctattccctaagaatgtaatataagataaatacactgaaaaatatctaattttaaacagatgcagagagtcacattctgtttctactattctttttgattgcctttttaaaatcccacaacatattatgtaaaatattttgtttgtttatctactttgacatatgtgaaatgaatgtttaaaaagctatctcattagagcttaactatatctttttattaacaataatatcttgcatctacatatttgtttttacagtgcgctaagtattttctcatttactataaaatacagaaaatatggtaaaacataatatgggaaaagataaatttgggaaagttccatgttttcagacattcagattgcctagaaataatatatatcagccaagaaaataaaacctgtgttttatcagaaacattgcttatctcaaattttggtaataggaatatttcatttcagtggagaaaaaatgttctttgagtagacaccattatcacatagccagacagatagtatttggtaatatattgggaaatgctactttcttgagtttccatttcttacagattatttgggttatttgtcagccctctactagccaatttgtgttgaaaactgtctagggtcacacagcatctggatttagtttccttcaaatctagttggcatcattggtagagatcacatcttatgaatggaaattgaattggaaatacattttgctaaaagtaagctttgctcttgctttcagggaagtgggtgcgtggttcactcaggctgatgccactgaaggtaaagtgtaggtgtcaaggcttgcaaagtaattgaccaaaggaaattttgttaaaattaaggctctttttagaatgctggaattaggataaacacacctcagtttttattctggcttagcacttgtagacgatgaagacttggttagaaaaccaaatttattcatttgaaaaatgagatgaataataccatagtttctcacagcatcactggtaacttcaaataagataatgcatatggaagtgtttcaaaaatttccacattatatacgatggtaaacttcttattactactattttcatttgtatttttgttcttggtccaaagtataggccaggccagctagatgactggctgcccattataggttacaaacttgatgatctctatgattctgaatcttaagaatttttcatagaagccactgcttctaatgttgtggaaactaccctgaaactgctctgcatcttgcattagtgttctgctgcgtacagttctcrgacaatccagttcattcggaatgccgctgggtgaaaacctcaccactgtttagtgacaagatagatccctgaccacgaaatctactggtggcaacattatattcaacctggctactctctgctcttataaatatcctctgcataaatcccaaataattggattttattcacttcctgcattggggctccctagcaactactatgtggaatccctctgataactgctcagtcatgataatacatatacaacctyatatgaggcacgaaccccacatagagcaactcttgaccaataaccctattctgtttctaagatggacaatttggaaatgcattttccacagaacctgaaagggtccccagtaggatcaagtagtaaccatgttgatactgtgtctttagactggctctcctttctttcctgattcgttcttcccaggctcccagttccgtttactaatatctatttccaaaacaaactaccttccaatctcagactctgcttattggaagaaaataataaaagaaaattactccatatatattatttacttaatttttacattaaatttgctatattaatattattccagttttactaataagatcactaaggctcaaatttatgtaacttgtgtagtaagaggattatgtcttcagactcagaccttctgtgattgccacatgtcagtttacttaggaaataaagttatgataagtcctttactaaaaaacaaacagatagaccaccaccagagcaataaacctgatgtatcattaatggaatgagaaagaggacagagcaaaggatgtcacagctgtctgacaaggggaagacacaaattttcctttaaattttgaagagaaattattttatattgtagataatttggtaccaataacaccccttacattatatctgccttgtgagtttattacaacagattctactctcataagttaagtttatgagacagatggccaaggaaaaggatagctcagatttggtccccacccaaatcacccaacaagaaccaacattatatttagataggttttacaatatctaccagacatctcgtattcttgagtcccatattctttatactaatatctgtgttccatactccttataataataaaatgacatttatatcttcaatctcttatccatctgagacattattgtcacattctagctgtaattgctgtaatttcatatccattgcactgagtgtaacttttggcacatttcacacacactctcactttgagaagatactataagatattgaaggagattctgttgagaagtctttaaatactcatgccatgctcagtgtggaatttggggtcacagcacaagatgagtaaatggatttcttttttgttgttgctgtttctaaagagtaaatgcctttttagttcttggatcatgcagactctgctgtattgcacatgcgctagaaccaggcactgtttagtaatggagtgacagttatttattatcattttactttctgtattcattcctactagcttcagctcaacatcatttattattgttgtcaccagtggcaaatgccagtaggcattgtaaaggtctgtaactaacatataatgatttagagtctgtggtcaatgagaacaaaatattaaaagaccaataatgcatgacttacgaagtgacaatggaaatagcagtggaaatcagtaattatcttaattgttaaacatgaatactcactggaccaatacgtggttatatccagtgatcaggcgtaccggagtgacacaggagtttgagtttgattcgggttcatagaacattcttcacagagctcattgtttattctgttcatgctttcagccagaataaaataggcatcttttatctgaaaaactcaaattcaaaagagacatgaaaatacaccttttaaaagagaataaaatttctaaacttattaataagatgtttgtaagtcctaaaagcttcctaaaatgttatatgacatacagactaaatcatattttctatttaaacagagcagtgcctgatactgtttaacacatcatagtttacagaacattttcaaattggtagcttatttataaaaagccctggagcttattttttgttatcttttccgtttggttttactaattaggaaatgaaacaaaaaatttaagtagtttatgcaagccatattaactgggaccaaatcgcaggtcttttggcctcaaacatgttctctttccagtacagcacacttgtaaactggaatagtctcatcatcccttaatattgtcattgatctactattgcaacagccagcattatagagtcaatattataaattgctgtactagaaagatggtttgttaaactgaagaccacaaaccttaaaatyagatgtatttaaaccttgcaaatttctacacgtccccatcctacaatcttctatcaatagcaaaattggcttgttgattaccatttagaaactacctggtaatgcccagaccctgaaagtctctcttggtgggtcacttcaccttgatgaagtggagtattgggcaagtagggtcatatagcaggggatcctgcagggtgaggatccaaagttagttcccaccacggaatccagaagagcaaaggcagttgctccttagtcattgtctcatcacattggcctgtgtgatgtttcaataaaacgagaattctaatttctagaagtttttcctgttttattttctgcaataggggcagcagtcgtagtagagacttaggaaattatttaagttgcagcagggtggcagctgaacgttcctcaaacttacctgagtaataactgtgggtttaaaaaggctcttcataaaattgattgaaagagagtttggggaatagaataggtgagcaaatgacttgccttttatagaactactgtaatgtataagtcaagagaatggactttggagtcacataaaccttgactcaaatctcagttccaccaattactgtccatatgaccttcataaagttacatttctaactttcaattttcttatctgtaaaatcatgatgatgataataataatatctattttataggtgtttttgaagattcaattagatatgtgaaaattcttgtttggtttctggcacataggaagtgaacaataaattttgatttttataaaatgaatctcatgaaaaatgcagatctttgtgtgctcctgatgtgctttgactttttattgagtagctcagggagctttgtaaatacaaatctctctgactcctgatatgggamtacttggtttcctgtttcatggtactaagtatttttgacatcatggacactttactaccagaagtcttttgaaattattttttgcctcaagaaggggactaatgaagaaatgctttaagagattaaaaggaagaaggcattgtgattcttaatgatgccagcaagtttatgtaaatctgtattcacaaaagtaagctagaactgaaatagatatccaaaaaagcaactcttgttaatgcaacatcaccgaaaagttgacccaatagttgtcaagttcttatttccctcaccatttagtaaaatgcctggctctgcactgggagtttttcttccttgtggaactttggtagcttggtaatccattagtttctgtctctgtcagttctcataaagttgcataggacttaaacttttcaatttttaatttttctgccaggcgcagtgactcacacctctaatcccagcactttgggaggctgaggtgggtggatcacttgaggccaggagttcaagaccagcctggccaacatggtgaaacaccatctctactaaaaatacagaaattagctgggcatggcaatgcaygcctgtaatcccagctactaggaagggtaaggtgggaggattgcttgaacccaggaggtggaggtagcagtgagcggagattgtgtccactgcactccagcctgggtgacagagtgagagactgcctaaaaaaaaaaaaaaagaaagaaaagaaaagaaagaaaaaagaaaaaaacaacatttaatttttctagatgtataatgattttttaaaaaaagagaaaaaaatacatctcattctgatatttattggatgcatgttggagatagttctgcaagtagtcatttataattacctcttctttctttgcccctgcccaagaagaacatattctacagtcattctttcctccgcctgtacaacttgaaatccaataaggtctaaatactaaatcaaaggttttgttctgtctcacacaacttaaactttgattatagtgtcttgtaggtgagtggtgagaaaaggaatttgttagcactgaattagactgggtaagatttttatttaaggatatttgaatctgctagttctaattgctggaattgagtttaatgaatagaacattaaaaacaagacatttaaatattataatttcaacgatagtcatttcatatttcattgtgaccaggttatactacatttttaaagatacattatttstcatatatactgatgaccccaaattacagaaattgtaatatgcagtctttgcttgatgactaaggtctgtcatgtgtttaacattatattcacttaagagcatatagtttgtcaacctgccctgccttagagaaaatctctggggccattgaatctatataaggtctataaatagaagtaatttaggacagaaataagaacagttgcctaggttactggacacaacctcaaaacgtcaatagcaacagatgaactggagcatatcaaatcttaaaatacttgcgatggttcttagtgtaaaaaaaatgccatgtaaactttatgttggtgataggaaaaactgcctcacttttgcttgtttacatgcagttacctgaatatccttcactatgaaatagaaaaacaattccatggatgagtggtttactctaaaaattaaaaacattttaacaggccataattattatcagtatatactctcaataactcaaatttgtacggaattaccttacagaatattgggacacatgacctcattaccatcttcatgatctaatttggcttattataaaaaacagttttaatcaatatagataaaatttcattaatcagcagcaacacagcaggcaatacattttctcatcattggttactatcatttcaattttatgtttggcagtaactctgctctcctatctttctgggtgatctttttcatatttttcatggtttccttttcctctatctatttttaaacattagggtttattagagttctcatataagccctatagtcctccagctcttcctacttttcttagacattgtcacataatcccaagatttcaaatatcatatgtaggcatgtgattctagcctagtcctgtcttttcagctctgactacatatattgggaggcctacaaatttcctctccttgaaataatcacaggcatctgtagatcccactgtttccaaacctaaatgcaccaccttaatccactaatctactcaaactcttacattccttaaggcacctctgtacattcagttgcacaaatctaaactcaggaatagtttttgagtcttcccatagctaatcatacaacatgttctggttttactctcttctaagtattttctgaacttgtccatttttcaccatctccactatcaccactgtcaaagaagaattgcaccaaagttaaataagagaggaagactttattcaaggcttttgcaatggaacaaaggctagaattcattctgagctcaactctgctgaaacaaagatttgtcagagatatggtgagagggattatagtccatcaaatttgctaattgcctttaaccaaagaaatcgtaaaacttctcataaatgttttctttataacaggagatggttttacaacttggagaaagccgttttcaagcggaggggaacattcatgccatcttggtccctcctttagtttaggcaccggcacctctcacctagatttctgcagcatgttcctaacttgtctcctgccatcagttttgtaaacttccattgtccatacttaagctcctgtgatatttccaaagtgaaaaatctgtcatctatcatcatacataaaagcccttttaggtcttagtgtcaccccttgcccttagcatgaaatccaatctcctaatgccctctgtaaaggaacttcagggtctgctctcatttgcattatattttgccggtttctcttcaatgctacctcctcgtgcagaaatctcaggtcttacaaccatcaggctcaccctcacaccatttcattatctctgagaaacacaattcctacgctgccccctctttccctttactagtatctgctcatcattaggattccagattagcccagccttctctgatacgcaagtctgagatagtttccctccaataatcttccattacatgtggattctcacattttgatattcattgtgtctgtataatttcctatataatggatttttctccctgctaaattctaaactccattacagcaggggacatgttgtcttcttttagcactacatttgcagaacgtaggacactacttagtacagaggagattcatatgtgaatcacgtcatataggaaagaacataaggagaggctttattttgtaagatatcttgccccaaaagcacaccctaggctaatatattgagcctagggtattacatgaatttatttctttatcttttttcttccaacagttgtaactccttgtgccagataaatcttactataaattcttagacactacactgaaatattcaatttagtaccagctagtgtaaatattaattgatctgcttgtttgccgaagtccttcactacgccattttattcctggccatataagggatatagaacctcaatcctttttatttgctacaatgatccttgtgtttctgacagagagttaggattttccctgagcctatatttctgatttttccatgtcagaatggtctagttttgtcttttttacttcctttcaaaagttcttctagatgagcccaactccctttattctcataaagctttctttatactttagcccctattgatttaataaaacaaaaacttctgctgaaaagctgtctaaaggacagtttactcactccttttggatttttacatgtcaagtgcactaggctctatctctatccattgtaaagtagtgtacttgagcagtttgatctttaagttctttacttgaatttaaatttagtgtcatttctttaattttataagtcactgtataaaaatctagacagagaaaaattaaagtttaaaacactgtatattatagtatccaaaacttcttatatacgagttaataaatgcttcttgaaatttcaatctgggaaagatttttaccaaatatcttaatatgctcttacttatcagacagtggagcttcattaaaatatgtacattttcatcctgctttggttactgggaagttctatgtaaaaattaatattcaatagctaatctgaattgcttagtatataatttttaaaaattaaaaagatatcttttttattatagtttttcttaatttagtttttccgttgtcaaaattttcttatcaccaatgatgaagtatattttagagtgagagaaggtataggcatcaagtatatttttgcaacaattagaacttctgtgatttaagcctaaatctctctyctcttccattgatttatagagtasaacgttggtattcaaaaatgccmgttttccaccttataacatggacaaaaaaaccaaagttctatatctttagtagtttataatgccaccaaggcatgaatttaagtggtatattgtgatatatgtgacttacttgctacttagtgaacctagcctgccatccattctttaaacagagttttctactcatcgatgcatttacagtggaagaaatagcaagcagagaagttctgagaagaaaatgtttttggaggtgaatgttggtgaagtgagcagtaatagaagtctgaaactaaaagggaggcctggtccagatgatgtataaaccatcataagacatttgccttttactttgagtagaatgagaagccattggaggggtttgaagccagaagaatcatgatatgacatgttttaaaggagtctttctgaatgctgtgttgaaaatagtctgagaagtgattcaggaagaagcagaaagttaaaaaccattgctattattttggtgaaaaatggtggagacagagaccaggattttagaaatggggaggttgaacgttgttgattgtgtatatatggtgagaggtaaaactaactaaatttgctaaaagattggatattgggaatgagagagacaggagtcagggacaactcaaggttttggcttcagaactgggaagatgggcttactatttataytgatacagaggagactgaattgagcagtctggagatggtgaaagagcagaaattaattttgactgtgactagactaaaagtcagttgaaaaaccaagcaaagatgtcagctagactggaaattatcttatatrcatagctttatattatwattttgcaaccttctaaacttacagtgaagttttatgtattacttggtgaccatttttttttcctcaaggaattggctttaggtctgttttccttcaaatttcagacttcatcccccaacaaatctcctcttttctgacatacttgttctcttgaatagcacctttttagtaatgccaccactaaccactgacttaaaactgtgactccatttccaactctcttataacctctttccattttttctttacttttttccataacattaccttcactctctgatgtattacatatttgcttgtttgtttagtctccctattagatagcaaattcaatgaaggcaacagttttaatgttcttttttttcccatgatgtattcccccacacttagaacagtgtctggctagtaaatgtgctttaaatatttattgagtcaataaataaacrgtgttaaccatatatgtgctttgggaaaagagacctgtgcagaaaatttgggggtggtggggttgtttcagatacagcacttgaatccaaccaattataatgtagctacagaataaatagggtagctcctatatttccaaaatagtattttagtagataattacttagacaatgggcatttggaaaaatgttgaggctaaagtactcaggtgattctttctctttgtaggtttaaaggtgtttgtggtagacatctggctagcaagtatgtctctgctttttctgccttaaattgtcatcattgaaaaagtcctatttcatttatgttgaaaattgaacatgtatacatattgttgaattattagtccctggttaacaaaaatatacttacatcttttcctactaaagacaataagtgtgtagtaataggtaaggtagcagaaaaagaagccaaatgcaacaccttcttttacgtgctttctaatattctaaaaattacctttgtacggtgaaagtaccataaccgaaatagtatttttatattcatatttttaatcagtgagtaacttctaacttacatttattttttagaaatgtgaacatgtatttctaatatataagttgtttaggctatatagcactctaaacatctaaagcttggctaaaatcccatgtaaatatgaacagacatataatagaagcatttccttgagtgtaaagtcatcagctatgtaatagtcatgtacttgtaagaaacagagcttttagaaaaagtcagcctccaaacatgtctcttcgtttctgatgctaagaccattttaaaggagagcacaatttctggagctagactcctatgtttgaatcagactttgccacttactaactgctgtcattgagcaagttactgaacatttctgtgttttgcttacttatttttaaaatggacatacatcatagggttattgtgaggcttctaggagttaatatttataaggaatgatgtatcattaagtgataaaaaatatctgtcatcatcataatcattaccaccaccaccactatcacggttgtcatcattatttgttgagtggattcacatttatgacatctctgctatttttgcagcttggcaacattcaccttgctaattagttctcttcagatttttcagaagggtttctggggagagccagcctgattggccaagctaaataaatttcctcctatgtacaaagtcctttacatgggattctttcatgaatttctagttaatttatagatgggtagctcttgagccacatgcctaccctggtccagtttcaaactgcagctcagaagaaaagaagtgctgtgttgtcagggctgttatcacaccagatgcctaaatccgtttgcttgcaattatgtagtcacgaatgtagcattagattcatgttgttctttgaaatgatgaaattagaaactactgttactaaaatttcctaaaataatataaaatggtgttataaggaaaaaggatttcattttcaaatatagtttctaaaaatatgcagaactcgcttggttttgtttgctattgtttttgtaagaagcaccaagagtgcctgggtcttagggtcaccatccctaagattaatcttggctctttttattagtgacagtatgacatttagwaatatatatatatatatttctctgagatactggttccttatatttcaactcagagaatacctaccttgtaatattataattagaaataatgcatataaaggaccttgtgtagtgataaaaacaaagtagatgcctaacacatggtctgttctattaaaatatagtgtttataaagaacagtaacttcaaatcataagggattcatattgtgcagtgaattaaatataagttacctaaggtaaaggcgaaccagagtagatttaaaaaaacagtttatgttttaatttgcagggagggaatagaaaaaaaggcacaaggaataggaataaacaaaagtatatagaaggaaggaagaaaggaaggaaggaagggagtaaggaaggaaagaaggaaggatggaaggaaggaagggagcaaaggaagggagggagaaagaaagagaggagaggtttgggttggggcaggaagactctctatttaccaagagtaatagtgtgcaatgaactgaagaatatgactaatgcaatcctcagctcctgagttccagcaacataaacaacaacaacaaagggccctatatgtactagataaaaangagtaaatatttatttttgtgactttaggatggtaaaggatgttccaaatgtgataccaaagaccaaaaacaaaagaaaagggrcgcgaactttactgctgagaatacaaaataaaaaaggtaaacccaagcaaacaaaacacaaaataaagacaaacatccatttgaggagataataatcacaaattatataagaaaatgtttatatattcatagaaatagattttcacaaattaataagaagaaatgactcctcaccccactttccacscctggccaacagaaaactgggcataggccctattacaaggtattcataaagaatacatgtacatttatagtaagtatgttaattgttgtcccatctcatcagagattacaaaaatgcaaatgaaaacaacaatgaaatactatattcggataacatttgaagaagacatgaaaagattgttaatatccattgtcagaaagtttttatggaaaattgatactcaaacactttgtggagataccaattagggtaagctgtctgcaggaaaactgggaagtaagcattgaaaacctttataaaagtgcattctctttgtcttctagaatgtttgcccagatacatttggagaactgcagaaagatattcaccactcagtatacmcacacacacacacacacacacacacacacacacacacacacacacaaaacacctacctatctacataaatatgaaacaactgataaccattaataacatgtagataaatgataccagatctaaatcatgaaataagagttataaaatgtgacaaatctatattatacagacactggtctactttataatgttaaaaaataaggaacaaaacagtatacataatatgatctcattttgcaatataatttgtaaaataatgacacatatatatgtagcctacaagaatagtcttaaaatattgctttcaaaatctttggtatatgaaacaatattttatgaaaataaaggtattctgtatgaaagtacagagggaaaaagaagcctaccatactactgagagtttgtgcataattttatagaccaaaatgtttcaaataaacataaggaaaaaatagctatctataagtttactatctagaatgagccgtggttgttaatccatttgattttcttaatctttaaaaagttacattaatagaaagtatatatactcttactgaatatttaatgaagcatacattattaaagcccactgtaagacgaaatttttgttctctatcttttgatagaggctactaattcttgtctcaaactggctaaayattctttcatttccaaacagtagcactacctctagactaagtctaatgccctgaagttcagatacaaactaatatgccagtgggattgatgtcaaagtgatagaattgcagaatagatyttagtgacaatttttcaggctagttctaattgattgagtagaattccaccactgcagttctgttgctgatgattattgttaaaaatgactgaaaacaaaagagtcaaccaagcactccagagatcactggctccgtaaactggttagcttacatgagggtcagtctgagccaaaatgtccactggtccttagctaaaatgtcagtgtagggaggagtttctctaccgtgtactgttgacattttggaccagacaattctttgttgtagtagctgccctgtgcattgtagggtgtttagcagcatctctggtctctacccagtagatgccaatgaagcaccatcattgtctggggaaacagccaaagtttgttgtctcgcgataagaggaacaaagatgctgacacatacacacggagtgggtttaagagcggaaagtttaataggcaaaagaaagaagagagagcttcctcatgcagagaaagggggtccccaagtatgtttctgggtttggggtgagatgaggtccactttatagaggggcttgaggagatggtgtttgatttaaattgggcccaggggattggtttgaccaggtgtgctatttacatagcccacaaatcttttattatgtagataaggttttacctggctggtgccatgacacctgcacatgtggcgacaaggaaaaggaagaaggaatcaccatgttggatgtacctagcttccaggtacagctgatgccatttatctatgcaaatttccatcttgcttatctatgcttgtaacttgatttttcaggctgctttttattagaaaagaaatgatttgggggctgctttttattaaaagaaaattctaccaagaactctttcaccctcactaactgcctaaataatttcttactactctatcaccagtagcgcacacctctcacatcacttgtgactaacaataatcttccaagagattgccaagtaacaatgaggttgtgattgcggagtcggggagaggtaaaatcaaccaaaggaacagccattctttcttaggaaagatcgttcttttctactgagtccttcctaattttgaggttaaaatattctttttaagaaaagaatagtgatagtggatggtaagttttttgtggtaattttttcttcctttttaaattttttgttttaaacgtgtgtgttttattgcccttacttggtaaaataaaataatttgcaaacatatgtttattctgctactttttaaaaaaaattcgcatgcccatgaaagcccatgcttaagaacctttggcaaaaaccatggtctctcatcttttactttgaaaatgtttccaattactatagatgtgacttgtctgagagccatttgtgttgagtctgcagtaaaactggaatatatcttcctgaaagattcctccaaacaccctagagttttacctttgaaagcttaactaattgaagccttacttttaatttccttttgngctcatttatagacatggcttcatctatatcctgtctcagtactaagataggctcntgtgtcagctgctgcctcttgagcagagggtcttatttctagtgcctgaatggaattttacttggaaaagccttgtctantgctatgggcctttctaatccagatgttccccctccaaattcacattcagaagacaagaagaattatgttttgtttatttaatgttggtgtgtgttctgaccagatggatttagcttgtacaaactgattgtattgttagtgctactgatgtaggataggtgttaccatcaaccctgtgttttgattcttgcagcagcaaaggggtgttttacatgttttgaatcttaggcagtgattgtgccatattttaacataaatattcatgtaaaataattcttatggtactacataaaaagggattgaattacttccattgcatatagaaggaagattcctttaattgagatctgacaatgtaacacagaagtatatttcaaaacaattaagcctcatgattttgtttggagaattacgaatgctgtaggcactgtaatcagaagaataaatataaaaaatgatctggcagtttttagcacttaaaacttagattctttgagaattttttgaattgtcagaataacatgccaacattgtgactctctggtgacattctcccatattctctttcatttatttttttcttgattatgaaagaaaaataaatcaaaaaagaaactagaaaaaataatactattctatatataagaaaatattcaaaatcttgcacattaacttattatacagacaagatgtaatctattacagttgcatgtgaattgtactttgagaatttctgtggtccaggtgattgaatgaaaactggttaaattataccaacaaacaccaattctctttctacctcagtgccttctcaattgtgtcatgtttcctcctcctatcactttatccatcttctcttccttgtttattttccttagtgaatcatgtatcactaacatgagcattttattaataatcctgaatgaaaatatattgtttcaaaatgaatatattatttcattcttcttctacaaatcttttaaactctctttttttatcattttgaaatattctaaggctcaatcttggaatctaatagagacaagggattctttgcaagctcttctatcttaattcttcacatattgccttactttgtgaattctcaygagcagctcaaggagggctttgtcactttctgctggaagaatgcttgatgattcttatcttgtcagatgagtccagaaggtctttgttcctgggaccagttcctaattagtgtcctagtgttctcctatcctataagatctcaagtttgttacatatcaccttaaataaaaaaatacacaaataaatatataaatacatagatagatgatagatatataacattgaaacgtgccattgaaacttctattttacaaattgacccgaacaattttattttttgattattgtgtcccacctctggggaaataattcataactcacttggggatttattaaatgaatctttagctgaaggaggcttagagaaaatagaaaaattcagtgtgtatacagataaaacattttcaactmrtcaagatgagtcctttttctaagaattttttttctaattccaaaaattctctttagaaaaaacattatttagtaaacatctattttaggtactgcctacatttttgtaagtaatctagaattttagaaatcatcttcaatttctggtagatttcaaggtattacaaattgcttgaagttccaaaactaataccactgtaatggaagacccattctctttttttttagtttttaatttttgtggatacatgataggtgtatgtatttatggagtacatgaattattttgataatggcatgcaacagaatagtcaaatattttgtggtgctttaagtacttttctgtagcattctgatgggccatactttcagagcctgcagaactacattttgaaagtttggtctcttctgcaaactcactatcatttctttttttctttccttttctttttttctttttctttttttttcttttttttttttgagatgaagtttcgctgttgttacccatgctggagtgcaatggcccaatcttggctcaccgcaacctctgcctactgggttcaagtgattctcctgtctcagcctcccgaatagctaggattacaggcatgcaccaccacacctggctaattttgtatttttagtagagatggggtttctccatgttggtcaggctggtctcgaattcccaaccttaggtaatccacctgcctcggcctcccaaagtgctgggattacaggcatgagccaccacacccagccaactcactatcatttctaatgtaaatcacttggagaagtgagtgctcagaaagccataataagaaaaccctggcctctgtaggacttggctacctatacttatatttgggacacaatatcctgtttgtgtacctgggtgatcagtaatggatatacgatggtttccacaatacataggatgggtcataactagcgtagaagaataagccagaccttagttgcctctttaccaagaccatatcactctgcatctgtctgcctttcaaaatctttaatatcttgtctaatatttttatatatagtccaggcttatgctagctgatcaaagatagttaagagaaattttattttttcataggcaagatgttaggtagaaagtgtgtggcggtcctttgaccctcacgtgaaaccaaggaggttgtggcaatgataattaggaagaaatactcaagtgggaggtgaayctggagaagactagcataggctgcttggtccagttgcgttacccctgtggagtttgtcttagcaagaatattttattgagacatcaggatccatttaaacatcctaaattacaagttgcatgttatttaatgatgttattctagtattaagattgggtagagctttaattgacaagctatgtggttatccaaaattaggtgagtttttatagcatctcagtttataagctattaataacattcaaattggctttggtgagtatctgtgatcataggataatgttttcttgtttacttaagccctcacttctttttactcctcactaagaagatctctagcaaagagaaaaaaaaatagttttagactttcctttagsgaagggactctttttcttcaggaaaatatgctgcacygtgttgggagatgagactctgatggatgaatatatatatgacaatacttaaaaagtgtgcttagaaaatatgcagtattttgctgcaggagaacacacaggaaagatgagaaaaggacagatggggcccatctaagaagacaggatgccaaygactgaaaatggtagccaccatgaagtaaattattctgtatttgctgacatacatatgacaattcaggtgcatattttacattgtttttaattttttattttgaagtaattttataattacagaaagctgaaaaaagtacrgagatcctataggcctttcacctaatttcccctaatgttaacaacttgcatacccagggttcatttgtcaaaatgaagaaatgaccattggtattatactactaattaaaccacagattttattcaaatttcatcaatttttccacctatattctttttctgttctaggattcaacattttatttagttgttacatctcctagtcccctctagagtatggtatttcctgaatcttcccttatgtttcatgatcttgatatttttgaagaatacagatgaagtattttatagaatctcatataatttgaatttgtcttatgttttcctcattattttaaggttatgcatttttggaggaaatatcacaaaactaacatgtccttctcagtccatcaaatcaggaggttcaagatattaatagatcttatttctggtgatgttggtttttgtcatttggtgttggttgctggctttttccactgaaaaactaagttttttttttttctttgtagttaatatcttgggtgcagtgccagtttttatgtttatttttatttttatttttttgccagagttttgctctgttgcccaggctggagtgcaatagcgagatcttggctcactgccacctcagcctcccgggttcaagcgattctcctgcctcagcctccagagtagctgggattacaggcacccacyaccawgcccagctaattttttgtatttttagtagagatggggtttcaccatgctggtcaggctgatctcgaattcctgacctcaagtgatccgcccaccgcagcctcccaaagtgctgggattacaggcgtgagccactgcacccagccaaagtgcagtgctttaagactattcaattttgttccttctcaaatgttcacctataaattttaatctccatcaatgaaccttgycaaagaataattactgtggtgtttgcctaacccatgattttctactttgctcacttcttctatatttattagttggagttttaaggaagagctgtcccttctcccacatttagttattcattcaattatttatttatatcactatgaactcatggatatttattgtagtctatggagtttaaccttatttcactgaccaaattgtccaayctttgatatagaaagttttttttgtgtttttttggtattgaaagtttttttctttttttaaattttacttttttcctatttcatgattattattacagatggggtcttgctatgttggccagtctggtcttgaactcctggcttcaagcagtccccctgccttagcccctgaaagtattggaattacagcsatgagccaccaggcctggacatcctgtttctttttaacaggtccttcttttttgagcaattacttactttttgccaccataggatgattcatactcaactaatttgtcaactcttctagctgaattctacttgccartgtcaggtggcatctacccaaggcaagcaaacacttacatcatatctctttcagaaggcgcttattgccctagatctcaggttcattggttkacttctgacttctgaccaagaaagccttaaatttctccttgtcttgatgggattcyttctgagtacaggcccctggcctcccttttcttaaagcatctaytttagagaacttcccattgtaaattctttctctgtccctttgtgatgtacatcttgtcccagtttcttgccaatttaacaaaatataatatctttcttaagcatctgtgaaccatctctgaaatgtagttatcaagaaaggtaaagcctctatttcctactctctgtaggagggtagaagcctattcagtaagtaccatttagcaaacacagatggtctaatgacattgaccatctccactaatgtcctccartacttttctactagctcaccccagtgcttaaaaactctccttcacttcgcttcagcagagttgagttccatctctgcctccattgcagcagtattgaataaaattttccttggctgtttaactcagtcagtgaarttattatttgacmactatgattggctttaggaaaagtcatggacttgcagagttttggctttggttgttgatgtaaatgtggaagcratacttttttacccatattctacatctttaagtaaaaatcagagatattgcaatgttaagtcattttactttgtaaaattctcatgttgtccctaaacattttcacaaaccttcacatgtacacaaatgacatatataagtgattttgaagaattttacaatgttgggttactataatggagtaagaagggaatagttatacaagatcactctcttgtatatatataagagtgattttgaagaattttacaatgttgggttactataatggagtaagaagggaatagttatacaagatcactctcaaatgaatgcagtagatcgagatcagaaatgcagagaagaaaagtggcctatgggaatataagccctcagtaatttatgaagttcttgagtaaacttgagactctcaaagaatgtatgagaagaagcatgactgttttatttatatttcagaatatggaaacttctgctaactttgggtttaggtcataaactaaactgacttcaagcgatccgaatcatgaatgattacccagtaatggagtcagaaagaaataatagtagtatattactcaaattgatataaactattttattttacctttttaaaaacctagtaaataggcaatagattaatattatgtgaaatataacagcttatttttctttgtgcattacataatctatattcagttgttaataatataatgagaatagattttatattttctttgccacgactgtgtcactacaggtgttgcatctggttttcaatggaaggagctataattagcatatttatatggatcattagtcttggtcatattgaatcataataatatagacatatgtaagcataatttatggacaagcaaatgccatatttagaattctatacaatattcctcaaattgttattttatcaagaaaattgttgttagaaagatagaatgaaattttcaaatttccataaacaatttggagggaaatctggtaattatattcaattacacatttaatacatacatagtaataaaattatattcatgcaaaaatatgattaaaagaaaatacatataaaactaggaggtatataattctttctcaaatcttactttagttgttatactattcatataatttgtcattataaaattcatataataagatttaacttttttaaaagtcactagaattggttttctaattgtattatatgcatctttaccttaccaaccaaaatgttctaaatacgtctttttctgcacagggatcttttaaactgtttgagagcagaaatggtgccatccaactctactttacagtagacatcaataaatgctgggtgatgatgctgtggatgactcattgtcagtattgtgaccaaatataattgtactatgctataatacaataataggatgaaggtgtcctgatataagcaggaaagcttatttataacttgaagggcctcattatctgactgagtagtctgtctcttttttgatagattttcttttccatctttgtggtcagactaatacaccttctgtctacttccaatttactgtaaactgggtcatggaattcaggtaaccaaacttattcaaattataagcaaagtataagtttctgggcactgaatagcatcttaaaggcattcttgtgaataaaatagacttttagagagcattgtttgatttcctcacagcctttataatatttatttattgaactgtttgaggatttctatattgtcagttttggcagcatcaaaagacaaaaagtatatcagcattctggaacgaggaaccaaagaaaacacaatgcaattaaataaattaaatttagtgtaaatctttgcaatatttatatttaaaaataaaaatacaggacagttttgatatggcttagttatagtttatttttgtaatgggcatttcagttgagtgttaagtatgagtaaataatttacatgaatgttacaaaatttctattacaactttggtctttgtagagtgcgaatatagtgtcctgaacaaagaccattattgttttcttgactggtcagaattcatctagaatttgcaattctgtctggaagtcattttatgaaagagacgatgatatactgaaatatccccaaaggaaaaccttgattctgatcttctggataacaagttcttgaagtgtctggaattgaagagttctacagaaaaggaataggtgaaggaatgaatgagagaatgggaagatgacagttaatagcatctgatgattatttttcacataactgcaagatcatcttgtggaaaatagattacatatactcctttaggttctagaggtctgaattcaggctaatatgtagacatagagaggaaagataaagattttctaataactacctctgtctaaaaatgtaattcagtgcctcagaaggaagtacttgcctgttgttggaagacaaaagtaagatatcaagtggaaaaagggttaacagctcaagtagaatctcctcagtgatgaggtcactgaagtcctggggttggtcctcactgttgggaatagaaactctttagtgttgatgcccctaawcaaatcaaccaggcttttaaagattgactcttgctaaacaaatytaccaacccttcaatatataattatatatacatataattttagaggaaagagtataaaggcttggatcttcaccttctggataaaatatatattgcaataactatatggccgtgctaggatcacatctgtcaaaaggatgaggatattcacgtcagctttyttgatacctgctcacatcagcatcttgttttaggggctccatacagatcaccacctttgaaacaacttttctttttggagaaaggtttatgctacagccacacttaagtgtaaatttctgtcattatgatacatgccaagatcctgaatgaaatttatctatgtgaagattacttctggaggtcatgagtctcatttattatgttttaatttttattggtaaaatgtgcatggactgctttatttctcaggcccagagaatccagcattggactttcaggaaagtccgaaaagtggtgaaagcattattggtcacaaatgttatagatggaatgatattttgaaataagatattatatatcctgtaagatctctcatgcctccacaaaaaattgtagaaaatgttatttgtgtttcattttttattgtgaaaaattaaatgcacagaaatgtttaatcactagtacaatacagactcatattcccattacctagaaataacartttaaccatagttccagagccatatttgggtttttcttaaactacatcaaagtaatttraaacatcatagcattttatatctaaatatttcagcaggaatatcccaaaataatgaacattctcttatataaccacaatatgatcacaacactgaacaaaattaacaatcacttcttaattttccttaatactcagtttatacacagattccttcgtccatctcccaaatgccctttacaacctttatttatctctagaacaaggagagaaactagattcacagataaaatataactatttcttatgaaaaagaaataaaacattggagagggtttcattataggagatctgcaaatgttccctaaggaactcatttccatgattgtgacaaatggacattaatatctacctcatcatattattatttaaatggcataattttttcaaaagtgctcaatagagtgactggcatactggaagtgtgaacaaatgtcaatcactatcattattatatttaagacatagataatcagtcaaatatacctgataatttactctgtttcgacccagtccctgaagcctataaagttttataataaaatgagacagttttataacagtgaaagtaacccactgggtgttaagaggggtgttttttgatggatgaggaaactgagagctaattaaagcaaatatatattttaagtctgatttagaggtctatacataaaaatgtagaaatgtataccacttcttaaagtccaactccaattcctaaatgttaattttaaaatattacagaaaattgctcttaatgaattctcaggaatatatttgagatcacaatttagtatgcttaggataccaatgcataaatcttgcttaaataaatttgttctcaaaattttaattaggttgaatttttgccaaaagcactttatattttctaaaattccatcaaagtgttctatgctatttatacttttgatgtattaaaaatacatctatttcccaaatgcctctaggcttattttaagaaaacacgtacatgtcactattaaatttgagacacgctgaaggtaagaacatgagttatcattagagaactatttttccaatatgtatayataccatgtgtatatttttaaagtttatcaaacattttattttgaatgttgagttctagctacccattcatatgagtgatatgaattaattagaaattctctaatatttataaaattaaaaaaatcataattgtggattatttattaacaaaataatatttctatgtttcatccagtttcatggatagagaaattagcaaagttatatgatttacctaagaatttaatttccatgaaaaaaagttatagttaaggaaagccaaaaarraaattgtggaaagggaaagctactaatgaagacacatggactgaaacatcacatctgtcactagccagctggagagttcttttaagtcatttcccctttctgggacaattttcttatctgcaaaataagtgatgtggattctggggcttctgagaataagataattataatggcgctatatttctatggcatttattgcttatggaaagcacttactcaaaatatttcatttggttcttgcctaggctctgtgaggtaggctacatgaatattttagttatccttcttttccattttgtggaaagtcttggaggccaagatgatacatttatatacattatttatatatgcaccatttactgagtccctaatatattccaggtacaattgtttatagtcataactaattctcacacaactcctataaatttattatcatttaacatatgaaactggggtttaggattgttaattgctgtataactaatacttggccaaagtggaatttgaatggtggtctgtatgacaacaatttctgcatttttcctattatgtcacttttttcctttcttttccttttgtctcttttaaggggtaattatagtcatttaaattttttaagcagataaataatgtaagcatatcaatatttgatgcagtagtaatgagcatagtacaattaataagcagatatgaagatgaaaaacgatcaattgtgctattaatacagtcttggaggaataataaggacctgagtttgaaaaatactaggaaaagtgcataagagaaatgaatctaagatctgtgtagaggcaaaagcttggcatttgtgtaaatgtggttgacaatgaaaatacaagatcagtgatataaaattttgagctcaaaagtcttgagttttttttagctcttgagtatttctgttaacaatcacaaacaaacatttatcatgcaatatgttcctactttaagaggacttattttctaggggaaggagaaaaaaatacatctaaaaagtacaaatgaaaaattatgtgtaatgtcataattattattctgaaagatgatattgttttcaacaacatctctagtaagtgagataagatagttgtgttcacaagattagactacaagagagaacaatatgaacatctagggggaagaactgacaacatgttctaaaaattttgagagaataattacacacacttgaagaatggagaaaggggcatatactatatgagtctggcctggaaatatgattaaatttggaccaacaaattgggggaagggaagatgagcaaaaataattaatgggcaatatctcaagatatttacctgcagcaacaaatagcttagcttagcttgagggtacagtgtgttgaaggaagtaagatgggatgagattgaaaagctggtagaaacaaaggttatgatgatccctgtgatgtactaattccattcctagatacatactcaagagaaatacacccatatgtgcacctaaagaaaagtccaagaatactcattatttatcatagccaaaaacggaatagttttcaaaatattgtttatagaaaaacatgaataaatttatagaaatatatatatatatatttgtagagtggaataatatctgtatagagcaatgagaataaacaaaatataactacatgcaacagaatagatgcatttcaagcacttaagtgctgaatacaaaaagccagacacaagaattcatgtgctattattccacacctttataagattaaaacatgggcaaatctacagttttagaaatsaagttagtgattacccttaggagatagtgactagcagaagatagaaggaggcttccgagtgtctgtaatctttttaaggtttcttgatatgagtgtaggtgcatggatttgctctgtttgtgaaaatcgttccaactgtacatttatgatttaggcattttatatgaattttctattttaatcaaacaaatataatggtggtgtttgaggaattgataccctttatttgataaggtgatgtaaagataaggagattagatgaaggattgcacaattccatcatattcagaaagattgaatcaagcagtagcaaagcaagaagatttaaaacaaaggagaatattaagaccagaagacagcaggaatggtaatattaatatatagagggaaatggatgtgataaaggataaaatggacaactgacagaataggctaaagaaaagaggataattttctaaaatataaaacttcaagactggaaggcaggaagtatcactgagaaacatgaaaatcaagaggataaatggtttggctgagtgtgtttttcatccttctgtgatgaggtattcctaacagcagtgaatgtactgatcacagtattggaaaggagaacaggactgaagaggttgtttggaagtaatcttcatagcagtgatggctgaagtcatgaaagtagcgtagctgacctatatgtacactgtagaagaactatattggctaattaacacatgcattacctcacacagttatcatctttgtggtgagaacactttacactcactcagcatgtttcaagaatacaatttactattcactgtagtcaccatgttgtataatagatttcttgaacttattcctcctgtctaaatgaaattttttatcctctgaccaacatcttctcaaaccccctcccccactaccccagctcctggtaacccctactctattctctccttttgtgataccgtttttagattctgcatatgagtgaggtcatgtggtactcatcattcagtgtctggttatttcacttaacataatttcctccagattccctgttgtcacaaatgacaggatttcattcttttttatggctgaatagtattccattatgtattccacaaggtatatacacttcagaacataatgtggtgcatagtaagtacttacaattttatttcccaatgtaaaaaagaaaagaaagtagatgagtgtgctaagggagaagataatgaagaaagttaaaagggtcagcacagattctttgggagatgcgcgtttggcagataaggggagatggaggactctgagaaggggcagttggatgtaaggggaaggcaaaaaccaagagagtggatcacgaggtcaggagttcaagaccagcctgtccaaaatggtgaaaccccgtctctactaaatatacaaaaattagytgggcacagtagtgggcgcctatagtcccagctacttgggaggctgaggtgggagaattgcttgaatctaggaggtagaggtggcagtgagctgagatcatgccactgcactccagcctgggtgacagagcaagactctgccttaaaacaaaacaaaacaaaaacaagaaaatgtttcaggcatcacttggtcagcactttcaggagttacaaacaaagtaaggataatgaagacagagaaaaacaataaaaatctgtgttccctggtcataggaaagttttatagcaggtgttggcaaattgtagtcaacaggtcaaatctggcctgctgcctgcttttgtacatgagctaagaatggcctttacatttttaagtggttgaaaaaattcagaatagatgtaatcagatgtgatcagaataatatttgtggcatgtgaaaattatgtaaaattcaaatttcaatgtctataataaggtgttattggaacagagacacactgatttgtttatgtagtattcatgactgctcttgcaatataacagagtaacaactctgccagttgagtaacggagtgatatggtgtgagctgcaaagcatatatcactatcttgtcctttatagaaaaattctgccgacctctcttttagagttaaattagtaaatgaaatctatgcttaaaaatgcctaataggcaattgggataacacagcttttcattgaaaaataatggataatattataaatagagttctgagattcactgcagagagtaaagaactgaatctatttgtgtaagtaatggttgacagttaacatcactttactcaaaaagtgtgttcttrcatatcatttgatgtccaaaacagcctgtcaggtaaagatcatggtatataatttaaagatttggaaacttaggttctaaacaatgtgactattctttggagaacaattgctttcaaaggtagacagcgatagagaaataccatcatggagaatgtgtatatattggtatattgtgggcaatattattcgtgtttgttggcttagtgatagaacaaaaactctagagctatattttctgatttacatcctgattctaccattgactgacactataatcttgataaatcacttaatgtttcagagagactcgatttcctcacttacaaaattgggataataataattcctcatagggctgctatgaakyttaaakgtttcttgtgtttggtaacacattccaagatcaatagttacacaatataatcttattcagatggcagtgattgaaaaagcctttgacagttatttctatcagagttctgctctatagatgtaagcagaaacctaaacacatagccacctggcgatatatatcagagatattctacttacttaatttttcttaagctttgtacctcagtttctttgtttaacttgaacaaaataattcaataaagaatttttcacctagactttccaaacatcaagtattctcttaagtcttcctttggaattttcagcgtggttgaaattgatcgatgacatataataaatcatagaagcacttaaaaccttctgcaaaggtgtcagtaacttaatgttttgttgctgctattgttccccctgagaaaaaggaccagaattctctagaacttttaattttgcaaactattgcccaacttttggctcttatcttgtcagaggtaaatgtctgttgtaattcaccatttgagttgagatgttattaaggagatgaagtgcaaccaatgagctccctgtccacaacagggtcagtcgcaatcttatccaataattgactctgttccctgcatggcaggtggatagcagttgcaattactgtcattttgtgtctagggaaacttagacaggagggttaggtaacttcctcaaggtcatattggaaatcagtggcattccaagtaactgaacttggaatacacttaaccagttcagctcttgaatagctttattatgagaacagtaaataattttccataatataccagtgtatattcagcactatttattctaataaatagaatcacagatttatgacctctgagatacagaatgtaaagagaagcaccagttgaacctatctggagctattgtaatttgaacatttaaacaccttttatgagaatggagagaatgataatgaccggtagtcaagatggagaaaacccatttctattygtgagtcagtttaatgggttggtggcttataatttacttaacgtgcttgcatattacttttcatttcagaagtagtgagctgtgtcttcatttacgtgctttgccatatgccagcagtagtaaaagttgctcctctcttacaacctcacataggacacatttcctcagaaaagaaactacaaactactttcagaggctaagaaatagcacttgtgtcagttaaaaacttagtcttgtgtagcttaatttgattcttcatagaaaaaatacaaacaaaatgaaaaaatttattagacatatgaaaatattttgataattttattgaataagaaatagctaccatttatggaacattcaatatgtgtcaagcattatgctgagatatttacagaaaattcaaactaaaagcatcattgttttttctttattatgttaaagttgaggcatgactaattcatcctgtaattgcatatatacacataggtagacatagtctcatttcaagttaaattatgttatacatccacctttttatacgcacttttctaacaaaggtgatgcattacactaaattgatgttaatttaaaatttgaagcgtattagaaatttgcaaagtcccacatttattttataaaatggatttaagtatgttggacaccaagttctacagtgttattctaaatgtaacattatagttctagagcaaactattataatttaatagatttttatatgaaatattaagcctggaaagttttaattgaatgaatttaactatattgtgcctctgattttaaatgaacaagttttatgagtatcctataatatctacttattcctaaaatgcttttgacatagtggaatgattttaactctaattatcacatgttttaggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggtaattatgtggaaaacgatgtgtaatattcataatggctgaaaatattagtcatattagtgaaacctcaagattctctgagtgtcaagtgccaaaaatcaggtggtaggggaaaagcaaatatagtattagaaagttgtaggtgtacaattctagaggtttcgatcgataaataaatatggcaagtttctcagaaacttctgtggaattggtttggacaccacttatactctctcaccttccccttccccaggcatctgctctgtgtatcatactagcatgtgacttctacaaagaatttggtaaaccaagtgattcgctggtattggagctatctgaatggttgagtttcatagctgtgtaattttagttatagtgatttatagcataatcaggatagtggtatcttttgcttctgagatgagaactagatatatttgaaattataatcacttaatgatagccatgaaaaaaatgtacattgtgggcatattgcagaagtaataaaaatgtttgttattgtcttaaaatgtcattttatagagttagtcaaaaagcaataaaatatatagtggctgccctactagtaactaatgtacacaaactataacaactaaaataattcagtcrtggtgtagttataaaagccacagtacagaaggatacactgaagctgacctagtacacttagaaaatctttcatttgtattaccatgtagtattcatgtatatggtgctgtgtaccgttggtacattcatttataccccaaaataactttcaggtggagtaatgaaataactgttaattttaaaatcataattaatggagaaaatgtacatgaatctttcagtgatattaaaattgagaaacagtttatgaaaattacatacaaaataatttacaaagaaaggattgttaaattgaacttcaaaaaatgtacatcaatagaatgtcctaagcaatattgaaatgtaaatggataactggataaacaaaaatttgatcccatttatatataaagaatacttgcagacataaaaaattaatattgtagtggaagaatgracaaagaatatggttatattattaaccactttctccttataaaagttatggcagacaaatatttgaaaaatattaaaaataaaatagttagaataagatgtattttaaatctatcaaatttgccaaaacttttaaaataggcttggtacagagcatcgtgttgaaaatctaatgacataagccttatagtaatttgggaatatgcgtaaaatgaaaatctttataaacttttcatacgtgcatcatctgtatccatatctgtactatacttcasggaacctatccaaaggaaataatataaagtgataaactttttatttttttttgagatggagtctcgctctgtcatccaggctggagtgcagtggcacgatctcggctcactgcaacctctgcctttggggttcaaacgattcttctgcctcagcctcccgagtagctgggactacaggcgcacaacaccacacccagctaatttttgtatttttagtagagacggagtttcaccatattggtgtggctggtctcaaactcctgacctcgtgatccgcccgcctcagcctcccaaagtgctgggattacaggcatgagtcaccgcacctggccaaacttttttgaataaaggaaacccttggcctctgaaagtttactgaaaaatcaactcacaaaaggcagattaataggtgaaaaaacatataaatttatttaccaagtatatatggtagccttcagaatgaagacccaaagacacaggataaattgtttatttttatgcttaagttcaataaagtatggacaatcatgtagaaatatgatgggacaaataaggtatgatcttatgttaatagactgagtggggtacccagcaaggcctgtctgtctagatttttcttggcttctctgaacatgtatttctaccttctggatatggggcaagaccctcgctggaatatgggtcttatgacctatagtcaaacaaggtaggtaggaaaattattgtatgactagtacaattacacagagagatggagatcgttttagaataatatttttatgttttatcactagctttggggaaaaggggttctggcttctgtgacctgccttggagaaggattctagtatttatgactagcctcaggggaaaatggaactgagcaacaggagaacagaaaaaaatcagagaaaaacttttgcttctgaagctgcttctaagtccttcattttggcgtatattttttttttctgagccccaacaggataactatagaattatttaaaataatagaaaaattgggatgattaaacaaatggttgcctgccacatgaaaagagtctatagaaaataaagtcaagttttttaaatagtatgaaagtagtctaaattttataatctattatgtatatggatgcatagatattctcatatgcatatttttgtctttgttttgttttataccaaacttactctttacaatataattcagttctactttgtattcttctgaaagaaatccactttccaaagattatgtgcagtgaagatttcattggaaagtgagaaaattaaatttattgtgtattatacatggaatttcataaaaatacctctttaaatgtctatttctattttttgcacttaactcttgccatttttccaactctagtccatagcttctaaatgtcttcttattcctcttcatatagaaagtaattcagttttggcccatggttcaatttctgcaggcaaagattcggagaaatctgtttgtatatgtctctgcttctctctttctctctgtctctgtttctctctctttctccacacatataatcacaagcattatataatacaaacatatataacatagacatgtatatgcctgtataggaacaaaactaaactttcatgggtttaaataatgattatgttttagtagttggattttggataatttaattacaacttttaaccttctataatttgttgctgatttaaagtatcaatacatttatatgaaaaacaacatatggaaagaaacctgaactataatagttatattataatatcatcttggtggctaggtgcggtggctcacgcctgtaatcccagcactttgggaggccaaggtggacaggtcaccagaggttgggagttcgagaccagcctgaccaacatagagaaaccctgtctctactaaaaatacaaaattagctgtgtgtggtggcatgcacctgtaatcccaactactcaggaagctgaggcaggagaatcacttgaacccaggatgcggagattgtggtgagccgagattgcaccattgcatatcagcctgggcaacaagagcgaaactctgtctcaaaaaaataaaaataaataaaataataataataataacttggtaagtggcactgagaagactcttaagctttctcaccataaaatagtataaataattcaagtgggtgtatttatagacaggatttagagctagaagggacaacaatgaagggtaaagccatgaggaacagaagctttgaagaagtgggcagagaaaatagaatctgataaagaaagagcattcaagtgttaataagaaaagtaacatacaaaggaggatgctgggcagagaatttcagtgagtaatcaatggtcttacttgaagataatgattaaaaagatactagtttggcaattagtagatttaatcaatttgttgttgacttttgctttacgaaatggtgaatggaaaaaaaccttatttaaaaagataggtaagagaatagcagatcaaaaaacaaagagactcaaggtagtaacttaaaagagactaatgatcatgacaagatttttgagacttctggatgtttgaatatattttaggctggagggaaagaggaaatggggagggacagaatgaaattgtaaaaggggaataaaaagctatagccaaaaatgagataaatggttagtgagaagggaaaacaaaacaaaacaaaacaaaaaaaaccatttaaaccaacataagtttacatggctgttccttctggtcacagcttgaatgaatgagctgagaatcagattagccttttttggccacccagggtaaagactttccccaactagtctgtacatcagtttcattatcactctatattactttccttttagcagttatcactttttggtttaaataattcattttttcccatatttcctgcctctatttccataacagagtataagttgtatgaatgtatgaaatttgcctttttttatacccagaatttataacagcatgtgtatatatgcttagtatatatttaatatgtagtagctgaattaattagatttttaaaatactactttaattcagaaggaaccaggaataaacaaaaaaacacaaaatttgaacaaaaagcagggaagtaagcataagcttactttgtgaaagtcttgaaagtcactctctttgcttgcttgttagcccatatatagatcctaaatgttgatactaagattttaattttaatgcccttatggcatttggaggagacacatagtccggagacctgggactaagactcttagaaaagcttatagccctacctttaaaaggggaaccagagatattttcacacaccagcttgatggagcatcaacggtgaatgcttttccctggggggtcttatttaaataaaggccatctttaagaaatagagatcccaagtgtgtgacctattaaactgatgaatttcaaattgcataatcagaaatgccaccatgaaagagaaattaagatgcaaaaaagaatgatcaccaaggaaattagaaaaggtgttgacacattcaaagaaggcttggtaaaacaccatcaataatatggttaggctttgtgtccccatccggatcttatcttgaattatcatcctcataattcccacatgtcaagggagagaccaggtgaaggcaattgaatcatggmgtcagtttcccccatgctgttcacgtgatagtgagcgagttatcaggagatctgatggtttcataaggggctcttccgccttcacttggcacttttctttcctgcgccttgtaaagaaggtgccttgcttctcctttgcctactgacatgattgtaagtttcctgagggctccccagccatgcggaactgtgagtcwattaaacctcttcctcttataaattacccagtctcgggcaattctttatagtagtgtgaaaatagactaatacaatcaatgacaacaaaaaaagactatttgaagtgaccacactacataggagaagtgtaagggttgaagatcagagttaaatggcctactattcttatattcaggaagaagtttaaagtattaacatactttgctacatagaaaattatatgcattatatgcattttaaatttccaagacatctttacaataatgaaaatagaattaaatagaataaatgttccatatcagtagacaaaattaatgtagagaagataagttagaaaatgagaataaaatgaaaatttagggtaaatataaaaaagcaatagcattataaatcataccaataatatcagtatttctaatatttagatttagtaagcttactagttttttaaaaataaaattatttaaaaatctgtcatttaacatagtggcgtataggaatcttttgatctaggaaccatgggaaagaggaagaaatctctctctaaaagagtaaaggaatgtgtaaaaaaagtgaaagaaatttcagaagtaaatacctaacagcttctatttgtggggtaatgccatctgtggaatatgagaagccttcagaagacaaacatggagtgacaactttgatagagaagcagatcttgatatataaaaggtaatcgactaggaatatatatatatattatatatatatatagagagagagatttatacatacatatccaactggatatataaatctatatatagatctatctatctatctatctatctatctatatctatatctatatatatatatatatatacatgtatccagtcattggctggaaaggagcagaactgaaactactaagaaggatatattgaaatgactgggtctacactgggaaagaaaggaactgatattggggagtagagccaaagtggaaaaataacagcatgtcacttgacagatggtgaggttacagacctccttgtagtattttttcctgctctgtacatgtctccctcctaaaggaattaatatcttactgttggcatactctgaatcaagttgtaaaaggattctgacaaatcagtggctttgagggtatcctaatctgtagctggggtgttagaaggggattcataactccatagagtgacaaatcatttgaaaatagacacatttcatgttttacaaaagctaagcagcccaacattctctcagtctatagccatcactagcaaaggcatccacagaacaggaatattgtgtgtttgaactgcaataaaggaagggtagtaaaattgaattttagactctgataatctcttgtgcttgaactgaatccagagtcacctaaatttcagttcatataaactgtgataaatctccaattgttttaaaatgaatgaaatctgttctttacttctattttattcccaattctgtttcaagagtttcttctcagacaccgtaatgtttttctgagggttaaacttagcagttttatatataggctattccttggttccacctttgtcacatttctttcattgcaggtttttcgcttgtttgtagtgggacctgtgagagtgagggtcacagctggcagtgcagtatttatcagctagtagtcccccatttggtggtagtagtagtacacttgaagtcctccatatagattttaaatagctctatagtttaaaaataataaaagaaaaaatagctcatgctttatatcttctgaagtgccacaaaatgctgttttctcattttattcaaatattattttattaataaaagacataatgatasctaaactttgatgagtgcttactgtgtactgtatcttgagaaaaacatgttttcttgtttatcctctagacagtttgattgattattataccctccattttattaataaagaaatagaggtcagataaattgcccaaggacacacaagcaaagttaattttgaatggaggttggtccgacttcagaatttgggcacctacccattgtacaacaagwctttaccctgtgctaaacacaggataagacccaatcagttctttcctcaaggaagaaacaaattgacacatcagagataacaataattatgttatgtgttgttaaactgttaaatgttcaatctgttaggattttggaagagagagagtttgtggagaataagcacagaagaaaaagtatgaacaaatgaaatttgtattcgattttgaatgaggtgtggggttgagtcatggaaggtgatgatgtatgtgagaaagttcatgagaatggaggccagcaggtaggaatgagtcacgtccatttaggggctctaagaaaaaaaatatgaaaaagaaggaaattaagatgggcatgaagaaagtgataggttataaaaggccttagaaaattgacagtttttctttttatgaagtaggagatacgtaacaactgaaggattatgatcatggtaggggcataatggaaatgataagtgagaagagggacaggcatttatgcgtggcactgtagcagagaccacccatatggatccggccacagttggagactcataattagatgcgctttggagaaagtctggtatagactaattcaaacacaataaactcatagaaagtactgtatcagcagtgtgaaaaaattacttacataaaacttgatgtagccatttctgagtattggcacatgaaccttgaccttccagcctaaactgaagatgtggagcaagttctactctagtcatttgtgcacagttacaaatgcagcaaggcatctctgttccccttgtgatagccttattcaagggcagagaagtcaggctttatgatttgaaaacatgatttctccttggtgaagggccattcctacagtcacataaactgtgttacattgttaacattgagaaggtggcatcttctaacaacccagcattccttttatacatcttctgrtattttctagaatcagagtaaaggatttaaaactttctagaggaaagcaagtatttcttcttgtactaatcactttctttcccagaaaaacatctttcaaatttcttcctagaaggtaaggaactaggagcagagtggtagaggatggggtractgggaccttgacacttagcattgagtattcacacattcatttaatcaccctgttgttcataaaatgtaccccacccctaaaataagtctaaagacccacaatgcaaagacyattttatcctcttcagagaataatatctggaattatgctgggctgaggtgggggtagatattcagtggtgtgaaataggagatgggatcaaactgcctttttcagtccctctcttcatccccaagtttaatcatacctaagtctttctgcataaaatcacttgattcttaattttccctgttgctggtttgaactctgactttctccgattggctatgtcatttagtacttgtcatctgcttttgagtttgttaatatttcttgctgttattttatcttccattccattctctccgtgctagtgtgtttaagtctttagaaataaacaaaaataactcatatatagttttagtgagacttgaaaaggagcaaaattagatacatgtgtcagtttgccatcttaacctggaagcccattagtttttattaaggttgtgaaagttttctctttatgagagttagatattagattagatattatttttttcataaattatggccccgttttttgctctccctcttaggtaaattctgtccaygcggaatcttgactgtgaacttaaacagttcccacattttgtgactttcataacacttgagacccatttcattccttccctgatgtgagcagaagacaggctctaggtataacttccagatatttaattatatcttctrtgatcacctaggatgcatttccttaaaagttgcagaaaaattatggggtaaaaggcaaaacataactcttccttgaataaataatacaaaccagtatattayctttgcaaaaataatgactgttaagagtgtaccacctttagtgtgaatattattaaagtaataaaattgaaratacctaaaagaaagtaaagctgctctaagcaccaacatgcttaaaactatttattcaaagatatgccaaagtgacatccctatcctcatgaaattgtatatttcaagatacaatgtgatgtgtttttacttgaaaaatatgtactaattttactaaatttatacagatttttctagaatttccattggctcattcactgagaatctgctgaatattaggtactgtccttgtccttggtattaaggacatacagtgaacacagtggagaatttagagccagagcaacataagatagcatggaagaagaattgaggagaacaaggagatgggcagcaaagcagacagggaaagaaaaagatataaaggaaagataacagttaggagcagacgagctggtgcagaaattcatctctgaaaggaatgcagaatgttgctaggagctgagatataaatagggaaagtaaagattttcaaggtttttatacctgagtctacttatactcaggcatctgagactctggcaggtgttgaatgaagtctattagtttgttgaacagacaataaaagaacggaaaggaccttcattatccagctgtcttcattttaattttattcaatgacacaattctgtatttatgagaatgatgttctgaagagaactttggacagaaatagctacagaaaacgggttatttgtcagccaaatgagatgccaattttccttaccaaaatggggctaattccttcctgatactcccccctctgaaaatatgaagatcaatatttaccagtaagaaaaaataaattatggtatgataatttatacagctgaaaacctctttgttaatagacatcatttgtctggtaatgggccaaccttctggggacaaatgtggtcaatcacaaggttattcaggtgcccctgaaacatcacaacttgaaaggtcaattataacacaagtctaaccatatgtataataaacatgggaagaagacaactttctaaaaagttttgattagttacccaagagaaagcatgtatgctgcattttctaaaaaggctggcctgacctcatcctgttacttaatatcacagccagtaatccttctggtattatgtttctataatatccctaaacatggtctcagaattttgatgagccagctaactaagccaacttgtctgcaagtgagccaggtgttttcttactctgtccattttaagcatggcctgttgcactcaagaattaaccaaaaacatggaggaatatgtggatcaaatagggtttgtttggaagcactgagctctcagctttcctcatgtccaggagagcctaagatctgactggacaatgggggagatgttttaaaatctgtcaaacagaagggaaaccaaagcaacactcaaaaatagccatgtagaaataatgttgcattcatcatcaaaaagaatccttgggatgcacagcttcagagggatggtggatgaagaactaggttgggaggtggggttgaacttattttgtaccctgtgcatacttcccactggaaacaagcttgcatttacaaagcatttctgcccccgctgtcttttctaagatacaaccctgagagatggaatagaaaatgaagcgagggagggaggaaactcacctkgcctcacttctgctagggtttcagaattaaatctttctgaaagcatagttggagtatgtgaaatctgtatgttctatggctcatatctttttgttcattaaataagaaatctctttgcacatgactcgttttgctttctgaggtgaaacatttatattctaatataatgtgttaatgacaatagcaatttaaatrttgtagcacacacagcaaagggaattagaaatattggtaagttttatgttttccccatttagaaacagtctatgtcttatgatttaaactgtaaaggcagagaagtccattttttacattacttgataagactactgaattctctttctcatatgtgtggtaaatatacacaaatatctaacaaataattgaaatataaaatatgggataagaggattatttacaattttgaaaaacatgcctggcttttcagcttatacttttaagaaaacattcattatatgtttgaaataattatatctggaaggaaaaattattttttgctgtgctccagaatgatggcttactttttttcctattggatagtgtgttagagtaattataagcaataatcattgcctttcccataaatattctccctgtaaataatccrtttattttactttatgtagtcttgaatcactagaaactatttagtaatgctgatgagaaatgctttaatataaaggagactgattttatctgtcagttacttttacatgataaaaatgtacaggatgattgctaatcatgataagtaatgagcaaacattcagcttaaataagatcttagtaattgtttattaaaattaactgggaaggcataaatgcttttacctgaaatctcaatttcaatttctaaactctgtagtaaatttgtcagaaaatttagtgaaatggctattttagttcctaagtggcagaccggttctgtatcgtgtgaatcttcagagattttaggtgttatagttaaattatattaatacaaaaatgtgggaataaacagaatgagaacatacagggactgctcatccagactttactattcagaccttacagaggaatcagctaccatcacttgctttgggcagagtctcaaaaacaggcagggaaaaggaaagctttaaaaaggagatttctagtattttctgatgggatactgttgaggtagagaagtttcaggtagactaaataggagcaggacattttatgagatgggtttgaggggtatatttggctttctctgattcttactgaattgaaagctttggcaaatataggtaagktggctgtcattgaccaaatcatgtccattctgggtctattgctacataagctgtggtttaatttccaggactggttgctgcagaggttatggtcaaagctctactgtcatataaattctggccattgttcatttatacatttaatctctctgccaacaaagtggaaaacctagaagaaatggaggagttcctaaccatatgcaagtaccaagattgaatgctgaagaaatccaaaacctgaatagacaaataacaagtattgagatattaacagaagtctcccataaaagaaatggctaaaagctratggcttcactgttgggttctaccaaacaatttaaaaataaataatgtcaatcctactgaaattatttctaaaatgtgaggaggagggagtacttcctaactcattctatgaggctagtattatcctaataccaaaaccagatgaaaagacagcagaagaggaaaatgacaggccaatacctctgatgaacatgataaaaaaaatactcaacaaaatactagcaaacagaattcacaacacattaaaaagtacattcatcatcattgagagggattcattccagaaatgcaacagtggttcaacatatgcaaatcaataagtgtgatacatcataccaacagaatgaaggatgcaaaccatacaattatttcaaaagattcttaaaaaaaatctgataacattcaacatcccttcatggtaaaaaccctcaacaagtatgtatttgtcctcaaaatgaaaaatatctcaataagataaacgctrtatataacaaacccacagctagcatcacactgaatggggaaaacctgaaagcctctcctttaacagctgaaataagacaaggattcccactttcaccacttttattgaacataatactagaagtcctagccagagcaattagacaagagaaagaaataaaagtcattcaaattraaaagaaatgagtcaaattatccttgcttgcagatgatatgattttatatcttttttttttttttttttttttgagatggagtctcgctctgtcgcccaggctggagtgcagtggtgtgaccttggctcactacaacctctgtctcccaggttcaagcgattctcctgcttcagcctcctgagtaactgggattacaggtgcataccaccatacccagctaatttctgtatttttagtagagatggggtttcaccatgttagtcaggctggtctcaaactcctgacctcatgatctgcctgcctcggcctcccgaagtgctggkattacaggcgtaagccatcacgcccggccgattttttatcttaaaaaaactaaagactatcccaaaagttactggatctgataaattcagtaaagtttcaggctacaaaattaatgtataaaaaccagtagcatttctatataacaacagcaagcagtctgaaaaaaagaaaccaagaaagtaatcccattacaatagccacaaataaaataaaatacccaggaattaaccaaagaagtgaaatatctgtacaataaaactgtaaaacattgatgaaagaaattgaaggggacacaaaaatggccatatatttcatgttcatggatgagaagaatcaatattgttaaaatgttcatactacccaaagcagtctacaaattccatgcaatctgtgtcaaaataccaatgacattcttcacagaaacagaaaaagtaatcctaaaatgtatatggaaccacaaaagacccataatagccaaagcaatcctgagaaaaagactgaagctggagacgtcacattacctgacttaaatttatactacaaagctatagtaccccaaacagcatgatactggcataaaaacagacacacagaccaatggaaaagaatagagaacccagaaataaacccactcatttatagtcaactcattttggataaaaatgccaagaaaatacattgggaaaaggagagtatcttcaataaatggtgctgggaaagctggatatccatttgcagaagaatgaaactagacctctatctctcactatatacaaaaacctaaatgaattaaagacttaaagctaagactgcaaactgtgaaactactagaagaaaacattggggaaaaacttcaggacattggtctgagtaaagatttcttgagtaagacctcaaaagcacaggcaaccaaagaaaataaatggacaaatgggatcacatcaaagtaaaaagcttcttctgcacagcaaaggaaatcatcaacaaagtgaaaagccaacccacrggatggaaaaaaatatttgccaatgacccatctgacaagagattaatagccagaatttataagcagcttgaacaactcaataggaaaagaacaatccaatcaaaaatgtacaaaagatctgcatagacatttctcaaaaggatacatacaaatggcaaactggtatatgaaaagatgctccatatcactaattatcagagaaatgcaaattaaaactaccttgaggtcacctcaccccagttaaaatggcttttatccaaaagacaagcagtaacaaatgctgatgagaatgtggaaaaagggaaactcttgtacactattggcgtgaatacaaattagtgcagccactgtggagaacagtatagaggttactcaaaatctaaaattagaacttccatgtgatccatcaatcccactgctggatatacatccaaagggaaggaaatcagcatatcaaggagatatttgcactcccacttttattgcagcattattcacaatagccaagaaatggaataaaattatgtatccatcaaaggataaatggataaagaaattgtggtacatatacacaatggaatattattcaacaataaaaagaatgaaatcctgtcatttgcaacaacatggatagaaatgtaagatattacgttaagtgaaataagccaggcacagaaagacaaatatcacatgttctcattaataggtggcaacaacgataacaataataataataaaccatgaaagttaagagaaaaatgagatgtggttaatgggtacaaacatatagttgggtaaaaggaataagatctggcatttggtagcacaatagggaaactatagtaaacaataatttattgtacatttcaaaataactaaaggagtagaattaaaatattcctaacacaaaaaagataaatattagataccacagccacccttatttaatcattatatgttatatgcttgtatcaaaatatcacatgtacctcataatgtgtacaactattatgtattcataataattaaaaattaagggagttggagatggttaatgggtacaaaaatagaaagaatgaataagacctactatttgatagcacaatagggtgactatagtcaataataacttaattgtacattttaaaatgaagagtataattggattgtttgtaactcaaaggatggataccccatgctccatgatgcgtttatttcacatcgcatgcccatatgaaaatatgtcatgtatgccataaatatacacatctactatgtacccacaaaatttaaaaataaacaaaacaaagtttaaaaaataaaattaaaaatgtaaaaatgtgtgaaaaacatcctaagaaaagaaatttaactgaatatcatttctttgagatggtgattggtaggtagttataaaaacaatattgaattaatctgatatttaaaaacaaaaataaaatagttatttttatagaaaaaggtgatctctgataatgtgtattctaaaccaatagtccaatgagtttaaaagtacctggtttaaaaaaacacagtaagatagttcaatggatgcacctttgtgaatataactatttttgtcagccttattctcgctgtctgtttcaagaactcttagttagagtagtttggatttatttggtcttctacagtactttaatgaatatattctatgcatagaatttttttcagaaatgaaattttaaatttcaacttctgtctctctccaaaaaaaattgtaataccttawcctcaacctcgtcatgtctcattttagattttgtcattctctccaaacttatttagatacttaattctttatttattttcttattcagaaagaatgctttgcccatattttaactactctctcatgaaaattttgatctctccgtctctcatgtccatatgacacaaaatctcaaccctgcctcaatcctaccacagactttttttgtcctttgtttggtcttcagattgtggaactcacccatttttcgctagtgctcaggtatttgtactaggaaatgttatagagggagggatcctcagagaaacagagacagtaaatttttgctactctgaaatgtaattgcttaagacacttttaatttaaacaacrtacaacatgcacacactgagagagaacttgaccctctctagtaaacatttcttttactttctctaagtctttgacctcgaatgctttaccttgagtacagatattttcctctgccttccccatccttcatttcaagtaagtactcacctcaaaggcaatctttgatatttgtattttgtgaccacatttcctaattatggataagaatttatctcagtgcctataccttggctgttacaggctcattagccaggtcctttctgcatgatttcactggtcaattgggtgcaactatacaaatattagttatcattctcattgtaattatcatggcacttaaaatgtaagaatgccttctgtttgttcatataatggcaaaatggccctttagtatactttctccatgggagcttactctgtgctttcaaatcattatatttacttatctagactttcccatcaatatagcattcatatcatgtgccaatttatggaatttttactggcttcaaatttttttctatctataataacaaaaaaagaaagactcacaatttcattattgtggggccaaaacattaagaattttgaattagatattttgggctgttaaatgttttagaagaaataacttctgagtttcccttaggaaaacaccctgaaacctatcaatctaattattatctgcaggagaatatttcttatatcccacaagggagacctaagatgttaggaaagggttctatcatgtttctgaactgatagaattgatagtctgcaagaaaaataggaataaaagtggaaacaagtgatttgtaggaatgagaacactaaatataatattttgtcctttgaacattaaaagtatttttgtttattacaatttatcctcacttgtagagaattcattcaaaactatcttcagatagcttaatgtaactgtttggaaatcactaaatgtttttgaagtttgccaacatattgtgaactagaaaaataagctgaattatttcatacaagatatttcatgaaagccttggcttttcagtttaagcagatactaaaattacctrgggaattattttgcaagtaagtaggttgaaggaaaaacaaaaggcagtggaacgaagtccaggaaactgaataaagaagtcaaagattcattcacttatttgttcattcatgtgctcattcattcatgcatgcatttaaaaaatatttcatgatcatgtattatacacaggattatggtcttcacgtaaaaaacaaaatctgaayttggactcaatttctgtccttgaggacttacagaaattagaggaataataaatgtaataaataagaatccaggttgggtgcagtggctcaggcctctattctcagcactttgggaggctaagatgggaggatgcttgaggccaagggctcaagaccagtctgggcaacaaagagagaccccacaccctcacttttccctcccaccacaaaaataaaaaggaaatattagctgggcatggtagcccacacctgtagtcctagctactcaggaggcttaggcgagaggatcacttgagcccagaagttccaggctgcagtgagctctaattccaccactgtactcccatctgggcgaaagaacaagaccccatctcttaaaaaaaaaaagtaagaaatgggaacccagaaaagaagtgagcagcctatgtcctgtggattaatgaagaattcataaaggaagaactatttgagctcaatctgataggatgagtagcttcctaggtgggaaagtggaagcagcattccccagagaaggaatatggaatgtagggcacagttagaagaaaagaagcaggagatwacatggtgtgaattgggaacacatcatgaaaggattggaatcaaaacttaatattataaaaatctaaggagccggacatagtggccctagcctgtcgtcccagctagtgaagaggctgaggcaggatgatcacttgatcaagcccaggagcttgaggctaaagtaagctatgatctaccactgcactccagcctgggcagcagagcaagactccctctcttgctaaaggaaaaaaaaaaaatgcatgaggatgtcaagtattttaaaatgactctaatgtgttgtgcatggataatcgagaaaaatatkggtgctatttttttttttactgaaatgtgaattaaaggaaaaagataattctgaggatgatagagagttcaaaatcagatattttggatttcagaaaaaaatgagcatgtgaaaatatctgacttcctgttgaaaagagcagctagggttcaggagaatattcattatacatccaaatttgggaattattctcagaggcataattattaaagctttgagagccaaagagcttctcrgggtaggctatgtgaaaagagaagaaaatgaatctacaggttagatattagtctttattttgaaatataatatattgtaataccaaatactaatttggccattcataaattgttaaacatttctctcttttttgtgtgtgtggttcctatacacttttttggccttaaaaatcttttattttaagtttgggtgtaaaagtgaaggtttgttacataggcaaatacatttacacgggtttgttgtacgtattatttcatcacccaggtattaagcccagtacccaatagttatcttttctgctcctctcctcctcccacccttccccctcaagtagatgctaatgtattttgttttcttctttgtgctcaaaagttcttaccatttaactcccacttataagtaagaacatgtggtatttggttttctgtttctgcatcagtttgctaaggataataacctccagctccatccatgttcccataaaagacatgctctcattcttttttattgcttcatagtatgacgtattatgtatgtaccacattttctctatccagtctgtcactgatgggcatttaggttgattccatgccatgtctttgcgactgtaaatagtgctgcaatgaacatttgtgtgcatgtgtctttatgatagaatgatttctattcctctgggtatttacccagtaataggattgctgagccgaatggtagttttgcttttagctcttggaggaattgccatactgctttccacaatggttgaactaatttacactcccactaactgtgtataagtgttcccttttttctgcaaccttgcaagcatctgttattttttgactttttaataatagctattctaactggtatgagattgtatctcattgtggtttcaatttgcatttctctaatgatcagtgatgttgtacttgttttcatatgcttattggccagatatgtgtcttcttttgagaagtgtctgttcatatcttttgcccactttttaatgaggttgtttttctcttgtaaatttgtttaagttccttatagatgctggatattggacctttgtcagatgtatagtttgcaaaagttttctgccattctttaggttgtttgtttaccctgttaagagtttttttttgctgtgtagaatatcttaattttaattagttcccacttgtcaatttttgcttttgttgcaattgcttttggtgtcttcatcatgaaatctttgcctgtttgtatgtccagaatggtattgcctaggttttcttccagggtttttataatttttgggttttacatttaagtctttaatccatcttgagttgatttttgttttctgttttttttgagatggagtctcgctctgccgcccagactggagtgcagtggcacgatcttggctcactgcaagctctgcctcccaggttcatgccattctcctgcttcagcctcccgagtagctgggactacaggcacccaccagcacgcctggctaatttttttgtatttttagtagagatggggtttcrccgtgttagccaggatggtcttgatctcctgacctcgtgatccgcccgtctcagcctcccaaagtgctgggattataggygtgagccaccgcgctgagccttgagttgatttttgtatgtggtataaggaagaggtccggcttcaatcttctgaacctggctagcctgttatcacagcaccattcattgaatagggagtcattcccccattgcttatttttgtcagctttgtcaaagatcagatggttgtagatgtgcagctttatttctgggctctctattctggtccattggtctatttgtcggtttctgtaccagtaccatgcatttttgattaatgtagccttgtagtatagtttgaagtcaggtaacatcatgcctccagctttgctctttttgcttaggattgccttggctattcagactctttttggttccatataaattttaaaatagttttttttctagttctgtgaagaatgtgcttggtagtttaataggaacagcattgaatctgtaaattgccttggatggtataaccattttaataatgttgattctttctgtccacaagcatgggatgtttttccatttgttgtgtcttctctgatttctttaagcagcttttgtaattctccttgtagagatctttcacctccctggttagctgtattcctaggtattttattctttttgtggcaattgtgaatgagattgccttgctgatttgggtctcggtttggctattgtgggtgtataggaatgctagygatttttgtacattgattttatatmctgcaactttgccgaaggtatcagctggaggagattttgggctgacactttggkgttttctagatatagaatcatgtagtctacaaatagaaatagtttgacttcctctcttcctatttgggtgccctttatttgtctctcttgccagatagctctgggtatgactttcaatactattttgaatagaagagatgagagagggcatatttgtcttgtgctggttttcaaggggaatgcttccagcttttgcccatttagtaaaatgttggctatggatttgtcatagatggctcttattattttgaggtaggttccttcaatatctggtttatggagagtttttaacatgaaagggtgttgaattttatcaaaagccttttcttcatctattgagatattcatgtggtttttgtttttagttccgtttatgtgatgaatcacatttattgatttgtgtgtgttgaaccaaccttgcatcccagggatgaagcctacttaatcatagtggattagtctttcgacatgctgctgaactgagtttgcaagtattttgttgaggattttttcatcaatgttcatcaaggacattggcctgaagttttcttttgtgtgtgggtctctgccaggatttggtgtcaagatgatgctggccttatagaaggagttagggaagagtccctcctcctccattttatagaatagtttcagtaggaatggtaccagctcttctttgtacatctrgtagaattcggctgtgtttccatcaggtcctgggctttttttggttggtaggctatttattaccgagttaattttgtagctccttgttgacctgttcaggtaatcaatttctttctgggtcagtcttgggagggtgtatgtgtccaagaatttacccatctcttctagattttctagtttgtgtgcctagagatgtttgtagtagtttctgatggttctttttggttctttttatttctgtggggccaataataacattaccttatcacttatagttgtgtttatttggatattctctcttttcttccttatttgtctaggtataatagcctatctatcttattatttttttcaaaaaaccaattcctgtattcattgatcttttgaattttttgcgtgtcttgatttccttcatttaacttctgatattagttatttcttatcttctgctagctttggggtttatctgtttttgcttctctaattttttcagttgtgagattaggttgttaatttaagatttttctaaattttgatgtggccatttagtgctatgaatttccctcttaacactkccttagctgtgtctcrgagattctggtatattgtatgtatgggggtctaacctcccactttgctggacctgcagctacttttgctggaaagcccaagtatctaaggctccagggtctccacatatgrctgagcagctgctcttccaagactccaagtgtctctgtctgtcagactgaaggccctggtacaatgggttcacaaggagatctcctgacctgaaggttacaaagatctgtgcagaagcatggtttcctggggcagctcattcactcaccacttctctgggtgggggaggttctccttgctctgtgttgttcccaggtgggcagttgtcctgtcttgcccttctttgttctctgtgggtcaagttgtttccttgattagtygtaatcatccagtgagtaactggatgtttcagttgagggcattgtattactcacccctttcattcttctccctgacagccatgcacaccagctgcatctagtcggccatcttggccactccctctttaaaactttcttgtacattacacatacctcttagataaacttaataaaagataaaacatcatcattataggcctggcaatgagaatattgtataggtgttccatgaaatcccttatctatgaagaatacagctgtagtttcctcagttttatttgtttggttggttggttttgtttccagattagagcttagtagcctagaagaaaaaaaggaatactcatattttcagtagttcttcaatataaccaaaaaggaaatttagctttgaatttmtaccacaatattcttatctgctctagrgtggaaatacatagtagcaacagggttaaagcaatgaacactttctttttttattccacttttaagcaggagttagagcaccttctattattaaaaagaagtttccattaggatgccactagagataccaaaatcaaagtaaataaatatatttctacatagaatattttaatgttataacaatcagtaacatttttgtttagtctgttttcacctatgttctacattttaaggacaattaaggggcagaggatgtagtctcacaataagttttcagggtatgttatttgaacagaaagcaaaagagacacaatattttaaggtttaggtagataaaacctagcactgtggcaggagtgtctrttggaagcaaatgtcatttcctcccagtatagagtagtttggtttttgagttgtttctttaggttcagagtaaataggatgctctctaaaatctgctctaattgtgatgaacaatgtccccagcaactctaagtgtgtaatatttgtagttgttgttgtttctcctcccatcagattatctctgtcattgaatcttccctggcatatataaaagtaccatgcatagtggaaaatgccagagtgctactgtttgtttttctagtgtttctcattgagtgttggctttggaatccaacacacaccactattgaatcctgagattgtcattagaggctaactgtggtatggacaaatcaattactctttctcaattccaattttgtcattattaaaatgaggaaagaagatccatgataggtttgctgtgatgattatataataatgyatataaaatgtatggtacagagtgacgacacaataaatggtgattgttattttcaaattacttcaaattctctaaaacagaatgtaaacagacaggagaaaaaccatagcgcagagctggtgtggaatttaaaattctttacagaatcccacaaaacttagaatatggggcaaacccacataatgccatagctggaygatgaaaaagtttatagtcaacagctgatgacagaaaaaggataaaaacattttggccaaaaaaacagcatagaatagtcatcatagatagctaattcatggcgggataatattagaagagagccaaaaggcaaagtgcagtttcagtgatgtgggtcatgtacggagaggaggagattatattctgcattgccagaaatgagaagaaatttctaaaaaaaaaaaaatcaagataaacaaacattaaagggtgttgttttaaataaatataagcatttgtttgatttgcttttgatttttctggataaatataaacatttgtttggtttgcttttgatttttctggataaaaaatggaaggccgggcacagtggctcatgcctgtaatcccagcaccttgggaggccaaggcggtagatcacctaaggtcacaagtttgaggccagcctggcaaacatggcgaaactccgtctgtactaaagatgcaattagccgggcatggtggcatgcacctatagtcccaactacttgggaggctgagtcagtagaatcgcttgaacctgggaggggaggttgcagtgagccaatatcgcaccactgcactctagcttgggtgacatagtgagactccatctcaaacacagacacacacaaacacacacacacacacacacacacacacacacacacacagcatagtcctattacatttttaggcacaccctaattaactaacatcttgatgtcccttgaggtatgcctcctacaaaataatattagaaaaggcagattcaagatttcaggagcgtcagtttgccagctggctgccatgtgtttgactggtgtttaacagtgagtattggctgacctctgctgaagaacagggatagtatctgggcacctgaggcaactgcggtccacaggtgaaaacataatctctcagatttgtaatggaatactgagagatgtcaagttgagtcatatcacataagtgtcacctgctctgacagcattcaggacatttgcccatggtgcttttcttccattttttctcttcgtataatcatacactgtaagaggtcrgtggggactggtagtcttttaaagtgcattgacagaaaaggacagtatatatttcaaatctggctcatttgttatagcaaaagacagatactgaattgcaattgctctggataagggcaaaactcatttaatatagctacaaagtataataaaattaacctaaaaaaagacatgagtaactccacagtgctctcttaatgactacattgccagtggaattgctaatttggggttcaatgtgcatccattatttcaaagcgttcaatatttaagacaatcttccaatatacttccaagtcacatttttgtactttctttttcgtgtttttcccccacatgtccttttcttagcattgccattaaatcatttatctttttgtaactactctgagatttctcttctctctctctcttttttttttttttttttttcattacccggatagctaccttatgtttactgctttccatggagattacttgtcaacacaccttctgttttattttcttctacttctctggcctcaatgtaattagatggtcaatttcatccttttatttccatagtctactcctcttatcttattctctaatagtcctgttctccaatccacttattctcattatttttattttcttttttttttttttttttttttttttttttgagacagagtctcgctcagtcacccaggctggagtacaatagagcgatctcggctcactgcaacctccgcctcctgggttcaagcaattctcttgcctcagcctgccatgtaactgtgattacaggcatgcaccaccacacctggctaatttttttatttctactagagacaagatttcaccatattgggcaggctggtctcgaactcctgacgtcaagtgatccacccgcctcggcctcccaaagtgctgggattagaggcatgagctgctgcgcctggctgtattctcatttttttttaatactacttctatttctccattcaacatttatcttttagatatgaccctctttatctaaatctcatcaattatcctttcccttcattttaacctcattttacaaattacttgcttcttccatctctcagtcatttctttttctttacatttatataaggtttatcatatcccttttcccaccactttctttctcatgctttataagtatttattgagtttttctatgtgtctggcatataggaacatactatgacatagaccttgctttcaagaacttccccatctagaagagatagacacataaattaataaatttttaaaaatatagaaagttcatgaatataaataaacctgcagttttatagaagccctggagaatgtgaaatgggttgagagcggatgtcatcaagaaaaactacctggatgatgtttactacctctaagaattgacggaggaggtgatggaaagtgctctctaggtcagtgagacagcgtgacaaaaagactcagagatacaaaatagcatgtcatggtagagatgaagaagtagttaggtattgccagagcataagtggaagacagagaatgtgacaaaggagcttgagaacagggaagggtcacactgtagaggatgttatttgttatgctgagaagcgtgacatgagcaggaaactgaaatgcattgaagaaggaaatggccacaattattcatttttattatatattctttcagctatttagacaggacagatttcagggatataagaatggagttaggtatcccagttgtaagctattttatgagaatctggatcaggatgacaatagagaaagaccagaaagtacagattcaagaattatttagaaaaaaaaaggaacaaatgcaaatgctagttgatgtggggagtgagagagaggctgattccaggaatctatatttagtgatgagatgcaaggtattgtcaacatcgaagagagagaacacagcaaagaacctgctcatccttcattttatttgtttgttttgttagtttttgactttttattttgatacaaattttgacttacagaagagttagaaaaaacatgcagagagcactcatctacacattgcttggcttccctgaatgttaaggtaacatcttacataaccatagtacagtgatcaaaaccatgaaattaacatttgtgctattaatgttattattactgctattaattactattaaacaggcctaattggaacttcaccagttcttttactaattggatctcaccttatatttagctgccatatctcctttggctcctccaatctatgacattccctcagtcttttcttgtctttcatgaccttgccacttttaaagaatactagtcagttatattgcagaataactgccarttggggttggattgatgttttctcattattggattgaagttatgcatttttggcaggcatgctacagtgatataaccttctcagcctatatatcagggagtacatcatgycagtatgtcttattactggtgataattaaccttgatcatttggttaaggtggtgtctgctggctttctccyctgtaaagttacactttttccttttataattagtaaatatcttgaaggagatattttgagactatgaaattattttgtttctcctcaaactttcrcatactaatttggacatccattggtagatttttttaaacttttaagttcagggatacatgtacagatttgttattatagataaacttgtgtcatggagatttgttgtacagattccttgtcacccaggtactaagcctagtacccattaactatttttcctggtcctcaccctcctcccaacctccaccctccagtaggcgccagtgtctgttgtgcccctctataagtccatgtgttctcctcatttaacttccacttgtaagtgagaacatgctggatttggctttctgtttctgaatgagtttgctaaggataatggcctctagccccatccatgttcttgcaaaggaaattatctcattctttttatggctgcatagtattccatggtgtatatgtaccatagttactttatctagtataccattgatgggcatttargttgattccatgtctttgctattgtgaatagtgttgcaatgaacatacacgtgcatctatctttacaatagaacaatttatattcctttgagtatttacccagtaatggaattgctgagttgaatgacagttctcctcttacttctttgaggaattgtcacactgctttccataatacttgcactaatttacactcccacccaatagtgtataagcatttctttttctcctcaacctcagcagcacctgttattttttgagtttttaataatagctattctgactggtgcaagacagtatctcgttggggttttgattttcatttctctaataatcagtgatgttaagcttttttaaataagtgtgttggctacatgtatgtcttgtttggaaaagtgtctgttcatgtcctttgcytatttttatatggggttgtttgttttattttttcttgtagatttgcttaagttccttgtagatggtggatattagagcttagtcagatgcagagtttggaaaaattttctccccttctgtaggttatctgtttattctgttcttagtttgttttgctatgcagatgctgtttagtttagttagatcccatttgcttttgtcgcaattgcttttgatgtctttatcatgaaatctttgcccgttcatatgtccaaaatggtattgcctaggttttcttccagggtttttatagtctggggttttttctttaagtctttgatccatcttgagttaatttttgtgtatggtgtaaggaaggtgtccagtttcaatcttctgcacatggctagccagttatcccagcaccattttttgaataaggagtcctttctgcactgcctgtttttgtcagctttgtccaagatcagatggttgtaggtgtgtgggcagtcttatttctggactctctattctattaagttggtctaaatatctgttttgtaccattrccatgctgttttggtttctgtagccccatartatmgtttgaagttgggtagtctatgcctccagctttgctctttttgcttaggatttcctgggctattctttggtttcatatgaatttcaaaatagttttttctcatctgtgaagaatatccttggtagtttgataggaatagcattgaatctataaattgcttcggccagtatggctactttaacaatattgattcttcctagtaggaatgtttttctatttgtttgtgtcatctgtgatttctttgagcagcatttcgtagttctccttgtagatatctttcacctccctggctgcctgtattcctaggtcttttattcattctgtggcaattgtgaatgagattgcattcctgatttggctctcagcttggatgttgttggtgtgtaagaatgctagtgatttttgtacattgattttatatgctgaaactttcccaaagttgtttatcagcttaatgagctttggggttgagactatgggattttctagatatagaatcatgtggtctgcaaacagggatagtttgacttcctctctttctattcggatgccctttatttctttctcttgcctgatagctctgactaagattttcaattctatgttgaataggagtgatgacagagaacattcttttcttgtgctagttttcaagggggaatgcttctagcttttgtccattcattatgatgttggctgtgggtttgccatgatggctcttattattttgaggtatccagggaaacttctcatcctttsatgcctccatcaagtggtcttccaacaataatgataatttgcatttttttaaagtgtgctataattttgaaagctctcacacattcattacttaatttaattcttatgaaaatcctctgaaattgactyagcaggtcctattttccataattttcaagtaacagtactgaaaaagccattgctcaaatgtatatcctactgaccataggttatttaaatgctcaaatttttttttcacaatgagacagcataggctcctggtctggcagtcagtctgctggggtctactgtaggtatcagcaatgcagccacgaagctactgtcttccaaacataaaagaggttagagaggctgatcctcatagaaagcatcctctgcctgagactccttgccactggaatgcatgttgttcagttactcctacagagaaagttgccatcaccatcagaaggaacacacttcaagtaagaaagatatccatgggctcagaattcaccttaataagcaaatatttcatayacatataatgttttccrtaccatgttttatacatgggttacatatagacatgaaactgtactagtgacttctagaatcagtctattgatctctttatatttgttgcacatttgtcttgtattcctgtggagttgtattacagacaatgatgttatttttaaagcaatgcgtagagcttctgggctggtgaacacgtagagctgcatgggagctttgtggtctgtccctccccttcgctttatgcatcctttccatttgggctgttcctgtgttgtgtcatttctaataaattgatacacaataaaaatagcaattacaaatggttggtataaaagaaaaaaaaactctatgttttcctagtccagctgaaaactagagaaatagcttttctagcagcagtaacaacacgggagaggttgatgataacaagggcctttcctgaacggcatttattttcatttcaaatgagggatgaacacaagggcaaggcaggatacttcaccatggattaacttttcttgaccgtactggaatccactttgctatgagaatgtatcatatcatggtttactctgtatttccaggtagtgcactggcaaagtctttaaataagtttaattctcattcatcctcattattatgaaagctgtgtttagatttaaattttatggttaaggtgaggcttaattccatgaattgcttatttattttttcagtagaaaaatgagagagaatgggctgaattatgattcctatgagaagcttggcaacagcttaacttcataaactaattaaagagacttgtcaaattatatttggcagcttaaaatcttggattcaatgtaagagatcagaattaatctgaatgttgcttatattaactagtgtttattcttttaaccaaatttagtcctgaactattctgaccctgaagggcaaaatgctctaaagcagtaattttctataaaaatctagaatttttcttatatcattcatatctgtgtcattttaaatttggaactactggccaggcacggtggctcatgcctgtaatcccagcactttgggaggccgagatgggcggatcacgaggtcaggagatcaagaccatcctggctaacatggtgaaaccccatctctactaaatacacaaaaaattagccgggcatggtggcgggtgcctgtagtcccagctactcgggaggctgaggcaggagaatggcgtgaacccacraagcggagcttgcagtgagctgagatcgcgccactgcactccagcctgggcgacagggygagactcagtctcaaaaaaaaaaaaaaawaaawaaaaaaaattggaactactatataaattttatgcatttctatgataagtctctgtaatatagtccaggccaaataattctcttttaacaactgctaagtaaattcaactttgtatatgtggatagttttaataaaagtaaaccaaggagttagtaaaaacggttgytctcaaactgtaatcaggaatgcctggcaagctggacgtggtggctcacccctgtaatcctaacacattgggaggctgaggtgggtrgatcacctgaggccaggagtttgagtccagcctggccaatayggcaaaaccccatctctactaaaaatacaaaaaattagcagggcgtggtggtacatgcctgtaatcccagctactcgggaagctgaagcaacaagaatcacttgaacccaggagrcagaggctgcagtgagccgagattgcaccatgagactccagcctgrgcaacaagagtgaaactccatctcaaaaagaaaacaaaaacaaaaacaaaaaaaacctggtggtccttttaaacatgcatggttttcgccgtctagagacttactgaggttgaatgtcaaagtatagcatttgagaatattttatgccttccagttgattctgcygtgagctgtttgagaaaatactaggttaaactgcatgattaatattattcactattaactggagaagatagtaatgttacaaatccatatgctggtagatgtataaaacatctttaggtgtttttctctagagaactgggggtcaggcagaggtgaaagagatatttatttttgactctaaatgtattccttctaccatttgaagttagttttcactgagcttctaagttacaaatatggtgtggggtgagtgggtatgtgggataagagtaaatgggtatatataaagtaaaagataaagaaaagtataggatctgttgtattctttttgatacctcataaatttatatttctccttagaaaacttctgttgatagtttttaagtaatccttaaaaattaacattcacaataagcccatctttcatttctactccatctttagccttttacacaaaattctttctagacttctcactataagccaggccttatgctaggctatgggaatataagtgacacatggtcactaccctcaaatgttgccaagaaacccccccaaagtaaaagaaaatcctttatctataaacagataaagaaatttgtgtaaggtaaactcatccccaaatacttcacctaaaaagatttaagtatcaaagtatctactgagaatataatacatttattataaagccagcggcaaaaaaaaaaaataccctcattccctctattcctactattccctcttcctcttttgtggaatattgacctatttcttcccaatcttttatgtmggtatatatgtatttgtttatttaaattatttgcttctaccataatactgttaacttttgtttagttatttggttattctaaattcttaggctgccaaaataccacccaaaggaggatggaggtgagaggaaaagtgctttcttagaccccccatgtctgtatactactattccctggaatgctcatttcattccctacctgtacccttttcggcttcamaaactcctcagaaatgcactcaccttctatttatccatctaattaccctccctgcttattttgaaatatataatttggactacaaagatatgctggtaaacagattttctttaaatttgaaataggtgaggactgccaggcaaaggaaggaaaaatatttggttattaaatagcactgagattcaaacataaaaatgaatgccccaaacactgcacgctggtcaaatgtggagtataaatttaactctaagctgtttaacaaaagagagtgatataaaatagttacagttattaactattttraaatttaaaattagtaactattatttagtaaaatgtactttttaaacatataattaaatgtttatggaaagcacaacacttactgatttgcaggtacaccattcattttctatttttaatccacagttcttgttttgcttacgggtggtgtctgttttcccttcatgagctttaattggctaaaactgatcccttctcattcaggtagctaatgtctaggccacaggaaattgaatgtaagtggctattaaaggagttctctggaatactcacagtgcataaattagagttttataaatgatctaaaactagttaatggtcaaaatagtgtgaagttagaaattatacaaataaaggtaaggaatagaagctagcttttgaatcatctaaataaacatgctattttcctgtcactgagcacagggctgctgctgctgctgctgttgaagttaggtgaaaatggtgaagaattgaactggagactgtataatgagaaatgttcagaagctccagaaattcaacagcaaatttttccttgttttcattctcagaattctctagtagaatgaatcagatatkgatgaaaattgaatagagaagtatgccgagaacttcacagtatcagtcagtctctactgcataacatttaaatattttcaggtaatgcttcccatgaagtcatttagcactttctaactttaaatttcaattgttgttatataatataatataatataattaatataaatagtatgagtactttcaattcacgttcactcacactatctaattcaaatatctagatcacctgtgagraagataaaaatagttataatttatttattgtcatatcatttcaaagcctgttctaaattcttttcttaactcatttaagtaaatcctatgaggtatatactgttaatattttacagatgcaggcattgaggcatggagaaaatatcttcataactgaaggcctcacaagtggtaaatgccagagatggaatttgaatgcgagcagccgggctccagaactgcccctaggctttgccaacatattgcagggaaggaagtaggagcgaagacattatataagtctgtgattcctaatacatatctctatatgacgtgtagaggtatagaaaaaaatgtcatctggttgggtctgaagttatagaaaatccagccttaaggtttcaatcagtcagaattagaagccagagttcttccattccaagcctatataataaacatagcttcataagggaacatacaagctaaagagcatcactgattgagtctttccagtccctgatctcggggggctttcagtccaggaaagtgcataagcacactgaaactgaatgagtgctattgtatacacacacacacatacacatgagcacatgtgcatacatgtatgcatacatgcacacaagatttagaagacttatatgcatttwaaaaaaaaggtttagaatccagattaaacaaacaattatgccgggcacagtggctcacgcctgtaatcccagcacttygggaggctgaggcgggcagaccacgaggtcaggagatcgagatcatcccggctaacatggtgaaaccctgtctctactaaaaatacaaaaaacaaaattagccgggcgtggtggtgggcgcctgtagtcccagctacttgggaggctgaggcaggagaatggcgtgaacccagcatgtggaggttgcagtgagccgagatagcgccactgcactccagcctgggtgacagagcgagactcgtctcaaaaaaaaaaaaaagaaaaaaagaaaaaaaaattattacagcctgagctgaatcagtgtaacttccagggaggagcacttgaactaggcctacagaataaccaggatgagatgaacatgtcgagcccaagcatcagaatgaaacaaaagtagctgaagtgttgtggaaagtacaatgaatgtggctatttgttttgcttctaccaaacatggtgaccttgggcaagtcccttgacttctctgagtccatttcctctcctgtaaattagaaattgaataccaccaactacaccaggccattgtgaagaaaaataatatacatgaatatgccttatmaactataaaacggtatataaattaatrtattattaatagtatcttcatgtttatatttcatgaaacaaatgattatatgcagtagctatttctttttaaattcctgacctatggctttagatgtgataaattacttagaaatgagaacatggttgtgtgagttctctcataaaatgttgcacagtgcctggaaaatatctggcatacaacatacatttggtgaataaattaataaatgaattataaaaatgaataaatgtcaagctacagtttttccatgtctgtcattgccctgccttaaggagaccgtagcttcaaccactggactgtggaaaaaaaaatctgcagtattatttaaatctgtcatgcttgctttcatctcaggataaatgactagtagcaagcattctaaatttaacattatttttgtgttttaatttcatagttataatttattataattcacctaaaaatacctctacataattcataaaataatttaatcaaagggttttttcacatgcaaaagaaaaacaatgtttgttagttaggttagtaattattaagcattctctaagccatttacttttcaaataatttttttaaaaaaatcaaagaaatattgtgcactaaagaaaaatctaataatatgtaaggatatrttttttaaaaatgtcctctcccactcacaccttccctgtccctgtctaaattccaagatatgactactttagctacttttatgtttagctgttctcttagttacctagatttaactaaatatctttctatttcataatttttcatctgcagtcattgccttttgactccccataaatttataccaatgtttttcagttcctttaccagctacttctataactttaaaaataatactttagtaaccattttgttaaccatcagctttctatgagaacaggattcatctggactcctaatttgtgtggtaggacctggtagctgtcttgccatttttaatccttttctgaccactttctaccttccaaatcttacaagtgtaccttgatttttactctgcaaggttattttataatcataattatacatgttttaaaatttcaacttttaggttcaggacatgtgcagatatgttacatgcatatactaggtgatgctgaagttcagagtatgactgatcccatcacccaggtagttagtatggtacccagtagatagtttttcaaccctttactccctctctccctccctccccaactttggaggctccagtgtctattttccccatctttatgtccatgtgtccccagtgtgcctggctcccacttataagtgaaagcatgtggtattggttttctgttactgtgttaattagcttaggataatagcctccagctgcatctacgttgctgcaaaagatatgatttcattcttttttatggctacataatattccatgatgtatatatgaaccatatgttcttcatccaatccattgtttattggcatttaggttaattcaatgtctttgctatygtgaatagtgctgcgatgaacatatgagtgcacatgtctttttggtmggatttattttcctttgggcatgtacccaataataggattgctgggtcaaattatagttctatttttagttctctgaggaatctccwatygagtttccatattggctgtactaatttacatcctcwtcaacagtattcaagtgttcccttttctctacatcctcaccaccatctatcagttttcgactttttaataaagtcatgtgagacacataataaagttatgtgagatggtattttattgtggttttaatttgcatttctctgacgattagtgatgttgagcatttttttcatatgtatgtttttgcttgactatcttcttttgagaagtttctcttcatgtcctttgcccgcattttaatggggttgttctccacttgttcaattgttcaagttccttagaaattctagatattagacctttgttggatgcataatttttgaatattttactccattctgtaggttatctgttggtaatttattttgctgtgcagaacctctttcatttaattagattccacttgaccatttttatttttgttgcaagtgcttttgaggacttagtcataaattatttgccaaggctaacattcagaaaggtatttcctaggtttcttctaggattttcataggtttaggtcttacatttaagttgttaatccatcttgagttaatttttgtatatggtgatggctaggaatccagtttcattcttctgtatacggatagacagttatcccagcaccatttattgaatagggaatcctttccccattgcttatttttgtcaatttttttgatgttcaaatggttgtagatgctcacctttatttctggmttctctattgtttcaattgtgtctgtttttgtaccagtagcatgctgctttggttactgtagccttgtagtataaagtttagtaatgtgatgtyttctgctttgttctttttgcttaggattgctttggctattcaggctctcttttgattccatacaaattttagaacagtttttttgtaattctgtgaaaaatgacattagtggttcaataggaataatgttgaatctgtagattgctttgggcagtatggccattttatgatattgattctccctacccatgagcatggaatgtttttccatttgtttgtgtcatctgtggtttctttcaacagtattttatagttcttgtagagatctttcacctccttgtatagctgtaattatgtcattcatgctttgttcaattgcctgattctataatttgaaaagtctgtaataccataattattatttggactatgaacattgctcattacaatgagtggtgtgcaaagattacattttcttttttataattccagtacttcaaagttgtgtgccactcatgaagaacttcttcatttatttgtatgtttatctactcattcaataaatagttacagggcaccttctatgtatcaggcactgttccaagctcatggaataaaataatgagtgaaaactacaaatgttcctgacctcctgaagcttatatcccattgaacagagacaaataataaggattgggcacagtaagtaaataaattacatcacatttaagaaagctatggggaaatgaaaacataaagcagggtgaggaagaccattcttgctggttgtaggttataattttaagtagtgtgatcagttagacttcatttaaacaatatttgaggtacataaggaagttcagtacacagatatctagagaaatagagtttgaagcagaaggcagaattagaggaggaaatcctacctgggaagtgtacctgatctttgagactggagtaagcaaaggtgaaagtgttaaaagatgaggtcagagatgtgattggggctggggattggggtggggacagatccagtgaggactctcacttttcctctatttcaggggagcatttcgggggttgagcaaagatgtttactgctctgtattacattttttaaagggttactcctatattgataaataaatgtaagaagcaaatatccaagtaaaaaggccaattagaagctatgtaagaatgcaggaaaattgtgatgtgtccttcaacactgggaattccatgtcttttatttccttgaaatttctatctctttttaaatgttctatctttcttgagttatatgttggatcttttgtattgattctatatgtctcttagctttttttctcaaaagtttcacctcctattcttcattttatcttccaattcttccactgaaagtaccttttagtttcattttttgttgttctttcactgtttgtttttttccccactgcaccctatacctgtattatggatacactgtcttcataaataaatcatcttagcaatattggtatggagaattttatttgggtttagtttaacttctattccttttctttgagtaatctctgcttccccaatagtcattttcccttttttttaaattatactttaagttttagagtacacatgcacaatgtgcaggttagttacatatgtatacatgtgccatgttggtttgctgcacccatcaactcatcatttacattaggtatatctcctaatgctatccctccccccttcccccaccccacaacaggccctggtgtgtgatgttccccttcctgtgtccatgtgtcctcattgttcaattcccacctatgagtgagaacatgcggtgtttggttttttgtccttgcgatagtttgctgagaatgatggtttccagcttcatctatgtccttacaaaggacatgaactcatcattttttatggctgcatagtattccatggtgcatatgtgccacattttcttaatccagtctatcattgttggacatttgggttggttccaagtctgctattgtgaatagtgctacaataaacatatgtgtgcatgtgtctttatagcagcatgatttataatcctttgggtatatacccagtaatggggatggctgggtcaaatggtatttctagttctagatccctgaggaattcccacactgacttccacgatggttgcactagtttacagtccattttcccttttttaaaaaactgatttttccatgttgaaggctgtcttcaaatgtatggtaatgcttggatcgctgttcatatttaagtataagtaaaagaaaggcagacttgggggcctatatacttatgcaggttttgtctgtctcacttgacaaagaatgagtaggatgaatctgtcctttaaactggaggactctaaatgctttaatctgtcattgtcaacatttgtgtaagcagttagagaattcttagaatatgctttccatatttcttcaaagaagaaatttctgccttttggcttgagagataaattttggctgtcagtattttttgagccaagataaaggagggaaattggagtggggtggcrttgactatttataaaccaaatattagcctcatttttgctatgactagtgttgctgagtctggagcctgtgtctgtaatcctaaattgagtcttcctttactgtgaaccataagtaaatacaagattacaaagtggtaagtgctcttatttttgttttaaaaataaaacaagatgacttagggaggtcaagaatatttccctaagaaagggacaattatgaggagatctaattaataaggaagcattcacaagatgaaaaattaccagtagagagcacatttctggcatagcctattcaatgaccttatttcatgggagcacatagggtgagcacagggagagacagacatttaagcttttagttgttgttgatgatgattacttcattttggacctagtgttactaacaacaataagactaattgttaaatatgcataaaacacaattattaatatattcaccttaataaaatgatcactaaacttttgagcccctagtatgtgtgactatcttatgtgttaattataatatttagtataatttttatcttccaatttgcaagtttggaaattgaaactgcaagaacataagtaatttgcctaatgtcacacaaccacaaaaactagagccatagcaaactcagaactgatttttcacattgcaattattttctttataataccttatgaaataaaaccacagctaaaaaattaataagatgattttttaaatccctagactttatatccatttgttttattttatctatttaacttatttgacttatttcagtgtttataataaaaaacaaatctgaacttaagagaaaaaataacccctagaaatgctaatatttatttactactgttgtttaaactttacaatattacttagaagcaccattttcatacagtagtatttaaatctgattatattagagctcaaccatgggtgattttttaaactgatttatcttctcatttattgtgcgacttcaaaatcttgtgtcaataacaccaataagatgaccaataagatgactcaaatacacttttgtgggatttgttaataaatgacccagatggaacaacaagaatattaaaatgaagaaactctagacacagtttgttgctcagccttgtaggtgaaagagacagaggaaaatgcataatacttatcagtcaaatagggcctagcagaatgccaatattttagactgagacatttttatgtgtcatttgaagtcatttttggcccttgttgttctgcagatgttcctgaaaaaatctaatgattctactctttcactttgttttgatagaagttttaaatatatcttcccttttctgtgctttagagaacaatcgagactaaaccggaagaaagggataaaaactttaggagtgatrgaactcagttcaatgaaaacattgattaaataccttaatcaaagtaaacattaatataaaaagccttttaggaacatagaggattaaatatgggaattattataatgactggcatcttgagccaaccctttaactctattttctcctatacgaagcagatgccacagtctttcatctaaagcacatataaagcaggatgacacagacattcagtgacagagctagaaatcagaaggagctagttcatctaacttcattaaagcaactttattttgttcctctggttctttaggatctttaatgatacgctctcaaaaattcaaaacaggtgactgaagggggagatrtaaaacaaactaatattagacaatggcactcacattttgatttttagcttgagtgtgcgtgtgtgcacatgtgagtgtgtgtgtatgttcatactgtacagcatatgtgctgcttctaatatttggcctggtcatgtaggatattttgttgcagctaattcactaatctatcacatagacacatttttaaattatgagtcttttatgaaataggatgtctcttatttgtaatgcttagggagcaaaatgtctgtttttagtagggcttgatatatctcattgctgaaaaatttcctctaaatctgaggctcagaaaatgtactccattttacataattatacccttggaaatcaccatttctgcctgatgcaagttgaacttgctgcttagggtgtatgaattactcctttgatacaggtgaacaaagcatagatgtgaggaagatagtagatgatgagcaaaaacacattcaatgatgtaaaacacatttatctgaatttatatcttccaacagkattcagggctaggcaatattcaggaaaaaagtggtattatttaaataaaatgagcaattgctgacttgacccatgggtgtttgwcattgttttccaggaaacaggatgggtgggttgttttcatcacctccactgtttcccaagcttcccctgtgatccacaatatgaatttacaattgggttttgctgaaatagcagctagagcttgtgcagcaaagtttttctctgccaagttaactgggctgtatgggattaaatctgtgaccttgtcctcattaacccaaygctctaaccaactgagagagcttctccagttcactctggagtatgtgagatgtctgcaatggtggacaaatgcaaatagagtatgtaacataatggccattggcagaatttttattttaaaataagcattcttgcagaagccaatattgcctcttaactaattactrttaaccaaagcattcaaatagatgcaaagctgtcactgctagatttagtatttaaaaacataaaagatattgctattcatgttgggaatgttttcatgtactatggcttagaaatcatgatctgtaaataatcagcagcccctttcttccagctgtgatgcattatcaagctgggtgctgactgcagaggatctagctttctgctctctgtatcactgattcttaagtctcttgacttgcaatacttttatttactcgtgcaacttgttttagcctatttcaggcttgtcatagattagtttcatcatttgactctgtttaattagttccccaggtctgccactcatctctgaaagcctatgttccatttcttaatccakccattgtttacattatcaaacagtttagtcttgacctcatatgttacctaggaaaaagagttcagtgattgtttcttaatttgactggtcatgaaagtgtatgtcaatatgttgatttttctgaactgtatgtgtaaagatcagtacacatctttacagagaatggttacattttgttaaacggtcatacaacaaagtatggacattttcaaaccattatcaatctatgaaactgtatcaacgactttgggtaaattttgattttttaaaagttttgcatggggtcrggcgtggtggctcacgcctgtaatcccagcactttgggaagccgaggtgggcggatcacgaggtcaggagatsgagaccatcctgactaacacggtgaaaccccgtctctactaaaaatacaaaaagttagctgggcgtggtggcggtcgcctgtagtcccagctacttgagaggctggcgtaggagaatggcatgaacccgggaggcggagcttgcggtgagcccagattgtgccgctgcactccagcctgggcgacagagcgagactccgtctcaaaaaaaaaaaaaaaaaaaaaatgtgtatggtataagtttctgygataactagaggagctacatacttttgactcacactaaaccaaattgttctaacaagaagctatctgactctagtttatttgtgagaagaaatgtttctgaatagtcaccataaactttgtattggttaaaatatcgtagaacgagtttcatatgggtgtagaaatttttctccgttatataaaagcttgtaattttttttctaaaaggagacttggggaactgcgacagtgcactagcaattcagcttttgtgtaaattactttatttatcaagagttatgtttcaaatatttaaaagrcctaaaagtttctgtagaccatcttctcattttatgggtgaggaagtgagactcagcaagacttcaagaagcaatttcacaatacgtctagggagaactcaaatccctttattcaagcaacatttcatcactgaacacatttgtgctggtacttttaaagtataatttgttgtaacattcataggcatactttaatttatctaatatctatatttctttagtaagagagcaatgtatttcacctccatatttttcattactggaaatagagagaccaggtgctaagttaaaatttgctgatgtaaatatgagtcaacattctgcttcaatactgtatctctctgtctctctctctccctctctctgtttgccacttaaaactcatgaggtatgtatgttaacagataagtaacaagttcaaaactttctacattttccaaaaatgtttactaaatgcaaagttgtgactgattcctctgttgcaacataagtaaacattgcaattccacgaactacttaaaaccatttttaatatttattttataattctttgactgggttagtattttaagcaaacatggaaaataggtagtgaaaggctttctaaaaacatttattatgtacaaagttcatgatatgttttgttctaagtactagagatggttggtttaaaaactttgacttggtccrtgaggtgttcgaattctagcaaggaagcaaacacactatttaaaacaacaataaaataactggatatgggttgatatcagtgttctactycaagtgatatgggaaaacaatgagggagcaactgattattttagggaagtcctcacattttttagagaagaggtggaaattaaacaatgaatggcataggataaattggaattaactaggtggagaagcaaggataacgattataggctaaggaaatggaaacagctaaataataaagatgagaccacaaggggatataggagtaaagttgtccaaatagtagcatcaaaggtttgtgtggtaagaagtgtttagtatgggaggatatgcttagatatctggaacccagatggtaagcaattgtgtatctcttgctaaggaagcttggttgcttttggtgtgtgtgtgtatgtgtgtgtgtgtgtgtgtgtgtgtgtgtgtgtgtcatgtgcatatcctgggtgtcatgctactggtaaagcaagtgtatataggacacatgcagttcctctttcccctttgcctgtaaagtagatttgacatgtaatttttaatgcatctcaggtcatggaacagtgaattcttttcttggtagatgttaatactgaagaatttaaagagaatcatgaatggaattgcctttcatcaaagcaaaaatgaagtccttctcaaccttgtactttgcgcataggttgaagataactatacatcattcatttttgaaatataacttttgtttaaagctactggagattttgctatttatttgagaagtaatttgaaagtgaggagaactcagcatatgaaggttgaacatgtcatcaactagtccaaggaaattcaaagtcaaaaatcaaatccttacgtttatgaaagacatcttcgaggctgggcatggtggctcaagcctgtaatctcagcacttttggaggctgagacaggaagattgtttgagcccaaaagtttgagaacagccttggcagcatagcaagaccccacctctacacaaataaaaataaaataataggccaggggtggtggcacatacctgtagtcccagctccttgggatctgagggcagagcatctcttgagcctgggaagtcaaggctacaatgagctgcggtcgtacaattgtactccagcctgggtgacagggcgagaccctatctatctaaaaaaaaaaaaaaaagccaagatcctgtatatggaatttccagattattctggggaaaaaagatatgttacttgaagtattcattcaatcaagctaaaaatattctaagtttagtattgttttgtttttctgtctcagtttggacactaatactgtggtttgcccaayatggaatattcagaatctgagagctctatgaatatttgttgtttgggcttaactaaattagaactcttgtggagtaccatatttagagttctcctttagagtagagcccaattagcatcttataaataatgcaaatatgaatgaagcagtaagaatgctgccaaagttcactgcttgttttcaacatattgctatttacaaatacctcgttatttttaatgtaaattctttgcaaagtattattataagtaccgacagcaataattcacattttaaataacaaagaataaygacaaacacaaatcccctgatagtagttacaatttcctccagtttggcaatcctcctataagacatgaggatgtggattgctcttcagtatcactgattcttctgccatttaaaaaaagattggataaattcagcctcttaagttcctaatttagtaggtttgatatagtcagtctaagtattaacagcattttagcacctacaattcttatattcgatgtttyggggtgtgcaaamamtatgtagaccagacgttctgtctttaagtmatgtccgtgacaaatagagatcacagacgtttacaaaagtgacgattactctaagtgggcagagaacagagatacttakgagctgtgggtggttaagcaaaagatcaagaaagagtcagtgatcaagaaagagtcagtgatcaaccatgaataaaattcagatcatcggccggatgcagtggctcacgtgtgtaatcccagcaatttgggaggccaaggmgggcggatcatgaggtcaggagatcgagaccatcctggctaacacggtgaaaccccatctctactaaaaatacaaaaaaaattagctgggyatggtggcaggtgcctgtagtcccagctactcgggaggctgaggtgggagaatggcgtgaacctgggaggcagagcttgcagtgagtgagcagagatcgtgccattgcactccagcctggacgacagagtgagactccatctcaaaaaaaaaaaaaaaaattcagatcatcagcaagtgtttaggcttcaagcatgtgaaatattccaatcaattggcaaattatctctgaggctaactagggctccctgagcatcagaaagtttaccagccagaatgtaagataaattaatcctgcttaaatattttccagttgccttcctctgcaggaatgttcagtgttggttgaagagtgttgagaatacaggtgccctaaacatgtcagccttgcaggctttccaggtctctactctccaactttttgtccatcacccctctggtctctgttctgataaaatcagcagtcttttcccagagtgcaaaagcagtctcttcccaggaactcatatgtgccagccactccctcctgtctatttggccaaaccttccactttcttcagctcaagtctaccctcctgcacttttgcacttagcttcctgggatagatgcatgcaagggatgcctttatcccaaattaaaattgatcttataagctttaaaatgataatggaatttgttttgctgttatttgccatttttattgacacaattgaaatacagaaaattacattcaactatggtttttgatgatgagtattttgtgatgaaggaaagaataagttttgaaatacatgtattttattaagttttaaatgcttaaaaatcaggtagcattggagaactcaatctatttccattgtaattcctctgaggtaaataagttggtctcatatctatactgaatgtaatattgtgttaattataatactgcagcgataaaatagaggaaacactaatggactaattatgctaaatatttccatttctaagtagacagaaaacaaaaaaagttaacattcctacttcactgtaattcattttatagactttgaagctgcaggaacatcaaactacactaagcaattttttaactattttttttgcccatttcttttatttaaattttgatttctccttgacttttatcagttacttccttttgatccttttctcatattcttttttctgtagtcctatgtttacttagatcatttaatatattatagtattcaagtatttcagcaacagatttttttatgtcagaagcattggaatcattttaaaaatcaaaactttaggcataaccccattatacaaatataggcaaaagaagacgaacttgggaatgctacagtaggagaagtgggatcccccacttttgggggggatctgattcccatttctattctatatccttcaacatgaaggcaagcgaaagataggttgacaacactgatctatttaaaaattatgtatacttaattacagtgattttatttcccattgaatcttctatgtaaatactactgatagagctggctgagttgtttttataaaacatagacatttacatattcctacctatgaaattgaatgtagctgtaactgaatgtgggtaaaacctcatcttccttaatttgtttgagaagtaattataaaatgaaatggctggtcctgtggtaattgttaattatgacacaatttctctgcaataaagctctcagctaaatagataacatatgacattttcatgagttagtttagccatttggttaaaatataaaatgcttcatatctgtcttggttatacatttattaatgccatatggttgatcatctgtgtaactgtctctctaactggtttcagatagctgaaaatggaaacaagttttctttataactaaaatagaaaataaatatatcccaccataaacgtgaatgtgattgatcatctatcacttcctattttttttccttcaaagatgtagtctatgtaattctgaggaatcatttattgaaaaagaaaaaggcttcaaattatgatatctaacaactaaaaagtcttgcaagtttttcttgctccaccctctcattttacagatagaaaagataattcctcttttcaaaatttaatatattttatagagtgaacggtttgagaaacaattgattattctctgtaggtcattgcatttcagggctttagatgtaatgtgacatttcatacaaacagaagtgttgattatgtaataagtaagtaatattgcaatataattgctctacctgaattgtgagtgcttataaagaatgactggtaaaatagatgtcataattgtgcttgtaaaaccatctggatgtttatctgagggtgacattatttttctcaaaataatactgcatgtatattaagaaaaaatttacaatgctttcacattgtttgtatgtcacgaagtttgtatgcaaacttcaaaaacaagttaagtagtacaatgctttactgaataaaactaaactaaaaagcagtgaatacaaacagttctcctgattcataattagtgattttatatactcgatacttctgcacttattctttgtcagccaataaaatagtgtgtgtgtgtgtgtgtgtgtgtgtgtgtgtatttgagctgtatcctcatatagaactagatatgcacttgcgcctcatggctatgggtatgtatatcttttgtaagttgtatataatatgacagagattcgatcatgtcacacttgtttctggacgaagttgaggagacctctataggaccaatcattttcttttatggccaaaggattaagatgatgcaaagatagtaccttccgagctcatgggctttcatatacctcactatgataacaaaattgrataaacataaaggaggccgtataggatatgaaagcaaatcatgtgtatctctgtgagaaaatgaattattcttcagatgattagaaccaaacagcccattaatagaccctaacctcaatatttataagtatgtaattctgaactgccactgtaaacaaaacccattttctcatttgttaaaccagaaattcaatgcatagcattttgtcggttaacaatagttctgtttggccacatgattaagtgatatttaggatgatccatcctaaatgtgcctgttgatgataaaagtttagaggttctttagtctctggaagccacttgtcctaattcaccaactcactgccattttgtaagtcagccaaattttcacagctatagcactatagtgactttatttttacctttttcttccagttcaaataaaattcattcaataatattaataatatttcagattgtgatataaataaagaattcatggagagctttagtcatctcttccaacagaaattaaatgtttcaagtctactaatagtactcactttgactatctaggtctttacttggaacctgtccatcaggtggtrtggtcagagctaagtcaataataataacatattaaggcaagtcttttgtatctgttttatcaccatatgactgacttcataggattaataaggcaccacactggtatsagaacaatgattccaaaaagtacaagaagcatattataaattattcttggttgtatkatataatgtaattgtaatgattagtttgttctgttactgcattccacaatccaatcaaaggtctaaatcgacacatgttgctgaagaaaaggcaatatagtccaggcatttatgtagttcagattatatggtgaactttattgtattataaactcaagttccatattgttagattgaaaaaagggagagaaaaatatactaagttgagatattagtttttatttaagtatctgataagtgagattattctggtaaaggttagaggttatactaatgcagaatttgaaatttacatttctgtcattatactttaatttcaattgtaatttctatttttgacacccagaaatctatgatgattttaatgaaaatatcttatgaaaatamtactgtcatattttaccttaaaacttaatattttagatgagaatagaagcacatctcttttatgatatgttgcctgtataaagaaggaaaaatagggactagttctactgaggtcagaaagtagcttttaagttaaagattttttttcctatcaatgaatagaatttttaaaaagaatcccaatggaattagactcactctttagacagtaatccaagtggggttatttctattttggagacagtcttcaaaacaattcaaaattactgtaaaaataaataataaagcctaaaatacaggtgcttaatggagcagatagagactcttytctgggatagatagattattggtgagttttgccaactgcttctttcactaaatgatagaccataagtgttccagggaagaawcgtctttcttccctgttggattgaagtaagggcatatgtcattcatagcacagccactgtgacaacacaaagggttttgctcccagtctgcagcctgggctcttaaggcactgtctttctgaatggtacaaaacaactactaggccttctggctggttacataaataggtgtgtctcaataaatgagctattaaatagttgattaactggttattatctctttgtgtccttaggcatytcccaactattgtctctaaaatgagtttggaatgcactttcatgttccactctagctctgatactatctgattatcaagatctagggagagacatgttagctcacacctttaacttaaattagaaaacagatgctataaatcattgtttgtgcattaaattcccgtgatctgagtgaaagcacatagaggtttatttgctaaatatttaacrtatatatttagtatcatacttgctaaattgctgcatattttcatatatatgtacatataatttcatatctaacatattacatgttayatggtacatatatatgaaaagatacaggaattagcaatgtgtgttatatgtgttaagtatggtgaatgaactgagaagaatgtgcttctccataaaagggactttatcctaatatttacacataagcatttatgtaggtaatgaaaaagttggcaaactttttctatggaaaggccagtgtataatttaggctttgcaacccagcaatctcagtcacagttacttaattctgctatttatgtaggtaacgaaaaagttggcaaactttttctatggaaagaccagtatataatttaggctttgcaacccagcaatctcagtcacagttacttaattctgctattgtaacacagaagcacttattgacaatacataaatgaaggagtgtggggaatgtggctgtgttccaataaagttttattcacaaaagcaagtggtgtcctaacttagcttggaagttacagtttgtcactcctaggtcatgtggacaatattctgaatatatccctattttaatgaactatctgttgctatagtggtttcatttctaccacagcaaacaatgcctagaaagactagtctatyaggtgttgatatggttaatattctcctgatagaatcaaggaattctagctcaagtatgtatttttaaaaatcatttagcatcattttgaactccaataaagtaaattttattaaatcaaaaagtttattttattttattttattattattattattattttttgagacagagtctcgctctgtcaccatgctgaagtgcagtggtgtgatctcggctcactgcaacctctgcctcccaggttcaagcaattctcctgcttcagcctcctgagtagctgggactacaggcgtgcgccaccatgcccagctaatttttgtatttttagtagagacggggtttcaccatgttggccaggatggtctcgctctcttgacctcgtgatccacccgcctcagcctcccacagtgctgggattacaggcattgagccaccgcacctggcaaatcaaaaagttatatagcgtgatctagaactgcattgttccatgcagtagcccctagccaaatgtggctttttaagtacaaattaattaaagttaaatacaatgtaaacttttttttcttagttgtaaaaagtatttcaagtactcagtagctacattggcctagcggttatcacagtggaaacatggaaaacatgtccattattgtcaaaagtgttattggacagtacttatactagaccaaaaacacatttatagtcattaaagcatttactaaaaggcagactatctcatagaagtgagagaactactctgtcagagggaaataaattgggaacttttcaaatctataatcgttatttaagaattttaaagatttccattgaatgctattaccacagaaccttcctagagatttatgtaatgcctttgtacattcaaaaggaaattccagctcagtaactgagctgcaaatggcacccattgaagctactcaaccacattgctgaaggccaccaaattgcttcttgcaggcttctactattcagaaattattaaatactttcaaaaaagtttaattttaaaaatctgagcttaaatgcacccmaaacacgtttctgtagggcattctttgtatgtagcgtaggactttcattttgttactccccttctgtgcattcattcctagcccatgataaaaataaaaaaaaaaaattatgcgtataatgaaaggtctaaggaaacttggatcaggacagatgttggcctgtagaagacttttattccttcacaagttgttattactgaaacattttagaaatttcaggagaatgttgaggttttaaaggaaagtattaatacacttgacaggttttaattttttaatctagtcaaggcaaacagctttgaatcaattatccacagttttcaacatataatcaaggattttgacaatatttagatgttgaattgccaagctattagcaaccaagagatttgattagacatccatattaataaacacctgtcataatagcataacagatgttctaggaacacagctaacacaaaatctaaaaaacttggtcgtattttttgmcaatgtggtgcctaaattaaactttacaacctttatcatacttgttttaataaaattcaatgctgaaataatttatatcaatagaaaaatatttttacttcaaatgactaaaaggttttcattgacatcaaagcctcttgcagaaacatttgaaattatcagttaaaagcgygttagcaaaatactagtgtgtgatgtgtgtatgtgtgtacaaaatatacacatgttattactaggggctcctgcgtggaacagtgcaggtctagatcatgcacatgctctaagatccactatttaaaaatttgccatagttcaggtccatacatataattttatttgatactcatatgtaacttatatagacttatagtttttgacaaaaggcatattttcagtkctggtccactcaatacaatggttgatataatatgctaaactatttaaattaatatactctctttcctttaggattgtatttcatgaaaataatatacatgcacagtatataaaaagaaacattgaggccaggcacggtggctcacacctataatcctagcactttgggaacccaaggcaggtggatcacccaaggtcaggagttcaagaccagcctggccaacatgrcaaaacactgtctccactaaaaatacaaaaattagccaggtgtcatggcacatgcctgtaatcccagctactagggaggctgaggaaggagaatcgcttgaaccagggaggcacaggttgcagtgagccaagatggtcccattgcactccagcctgggtgacaagagctgatatatgatgcactgtagccagtggattctgtgttgttccagagaatagatctaggaccaatttgaggaattcagcagatttttgttgaatttaaagaaatagctgatagttaaagctgtcaatctagcaaaaagaaaactatcccatggagttatgggcccctaatgtggaaatatgcagtgcgaaattagacagctattagtcatggagtttgtagaaattatttccacagttgagagaccccagactaattgaccatcaagtttccattcaactattagtttctataatggtataggtcaaaggcatttgtgattgtgaaatatcatgattcatgcccactctgattatctatgattatgtattttttatgcagttgtctcattttacttagttttatcttttaatataattatgtatggtttatggtacttattgaagagagaaattagctcctttgggaaatctctgtgggtcagatttttaaaaccccaactggactttaaatgtaacagttgtcttttttgtcattcatgttcacttactgttagtacataacttcttctttcaattccaagcttgattcagacattattctttccttcaactaatattctccccacaccaacaagtattttatcatatgacccagttttattttcaccttacatctattagcatctgaaactaccttattactatttatttgtttacatgttcatttgtttttttaactttactcttttccctatttgatttcaagccttatggatacaaatgcctaggaaaactcctggtctatggtaaaagtgcactataaataaatttaatgaataaattaataaacaaatacgtgggtgaataagccacattttattttgcatccatgaagcttaagatctaatagggaaaagagtctgttcccaaaatggtctttccactggggtgtcattttcatccagtcattctatgttgcagacagcagggccccagccttattcttgtttttatccatcatacagcatagcaaagtgccacacgcataacaaattaacaactgttaattgtatgggtgaattaaaacccttcatggaagtgatatcactttttctaaagtgtcttggtaaactagactcttttacaattaaaacaagagaaagagagttgctgtgtgtcgatttttggcccttaagagaataaatgaaactggcaaactggaatagtataaatatgggacaagaattagaagtgccaggcttgattgacccctactctacacatttctgacagtatgaacttggtcaaggcacaatcttgcatgcacatcaatttttttttgtaattggggctaataatctctgccattcctatactccagacttgctatgtatataaaaaatgcaatatatgtgggaaatttgtttaggttgtaaaatgccatacaattaaaacttaccagtatgggtagcattaaaacttctgtgaaacccaggagcagaaacctctccaattcacatgtaagagtaacaagtgtctctggttttaactagcaggagaatagaagggagtaagggagaagagaaagagaagagacaaagaataaaaaagaaacaagagtgagaaaagaaagagaaagagaagataaaatatacaagatgaggtcacaggaggagaatgtggccaagagggaggaagagaaaagggagtagaacccacaaaagagaaataattgcattggargggaattgcgagtggcatctatggtgaccacagataggctgaaatctctaaattaagacttcattcatttcaaagcaatagactaggtcaagtgagggatgaggtaggattctgtgtttcaaatcaacacaagattagccagaatgaggtgtcatcccatggaaatgggtgactacaaatgccagagacagggtgacattaacctattcattgctaaagtagaaaccgcagcaagaacataggcttatgcctactaagaatctcttcttagttggttgacatgcattctagttttcaagacccaaactctagtagaagaccaccttctggtagtggtggccttgcaatgcatatgacttgactgaatgcttacattttgtacagtgtgtcacagctgaaacctctgcagttttcaccaagcctggcctgacacactttccctacaattagttatcatgtgcgtggcataataatctgaacataatctttgaaaggaaaattaaatcatacatctcaattcagtgatccttgggagccatctgagtgtatggaaaattggttgctataaaagatgcccaaactcagctcttagaagacagagtagaacctacaattcccagcccttcagctattattttccatgtttctaaaataatagctatgtttgaaaataagctgctcttttgttctttagatcttttattattatcattatttgtaacaatgttttccagttttcaatttgaattcctctttctccttttgttttttgttggtctaaaaagcccctaaaaataattctttttgtctttactatagcatctgtgctcacaggaataaactactttttagttattctttaacttacatactacttccttctctaatatccagcatctgaaatgaggagcaataaaaatatgtccttatggtcattgacagtttctatttggaactgatttagccaagggaaaggaggctacatygtagatgatagtaacatgttgaaagtagatgcatgctaacaattttagaatgaacaatgttttcggataatcattcactgcctattttggtttcaaaaatgattatccattatgaatgtcacctttattttgaaccttcaaaaaaatgaatacctttttcttccttccatcttttctctacatgctttctcataatcttttgtttggaaatacctaatagaaccaagcatacaaaataaaactcaaaaccatgaagcttatttgcaactcagataaaggaattgattaattcatctctcgacacgtatatttttggaagaactgtgatatgtaagaccatggctagtctctctactgttgtgtctccagattctctgggaaaaccgagcatgagtcagccatggaccatgccttcaacatgcttacaatcttgttcaagaactaagatatctatatacataaccatgaggtagaaaggggtgacaatctcaaaagaggtatgggtaagatgagagatatgttgagagaaatcaaaggtttctaccctgctttgggcaacaggaaatataatctggaaaaaataacattggagttatggctttaaatattagtcttcaaaatggctataagatgttcttttcgagagtgaaaagaaaatattagaaagtttctttaaatttgttatctaaaacgtaaacattgtagccttcccaggatttaatgtatgattggcattgacactctsctttagtgtatatcccagacaagagagctttattaaagggttgtctgtggtgctgtcacttgttctgtagctttcaacattatcacaatcaaagatacctggatttataaccctccttaagtgcgacccattgttttaatttttttataaaataaactatggattaaggataattaaaagggaagcccaaacagaacaagatgtcagaattggcacttctcttaatcttagtagagatgatggtcagcaacattgcaaaataaaatcagtgattatccagtcaaaactgaaaagaactaggccagtaaaattagttatcaagaagactacgtgaagtacagaattttttttttttctgagattgagtctcactctgtcacccaggctggagtgcagtggcaccatctcggctcacagcaacctccgcctccagggttcaagtgattctcctgcctcagcctcctgagtagctgggattacaggtgcgtgccactacatacggataatttttgtatttttagtggagatggggtttcaccatgttggtcaggctggtcttgaactcctgacctcatgatccacccacctcagcctgacaaagtgctgggattacaggtgtgagccaccgcacccggcctgaagtacagatttgcatcctctaatactcattcacaaatttctcctgagggaatattgcatcttgagattgtttttaatgacattatcattagcaagatatttaaaatagtttcttttatctttacttgatctctttaaaatgtatatttctgtatacatcttatacataacttagtagcatgataatgcaggtataacataaagaaacatagacgtatagagaatgaagataaagcatgtaaaggctctattctggacagagaataaaatagaagccccaaagcaacctatttggctgaagctatcaatgttttgccatttaagacaccaaaagctcaatgtgaagagggacgcctttcggatgccagctcctggcgtaaacatattagacttcttggaactgatcccatggaacaggcacagtcttaatgatttcagtcttctgggaaaatgtcatatttttttccaattaagtggcaaagaagttattcagcaccagtgtgtaagccaccaaaatatattctatgagtttcctcctgaaagctgcaaaggatttgaattatattcagagtaacctccctgtcacgtggctgttggtttctcattttctattcttttcttcctaaataaccccacttaattgagacccagtatctcatgtttcagtgattgtcttcaaaaaagaaacactagagtttggggagcagttctaggcagtagagaaaggcagccttctcagcccggttcaatatgctcaaatgtcatcagatggttttcaagagtatttggggaaaacgttgaggcctattttcagaaagacaactggcagaccttaaatgaaatagatctgttgtagaaaaaggctgtggcctaatacatcctggcactgtgacttaaggcacactgctggggcagcagcacagcacgcacaccttccaggaaggaaggaggggaagtaggaaggaagggagggagggaggaggaaaggaaggaagaaagggagggagcgagggaggaaggaagggaggaagggaggaaaggaaggaagagagggagggagggagggggaaaggaaggtagggaggaagaaagggagggagggagggagggaggatctaaaagcctggcttatactcctttcagaatgacaccaatatgagaccctccagatggagctacctaatataaagccaggtccaaatatttaagtatggtgttagtctattttttcctgaggcacaaatttttttaaggcaaggacacatccacatgagaaggaggatcactcacagctgcacatgatgccgaataactaccgtattatggtgattttgctttaacatttgttaattgaagaggcattatgttgtatcattttgcaatagataaataatgggatgttaggcctcatgaagggtggatggtgggaggaggaagaggatcaggaaaaataactaatgggtactaggcttaatacctgtgtgatcaaataatctgatggagagaaaaaaaattttaaataatgtatacgtctgaactaaggctgattatttcaaatttttaaattgtaccctttaaaaattgactttgggtcactgcacaatatcgtaattcaataaagcatgtaaatcaattgagagcagcaaaaatgacacattaacatgaaaactagctgcataactcagtatgtctcaagtcatactcagtctgaataagctgattgaaaatagtaagctttacggtgtcctaaaatttaatgacctatagctgtactagactagaatggtgggggtgcggggggcatgccaaagatcagctgccaaaggtcttgtcatctcagaaacaacaacaaggcctgagactggtggcaaggcagacccttgaactaactctgtactgaatctattagctgtgattggtcttgactaagttagtggctctttcacctttgtgtgtttcttcatctggaccttagaataatattatgccatgaccagaataagaagtgagtcagtaggctttaagaaggtcagatgctaactaataatggctaaattatattattttcctaaattgaatgcgattattttctgagcttataaaakttggtctgatatgaaaggagcaggggyagccagtatatcacggtggtttaaagcgaagctggaaaaaatgcccaggctctgtaagaatcatgtgcatgattaatgctgaggccactgccaacaggaaaaagagggactctcacagtcagagagtgtgatggtatttacagtacattggctttgattaatgtgcacactcagagaagtaatgtgtggaaggcaagaaaagacctgttttcaaatgttggtgctgagtacagatttcccattgtgtccagagagggtgtcaacgaataatgacttttagtcttttggtttgttgggtgtgggggggtgttggtgaggaggacattscaggggtaactttcccatgtacaagggaagataaaaatggctttgcagcatggtgcagtggctcacacctgtaatcccagcactttgggaggccgaggcgggcggatcacgaggtcaggagatcgagactatcctggctaacactgtgaagccccgtctctactaaaaatacaaaaaaattagccgggcacggtggtgggtgcctgtagtcccagctacttgggaggctgaggcagragaatggtgtgaacccaggaggcagagcttgcactgagccgagatcgtgccactgctctccagcctgggcaacagagcaagactccctctcggaaaaaaaaaaaaaaaaaaaggctttccttgtgcattcttactactcatatgagtctggaaaggcaccactgagaagtttataccacatctcacagtttcaataaaggggattactaagtagttttaactataatgtcatccctaagtgatgcctttaagtatgcagtatttatatagtatttgaatgtcttatgaaaacatgtactagggttttcaaggtccatgggtgtcaaagaggaaattagtatatataataatcacctgaaaaaaaaatgttctcatctaccctagaagaggtttccttcttccttttgccccacgccagagccttatgtgctttcaaggagtatttatataatgtgtaacaccaggagagggaaaaggcaggttaaacttaatatgtagtgtattggggaaggagagtagcaccagacacataaagtgtcttcccaggtaattctggttctctcaggtctccaaatttttccaggccacccaccttcgatatgaattgtaagtaaaggagcatacagctagcaaataattaagaaccaagaacctgaccctttcactggaagttggaataatataggtcatgttaaaaaataactggcaatctagagaaataatcaccataacaccgtcaatttatcccaactgactgctttgatttaaatgcaggaaaatcaatagcttcatcataggagctgattctgactacttggtagtgactcctgagggctgtgtaggctaaataatggctctccacgatgtccaccttcaaattcccaaaacctgtgaggagagattattgtaaatcatctgtgttggtccaatgatattataggagtcttttcaagagcacaggagaacagaaaggagaaggacataagtgtgataacagaagcataccttttagtgatatcctttggagatgaaagaaaaatccacaagccaaggaatacaggcagcttctagaagctgaaaatggtgagagaatggattctcctctcagagcctccagaaggaaccagccctgctgacaccttccctttagcctagtgaaacttactttggacttcccagttccagaaatataaaataataaatgtgtattgtcaacaaattggttaatatttgttacagcagcgataagaaactaatgcaagaattgcatgaagaaaaattagtggaacaagtaatacaggagtgatgccagtcatgagttacagagggaactgtaagaattaaaatgcattcaactaccaactctagttttctccttagggtgatgcaagaatttcattgccattggaagaaagagcagagaagagtggcagtgtttcttagacagctgtgctctttagatgttatagaaaacaaacttagtcmcaaaataggctgaagtccttagaagaacttctacctagaaaccacaattttcactagggtaaagtttctcagctaacattaatggctacttttgttggttctagggaacatcggatggtcgatcatggacccccacaactaggttacatgtctctatgaaccaaaagtccaactgggggagaaaaccatagtaattcccccccttagatctatctcttttcagacccaagtagatgggaaaaaaaggaaaagaaaaagatacatgccagatttctgatgaaagaaattcaaccaaagaaggggctatttattttataatccttgggattggttcaggtagacagagaataatgttttaatcagacccacttagaacaacggctgggaatatcttgtttctgtatatttctttgcaatatataaaacattccactgattctgaggtacccgtcgaatttcagtgctttaagatgcatactgacataaaacctatgatgatgctttcactgcaagatttatttttaattggctctgaaaacatggatttaaactccttgctattcatttgaaactgacctgtattcttatatgttggagaaaagttaaggagtrttgagcgtctaaaattctgttttcttgtttataggacaaagataatagattttaggaacagagtgggcatgcraagcagcatatgatgtgatgtgcgcaattatgggcatgtccatgctgtgaatggctgcccttaaatgtgtgtagtgcaaaaggtgtgcagttctatgcagcagtgctgggtatgagaagtgagtaagaaaagtaagcaattgcagcagtgcctggaacattgtaagcacataataacacaataatgtttgttattatgttatgttttcagtacaaaatcacacaaaaaaatattaaatcttcagacttataaagtcctggagaaaatagtctgttttactaaagacaaaaatcaaaattatttggtttactgatctctattttgcccacaatataacaaaaaacaaactttgccaaagaaattcttcattctaattctacctttgatttcacctatgggttttgtgttttttcttgggatttttccccctccatgaaattcttctatgaattctataatctgtctaggatttgttacaacactaacaggtaaagggtaaattgaggtatttgaggaccgaagaacagaaaataaaattgtgcctaggatttctttagaaaagtagtagtgaatttgaggaagggaatttcttctctctctctccacacacacacacacacaccaccaccaccaccaccaccgccaccagcagcaatggcaatagtaataaagtattctcccaggttgatctcctaaaatatcttgaaaatacactctatccttgtttcataagcaaatgcaacattgaatatgaaacactattattgtgcacaaagtagaattcatgtaatttttgtttttaataatagatcctctagatggtgacaatttcaaaataggaaataaaattggtcttgtgcccaggcagagtatatgtcatgtaattacagctgtattagtgaagtgcctcagttctttctcaatttttcccatctacttgatgacatacaaaatttcctttcacaaggaacacagccttttgttgctgaaatgaaaataaaataaaatataggattttagcacccctgggatcatgtgcaaaggcaatgctgtgagttcacaaaaccttgttttcttttctttcccgaacggaatagaatacatttcccagctttctttgcagttacatgagcctttgtatctcatttctggaatatgggtgggagtgaagtgtgtcaatttctgtcctgaccccagaagtctcctatgagatctattctcattcctttctgttgttggatatctggatgcaatgacttgtgcagagggttctggagccttaggggacaggatatcttgtagatcgagggtacctaggtccttgaacaactatgtggtacatagcccaccacccacaattcgcctggactatcatgtgagagtggaatgaaatttattgtgttaagctactaagacattttgatattataatagcagttaggctactctgaataatatggaacaagagaaatagaaaggagactaatatatacaatgccagacaaacattttccctctttcatggagcaattcctttttcagacttgaatcccaaaagttcttcaggatactaattactcaagatgattgctagctgagtattcattagctgattttccaaggacttttatagggtcctcaaaactttggaatgacactttacaagagaaagtaacacccagagggagaaatttgccaaattaaagtttcatgtttgaatagtagaagaacagtgtgtccttgcttgagtctatatctcttttcaacttatcatttttggttgcttccatgataactactttttttcttttttatctaatacagaattataagtaagggaattctggtagtagaattcccctactcttgtaattcagctctattcttgtagagctaatttatataatcctaggaagttatactaccacaaatatctgtcactaagagtaaataaattctgtattaggagttaaataacaactttaaacgataacaactacacacagagagagtttatgtgtgtatatattttatattccttttttctcactaaaagaatatatggacaagacttgcaaagtactactgtcagcaggtgtaagaaggaactcaatataatccattcagttgatgttatctggcaagtattgtaattttggaatttaaaaaagtgaaaaggtgctgatgcaccttaagaacagtaaaaaataagtaaataaaatgaaaaggtagatttttataaaatataattatttgtaaaaggagaaggaaagaaaaaatgacatttgatgaacatctgctatgtgtcaaatgttgtgtaaaacatttgattttctattccttaccatgtgacaaatgccacagttttattttaattaagagaaaataagctcagatcagcaaagtcaactagtgaagactacatggctaatcagtggcagtcctgggatgcagacaaaacttatttttcaagtctgtattcatttcaatctactttatcacagcactaaatttgaatgttagaaataaaatgattatatctaaagctaagactctcagataaaagttccatttgctatattataaaaaagaaaacatcaaagtgcaatctcccatgtagcatggcacatggaatggctgagtttcagtgtagtgttcagaagccagggagaaggagagagggaggaagggtaatgggaataagagacagaaagaagtaataatatctcaagaaagaaaccccaggactgtaggctactggggccatttcaatcacttgtcatgacccccgaaatctatgcaatgtagtatatatatatattttttattttactgggacagagatttaggctgtattccttgaggctgctatgtgtgatgaagtcactgttggtgggcctcccaactacccatcacctatatttaaccctggtcttcaatctgttgcattcatggtaatgcccatcaatggctaaggtgatcttctaatattttaatttttaactcgatatgttttatgggaggcaacatagcatagttgttaaaagtggactctgtagccacattccctgagttcaaatcccatctccaatatttactacctgtgaaacttggtcaagctacgtttaacttgtctgttcgtcagtttgctcatctgcaaaacaagcacaagagtgctataaacttaatgattattatactgataaaattagtgtgtgtatagtatagtgtctggcaaacagaaaatgctgaatgtgctaactcttaattacagaagaaaatatatgctattattgttttcatctataaaatcaaccgctatgttatgggacttattctatataaacatcaaagaaaaaaaggattaaggaggaagtttttgatctttaatactattatgttttcaacgatttagggaataaaaatataaataatataattaaactttctgttttgttttcacacaatagcagaaactaccaaatcatttcatagatattcactgtccttaaaaagacaaaatgactctatgaaaacatttggtattttttgtttttaagccatagccctagttaattgacctgtttctgatcacctgtaccatcttcttctttctcgttttaatcaaaagagaaaggaggaaggagaatgaatgccagaaatgagatgargtcagggataggaaagagagwcaaggatgaggcagtgtcagaaaygactggcaggtttgtgccaagccaataaattttcaragatattcctttcacttatctgaataaaatgtccatggtattaccatcactgggttattatagcctttttcattatactttctaacccataatgttttaaaattatctttattayattttactttctttaattgacaaaatgtatatatttattgtgtacgagataatgttttgaagtatgtataaaaatggaatggctaattaacttatgcactacctcagctagtggcaggccctctacttcagagtctgatctgcttttttttttttttgattattattgtaaccactgtttattaaagacttctggcctctggtttctttaaaatattttcaatctcwaaccctttcttctctaggtctttttctgtaggatccaatgcaataatttaagatgctatttgctgacaggagatcccaagaacccattatggaaatgaaggcagcaaacaacgtttgaatatatttcccaatttaaaaagccttcattacatagtacatttcaggctgagaattttaaaaatttatcatagtttcagtaattgtagaatcctcttgaagtttggcatgatatagactcatttgtaaaatgtgtattttgtttggcattcagtaggaagcttgccaggcaatacatttaattaaaaacatgaggaagagaataattgtggtttggcatagtgtattatcattacttttaggttctacatgtgcttaagatagtggtctcctaacaaggtatgcatttaaaactagaggtaatttccctttcatcagcccagggtttttaaactgggaaacatagtattttgaggggaagggtactttagctkctccttagatataacactgtctatcatttaaaagatgagagccttagctgctctccttagaaacaatctttgtccattgtttaagacttgaaaaattgatgcattgcctttcaggagcttagacagctttatttaagttgaactttctctagagatgcattgaaataatgaaatgcaatgccttacttgaacataaccatgtacrtaacatctagtcctgcctgatgtgtaaatttgataagagcaactcaaatattataatgattaatgttgatttttttattacaaagcaatctttgtcagcagattcagagaaaatgtgtgatgataaccatctatgagaccaggttttcattgttgttagacatgctgtttcatttttacagggaaacttgctaataatgattttgagaagcaccatgggaaaaagggcaatgaaagggcctttcttggcttacagggcacaagtattttaggttcaggttttcaggtatagagttctttgatcatttagctttgcatgaatcccctctgtcttttatcactacatagtgctattcttcttagtgaacaaagactttcttctaataacacatcttattggatttaatattagggtgtctattctcaaggtcagttcaaggcataaataagacatgcaccaagattgttttcactccctgtcttttcttaagcaactgtattttggcctctcagaatttttcttttctcactctaactagtttattcctttttcccctcctcactatccctctttcccttgaagcatcaaaacaattgctttagtgagctgtttcttcagggcgctattctctgctagggacaaggaacagaaatctaataattaaaaccgagaaattcagtgtggtaagactcagtagagagttaggaaatatggacagaagtggttgtaaatggatggaacagctacattcattcagataatcattcgtttattttttttcaaaaaagggaagatagaaaaatgtccccttatcatatttcagtccagttgtacatctttaaagaaaggagctcttggtgaaaggatccaattatataggtgtttggctccctttcacagtaatgtgtcaaaaacagtatgcatttttctcacagaaatgctgttcttgtatcaaaatggtcactcactccggaaacaaatggaaaacttctccaaaaattaaaagcacacttcttgcttttttcctaccttgtagaatcctgaaatcaatgcaacttttattctgtggcattaggaaccaagataacatgactccagctttatattatactcaactattatgatatagttcttttttgttttttttgagacagagtttcaccttgttgcccaggcaggagtgcaatggcatgatcttggctcgccgcaacctctgcctcctgagttcgagcgattctcctgcctcagcctcccaggtagctgggattaccagcatgtaccacatgcccagctaatttggtatttttagtacagatggggtttctccatgttgctcaggctagtcttgaactcccgacctcaggtgatccacccatctcggcctcccaaagtgctgggattacaggcagaagccactgctcccggacgtttttcttttacttaacagcaagtaaacagattgagggagaactgagagggacaaaaataaaccatgtaaggaagaatacatgaatggtgttcttataggcctcattgactttccggtactctctgagtttagactttccatccttttcctataggacaatttctttctttctctcatgcttaaatcatgatgtttaagtgacataacttagtaatgggcaaacaagatcagatcaaagggtgggaggggtaagatcatgtaaagggacccaggccaccgctctccacctccaactgtagtattctgttggctaacccaagatggtataccgattgaccagtgtgcagcaccagattttatatttcaccaaaatttggctggattattttagatcaacagatatcacgtcatttcagtacttcttattaattgtcctcaggcctaattcatttttttctggatttctttttcactcatctcagcaatactctcaacattttccttttaagtgaatgctagaattaatggatttacttaggtaagtcttggggtaactcctctttgaaagtgggagaaccactatgagacaaacgagaagataaatttaattcatgttttcatgttgaaggccttagattacacatttcttaggcttggactttccatgtttgaatcaactgtggagaatagataatgggattaaaaaaaacacaattaatggaaagactgtaaaaacagatttaaaaaataaagattggaacaggactccaagatggctgactagaggcattcagcaattgcctcctccacaaagaaaaactaaaatagcaagtacataatcattctttgaatacagcatctaagacagaacactggaattcaacagaggagtgtcatgaaacacctgargcaagaaaaaaaacagggaagtaaagctgccagcttggtcaggatcacctgggagcttggagagtcaccccagtgtgggaaaatggtatatgccccagcagtccacattcccatgatgggctcctgcaatcctagtcactggagagttccttgacccctgcagaccataaggctaccacaggaagcagcctggatagtgtgtaatggcgtcgctccagataggtagcttatgctgggtcccacaaacaccctgagtcctaagcagttgtagcacagtgtcattatgagaatgtggcccaaaccagactgcatttctccctggggctcagcagcccctgcattcctacatccctagaaccccactgacatctccctacatcccttacaggactgcagtggcatgagagtgattagactcagcagaacagcagggtcctcagcactatagaacacacagcaacttgcaccccaggttatgggtggtgtagcaggcaaagcaaggtgcccctgggacaaagggagccaaagcatgtgctccccagaacttgaaacttgcctgcctggggctgctcccactgatagcaactctgcctcctcagcaatcctcaacttgcacatgctctgaagactggctctccccatggctgctgcttccaccaattctggacactgaagcgtatacttccaagagcctgagagccaactggctgtggctgctgtcactgaaaataaccccaattcccagaaacaggcccacagtgtacttgcacgtgccttgaggatggattctccctgctcattgctgtcattgctgccaccacccagcactttaccaggggagcctaggtttcaccctggcctgccgatcacagcctgtacctgtgtgcacaatggaggaggcctaatgacaggcttgtctggcctggcaacatcacccatgcctgggcacattgtctagggacctggggatcatcttgccccacccactaccactggtatcagtgcaagtatttcaggtgcttaagcgcaggcccacccagctcatcacagccaccactaacagaaacatgttttatctgtgagcccatggggttgtcctgtcacagatatggccattgctcatgccatgcatgctacccaggaacttaatgaaccacatggcccratactgccactgccagaacccaagaaagccacctggaggtccaagaattagccttcttagacctaattacattcgtgcccatgcacgctgcctgtgggcccaaagacaggcatgcttggcccaccaccgaggcctgaggaccaacccacctgcagttctcatcccctacaaagccttaccacagcctgcactaacagccacagcctaattgacagaggaaatcacagataccactgaggctatttatagacaaataaatcacatggaggctacattactgcatgcacccagaatcaaactaaagtgtcctgtgaaaccaacactacagatagatctttaggaccttcccctacaaaagacaatccaaaaaaataaagaagtgacttacaccatatgcaaagatatcaatgaaaggaaaaaagaaacattaaatgtcaaggaaatatgccacatctaaagaaacataataattgtccagcaagatattacaataaaaaagaaattaatgaaatgatgaaaaaagagttcagagtaataatattaaagaagctcagtgagatacaatagaacacagataaagaatacaaaaaaaaatcagaaaagacaattaagaacataatgagaaatttaccaatgtgataagcatcataaaaaagaaacaaaaattctggaactaagaattcaatgaatgaaatacaaaattcatgtgagagcttcaacaacagattttattatgcacaagaaataattttatarcaggaataaaggattttttaaataacttggtcaggcaaaatagaataaataataaaaaaagattgtacaaatcctgtgtaacaaatggggctccataaagtaaccaaagtttcaaattctggatagtccagaagttgaagagaattccaaagccatagaaaatctatttagtaaaatgatgcctggaaacttaaaagtcttaggagagatatgaacatccagattcagaaagcttaaagagccccaaatagattcaactcaaaaagttcttgttaaaggcaagttatagtcaaattgttgaaagtcaaatacaaagaaaggatttctaaagacaggaagagaatgatgttaagtcaaatataaaggaaaccttattaaaactaacagcagatttttcagcagaaaaattacagatcaggagagaatgagatgatayattcagagagctgggaggagaaaaaccaaaaaaaaaaaatgtcaatccagaacactatacccagcaaaaytgatccttcagctataaaaaagaaataaactctttcccagataagcaaaaactgaggaaatttattactttcctttgttttcgtgactcctttaaagggttcttatatctgaaagtgcaaagatgatatctattatcatgaaaacacaggaaagtataaaacttactggtaaacatacaaatgtagaaactactcaaatggtacaactacagaaaaacaccaaaccataatgataaacaataagaaagaaaggaacgaagtatacacaaaacatccagaaaacaatttacaaaatgacaraaataaatcctcacacataaataataactttgaaggtaaatggattaaattttgctcttaaaagatatagcttggtgactcagacctttaatctcagcactttgggaggctgaggygggcagatcgcgaggtcaggagttcaagaccagtctggccaacatggtgaaaccctgtctctgctaaaaatacgaaaatgaaccaggcatggtggcacatgcctgtaatcccagctactcaggaggctgaggcaggagaataggctgaacccaggaggtggaggttgcagtgagctgagattgtgccactgtactgcagcccaggcaacagagcaagactccatctaaaaaatatatatagagagaaagactggctgaatggatttgaaaacaaaaaccaaaaccaaaagcaaggaccacatgacccaactatctgctgcctctaagaaactcacttcacttgtaaagacatatagaatgaaagtaaaggattgaaaaagatatttggtgcaaacagaaaccaaaagtgagcataagtatctctacttatatctgataaaaacatttttaagtcaaaaacagtaaaaaagagacaatgaaggtcattatattaaagataaaaggacaaatccagcaagagaatataaaaattataaatacatatgtacccaatatgaaatcatccagatatatgaagcaaatattattacatcaaaagggagagatgtactccaatgcaataatagttggagacttcaacactcaactcttagcattagaaagatcatctagacagaaaatttaaaaagaaacattgtatttaaactgcactttagaccacattggcctaagaggccaatctacagaacattttattgaacagttgtagaatatacatttttcccataaccacatagacatcctgtaggattgaccatatgtcaggcaacaaaacaaatcttaacaaattttttaaaagttaatagcataccaagtgtcctcctatgccacaatcaaataaaactagaaatgagtaaaaagaggaattttggaagctgtacaaatacgtagaaattaaacaacaatctcctagacaagcatcaagtcaatgaagaaattaagtaggaaatcaaacaagtttctgaaaaagaaagaaaataaaaacacaatataccaaaacctataggatagagcaaaagcagtgctaagagggaagttcatagcaataaattcctactataaaaaactagaaagttttcaaataaacaatctaatgatgcacatcaaggaattagaaaagcaagaacaagctaaatccagaattagtagaagaaaataagtaataaagataagaacagaactaaatgatacagagactaaaaaaatacgaaagatcaacaaagcaacaaattggttttgtgaaaagataaaaaattaaataacctgctagcaagactaaccaagaaaagagagaatacccaaataaacaaaattataaatgtaaaaggaggcattacaattgacatcacagaaatacaaaaggtcatcagacactattattaacagttaacatttacaaactggaagacataggggaaatgaataaattcctggaatcacaaaacctacgaagatcaagtgtggaaaaaatagaaaatctgaacagaacaataatgcacagtagattgaatcagtaacaaaaagactcccgaaaaagagaagcccagaattggttcctttattgctgaattctaccaaacttacaaagaataactaacattgattttcctcaaggcattccacaaaactgaagaggagggaattctccctattttattttatgaggcagtattaccctcataccaaaaccagacaagaacacaagaaagaaagaaaactacaggtcaatatccatgatgaatgagacacaaaaaccctcaacaaaatactagcaaaattaatcaaacagcacaccaaaaagataacacatgttaatcaagtgggatttatccttgggatgcaaggatgattcaacatacacaaatcaataaaygtgatacatcatatcaaaagaatgaaagattaaaaaatgtgatcatctcaataggctcagtaaaagcatctgataaaattcaagatmttttcatgatgaaaactctcaagaaagtagatttagaaggaatataccccaacataataaaggccacatattacaaactcacagctaacatcatactgattggaacaaagctgaaagcctttctatcaagatccggaacaagatgaggatgcccacttttataactccccttcaggattctagtactgaaggttatcagccagagcaatcaggaaaaagaaagaaaagtcatccaaattggaaaatgggaggccaaattgtccttctttgcaatgaaattatcttatattaagaaaaacctaaagactccaccaaaacactcttagatttgaaaaattaaggaaagttgcagagtactaaatcaacatacaaaaatcaatagcattttatacaccagtctgaaaaatgtgcaaaagaaatcaagaggcaatcccatttaaaatagctacaaaaaaaaagcctaggaataattttaaccaaacaagaaccaacctctacaaacaaaactataaaacactggtggaagaaattgaacaagacacaaaaaataaaaaatatatttcatgcccatagatcagaagaattaatattgtcaaaatatccatactaccaaaagaaatctacattttcagtggaattatatcaaaatatcagtgacattcttcacagaaacagaagaaacaatcctaaatgttacatattaatagaaccacaaaagtccccaaatagccaaagcaatactgaggaaaagaacaggaaaaaggacacaacacatcatactacctggcttcaagacatattataaggctgtagtaaccaaaaaagcattgtatgagcgtaaaaatagacacatgaaccaataaagaacccagaaataaatccacacatttataaccaactggttttcgacaaaggtgggaagaacaggcactggggaaaggatggctcttcaataaatggtgctgggaaaacaggataatcatactcagaagaatgaaactagccacctatctctcaccatatacaaaaatcaaatcaagatcagctaaaacctaaatgtaagatccaaaattataaaactgcttgaagaaaacattggggaaatgcttcaggtcattggtctagacgaagattttatggctaagacttcaaaagcacaggcaagataaaaataggcaaatgggactatattaaactaaaaagcttctgcacatcaaaagaaataatcaacagagtaaagagcctgttaaatagtagaaaatatttaatatttaaattatttaaatatttaatatttaaaaatatttgcaaactgtttctctaataagggcctaaagttcagagaatacatggaactaaaacaactcaacaggagaaaataataataatcccatcaaaaagcgggcaaaggacatgaacagacatttctcaaaagaagacaaatgaccaataggtatatgaaaacatgctcaacatcactaattagcttgaaaactcaaaccaaaactacaataatatatcattttaccccagttagaatgactattattaaaaggaaaaaaaaaaaaacagatgctggcaaaggtatgttgaaaagggaactcttatacactgttgatgagaatgtaaactagtacagccattatggaaaacaatatggatatttctcaaaaaattaaaagtagtactaacgtatgatctagcaatctcactcctaagtatttatccaaagaaaaggaaatcagcatatcaaaaggatacctgcacccctatttttattgtagtattattcacaatagcaaagatgtgaaatcaacctaagtgttggataaatggataaataaaatgtggtgtgtgtgtgtgtatacacacacacacacacacactacacacaaaatgaaacacagccattaaaaaagaattaaatcctaacatttacagcaacttggatgagcctggaggatgttatgctaagtgaaataagttagacaaatatcactttctcctccatatgtgagagctaaaaactttgctctcatggaggtggaaagtagaatcatagttatctgaggcttggcatggtgtttgttggggattggggggataagagaggttggttaatgggagcaaacatacagttagaaagaacaattcaaatattcaatagttgagtaggatgactatagttaaaaacaatgtattgaatatttcaaaatagctagaagagaagacttcaaatattttcaacaaatagaaataatacttgactgacgtgacagataccctaaataacattacttaatcattacacattctatgtatgtacaaatagcaaaataatacatgtaccccataaaaaatgaattttaccatcaataaatttttttaaagtaactaaaatatagcaacagaaaaaatgtgaaatactaaaagtaggcctgctgataaaaaataaatcgttagatacatataatatccaaaatattatgattctctctaaaatcaggaaaatacctttgccttgaggtatctaggtctatgaagggtatctctaggctgagttttactataataaacacctgggaatgaagatcaaaaaggtcttcatcttctctgcagtatttcttgacttaacacaataggctggcattaaaaaataataataataatactggagtctgattgtgctcttttcaaaatcaaaatattaaaaccaacagctggcagggcacggcggctcacgcctgtaatcccagcactttgggaggccgaggcgggtggatcacgaggtcaataaatcgtgaccatcctggccaacatggtgaaaccccatctctactaaaaatacaaaaattagccaggcatggtggcgcgcgcctgcagtcccagctcttcggggggctaagactggagaatcgcttgaacccgagaagcggaggttgcagtgagccgagactgcaccactgcactcaagcttggcgacagagtgagactcagtctcaaaacaaacaatcacaaaaacaatagccgttctttgggatgcgaatattttacatatgcggatggatggacgcatagattaatacattttttcatgaaccatcgtagctaacatatattttctcatgaacaccacagctaacatatataaatttttttccaggggcaaaggaccactaaagcatacaactgatgtgatctatgcagcgaaaatgatatcagaatcaggatcaaggatggatgtccttgctcggcagattgctaatcaggtgagttacttacaagtggacatcataaaagttcatgctaattgctctttgccattagaacattgatttaggcaaagttaaatttttactctcttcaaccattttttctaaattataattgaatttctaatagctctattaatacactaggtaatggacgattataaggaagcttaattatttcttagggcagatatttttagcttaaaacatactcaaattatttctagtatcagctcttcagcatcaaatatactcaattaattttaatcaattgtaattacaaaaccgagttttgttgttgttgatacattatatttctttctttcttttttggttgtgtatttttaacatttattttcattatgttttatttttaattgacatataataattgcctttgtagagtacatatatttctatacatgtatacactgtgtattgatcaaattaggtaatgagcatatactattcctcaaacatctatcatttctttgttttgaacacattcaaaatcttctcatatagctatttttaaatacacaataaattattaactatagtcagcctatgttacagaagactacaatttattcctcctatataagtgtatttttgtacctttaaccaacttatttttatcttcccctctccgctactcttccctgcccctgataaccattattctattcattaattctgtgtcatcaacttttaaaactctcacatatgagaatatgtggtacttgtctttctgtacctgacttatttcacttaacataatgtcctccagtcttggtcatgttgccacaaatgacaggatttcatttttctttgtgcctgaatattccattgtgcttgtataccacattttgtttatccatccattcattggtggacagttagattgattctaactaactgattgacaggttgtgaacagtgctgcagtaagcataggagtgcagctatctctttgacatactgacttccttttctttaaataaatacccagtaatggattgctggatcatatggtagttctattattagtttattagtagtagtttttaaagaaaactcctattttccataatggctgtactaatttacattcctaccaacagggtatgagtccccttttctctacattcttgacagaatttattttttgttctttcaattatagcaattttaattggggtaagatgatatcttattgtgcttttgatttgcattttcctgtcaattaatgatgtggaacattttttcatatacctgttggccatttgtatgtcttcttttgagagatgactattcagatcatttgcccatttttaaatttsttttattcttctgttgatatgtcttatgtattctgtattttaatcccttgtcaaatagtatgaaaatatcttctatcattctgtaggttgtcttgtcactctgttaattgttttctttgctgtgcaaaacctttttagtttgatataatcccatgtgtttatttttgctttygttgcctgtgcttttgaggtgttagccatcaaatctttgccaaaatcaatgtcctgaagccccgtgttttcttctactagttttatagttttggattttatgctaggcctttattttgattggatttttccatatggtgaaaggtaggggcctagtttcatttttctgcaatagatatccaattttcccactactgtttattgactatccttttctcaatgtgtgttcttgacacttgttcaaaatcagttggctataaatatgtgaatttatttttgggttctccattctgttccagtggtctatgtggtttttttttttaatgccagtaccatgcagttttagttactatatctttgtaacatattttgaagccaggtcgtgtgatgtttccagctttgctgtttttctcaggattgctttggctattcagggtcttttgtggttctatgtaaattttaggattttttttttctatctatgtaaaaaatgtcattggtatttttctatgggttacactgaatctgtatattgctctgggcagtatggacattttaacaatattaattctttccatacatgaacagaggatatctttttttgtctcctcttcaatttcttttatcaatattttatagtttaatagtagggatttttcacctctttagttatattgatttctaggtgttttgttttttgtagctatgagaaataggattgcttgcctgatttcttttttagattgttcactatttgtgtgtaaaaatgctgttgatttttgcaggttgatttgatatccttcaactttattgaatttttttatcaaatctaagagtttttttttttggtagagcctttaggtttttcttttttttgtatatatatttttatttttcatttttgtgagcacatggtagtctatatatgtatggggtacaggaaatattttgatacaggcatacaatgtgtaataatcacaacagggtaaataaggtacaggattcacactcagagtcaactatccagagacaaaataaacaaaaagaaattttaattttcacttagtagtttaattagtaatagcaatgttttattacacttttgacattttcatgaatcaatcagtaaagacaaatgggataagaatatatttaatgagtacagaaatatagttagatagaataaataagatctagtatttgatagcaaaacagggcaactatagccaaaagtaatttattatatgtttaaaaataactaaaagttataactggattgtttgtaacacaaagaaaggtttttcttaatataagaccatgttatctataaactaggacaattagacttcctcctttccaatttggatactctatatttctttctcttagctaatggttctggctaggccattcagttctatgttgaataaaaatggtgacagtaggcagccttgtcttgtttcagatcttacaggaaagtctgtcaattgtttccttatttttgctcttcaaaaattaatacattttaaaatgttataatgttaggttttctgtgtcaacaatatattctaatataatatttaaaattcaaagaaaagtagtatttagtagaatactaaagataatactaaagatataaaatgcataaaatacataattaatatagagactggtgttcataaacattttagtttcctttttttagatttctcatgtttatttcagtatttctaagcagctgctgcatccttagaaatactttacactttaactgaaaaatctgttgctttcattaatgtgttgagatattcaattaatatttcagactgaggtrtaatattatttcatggcttttatattatgttcaacttcatagtacatatttatttccttttggaaaaaaatgaggatttttgcaactgtttcatattatttcttgcttaaatagtattagggaaaggtttttgggcttctttttataatgattactattgttcactatgtttatactctcttggaaaatgaagaactctctcctattaaatattgtatttgtggatataaggaataagaaacaaataaagactaattataataaactgtttaataacattcctaataataaagaacatatgtcttttccgtgttactttaattattataaaattttattaatccttttttttagtatttagtatttacagctaaaacaaactatatcctaaataagtcaaaatttctgagtttgattatgtgactgaagcctatatatgcccacagttttctttattttagaatcttattgcattcacttttatgagagacactaaatcttagtgaaataagtgaaacatagtacatgacacatatttacatgtattaataactttttaaatactgaatgcttcctcccatttttttctgtttattttgaaacacccagttttcaaagttgacataattgtgtcacattgaaggttttttttcttatattgataatcttctttaattggatcaggttgccttgaagtaggtacttctataacatggctttatcaaattatgtcattgtttttagcattattcaaatggtatgggagaaagcaaaagtatcatcttacttctgtatagctttgacattttaagagaagcttagagaagtagtcactgactaataaagaattatagatgactctttttggccttttccatttcatacataaaatagtttcagatgaattacttttgttctgaagaaatatagttctaagtaatcaaaactgagaatgaagaaactgactcagttattacagtgaccatctagggaggttgtctttgaatgtgcttctgacattattattggatagattaagacattttaggcagaaaataatatctgaaattgattatggaataaattgagtaatgtaagcaatgtgattttcagtgtctatgtatattatgaaaaaaatctgctggaacattggttgctttctcttttgatcaatttaatatttcaaaaataatacattctagctttagtttttgctggtgtgtcagaaggtcaaacagtaatatccattccaactaacattagatttgaaattatatatatatttaaattatttaaatgcatgtttatatatatatcatctattacatatattattagaccaatttagttacattctgtaaagtttcagagttaaagttcacatgtagaaagaatgaaacaattagattagttgatgcttctcattctgcttgcttggccttttcatttttatttttcacttttccttccttcattgcttccttgagagaatatttattgtgtgtatgccacacacaattcactactctggcattggcattagctagttagaaagagaagaactaaaaccttctgtttaattttcccagtcattcaacattttttagacttcagaattgtctcaaaatggcggtctcaaaaaaggcttaagtatgccatcaaagatatatttaagtcttgtagaattttagcacaaattttgtctcctttagacagtatccttgtataaaacaagattgttatagctattcttacctataacaattcttaaaaattttgcttgtgaattaaacagaataagttggagaagtaaaatatgaatccaagatttcaggctttcagtacatatttttttctatttctgtactctacattgtaattaatcatattagcagatattctaaattagataaagtaacatctcataaggtaaggataatgcacaaaaagatttcaaatagttatagaagcagtataacctagataggaaggagacaataggagccaaaataaaattagcatctgctaaaagtgttttgcaccaggagagaacagtgttagactttctgatccctcggtgatctttaagcagcctaattacttcctccttgtaattttgccaaagcaaagatattaaggctaataactggacattcccacctaattgtaactgaacaaaattaaaacgaacttttagtgttaaatacattggcagctaattctaattcaagaaaagatgatgtttaaaaaccaaagtaaagaaatataaaccaaatcacacaaaatgcactccattatgaacaaaacaacctacaagtataatttgtattaatattttacaaaatattcttggaggctggcctcatttgaattgtttcatgttgatattataagaggcaaaaaaattatttcaatgaaactatactactgagaagcttctggagccttcattatatcatgattacacaactcctaaggatataattcctagatacaccttgtgacaatatgcgtattttaaaggtattacctatctgaaatttatttccagcagaaattttttaattttttttttcaagaggtttttggggagcagatggtgtttggttacatgaatatatatatatacacacacacacacacatatatatatacatacacacacacatatataccacatttatatatatatatgtatatataacattttctttatcattcattgattgatgggcatttgggctgattccatatttatgcaattgcaaattgtgctgctataaacgtgtgtgcaagtatctttttcgtataatgcctttttttcctctgggtaratatctagtagtggggttactagatcagatgatagttctactttcagttctttaaggaatctccacactattttccatactggttgtactagtttacattcccaataacagtgtaaaagtgttcccttttcactgtatccatgccaacacctttttttgttgttttgttttttctgatcatggccattcttacaagagtaaggtggtatctcgttgtggttttgatttgcatttccccgataattagtgagttgaacatttttttcatatgcttgttggccatttgtatatctttttttttttgagaatcgtctattcatgtccttagcccactttttgatgggattttttttcttgctgatttgtttgagttatttggagattctgaatatgagtcttttgtcagatgtgtagattgtgatgatctttctcccattctgtgggttttctattaactctgctgattatttctttttctgtgcagaagctttccattttaattaagtaccatctatttatccttgtttttgttgcatttgctgttgggttcttggtcacagagtctttgccgaaaccagtgtctagaagggtttttcagatattatcttctagaatttttatggttttaggtcttagatttaattctttcattcaccttgagttgatttttttatagggtgagagatgagaacccagtttcattcttctacatctggctagccaattatcccagcaccatttgtcatatagggtgtcctttcttcacttaatgtttttgtttactttgcaaagatcatttcgctgtaagcatttggctttatttctgggttctctattctgttccattggtctgtgtgcctatttttataccagtactatgctgttttggtgactatggccttataatatagtttgaagtcaagtaatgtgatgcctccagatttcttctttttgcttagtattgatttggctatacgggctcttttttggttctatatgaatcttaggattgttttttctaactctgtaaacaatgatggtggcattttgatgggaattgcattgaattcgtggaatgcttttggaagtctggtcatttttacaatattgattctactcatccatgaacatgggagtgtttccatttgtttctgtcgcctgttatttctttcagcagtgttttgtggttttccttgtagaagtctttcacctccttggttaggtatattcctaagtattttatttttctttttgcagattttgtaaaaaaacggttgagttcttgatttaattctcagcttggtcactgttggtatatagcagagccactgatttgaatgcattaatgttttatcctgaaactttgctgaattaatttaccagttctaggagattcttggatgagtctttagggttttctggatatatgatcatatcatcagcaaacagcaacagtttgacttcctctttaccgatttggatgcccttgatttctttctcttgtctgattgcaatggctaggacttccagagtcctgttgaatacaaacggtgaaagtggtcatccttgtcttgtcccagttatcaggtgaaatgctttcaacttttccccgttcagtataatattggctgtgggtttgtcatagatggcttttattaccttaaggtatgtcatttctatgctgattttgctgagggctttaatcataaagggatgctggattttgtcaaatgctttttctgtgtctattgagatgatcatgtaatatttttaaaatttttttatgtggtgtgtcacatttattgacttgcagatgttgaataatcccttcatccctggtatgaaccccacgtgattatggcagtttatttttttttacatatgctgttgaatttagttagctagaattttgttggggatttttgcatctattttcattagggatatttgtctatagttttcttttcttttttttttttgttatgtccttccctggttttgttactagagttatactggcttcataaaatgatttaaggaggatttcctctttctctatcctgtggaataatgtcaatcggattggtatcaattcctctttgaatatctgatagaattcagctgtgaatttgtctggtcctggacttttttgttgttgttgttggcaatttttaaattaccgtttcaatctcgctgcatattattgacctgttcagagtttctatgtcttcctggtttaatctaagagggttatatatttccaggaatttattcatctcctctaggttttctagtttatgtatgtaaaggtgttcatagtagccttgaataatcttttgtatttctgtggtatcagtagtaatatctcccatttcgttctaatttaatttatctggaccttctgtcttcttttcttcgttaatctcactaatgatctatcgattttatttattttttcaaagaaccagctttatatttcatttattttttgtattttgtgtgttggttggtttcaatttcattttattctgctcagatctttgttatttattttcttctctggcagaaatgttgatgcctagattagttctccagattaatgaactcctactttataaaaataaatgcacagaaagttctcaagatttaaataggactaaatgtatactgaaatatttgatctatttgcgtctttcaagtaatagtgaatctcctgttctaagagatgctgctttactcttttcccctttatgtaatgtctgacattttttcactgaaacagtgttttaaatgctcctagggtgattatctattcaggttcacttcatgtatagttacaaaactatgtaaccaaaaaataaagtgttttagggtctaggtggaaggagctatcttgtataagtggagaagaggaaggatgagcaaagtttcttcttgtagttggctggctatctttaatcaaaaattccaaataaccagaatttgtctgagttacctttccaccatcttttccacatccttattttatgtacaggataatgcacttgtatgagtttgtttcagtcgaagtaattctttgaatgacaaatttcaggcatgagggagagggtgacacttttgagttatggtctattacataggacactcatttcttctgagaatctctcatggaagtaacataaagctgaaaagtagcttgagtcataactttacatctactaaagtaaaggagctttgttgaataaggaaaacatcttgtctttaatttgtattgtgttcaaagtacatgtcactttctcaatagctgtatgtgcaaaccaagttgaaaataaaaaggaatttgaaacaattcttaaactcaagacaatttcagcctaaatatggacaaaatatgacaggattttaacagcatatataacttctggtaaaaacaacctttattcattgagatatgccatgcaccatactttcccaattataactctcataaatcaacatgtccagtcttgaacataccatatgagacaatgttatcctctaccactgacattataacagagttccagtgtatttttaatcatacttctataggtaccttctctgttctgtgtttcagaaacctgaatttgctaaacagcagctgtcataggcatagcaaagaaaaaaatacttaaaatatattgaggtttctaggtgtagaataagcacaaactaatggctgaccagatttaagagatggaaaagaggaacaaggcattcttcattgagatagttaatacaaagagaaaaaatagttgaataggtgagtaggcaagatagtgaaatagctgagagataaatgtgttaagtgtgaaatgttgatgagatgctgaaatggcatggactaacacagtagttacatggatcgcctgatgacagagctggatgttagaattttgtagtttgtgttgtgtaagtgacagatgaagccagagcactgtctactgttgtccaagaagagaatgaaagtwaaaaaaaaaaaattgctyaggaacaaaagctgagaacaacaacacgtgcaaggaaaaaaaaaaatgcttacaatacagtctgggaaggctggtgtaaaactaggagaaaatctaagaggaaacattcatgagaattaatatttatgaaaatcaataaagatctaaaagctccagagaggtgatataagggaggaactgcaacatatataatgaatgcggcaattataagtccattagtgatctcagtaagataaaattctgcggactggaggagttgaaaacagttcttagaatgataaggaaaggaggaatctgcattgaaacattttagtaggcatattcataaacaaaaaaggagacatgggattatagaagtcagggttttgctttgagggacttgatagagtcaggaatcagaaaaaaaaaggcattaaaagtagaggaaaagatgagatcattgatgatctgtgatcctgagcaagatgaaacaaggcattacaggtgaagaaatgagccctgtgggatgggaaaagtcatgaacaccaagtgcttttgctaccactgatcgctttaaattcctatttttgaaattcacagtgacacctagtacttttcattaacaaacttttccagcttagcaaaatgtaggctattgtctgtaattgcaaaattcgttttatttatttatttatttatttattatttttttaatttttgagacggagtctctctgtcacccaggctggagtgtagtggcacgatgtcagctcactgcacctccgcctcccaggttcaagcgattctcgtgtctcagccacccaagtagctgggactataggtacgagtcaccatgcccggctaatatttcatattttgagtagagatgaggtttcaccatgttgaccaggctggtctcgaactcctgacctcaggtcatctgcctgcctcagcctcccaaaatgctgggattataggygtgagccaccgcacctggctgcaaaagtcattttaaatttcttaaagwttaggctccaatatgagcaaaaaaatactaagattatggaataaaagtcttgaaaagtgttcgttttgctaattcacccctgaaatttaaactaaaacataatgaattttttttacatttttcctcattactaaatgatgtattccatattggctccaagcgtcttggtagaaacgtgaaaactggcttaaagtgagaaaaccacataggctgaaatgccatctgcttacatgttgtgagtccctgtgattataaaacttagatttaaaaaaaaatcatgcattaaggaactaagtagatgttctggaaaagtccctaatagtattcttttaaaagttattttaaagcaaatgttacttgagaaacaacagtaaagggcaagaatgttctaccaacctagagaccgaagtttttctgtcactttcacgtaaaratttaaaaggtgggaaaagcattgttygatgtttttaaatttaattttttttgtaaaaattgtacatatttaaggacttaagatatacaatgtaataatcaacaaaattaaaagacaacctatggtttgaaagaaaatatttgcaaaccatagatctgataaggaattaatatctagagtgtataagaaacatgcagaactcaatagaaaaaaaatccaagtaacctgattaaaaaatgggaaaagacctgaatacataaaagtggcccaaaggagatttgaaaaatagtagaatattcttaaagtaggaatgaggcattctcctgattctgcttctaagtgagcaaaactgactcagaaaggctttctgcatgtcaatgggaaagaaggctttaataacttttataagtataagaatttaccacatagtattttgttttactttggttataaaactgactgcttctgttataaccaagatattcccatcagttctgaaaatgaaaggtaaatttaggtcaagcaactttgaatttcaaaagatcattttcacactttctactcatttgactcattctttccttaatggaattataggcttttctactgtggccttggaagagtctcttgatagagacagcatrttttgcttaaacttgagtgattgcaattggttattggtcaagaatctgattactagtttgacagtttgattttatcagagttgtatagtggtgctggtcttcaaggaacaaatccacattaatcgagtttataattgacaaataagattatcaataagaaaccaacttacaaatcagaatgacaatttaatatttacaaaaaagataaaattggcaagaagactgatactgttcctagaacatggaggtaaggaggtgtagccagattatgtttgaacaygagctctaccactaataccatttattggcaagtgagttaacctctctgtttgtcaatattctccttcactaaatgaggataatgattccacttacctcatgaaactgtgggtgttgtgtgattattaaaacaattagtagagacaaaacatctagaattatagatgacagataaaacactttacatgtcaggkattatcattgtgtccatacttaagaatgaagaatagataagaaagttactcagtgaaagcaataataacaaaaaatgatttgaaagaatgccctrtagaagagattattgtgtatgcatgtgaatgaaacagagaaaactaaattcaaatcatttactctctctgaaacttactttgcaaatctacaaaatgaaaataatagatctaattaaaatggtgctttgagtactaaagttatgcatgtaaaggccttggcatagtacctggcacagacgaagtacctaataaagatcagctgcctgtcaagagaaaacaaagagatgacttgtttttcatcgttttaggtaatttcacatctgtaaattggggaaaatatttgcgtcttacagttttaatgattgagtgagaagatatgcctaaattagtttccatagcatgtggcacatagtaagagctaaatgaaaattaactattgttcttcctcctctgtctctgccttctcctcttcttcctttccctctttctttttcttttctttctccatatctttctcctttccaatcttcttcttaattagctacaatataatccttttgaggagatttgagggataaccctcatttgcttactgaaaacttgagaaacacccttaatttctatattcttgtctgattgtgtctctgtctggctatcctgtatctattcatgcatatgtccatgcctatctkgcagattgatagtatttctgcagaagagttgaattctttgctacctttgttgattattatcgactttgactcagggtaatgtgttctcatcttgtgcacacactctggagctacacagcctatttaaaaaatataagacgataagtacctcacaaattttccaaaaacactccagcttaagttattaattactgaataaaagcagaaatgcatgaaaggttttctggttgttcatcctactttttaatttgcagtttaggtcattagaataaaagctttaaaaaataacattttatagttatagaagaaatatatatttaagatatacaaaatttgaataaaataaaagtattgattatatcacatttattgatgattgtcatatatttctttcccagcatcttttaattttttttaacccagagtccagaatgtatttatctttaatgcatctaaaaaataatttcaacttttatttagattcagtgggtatattgcatgatactgaggtttgaagtacaattgatgcaatcacccaggtagtgagcatagtacccaataattagtttctcaagcctttactcccttcctccctcccctgtctagtaatcctcagtttctattgtggccatctttatgtccatcattacccattctttasctcctacttgtatgtaagaacatatggtatttgrgtttttgttcctgcattaattcacttgggataatggcctccagctgcatccacattgctgcaagagacataatttcattcattcctttttatggctgttattccatggtgtatatgtaccccattttatttattcaatccaccattggtggatacctaggttgattccgtgtccttgctttgtgaatagtgctgcaatgaacatatgaatgcaagtgtctttttgggtagaacaatttattttcttttgaatatgtacatagtaacgggatgagtgagtcaaatgttagttatgttttaagttctttgagaaatctccaaactgctttctacagtggctgaactaatttacatccccaccaatagtttataaagtgttcccttttctccacagcctcaccagcatctgttgtatttgactttttaataatagccattctgactggtgtgagatagtatcttattttggtttgatttgcatttctatgattattcatgatgttgagcattttttcacattggttggccacttgtatgtcttcttttgagaagtgtccattcatgttttgatgtggttttggcatttgtccttcccaaatctcatgttgaaatgcaatccccaatgttggaggtggggcctggtgggaggtgtttgggtaataggggcagattcctcatgatgagctgtcctcaggatagtgcattatcagaagatctggtcattkaaaagtgtgtggcacctcccacttccctcttgctcctgttctccccacgtcgtgcacctgttcccacttcatctcctactgtgagtaaatattccctgagcccccaccccaaagccaagtggatgccaacgcaatgcttgtatatcctgcagaaccacgagccaattaaacttcttttctttataaattacccagtctgaagtatttttttgtagcaattcaagaatgacctaactcgtaccatttacccatttttaatgggattgctttttgcttgctcarttgtttaagttccttatagatcctggatagtaaaactatgttagattcatagtttgcaaatattttcttccattgtgtgggttgtctatgtactctgttgatagtttgttgctatgcagaagctctttaattagagattccacttgtcaatttttgtttctgttgcaattgcttttgagaatttagttataatgtctttcccaagactgatgtccagaatgatgttgcctaggtttttcttcaaggattcttattgtggaggtcttatatttaaatctttaattcatgttgagttaatttttctagatgatgaaaaataggggtccagtttaattcttctgcctttggctagccagctgtcacagcaccagatactgaatagggagtcactgcttatttttgtcaactttgtcaaagatcagatggttttagttgtgcagctttatttctgtgttctctattctgtcccatcagcctgtgtatctgtttttgtgccagtatcatgctgtgtgtgttactgtagccttatagtgtagtttgaagtcaagtaatatgatgcctctggcttctttttttttttttttyycccccttaggattgcttgtctattcaagatatttcttggtttcatatgaattttaraatagttctttttctagttctgtgaaaaatgacgttggttgcttgataggaatagcattgaatctgtagattgctttgagcagcatggccattttaacgatattcattcttccagttgatgaaattgaaatgatttttccatttgtttgtgtcatctatgatttctttcagcagtgttgtatagttctccttgtagagatctttcacttccttggttagatgcatgcctaggtgttttatttatttatttatttgcagctattgtaaatggagttgagttcttgatttggttctcagcttgaatgttattggtgtataraaatgctattgatttttatacaatgattttgtatcctaaaaaattactgaagtcgtgtctcagttccaggagccttttagtaaagtattttatgttttctgggtataaaatcatatcaacagcaaagaaatatatgttgactttttatttgtctagatggataccttttacttatttattttgcctgattgctgtggctgggactttcagtactatgttgaataagagaggtgagagtgggcatccttgtaacagttttcaaggagattggtttcagctttagcccattcaagtagagattggtttcagcttttgtccattcaagtataatgttggctgtggtttctcttagatggctcttattattttcagatatgttcctttgatgcatagtttcttgaaggtttttatcatgaagggatgttgtattttatcaaaagcttttcccacatctgttgaaataatcatatgatttttgttattaattctgtttatatggtgagtcatatttattgatttgtctatattaaaccaaccttacattccaagaattaagtctacttgatcatagtgaattaactttttgatgtgccactaaattcagtttgccaatattttgttgaggatttttgcatctatgtttatcagagatattggtatcagagatttttttcattgtatctttaccaggttttcctatcaggatgatgctggttttgttgaatgagctaaagaggagtctctccttctccattttttggaatagtttcagtaggattggtatcagctcttctatgtatgtttggtagaatttggctggggctctttttgttgttgttggtggtgggtgttttattactgattcaatttaggaactcgattttggtctgttcagggtttcagtttctttctaattcattcttggaggattgtgtgtttcagaaatttatcttttcctctagattttctagtttgtatgcacagatgtgttcccaatagtttctgaggctcttttgtatttctatgatattggttgcaatgtcacttttataacttctgactgtgcttatttgaatcctctctctttttttctttgttaatctagctagcagtctaccgatcctgtttattttttcaaaaaaaaaaaaaacacaactttggtcttcattgattcttcctatgaatttttaggtctcaaattctttcagttccatctaattttaattttttcttttcctctgctaacttttgggttggtttattcttgtttttcttgctcctctaggcatgatgtgaaatcattaatttgagatctttctaactttttgaggtaggagtttactgctataaactttcctcttaacagcacttttgctacatcctagagatttttatatgttgtgtctattatttttatttatttcaaagaattttttggttactgccttaatttcattgtttacccaaaagtaaatttattagtccattttcacattgctatgargatactgagactagctaatttattaaaaaaaaaaaragagaggtttaattgactaacatttcacatgtctaacacttttagtgagttgttgaagttcctcaacattatcgtgtggctatctaagcctttttgtagatctagaagtacttgttttatgaattcagatgcttcagtgttgggtacatacatatttaggatagttaagactttttgttgaattcaaccctttatcatcatgtaatacccttctttgtcctttattactgttgttggtttaaagtcttttttatctattatatattatattttaatatattttaaaatacatatattttacctaatatgttatatatattatattttaaatatattttaaagtacatatattttatctaatatartagccgctcctcttttttgttgtagtttaatctgcaagatagatatttcttcaaccctttactttgagcttattgatgccattatgtgtgagatgggtatcttgaaaacagcagatgaatggatgttgttattctatccaacttgccactctgtgccttttaagtggggggtttaggctattcacattcaaggataatattaatatgcaagattttgatcctatcatgaagttgtaagctggttgctttatattttctatggtttgattgcgctatagatctgtgggctctgtacttgtgtttttgtggtagcaggtatcagctctatattttccccatgtttagaattctcttaaaggtctctgacacaactggcctaatggtaattaatttttttagtgcttgtttgtctggaaaatatttttatttctctttcagtgataaagcttagcctggtgggatatgaactttttgttgaaatttctttgcttcaagaattctgaaaataggcctccaatctgtctcggcttataaataaggtttatgtagagaagtctgcttttaaccttttgggatttcctttgtgtgtcttctgacctttttctctagctgcctttgagattttttctttagtattgaccttggatagtctggtgattatatgccttggtgacgttcctttttgtatagtatctctcaagtgttctctggatttcttatatctagatgtctacctctctagcaaaatttgaaacattttcttgatttatcacttcaagtattttttctaggttgttatctttttctcagtctcaggaatgtcactaatttttaggtttggccactttacataatcccatatctctcaaagactttgtttattttataaaaattactttttctttatttttttccgactgggtcaattcaaaagactggtcttcaagatctgaaattctttcctctacttagtccagtttattggtgaagcttccagttgtgttttgaaattaaattagttttttaattccagaatctctgattgatattttaaagatgtttatctcttccttcattctctggattgctttaaaaagtttctttgtgttaattttcaacctcatcttggatcttattgagcttccttgcaatccacacttcaaattctttatctgtcatttccaagtttccactttgctggggaccatagctggagaactagtatggtatgttgatggtatcactacatttwgaattttcatggtgctagaattcttacactggttctttctcatcttgaagcattgatacttcaaatttttgtaattatatttgtgcagatataatttttcttttctttccctataatactattgatttttttttctttccctttccctttcccatctatttttccctagggagtgtgactttagagaatgctgggtaaggtcttttggcttaacttgtgtactcctacacctttctgtcagcaggtttcatattgggcggttcagttccacctacaagcctgtagatggtgtgtatgaccaataccgatgggtgtatacttcatccttgtttactagcagaagctctttcttgcctcaggcaatgggcttattcttgtagtgcaaaatgctctgagctccctcctcagccctagaggtgttgggagcaagatgggcaggtccagactggcaggtttgcctataattccctaagggcaggcatgagcaccggtgctgaagcataatccagtgagtgggtaccaaacaccaagaggtgtgcctagatatggagctgggaagctttcttgtcctcaaattctctacacacagatttggggtggcctaaactcctaatccaggggactgggtactccagatgctgggtgatctgcctaggcatgaagcagagaggctcctctacatacctggatccctgcagagaaagtgtggggtggctcaggctgtcaatctgagcaaacatgtactttgaatacctggaaatctgcccaagcgtggagtggagagggcctgctacaccacaatctatgcacagaaagggtagggaagctcagcctgatgatttaggcaagctggtactctgagtgcctggagatctgcctgggtatggagcaaagagagtcctgatgcaccatgatctatgcctaggaaggatggacagctcaggctgtctcagcaggttttattattttattttttatttttatttatttattttttgacacaaggtcccactctgttgaccaggctggartgcagtgttgcaatcatggctcactgcagcattaacttctcgggctcaggcaatcctcccacctcagcctcctgaatagctgggaccacacctggctaatttatttttattttttgtagagatrgtgtctccctatgttccccaggctggtctcaaattcctaggctcaaaggattttcctgtttcagcttcccaaattgctgggattataggcatgagccactgcgtctggcattcagcatgttttaaatacacacaatttttaatagaatttgattgcaatatttacatattgatttttttaacttccaaaaacatttttccacatcctttgaaactctattttcttgatactgagtaatgctacattatattgatattcattcttatttagtctttccattattttgggacatttaggttatttccaaattttgttattatacataatgctacaatgaagatctttgcatataaatcactgtccacatttccttgttcttataaaaatttactaaaagtggaattaaattagaaggaatttttataaatttattataattgcataggagaaagaacacaaagattaaatcttaaccaaagctatttaccatggtatgataaagctcaaagctgtcctccaggaagttccttcgaaaagataaaatgatgtaggaggctggttttcataaggaaatttaatattctaaaacatgtgtcctgtctgtttcttggcttcagttgkattcacagctgttatctaaggtagaaataatttcctttgtctgtaacagctaagtacattgaatgctgaaagtagtagaacatattatgttgctccatgttgtttatgcccatttgagtagcacaggacagacagtgtagagaccatgagtctcaagcagcattctaatagtaattctaggagccttctaatagtaattctaggtgaaagaaataattacattttaaatatttctatagatttaccaaaaatataatctgaaggcttctaacctttgtcataaattaaaggcagctattttatatacctttttatgtctaaaaattattttaacgtttcttggccaggtgtggtggctcacgcctgtaatcccagcactgtgggatgccaaggcaggcagatcatgaggtcaggagatcaagaccatcctagataacacggtgaaaccctgtctctactaaaaatacaaaaaattagccaggtgtggtggcgcatgcctgtagtcacagctacccgggaggctgagacaggagaatcacttgaacccgggaggcagaggttgcagtgagccaagatcttgccactgcactccagcctgggcaacagagcgagactccatctcaaaaaaataattattttaacgttccttttggctaagctgaagtaactaaggttgcaaaatgaatgaactattgtaaatggtagaagcatatcagaagctacttggtcctgtatgaaaataaaattgctgctttataaggtacctgccatgtgaatactgtatttactcaccttgatctaactattatttattctgctgtatctatttttatctttgatkcatatttagtgcccagatccatcttgtaaacaggacttgttggcctacctggaacagattaagttctactcccaccaactgaaaatctgcagtcaagttaaagctgagatccagaacctgggaggagagctcatcatgtcagctgtgagtactgcctakcacttacatgatcacaggtggaagatgcttgaaacagagtaactacacccttgtttacatgaccaaatcttttargtaaaattagtttagaaaaactaaattggagtttttattaaaagtacatgtatttaaactagcaagaaatcttaaactagcagatttcttaaagaaaggttaaaaatgttgttyttatttacttcagagattaaagagtaaatcaagttttataagccaattggataagaaatgcatgttaatttagagcatgacttcagaatgtgtacagatggaactccggaatgaatcctataatttttctaaaataaatgcatgtggaattgcaaattaataaaatgattgcttcgctgctattaattgatattcattttccccctatttctttttataacatagatgttcatgtcttgagatttttcatttccatatatattttcagaawtggagtatgataaaacttaatagatttagaggaattttcataaattctttggtggccctgagttttaagctgctataaattaccatggtagaactaatgtataccttttctactcatcttttaatagcagtagatcatttctctggagaagaaatggtaataaaataatatttgatatctatattggattcagttatcagtgactttgagaaggacatggactaagattataaatttaagtttaaatgaaacaatataaatattctgggaatttatatttctgagaaaattttttttaattacactagtatatttatatgtctgtaacatatagggcctctctatcctggcattcgacagtccctcaatgagttaatgttctgaaagaggatgtaattacaaaaacacaaacaaaggatcaccatcaaaagtagtgggcaggagccagttgcggtgtttcagacctataatcccagcgctttggtgtccagatcacttgaggtcaggagttcaagaccaacctggccaacatggtgaaaccctgtctctactaaaaatacaaaaattagctgggtgtggtggcgcatgcctgtaatctcagctactcagtagtctgaggcacaagaattacttgaacccaggaggtggaagtttcagttagccgagatcgtgccactgcactccagcctgggcgacaatgcaagactccatctcaaaaaaaaaaaaaaaaaaaaaaaaaaaaagtagaggggaggaaacaaatagtgactgtctatgtcttgcctatattttatgttaatcttcacaataacatgccagatggatcacttatttatttgttctgttttcttatatagctttcccaatgtcatactagtaaatgtcagagttgagtttaccttcaaaggtctatgattcctctgttcagagagacaacactgaatttgtgatgaaagtgaaaaacacaagtcgaaagtgaataatttggaaattataagatggtattgcattctagctttttattccagtggttgttagagggggaaaaatagtgtctttgatattcaaattttatcaaaaatcccacataaacacagtgagtgcattactagtgccctgtcacttttcagagaaaaatgcattttgtttagtcacaagccatgcaaataggaacatgcgtgtgtatagacacatatgcatacatgtatgtatatatacatttatatagatacacacagcatgtatgtgtgtatagatgcatatgtattaatatgtatacatatttttaactactgtatattccttttggcttattaaacatccagtcttcattttctcatttaacattatactgccttaaatatgtaaaaaagtatgtttatttggaggataaactcttccatttacttttgtcattttcacacactaatcgtgctttgtaaggtctaaatttcatataaattttatttttcaaatatacagtttcatgttgtatgacgctaagctttcaaaaaatctgtggtagaagttcagcctctgcatagctgttaaaatatattggtgttaattatccttccaaaatacaatttcctttctatatatagaaattcattcctgtttggtataatgattcaaattcatgaactttacatatattacagataaattaggcaggagctatttagaatccatgatttacaatttaaaagctgagtcattatataaaatgaggaagagcattgcaaatccaaaactatctgtcatcatctcactcactattccccattagaaaaaaaataaatctgaaaaaggagagcatgcccccttttgcatatcttactgccatctgtttgcaggtagatcctagaaagctttctaaatacattacatttacgtgtgccaaagcacacttactttaatctctcagtgaccctgagttcttgtcttgttcctattctttaaattcagaagatctaatctatcatttttctataagatctcttgaaaaatggcaagcatgattccaaagcagagagacactaaaaattacagaaatttggtattcaaaactacagactattcaaagtttactaaataaagctggcatcccaagattaggttcatgaaacattgccttaccaaatatagtgggttaaaaataagtaggtgtgaacggaatgcatttctaaagtgaatgggcagtatgttctgttctgggtctgaggtgtgaaggtttaggataaagaagatgaattaataaaataaaataacctgagagatattcttataatacaccatttaattaaaattattccacaatcattcttacatctatattgcaagcactcatcttgaagttgcatgttttacctgtatagagacaaaatatatgtagttcattcaaatccattactatgaattgagcccctcactgtgcaaggcatagtagtacatctgagggatgtaaagatgattatatgataatttccttaagatattgaaatgcataaaaaattaagaaacataaaatgtacctgaatatacaaaaaagattccagaacactgtaataaaccatacaacattggcatgtaaaaatgtacatgtatagcaagtgaggaaataatttatttgatgtgcagagcaggcaagagaaagcttcataagtggcgcaaacctgttttgggccttggttaataagtagaaaacaaatgtgtacttgtaggaggaggagagggaaaggatttgagatagaggggacaactgaaataaaacagagatagggaagacatggaatgttatggacatggtgggcagtctgatttgactgaaatcaactttccttggtacttttggtgtgtgttttgtggaataagggtgggtgggcaagtagagcaaaagcttgtaaaggaaactgggaatgttttgaaaggatcatttataatttaattttaccctgtaggcaattgagagtaatgaacaatttcttagtttgagatggcaatagtaaatctatgtatttcaaagttaacattttttagacacagcagtgatagattagaaagataagggactaaaggattgagacctatttaggaatgacttttaaaaattagtctaagatgtttattgcagcactagtcacaatagcaaagacttggaaccaacccaaatgtccatcaatgatagactggattaagaaaatgtggcacatatacaccatggaatactatgcagccacataaaaggatgagttaatgtcctttgctgggacatggatgaagctggaaaccatcattctcagcaaactaacacaagaacagaaaaccgaacaccacatgttctcactcgtaagtgggagttgaacaatgagaacacatggacacagggaggggaacatcactcactggggcctgtcggggggtggggggctaggggagggatcacattaggaggaatacctaatgtaggtgatgggttgatgggtgcagcaaaccaccagggcacgtgtatatctatgtaacaaaactgcatgttctgcacatgtaacccagaacttaaagtataataaaaaaaaaattagtctaagagagaaacagtgagaacttacttagggcaatattgatgagaatggaaaggagtgtatctatacaaggaacaattctgaggaaaatatgtttagaagcaattatccattgggtgttaagggtgaaaaagragaaagaattaagaatttcctaaaggttttgaggttaaatagtttacttagtcaacaatggcatcgttaactaaacagtgtatatagaaggaagaccatgttacggtgagtatggaaactcattcaggttttgcttgttgaatttaagtgaccaaggggcatccaaggagaaaggtttaggagaagttgggtctttggttctggaacttaggaaagaggtatgaaagagaagtatatgggaccatccagtgaaaatatgttggatgccatttttttaaaaatagctgagacagtgatccagaaacaacttttttcacaaagtgattccaatgtacctttatagattctgagacttgactgtggcagttaaaacaaactgggagtttaccatctccataaagtgagtctgcgaatgggcggtctagaactgttacgacagcttcacaaagtcaccagggaatcaggcacttttgtctttcagcttcacttttcttggcttccggctctcgttattatcaaggtcaaaaatatggcttatacggctctaacaatgacttgtatattccaggcagtaagaataaagagaaactgaagcaaacattccttacactttgaaagggaccttccagaaggtccctttcaaatactaattttttttttttacaaactattcgctagagcttagtcatactgttatawttcactgcaaggtatgctacaaaatataaattttgtatgtttgtttgtgtgttaatcctgcacattgctttccccagtgtaatcagagttctgtttctatgaaaaagagaatggatattgggtggcagctaacagtttctatcatattccctctatgattaccaaaatcacagcagtacacatatcatagtcatatttttgcacatattcccctctagactataaagtccttgaatatttttacatgatttatggtgcagtggccaacgactataaaggatgcaaccggcaaaattatgcaggttggcttagycttaaaagtacacattgggttttgcatttagaaggtgtttttatatctttttaaaagcagtatcagtattatggtgaaggcaaaaattgtatcatgatcagttgagtactgagtatgcaatgacagataaaatatggtggcacagrctcaattttccaaaagtttgaagttgaaaggaataaaagagagagaaagaaagaragagatacttgagggtcagagcagacagartcaccaaaagcatttttgtttgttaacatttttatttatatactgcctaaagtggcagtaattgagaaatgtttaggtaaagaaaaaaaagcgaccagaagagaatgaacctgtgaaaaattaagactacaactgatggaataaagtcaagcaaatgagagaatgtgatgttagaacgggtagaaagattaggtttggaaaaaaagaaaaaagagctcttcttctcagccaggatgaagttgaattaagatataatcacatttattaaataaagaaaatgtggtacatatacaccatggcatactatgcagtcatataaaagaatttaattatgtccttcacatccacatgaatgcagctggagaccattatcctaagcaaattaatgctaaaacagaaaatcaaataccacatgtcctcacttacaagtgggaggtgaacattaattacacagggacataaagatgggaacagtagatactggagtctctaaaaggtaagagggagaggggtaagagctgaaaaaattcctgttgggtactatgttcactatttgagagatgaaattaatagaagcccagacctcagcatcatgctatatacccttgtaacaaaactgcacatgtaccccctgaatctttttttttgttgttgagacggagtctcgctctgtcacccaggctggagtgcagtggcgtgatctcggctcactgcaagctccgcctcctgggttcatgccattctcctgcctcagcctaccgagtaggtgggactacaggtgccccccacggcgcctggctaattttttgtattttttagtagagacggggtttcaccgtggtctcgacctcctgaccttgtgatccacccacctcggcctcccaaagtgctgggattacaggtgtgagccgctgcacccagccgtaccccctgaatcttaaaaataaataaaaaattgatttagtctaacttaaaaaaagatagaatcacatttatagaaatgaatgaaaggttgaagaatttcttgctgataaatcccatgtttggtaaaatggaaagagtagttttctgttaaaattaagatatgagcactctattcaagtttcattttagcaatagaacaaaataaggatgtccacatctcaatcacttttctcaacattgcttagaagagaaaataasctaagttcacagcaagtttttgagatcatgaacagagatagcatatgatagacattttttaccagagccaagctccaggacattgtctggatcttggaacctgatgcagcttcagttcacatggaaatgaagccagtttggccttccacctgctatcctttatcaaataaagaggggagttgccaggtacggtggctcagggctgtaatcccagcacttggggaggctgaggcaggtggattgcttgagcttatgagttcaagaccaaccatgggcaacatggcaaatcccatttctacaaatattagccaggtgtggtggtgtatgcctgtagtcccagctactcgggaagctgaggtgagaggatgacctgaacccaggaggtggaggttgcagtgagctgagatcatgccactgcattccaccctgggtgatagagccagaccttgtctcaaaacactaaaaaagggaggaggttccaagatggccaaatagaaacagctccagtccacagctcccagcatgagcgatacagaagatgggtgatttctgcatttccaactgaggtactgggttcatctcactggggcttgttggacagtgggtacagcccatggagtgttagctgaagcagggaggggcattgcctcacccaggaagcacaaggggtcggggaattccctttcctagccaagggaagatgtgacagatggtaactggaaaattgggacactcccaccctaatactgtgcttttccaatggtcttagcaaatggcgcaccaggagattatatcccacacmtggctcggagggtcccactcccacagagcctcactcactgctggcacagcagtctgagattgaactgcaaggtggcagcaaggctgtgggaggggcgtctgccattgctgaggcttgagtaggtaaacaaagcagccaggaagctcaaactgggtggagcccaccgcagctcaaggaagcctgcctgcctctgtagacttcacctctgggggcagggcatagctgaacaaaaggcagcagaaacttctgcagacttaaacgtccctgtctgatagctttcaagagagcaatggttttcccagcatggagtttgagatctgagaacggacagactgcctcctcaagtgggtctctgaaccctgagtagcctaactgggagacacctcccagtaggggctgactgacacctcatacgcctggttgcccctctgagacaaagcttccagaggagggatcaggcagcagcacttgccgttctgcaatatttgctgttctgcagcctcctctggtgatatccaggcaaactgggtctggagtggacctccagcaaactccaacacacctgcagcttagcatcctgactggtagaaggaaaactaacaaacagaaaggacatccacaccaaaaccccatctgtacgtcaccatcatcaaagaccaaaggtagataaaaccacaaagatggggagaaaccacagcagaaaagctgaaaattctaaaaatcagagcatctcttctcctacaaaggaacgcagcgcctcaccagcaatggaacaaagctggacggggaatgactttgacgagttgagagaagaaggcttcagatgatcggtaataacaaacttctccaagctaaaggaggatgtttgaacccattgcaaagaagctaaaaaccttgaaaaaaaatttgacgaatggctaactagaataaacagcatagagaagaccttaaatgacctgatggagctgaaaaccatggcacgagaactacatggcacatgcacaagcttcagcagctggttcaatcaagtggaagaaagggtatcagtgattgaagatcaaatgaatgaaatgaagtgagaagagaagtttagagaaaaaagagtaaaaagaaacaaataaagcctccaagaaatatgggactatgtgaaaagaccaaatctacatctgattggtgtacctgaaagtgacggggagaatagaaccaagctggaaaacactcttcagggtattatccaggtgaacttccccaacctagcaaggcaggccaacattcaaattcaggaaatacagagaacaccacaaagatactcctcaagaagaacagttccaagacacataattgtcagattcaccaaagttgaaatgaaggaaaaaattaagggcaaccagagagaaaggtcgggttacccacagagggaagcccatcagactaacagcagatctctcggcagaaactctacaagccagaagagagggccaatattcaacattcttaaagaaaagaatattcaacccagaatttgatatccagccaaactaagcttcataagtgaaggaggtataaaatcctttacagacaagcaaatgctgagagattttgtcaccaccaggcctgccttacaagagctcctgaaggaagcactaaacatggaaaggaacaaccggtaccagccactgcaaaaacatgctaaattgtaaagaccatcgaggctagaaagaaactgcatcaactaacaagcaaaataaccagctaacatcataatgacaggatcaaattcacacataacaatattaaccttaaatgcaaatgggctaaatgctccaattaaaagacacagactggcaaattggataaagagtcaagactcatcagcatgctgtattcaggagacccatctcacgtgcagagacacacataggctcaaaataaagggatggaggaagatctgccaagcaaatggaaaacaaaaaaaggcaggggttgcaatcctagtctctgataaaacagacttgaaaccaaacaaagataaaaagacacaaagaaggccattacataatggtaaagggatcaattcaacaagaagagataactgtcctaaatatatatgcacccaatacagaagcacccagactcataaagcaagtccttagagacctacaaagagacttagactcccacacaataataatgggagattttaacaccccactgtcaacattagacacatcaacgggacagaaagttaacaaggatatccaggacttgaactcagctctgcaccaagcagacctaatagacatctacagaactctccaccccaaatcaatagaatatacattcttctcagcacaacgtcgcacttattccaaaattgacaacatagttggaagtaaagcactcctcagcaaatgtaaaagaacagaaattatagcaaactgtctctcagaccacagtgcaatcaaactaggactcaggattaagaaactcactcaaaaccactcaaccacatggatactgagcaacctgctcctggatgactactgggtatataacaaaatgaaggcagaaataaagatgttctttgaaaccaatgagaacaaagacacaacataccagaatctctgggacacatttaaagcagygtgtagagggaaatttatagcactaaatgcccacaagagaaagcaggaaagatctaaaattgacaccctaacatcacaattaaaagaactagagaagcaagagcaaacacattcaaaatctagcagaaggcaagaataactaagatcagagcagaactgaaggaaacagagacacaaaaaacccttcaaaaattcaatgaatccaggagctggttttttgaaaagatcaacaaaattgatagaccgctagaaagactaataaagaagaaaagagagaataatcaaatagatgcaataaaaaatgataaaggggatctcaccacttatcccacagaagtacaaactaccatcagagaatactataaacacctctacacaaataaactagacaatctagaagaaatgaataaattgctggacacatacaccctcccaagactaaaccaggaagaagttgaatccctgaatagaccaataacagtctctgaaattgaggcaataattaatagcataccaaccaaaaaaagtccaggaccagaaggattcacagccaaattctcccagaggcacaaagaggagccagttccattccttctgaaactattccaatcaatggaaaaagacgaaatcctccctaactcattttatgaggccagcatcatcctgataccaaagcctggcagagacacaacaaaaaaagagaattttagaccaatatccctgatgaacattgatgccaaaatcctcagtaaaatactggcaaactgaatccagcggcacatcaaaaagcttatccaccatgatcaagtaggcttcatccctgggatgaaacgctggttcaacatatgcaaatcaataaacgtaatccatcacacaaacagaaccaatggcaaaaactacatgattgtctcaatagatgcagaaaaggcctttgacaaaattcaacagcacttcatgctaaaaactctcaataaactaggtattgatgggccatatctcaaaataataagagctatttatgacaaaccctcagccaatatcatactgaatgggcaacaactggaagcattccctttgaaaactggcgcaagacagggatgccttctctcaccactcctattcaacatagtgttggaagttctggccagggcaatcaggcaggagaagaaaataaagggtattcaattaggaaaagaggaagtcaaattgtccctgtttgcagatgacatgattgtatagttagaaaaccccatcgtctcaacccaaaatctccttaagctgataggcaacttcagcaatgtctcaggatacaaattcaatgtgcaaaaatcacaagcattcctatacgccaataacagacaaacagagagccaaatcatgagtgaactcccattcacaattgcttcaaagagaataaaatacctagaagtccaacttacaagggatgtgaaggacctcttcaaggagatctacaaaccactgctcaatgaaataaaagaggacacaaacaaatggaagaacattccatgctcatggataggaagaatcaatattgtgaaaatggycatactgcccaagataatttatagattcaatgccatctgcatcaagataccaatgacttccttcacagaattggaaaaaaaatactttaaagctcatatggaatcaaaaaagagcccacattgccatgaaaatcctaagccaaaagaacaaagctggaggcatcatgctacctgacttcaaactatgctacaaggctacagtaaccaaacagcatggtactggtaccaaaacagagatatagaccaatggaacagaacagagccctcagaaatactaccacacatctacaaccatctgatctttgacaattctgacaaaaacaagaaatggggaaatgattccctatttaataaatggtgctgggaaaactggctagttatatgtagaaagctgaaactggatcccttccttacaccttatacaaaaattaagtcaagatggattaaagacttaaatgttagacctaaaaccgtaaaaactctagaagaaaacctaggcaataccattcaggacataggcacgggcaaggacttcatgactaaaacaacaaaagcagtggcaacaaaagccaaaatagatgaatgggatctaattaaactaaagagcttctgcacagcaaaagaaactaccatcagagtgagcaggcaacctacagaatgggagaaaatttttgcaatctacccatctgacaaaggtctaatatccagaatctacaaagaacttaaacaaatttacaagaaaaaatcaaacagccccatcraaaagtgggcgaaggatatgaacagacatttctcaaaagaagacatttatgcagccaacagacacatgaaaaaatattcatcatcactgacgatcagagaaatgcaaatcaaaaccacagtgagataccatctcacaccagttagaatggcgatcattaaaaagtcaggaaacaacaggtgctggagaggatgtggagaaataggaacacttttacactggtggtgggactgtaaactagttcaaccattgtggaagacagtgtggtgattmctcaaggatctagaactagaaataccatttgacccagccatcccattactgggtatatacccaaaggagtataaatcatgctgctataaagacacatgcacacatatgtttattgtggcactattcacaatagcaaagacttggaaccaacccaaatgtccatcaatgatagactggattaagaaaatgtggcacatatacaccatggaatactatgcagccataaaaaaggatgagttcgtgacctttgtagggacatggatgaagcttgcaactatcattctgagcaaactaacacaaggacagaaaaccaaacactgcatgttcttactcataggtgggaattgaacaatgagaatacttggacacagggtggggaacatcacacaccggggcctgtcatggggtgggtggaggggggagggatagcattaggagatatacctaatgtaaatgatgagttaatgggtgcagcacaccaacttggcacatgtatacatatgtaacaaacctgcacattgtgcacatgtatcctagaacttaaagtataataaaagaaaaaacactaaaaaaaaaagaggtgagtatataaaaatttctatggaaaatacatactgttgcagttcagttcccctagtcatcttgatgtatgaatgtcctaaattagaaatagaataaaaaatataactctaagaagattaaaatgtatctgacttacctcaaggcattctcatcagggagcagattcttcatcaactgttcacctagtattcctatacaccacgcctagtgggaaactgttgtattttgtaaaaggagacttgctataaagaaataactattgttatattctagcctgtatatatgaaaaaggaaattcaggaacaaaaatcaattcattagaatgtttttaaactcttaaaattaccctttccccaaatgtcatgcttttgggtcagcatttttttggtactgctcaagactgattaattatgtaaccactctgttctgtggatttcttttaatgtgtttaatcacgttctcttagcctgaggcaggtgtgccaaagccacaatttaaaaaactggatgataaataaaactaatcagtcaaaggggaaagatcagaaagactgaaaattcrccaagcaactgcaactcagcttcaacagaaatcaaggggccatgttcattcaattaggaaagataggaaacagcaataattcagctattgaccaaaagagccatgagggcttacagaatgtaggcaatcaagtacttacagaatgacagtaggttaatgtgtttgctttgttaaagcattaaggaaaatagttaatgagctttctgaacctactgcaatcatttgtagacagaaagaaaacagggaaaattaaaaaaaaattggaaaattaactggaatatttatagagaaagaaagacgggaagaagtatgaagtggaagggagagaagcaaaagaaatgaagaaagggaaaggaggagaagcaagaagaggaggaataaaagaaagaaaaaggaaagagaagaaagaagatgcttcagtaaattcaaccctattgagtgttgctttttgtttcttttaatcttaagcaggaggtacatggaagtaatcagaccttagtaatttaaaggatatacttcaaaaaatgcatgtgggggtgctgttcttcctttttttcttttgtattgcattgtaataaagtggactaaggcatttccttgatatctaggtaaactaatattacaatgaattggattttctttttgattgtgcaatgcattcagttataatggtacttgaagaaaccttagaaataatctctttatgttatagctatctatctcatattcattttataaacaatgaaataggtgagggattttttttttttttttttttgaggcggagcctcgctctgtcgcccggtctggagtgcaatggtgccatctcggctcactgcaagctccgcctcccgggttcatgccattctcctgtctcagcctcctaagtagctgggactacaggtgcccgccatcacgcccggctaatttttttgtatttttagtagagacggggtttcaccgtgttagctaggatggtctcgatctcctgacctcgtggtccgctcacctcggcctcccaaagtgctgggattacaggcgtaagccaccgcgcctgacctagaatctcatgttctttatttcattctaggtctcatgttctttacttcattgctactgaaatgaagccctatgacctctcggtgactttagtgctgagatgacaggggtgggaggtaggagaggagtgggtggtattagcataccctgctaggatggttgctacatacatcaagagctaaggaatgattttaattgaaagatgtggggaaacacagactagagcacagtattaataatagtgatgatttaatgattctggattcttaagaagaactaatcagaacagacacttcagcctcaaaatgagaagctaacatgaggctatagaaaagctgctggaccccaaattataagacctgttatagtctagacattaatctctttgggtccatttcttcatctatcaagtttgggatgaaatgagcctcgtggttccttccaaatcagaatctctgatcttattcttctttgttttacctttcccttcacagttgctatccaaattactcttctcagtaccaactgacaaattatattatgctacagaaggcagttttgtttcattttgattgattttaagagggtgcttctccaattttgcttaagcaatctgcatcagtgagaatgagatcagctccttcaggagttacctgctaattgcaaacctagaaaaaagtacatgtgtaccaaaatggtacaatatattgtttatgatttgagaattgatttgacatggtttactgagactgctgtggtatctctctcacaaatggcagtgatctgttttgtgaaattagatcccttttgtgcaattacagagatagaaaaaaaaatctggatgaagcacacacacacaaacctggatatgggaaggaaagaaatgaaggggggagataaaaaaaagtatagatgtgatgtgagagtctctactgttaaatgtactccttacaataattactatattcttattcatatgtcaaatagttccatattattcaaaaggaattttgcctgaatttaaaacttagcataaacaattatttctgttctggagtaaataattagcttggttgttatcaatccttagaaaagagggaggagattaattatttctcttgtgtgctaaacaacctgaactatagaacttcaaagccagagatgaaatgagaggccatgaaagtgaacaagatgtatttgacaactataggaatgtgccaaattccccattaggcaaagtgcagctgaaggaaaaaaacagagctggatgcagacatcctgatgttcacgagttgagctgaaagccrgggaaaaacacagaagaaaaggggagagaagacaaaaaaaaaaatcaagtagctgtagattctaggatagtaaagtgctggcgtcaaaatctataaaggcatgtataaggcagaactgaaagcagatgtggaaaaaggcacaagactgtatggatgatatttgcaaaagtagtcatttcagtctgactcatgctgaatttatgcttgttgttgcataatatgaaagaatactaaagtcacaggataaaaactgtgaggttgtttgtgtgtgtgtgtgtgtgtgttccctagcaaaatcaatgaaattccatattttcccttttgattactaatgtctgaatgttattaatagcaaatcaataactcctartaataattattaaacattgatttttttcatgctttcatctgttccacagtttctcatctgcagcactattgactttgggggctggwtaattctttgttgtggggggcttccttgaacattgtagagtgtttaacaacatttccagtctccacccactctgatgccagtggccatccctttacctggttgcccattttcctgctactgtgagtgttggctgctaacatctcacagctgctcctttttctggataatgttgtcagccaagcaggagtcactatgtatgagtggttatgcaccaccacccctgcatgctctgacaaccaatcgctaataactgactgagagaaggatataaagctcaggctccttgcttcaagatggaaccaactctgctgtacaatttcacaacccrctctgaggtcaggtaaagctagtctcagacttagattaataattttcttattagttccaggccctacctccccatgcttttttcttccctccccttctgagaacagaccttcagtaaagcacatgagtaaatttctctcaggctctctttgtgggtacctactcaagagacaaatagtagcatcattgtgtcctttactgtcactttataggtggagaaaaggtgacaggagtatttgctgatttggtgaatactcttattgacacatttatatatattctctatcctcccaacagtgctacaagtaaacttatgatattttgttgacaagaaaagaaaggctaataaatgaacataacttgccaaatgtcacatggttagtaactgatggagcgaaaatgtgaatttgggctttattttcagagctctttgtgtcattccatgctaacatatatttattctcattttgcctgctctgaaacaacaccgcagagatgaataagcaaggtctttgttctctagaaatgcagccagaaagaaaagacaagcaaaaaataataataaattacaggaagttttatttcataaatagagtttgtttccacctgcttctgaaaaattacaacagtttcagaaatcaagaaaaatataaaaatttgaaactcaaaatagaaacaagctctaaagaattttcaaaagtataaagacttttgggattaattagttactctagatgagtaaacttaactagaaattaataagtaattatagtttagagttgtcattacttgttgatagacagcatagacatttcttaagacagaacattttttcaggcttcaaatttaaagagaaacttattgtgtatggtaattatttgaataacaaatggtaacatgaataacaaatggtaacaaatggtaacaatgtcctaacctaggggtctgtaaaagacagaaatgttcaaatagacatttcttyattgaccctcaataaaacctgaagttacattaaatttcaacttagtgaaggctctttagcacggatttgtggtartaatatgacctggaaatgttactttctgatgatctagctaatcacaaaaaaaaacactgacaaccataggggaataagtgcattaagttgtctctgcaatatttgatgtcttaaggaagctttggtcaagccctgggtcacaggcaattcgtggttgagttttctagcaacattcagtgttttttaaaaagtgatctatactctttctatgtatatattcatacattgtgtagacattgagcacctactatgttggggggggtgtgcatgcatgcgcttacgtggtatttctttctttctttctttttttttttttttgagatggagtctcgctctgttgcccaggctggagtgcagtggcatgatctcggctcactgcaagctccgcctcccggggtcatgccattctcctgcctcagtctcccgagtagctgggactacaggcgcccaccaccacgcccagctaattttttaaaaatatttttagtagagacggggtttcaccgtgttagccaggatgatctcgatctcctgacctcgtgatccgcccaccttggcctcccaaagtgctgggattacaggcgtaagccaccgcgcctggccgcgcacatggtatttcttatcactgactacaaaattgactttgtctcatgcaagttttaggaccctcacttatacttccaaccagctgtagagttcaagtctattcctcttcaacacagagataaattatgtatatgctagcctcaggctctcattcacataacatggaatgaatatgattgaaaaacgtgtaagaaaggtttgtttcagtcaataacactgaattaggcaatttaggctaggttatgctgtggtaacaaacagctaccaattctcagtgactcaacacaacaaaagtttaaatttcacttgcgtttaagtttaatacaggttggtagggagcttttctctacatttttacacatggaccagggattatgtactttctggaatctcactaatgaggcctccatcatttatgtacaaggaaagggaagaatagaaaggttgctcactggacaataaataccttccaggagggaaattctactacacgtaagttgcttagcctagtgtccagcatgtagcaggtgctcattaaatatttgtgattattattattaataatagtcgtagtagtcatggcagtagtcatggaattagctaatattggataaatgttaaatttaccctaaagtgatattattcactgatatatttcatctaattgttgtaagagttatttcaaattatgtgtaaagaaaaaaggtaagaaaatgccgtgcctttagtaagctcatttctctatttattatgaaactgtttttttgtccattcctgttttagcagcaacacgtggcataggctttgaggaagaataatgttctctgcttctgtaccaagattagagtttgtttcagatatagctgatgagtaatggatgaattgtacaaaaaaaaamaaacaaacaaaagacttaggctgtcattaactgtattcagcacaagggaaaagctcttcagaaggatggttggactttaatctacttgttcctaatacaaatggagacatttagccctgagatttcaacaatggacatagagacatttttatttgctattagagtgtttatataaggttacatgtcagaaatattcaattactgtacagaatagaactttaactacctagaaattcaaagaagtcatttttttggcaagattaacacttctagtagcaaggacttttaagatgtagggcagggtacaacagcccattatatttacagaaatgtttaggagcagtacagaattaataaatgttttggacaatagatgccaaagatttgcaggaaataaagtactttcatttgaatagcctaaagaatttcacagaaaatttgcactaaataataaagaattagaatttggttagatggagagagaaaatgtctatgtaactgacctgaaaatataaatgttctaagaatgcaaggtgatgtttttaataataaattttaaaagatttgtttaaattaggaagtagtgtaagtagagatccagataataactaacgctttgctagcatatgcttgtatatttgagagtgtgattgagtgagagagagagaaacagagacagagacagagagattcagtgatataactaggtttcatcatgctaaaaaagtttgtaattttatttaaagctaaaagaatgaagggtggaatatgtgtgtgtgcatgtcagtttggtttacatttgtaaactatatatgtaatatatgcatatgcctgtatagtacatgaaaatgagtgcttattaatgctaggcactgttctaaatatttaaaatgcattgacattttttatacttaccaaaaaatcctccatggaatagctattattattacaatcttatagatatgaaaattgcaacttaaagaggtctaacaactatccaaggtcacaaagctattaagaggcagagccatatcttaaacccagttccctcattctaaagtatgtacatttaatgttaagttgcccagcagaggggcatggaagctttagtgaaaatgtaaaattgagcagatccagggttcctatctttccctttgagcagatgaaacactcttttaggacagggttcttattcttcatttctgtgagtattacggtaagagtaatggtaaccacaatgacaactaacatttattgagctctaaataatgaccagaagtggttttacatcccttaaatatgttatttaaatcttcaaaccaatgaagaaggtcccattattattctgattttatagatgacagactaaggctcagagagctaaggtacaaggaagaaaaagagcctcttttctcctcattccccagttccatcctgcatctcccttttatccaagatgggctctggcatgcccaacactcagcaatagtgcttttgggtcagagatgaaatctgtctatttctataaatgctgtccaacattctcaatgtattattctgaaatagacaaccctagtacaccagaatcatcttcatggtccctcaccctcactctttccttgggcaggacttaaagcacagcatytttagagttcagaaccattgctcctataattcgtgaagtatcaatcaagtttgtccaaagaaaggacattatcctaaggcatttctgcagataggcagtcattaacgtaaaattaaaactaacatgctgatgcatgtgtcatcgccagactgcttaaaggcaccactgattatatattgtcataacaaattccaaccatttttcacaattgagccaaccatagcctttgaactcttggtaacttttatgctcatgtcttctctccctctcactatatatatatatayayacacacacacacacacatttatagaagaggtatttgcctacatataaaaatgcatacatatataaattagttgttctaaacaaggtaaatttgtgcctggtttttcaacctgaagattaaatataataatattagaatagctaacttgctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtctcttttgtgttttaagcaattactggagtctatgaaacaagcctcccctttgtaccatttaatttaattagacctctcatttgagctcttgctgagtcaatatttagttccttgtctatatccctggaacaacctgaaacattccatatgccagctaaatggcttaatatgcatggacatatgagtgaatgctttggtttcccttctctctccctgcacaatgtacacgggatgcggctacaaaactcctccactttgccttcccccttaattatgctcatccatggttcatgcagtaattcttttttctggaagataaattatgctggaatagaaggaagagcaatcttcagtgttgtctcactaattttgtttgtatagctgtttttccaatgtagcattttcgaatagccccattatacatctgcttctccacctgggaacactagccatgccaggtgcaatgccatggatggcataattttgcctaatggcattaagtgcctcggagtatgctaaaagaaagggaaaagtgacaaacgagctccagggaaactgtagtttgtttctctttgagggatctgtgcaaatattgggactatttgtggtttgttttgggaagggtgatttgaaagccgagaaaaattgtctgctaattcatacaagaggacttaagaatcytcctttgccaacytttcagactttaaaggctttctcaagaagaaaggattttgctttagcaacaattcctagggacatttatagaagaggtatttgcctacatataaaaatgcatacatacataaattagttgttctaaaaaaggtaaatttgttcctggttttccaacttgaagattaaatataataatataagaatagctggcttgctaaatcaatatctgtaaggtgctatgttttatatacaacatctcctttagttgttacttacctaatgtgtagatacttttatctccattttacaaatgatggggctatgtctcatgaaaggttaataatttgctcatgttcacatacctattctaagataaaactgggggaagattgcactgcttactgactccaaagctcacccatacactttgtaaagaggttcctgccctaaagatgaaattgaatcataaagtagtgacctgtggtggctgaacccttcagggttcccatcttgtctgtgtccatgggtccacaagccagagtaaatggaaatattgacagaaagatttgtgtccacgccctaccattcaccctgctagttgcatgcagcgaataggtttgatgtaatgtcattgaggattttgtttgtcctatgtcacttcataaaataatattacttcttttagagaatcctagcagtaatatttgaggttatatgtacagttgtgctttgtatagatcctctgtgtaaaactatcatcccagcatctgratcacaatgcatattaaaaacgacataactacactttgggaggctgaggtgggtggatcacgaggtcaggagatcgagaccatcctggctaacatggtgaaactccgtctctactaaaaatacaaaaaaattagccaggcacggtggtgggcgcctgtagtcccagctacttgggaagctgaggcagaaggatggcgtgagcccaggaggcggagcttgcagtgagccgagatcacgccactgctctccagcctgggccacagagcgagactccgtctcaaaaaaaaaaaaagaaaaagaaaaaaagacataactattatcaacagaagcaacaataacaaaaattaatccttactagcgcttgttatataycggaaaatgttttaagttctttatatattttactttatttaatctttataataattgtagcaatctctgttgttttaccacaactttgcaaattaaaacctgaggcaaaacttgagtaactggtccgtgaggtactaccatgagtatgttgtggaatccagatttaaatctaggtttttttattccagagcctgtactcctaaccagagcattttactgtctcacaaacgtaaagattctttaagtataaataaatgactgattttagcttagcaatacaaaatttgtctatgctaaatattttttcagttcttattctcttacccaaagcccatttctcacttctccttgcaagaagttcaggtcagaagatatattgataaagagaaagaaaagaggcaatgaaaataaatttgtatgtgctaatggatgcttcttttgttgttgttgttgttgtttttgagagggagtttctgtctgtcaccagactggagtgcagtggcacgatcttgactcactgcaacctctgcctcctgggttcaagcgattctcctgcctcagcctcccgagtagttgggacactataggcacctgccaccacacctggctaatttttgtatttttagtagagacagggtttcaccatgttggccaggatggtctcgatctcttgacttcttgatctgcccatctcagcctcctggatgcttccttctgttttaattcctctgccattggcaatctacttgcaatcattcccaagttctaatgcatctccaactgctccccacatcacaagagagcctaccttgcatccaaccctaaatgttattttaatgatttttaaataaacctgctttaatgaaacatgaacagataagtatagagttcttctctgaaatctagtaaaatgtactcctttgagtaaacacccttgtgaaacatatattttaaatataccatttcagtaagcaaacaaaaaaccaaaacaggtgacgagggcttggggcaggcaattatataaggtgaacattctctgttaaaatggagtgagccagaaacaccagttctagaaataagacatacacaagggttaattcttttcaaaatgctgcttttaccccatttttttttctccccattgttgcaaattgtaaacatctttaaaagatttcaggactctttgtgtttggttaagkttccaacaggtggaagatatcttccaagactgaccatagtcatatttgggaaggaaagatcagaatcaatttaatcaagatactaaatatgaaatgggggagggagcagtcagtggaactaaccagagtaacattctgaacttggaactgaatccagagtttatacttgcacaaatcctggcctccttccccatacaaacccctagtacaggtctttgagattgtttctagcaaactgaatttttcttccttagcctggggggaaaatgcagactctggctttattttctgcatgggaatcacgtgggtagcttaaatattccaggcatcttgacttggcatattgaacrcattttcttattccataagctgttctacatgtcgttagagtgacagcagtgagtagtaaaataagcactggctttggagtcaggtagacctggattcttagtagaccctggacttcaagagtcagtattgcaccatgggtaagaacatggaccatggacccagactgcctggctgcagatcctgctcttgttacaaaatatgtgactatggatctttgtgcttcatctgtaaaatgaggataatagtaagacctacagtacagacttctgatggcaaatgatttaaatatatctaaagctatttaacaatgcctagcacataataagcactgcttactgtgcatttgaactatgtaaatattggcttgcaaggtttgacaagatttgtggtcttggaaaggataagtaatcttctttttcttatctatatccataagatttgtttggtttattttcaggattaaatgtgataatggatataatacttttggcatggtcaagaatcagtaaatactaattattattgtggcattctggattactgtgacttaaatacttcacatgaaacatgagttaaacaagaagggttcaatgaacaggctgagaaagcatatcaccatctgaaatatcattttcttttgtgaatggcattgcaagtttcacaaactgatttttgaacaggatataatcccaaaatttaactgggaatctgaaaatccctcaactgcttagagtataattttttaaatcagaaaaaaaaattgtttcactgcagggataaaggcctatgcatctcaattctgtttttgctaaaaccacatgtgtgtaatcacaggtctctaagtaaaatgaactcacatactttctgaataaatattttactacttttccatttgtaccaaatatcatctagtctctgctcagtgatatgaaagagtcagtatatgttgaacaacataatctataataacatcagagtgaatagtggccattaatataaaaaacacataataaagtgatatgttttkcctgttttctgttatgttggagtaagtgtgagagcagaacatgcctgtagtttatagattaacaatgttttaaactaatctggggctagaggtcatcaaatgtccctcaataactatctgccaaattcccaactgttatgaaacaatattgactagtactttaaaatttcttgtggcttagaagtacaagaggtaagtacattccacattgaagagtacagatcatgtggatttttgcaacacaatgactgtttagggccttcctttcttacagattcagaaatgctctttatgtgttaaggtaaatattgggttctagaaaattgaaataaattattattagattggtttgggttgggatattcaactaattccttgctttttcagttggaaggtgctcaaatacattgatttgattaagagaaatccattgctcaattccatttgacttattttgtcataaataatatacagttcccttccaggatatttcatattatcctctttattaatcaagaataaaagttttggtgttcaggttactttttcccaaaataccaccacactgcattttattataaataatcttgctaatgccaaaagtaacctatcattatataattcatcaaataatcatacaaattatttatattataaaaactgcagtacaataatagtagtttgagcgcataatgtacgtaagttggtaatgtttttcttgctcattgagagtttagaagagttaccaaagagaggctagtgataggttataggacagactcaaaaaattacactaagctaggatgtacttagtttatagaaagtgtcaaggataggagaaaatattaatataggaatgtgtcccccaaatctgcattaaatcaagagaatattcattatgtatgggtaggaaaacagtttgcatgtatcaaggaactaaacataagaatttaaagacagaaatctagtcactgatataatctgtcatgattttaaagggtctgtggaggacctagaggaaaaagtagcagttattaatcttaaaattgtagaactggttgggactttataagtcattcagtccaacctgcatactgcacaaagaaatttgagctcagaaacattaagtaactaggaaaaaattattcggtagccaaaatgtacattgaatatttagtctcaatttacagctgaaaagctctttctaggcagggcgcggtggcttacgcctgtaatcccagcactttgagaggccgaggcgagcggatcacgaggtcaggagatggagaccatcctggctaacacgatgaaaccccgtctctactacaaaatacaaaaaaaattagccaggcatggtagcgggcacctgtagtcccagctacttgggaggctgaggcaggagaatggcrtgaacccgggaggcggagcttgcagtgagccgagatcgcgccactgcattccagcctgggcgacagagcgagactccgtctaamaagaaaagaaaaaagagaaaaaaaaaaaggaaaactctttctactagtctatgctgtcttccagttacttgacagctgtgttagtgggcctatttgatcccttatcattcagagcacaattataagggatcgaataggctcactaacacacaccgttggtaaggagaataactcaatgctaaactgttatgccacctgccaaagatgccttataggcttctgtctttggccaagattggtttcatattctggagtgagatagaactcaaaggtgtggataaattggcacagccacaaaggttaactaaattcagggctgggatccaggaagaacattagatgaaagtctttggaaagttcatagatgagaaaggttataaatcagacttccttctgtcaagcctcttccaaccccttaaagtccccagtcatctcactatatacttattttcaatagtgtcaaggttatagatgtgacaaattgattcttgacatgagtcatttttttttgtcatctttctgacagaagagagagaatttaaattctgctaaggagagcagaaataattatgcgttatttccctggtatcattaggttaaattcagacaatcctgtagctttggtttcagatggtttacgaagcacrtttaagtatcaaaatcaggaaagtgaaacaaagcattaagattctagtatcaacggaatcaaatactccaggatacaatatctacctaattctgagggcaattcattttctaaacttgctccagaaataactgtttcccctcagcttcaacataytcattgagatggcccctgatcattgctttccttcaaaatctttgcaggatatttgaatcagcagcctccctctttttaatgttcttagttcttatcaaagacaacatcagaakaactaatacatggtttttgtttgttttttgagtttttttggatataggacagggcagtccatctgaacctgttttgattaaggtagcattcttctctcactccttcctttgcttactctggcatgccaaacctgcttgcaaagtgtcatgatctattagattcacagaatcaaagaaaaaaatagtcatttctccagaatcttttaaaaaatgtaatcactacttaaatgtgagccaacaatcaagtacaattagagtttttcttatcctacatcttttgttttatattcattttcctagtgaagatcagggcaagacaatagcagttcactttggtaagtgctataataggagtacagtgtatgggcaaaatacaacagggtgcacaaagaaactggtcatgatcactacttgaaagaggagaatggtgttggggatatcatcaccatctccctggaaaatgacttagataatcaagctgagtcttaaagaacagtgtgaattcaagaaagaaactcttggaagaaaggcaaacatctactcatggaagcatgactttcatttcatactgtgagaaagaaacggtgagtaagttgtattggtggaaaataagattggcaaaatcatagtttgagactataacatgctcaatactctgaacttattctatggttactattgctgcttgaagtttgtaaaacaggaaagtaattatccaaatcatattttagaaagataatcctggataaattaaagaaagggaaacaactctatgagaccaatgggaggctatttcaatggttcatgtaaaaaggacattgatttgcattaattaggcagatgtaaagtcaaagaagggggtttacatttaagagctttaggagatacaataaatacattgtggtgactatgagtggaataggcacagatttggaggctactgtaatagtacttaaaagtttatatatagtgcatactatgtggcagactataacaaatgtttatatttatataatatatatagttatataacttatgtaattgtcatgtcaacaagtttattaggtagatatgattattgtgcctgtttttaatatatgtatgtgccagacactattacaaatgtttaaataaatatataaccgtataatttatgtaattgtcatgtctacttcattaggtagatatgattattatgcctgtttttcagatgggaaaactgaggcccagaaaagttaaataaatcatccatggtcacttgtttaataagtgacagagaaaagttttcaacatagactatttgcttctgaagtctgtgtttttaatcacttttaatcattatgctacactgctggggagaaagtttggcttgcatttgagatccttatagcacatctaagtgtaaatttccaaaaggcaattggaaatatgataataatggaacccaaatgtcagagctgaagatgtggawttcttcagcgtatgaatgttcattggagttgtagacactgtccaacaaataatgtataattttattggcccaaatgagagtaatagggacttcaagacagcttgatgccatcaagagtctacttctagaccccttttatagcgttaatacaaagcaacaactactgtattatttcataaatatatttggtttcatggttgtttatatattcaaaacaattatttgactgtggtacttgcaaattcatagaactcttttgcacctaactacattaataccagatactaaaagttaacttaagaaaataaagaatcctaatcaacatttatctattattaaatttggatttgaagaacttgcgcagtctgtcttctaagtccaattgtaaactccctaaccaaagctttactgttgttacaagacaactggagttagtcatttgtcttccctggtagcattttgaacaataaattgaaaagcctgaaaccaagatacatcaggtatctgaacaaagaagcaagattgatacttttctttccatgctgttgcaaaaacctcactatctaaactcttgactgtctattccacagaccatctcacttctttatcagttccaataaaatatgcattcataaacgctgccctatagcttggtcatatcattatccataaaagttcacccactgaaaatacccctagccttctatactcagtgcaaaagcctttccataagctagaatgcatgttgtgcttgataaaaacataaaatattatctgtcaatttaaaaaattaacaaagaaataaagaagaaaaattacacacacacacttagaaaatgaatgttctccgtgaccctaagatacacaaccatttcgctgaacccaaaggacaaaataattaaaagctataaaacattagcattcaccacattttctcatcatttaaactgcattgtctgcatcacttctagagcaggttttccttaactggaacattttcaataagatttctgtaaaaataaaaaccagtcttttcaaatcaccaaaactctagcacaggacaagttgcctctgtcaccgtttctgcttaattcaaataaatcaaggcataataaccagatattttaaaagagaacaaaacagaagcatggcatgattataagcagaacgataagattaaaaaaaaccaagttagtgcaaattatctccatgacattggcagatccatctctgaaaatcttgaaataataggagcctacgaaaacacattttagcatcttcttgcaaaacaaattctttattcttcctttgaatggtagatttttcaaaagattgaagatacgttgaaatatagtttcttaggacaacggactactgttgtagccaaaaattttctagagcttagcaatccaagtgttatacatatcatgttatatgaacaggaataactcaaattgcactggcttgtacatgtcttatcatttcagctgctcatgggagtgaataggggacagtcatatggacacactgggcactgctacttctttgcttggctgactcctcactcagtgttactgtgtttctcttaggctatgagattttgagttctgcactactaagccccagtattttctctaaaaggctacagagctccctaaaatcaatggccatcttatatcggtcctcaatcaatgattacctaggatgaaaactctgacctcctggtgcccaagatcttttacttattaaaggggctttcctttggttcctccatgcagccattctctcagtgtgtcatcctccttttttgattgacctctctgcccatatttttgtatttctttctgagggaattgttaaacaatatctcaataccatgttgatttgatccatacctacaaacactgtttttattgaagtaacaaaaactttgcttcaaaactctggattttaaagatcaaaatagatgtgagtggggtgagtgtgattccatcgataaaataataatttagaattcaaattatgaaggcaggatcaactagttgtrgatgagcaacagcaaatggactagtcatgcttaagtaaagttatgacctgggagttagataagccagtgctacaccgagtgcccacagcatgaatatccagagcaaggagagtctgcatatttttgaacatgggtgtgatgtgaagcaactagtgctggagagaaacagctgcagctgaagttaccaagatggttagaatgtggaacctcatctaagagactgattacgttgtcttcatctgaactattttaggctggaaatagagaaatgaaaatgggatttggaaaaggagtacttttaattgcaagtaacaaatcttattatcaatgacttaaatcataacaagaagtccagattatggttattacaaagtttaataatgtcattaaacctagattatttaacatttccttctatcatcatttgtttcttactgttatgtgtttcctcataatttcaatatggatacagcagctctaaatttcatgtttttacaccatcacttaagaagtaagagactgagcattctctttatatgacatgcaaaaaagaatctgtgccagaaccactccagcagatttcctcctacccagctggtcgggactgggtcacatgaaacacctctagaccaatcagttgtaaaaggtcaggtctggtttaattgcctgaataaaatcaggttatcattatcaaggaaaaatgggcaaatagtgtctgccacagaagacattgtggaagatgaatgaaaatgaattgaaaacttattaaatgggtaagacaggttattaaaaatactttagaccttgaatctgggatcttagaacatggccatttttttttacactggtgttatgaggaagatcttaaaggcaattaatctgtttagtcctaatctctagttcctggagaagacaatctcaaatgtttacttttcgtttttttgctatgatgcacattcacatgcagaacacatttcttatgagtaggcccatttcactgaacactgtcttaataaggtgggcttctaagcttgattcctaggaaactagctttagcccttcccctttctttcctgctccaggaagtatatcagaatgcaagtgagtaaaagggcataattagagggataaccttgaagccactccaatttgtgagaaaacagtaaatcattttctaatttcaatatttgaactattrttattactatcaaattatggctcttgtgagacatgtcacaaataattgaaatgcaccaatgtgtctggacccctaggttaaaagctttcttctagaggacaaccctcttctttctttgtgaccattgtgctattatcattatattgttgtattttttttatctatggatattcaaattgaacagttagatttaaaagagaagacaaaacccagggaatctaaagtggaaagcgcatacatacacgcaccattcagtctattattaggcatatagcattcaaaaattggggtcagttcatatgaggattgcccagaaattcaagcagtttttaatcacaaaagtcaatcttccccttgaaatggtgcaattaaggtgcagtagaatgagcgagcaatcacatttggcacatgtttctggaggacaagagaagctggggagcaccattcagaaaaaccaagtggggacaaagttcaatgatgaaggatttttaaaaaattttaaaaagactcccaaactagagaggaagaatatcttagtgcaaagtattcagaggtagaataagaagactgtgttgggagaccttagccaggacaaaacagtcccaattaagagatcttttcaatgagctacaaaatatttccttttctcaaaaaagtagcagcacaagatggttgagagaatgagggctttggagttacggcgatttggaattaatcccaagtttacctcttactatctgtgttaccttgggcaaggcactgaaattatctgagtcatagttcttagataccttatctaataagtgggaaaaataatacctacatcacaaggctgttactaggattatagataatattttaaagcatatggtcttgacacaagtttacaaaatgggagccattattacaaattcagctttgtgcattctttcagtttttgcaataacaattgataaaggagtgttattgttgttttcaaaaccttgacaatcatagtaatgacaatgaaacaggatatatacatcccattctgctatatcattaatctggatcctcacgttctgtccttctgacaaccctataaggtagatgtcgttggttttccatttaacagaggagaaaacagactcagagagagaaagaatttgtttgaatttgtgtagtttacctccagagtccctattcttaacccctcagctctacttccctcctcccttcagcttacacacaccctctcacctacatggtcatccacgtaaccttgagaactttattctttgaatttacacaaagacmaacatcacagtgattaaaaaccacacatggcttcttgcttctcctggttgctgaattccaatgcctggggattagtttagatgcctactgctttcaggttggggattgctgccaataaaatttcctgtttcctaagcagctgggaagccaacaaccagctgctctgaaatgtgtttgaacctcgtcctctcagctaggagacagctgtgctgatctatagaaagactctggaagattgtttgtgttttataagacactctaggcaggaagagagagacttctgatttgaagagagactaaattcaggaacagaactctttaatatttcccgatcacagacacttctccaacctctgatattcacttaggtacagagtgtgtgagtctcaaataaatagaagacagtcactttaattgttttcctcagggtgcatttttacacctgacatattctatgcctcacatctgagataacaaccttgttgctccaggcatctctggaataatttccaaagcaccgtactgtcttgttatctgcttccctttacttccagtgtgttgatgaagcaataatggtatgagttaatgctgctgctgcttaacctatgtttaaacaactgacatagtacatattgtaawgtttgtagttcctagcaggcaaggcgctatggcagtgcccacatctaccagttaaatgagactacgagaaagatatgtatttcaaaagcacacaagagccctgaaaactggtacctttatcattgattttgttgttgcaattgtctaaagctagtcatcttttcagtatagctctcactttatagataattgtgaaagtcagctattaatttagtaatagagccaatgacatagtttatagggtcaagttaaaccatggttgaatcttcaaagaccctgaaaaatctgggtcatgaaggaaattttcaacatgtggcaaaacttcagctgtatttcaaaaaaatagagaagctgatgttttatttaaaaatcagaaaaccatattctttatataaacatgtacagtatatatacttatgtgtataagtattaatttacaattaatctatgcatcccattgctcttgcagcctctattttcccaacaaaatactggaatttgtatagagatgaataggcatatttgacagcatcttaaggatcaagaatatgtaaaagggctgagagctaaagcccatccctctatcatattttttttctagtgatggaggtagagaagatgacatttatacaaaatgttgattttgtacaaacatttctttgaatgagagtatgaatgtgtgaactttattttttaagcatactcaatattataatcacagaaataaaaaaattaactactatgagattttaagaatgaaatcacgacatactaaaaatgaggggatatgcatgctcaggctaaaaatccatkttgctagtcatggttacttttactctcagaacattttcctagtcaagatgttttgactacttactgattttcagctagagttaaccaatgggagaaaattgacagactgctgacaagcaatcatttatttgtgttagtttatctacttggcatgggttcatcttctccatttccttcagcaccaggatggtaacaacttgggctgatggtgaagtgagggttgctttacatttggcttcttagtttttccgttgcctatataattaatttcttgtgttaaattccatgtttgaagcacctacagtagtttctgttttttttttttttttttttttttttttttactgagctctgactgatacactcaccaaaaggattgtgattaaccgagctgacctcacactattttgaaaagtgtgtgaagtgtgtgtacatacttatgtgtgtgtaagtacaggtgtgtgcacatgcatgtgcacacaaatgtgttgtggataatgggaaagagtcacagtacctgccccttcacctctaattgtcaagaaatgttcttgtgctgtttctggattttcaaccgtgggtagaatttgtcctaagctttattccaccaaaatcctcaaatttggtgtaatattattttccagttcaccttataaacttataaaagctatagctttggccaggcacggtggctcacacctgtatcctaacactttgggaggccaaggcaggcagatcacaaggtcaggaatttgagaccagcctgaccaatatggtgaaaccctgtctgtactaaaaatacaaaaattagcagggcgtggtggcgggtgcctgtagtcccagctactagggaggctgagacaggagaatggcgtgaacccggaaggtggaggttgcagtgagccgagattgcgccactgtactccagcctaggtgacagagggagactctgtctccaaaaaaaaaaaaaagaaagaaagaaaagctatagcttcatttatgtgcatgggtatgtgtatacacaaatctaagattagctgttatcacattaaatcttaataaacaatactgaaatgtatttgtattgtaattatgctgaaaggaaactgagtccaagatatgctaattgatttctccccaggctttgtatttagaatgtggcagagttgggactcaaacacaggttgtcgactataaaactgatgttttgttcttgggccaataagacatatttctcaagaagttagtttttaataaatgtccaacaatgatagactggattaagaaaatgtggcacatatacaccatggaaaactatgcagacacaaaaaatgatgagttcatgtcctttgcagggacatggatgaagctagaaaccatcattctcagtaaactatcgcaaggacaaaaaaccaaacaccacatgttctcactcataggagagaattgaacaatgagaacacatggacacaggaaggggaacatcacacactggggcctgttgtgggtgaggggaggggggagggatagcatttrgagatatacctaatgttaaatgacgagttgctgggttcagcacaccaacatagcacatgtatacatatgtaactaacctgcacgttgtgcacatgtaccctaaaactttaaagtataataaaaaaaagagaaataataatctaaaagtgggaatttgggactttggaactttctgacaagcatgacttccaacagatttgcattctgagttttaaacataaataatgagaaacattatttgatcaagggtttttgtgccatgtttagaggccagaaacctcctggtagatggagtgagggtatgaaatgtctggaaaatattaacagtttgtgcagaatacaagagaataattgaattcatgtctgcctttgacagtattttgcatgtggtttctgcacttaataattctacaatttatataagaaatatttccagtaacttattcatatgccagatatctcctgtagactgtgtcaagtaataaaagggtaaaaaagaacattgtctccacctacatggatcatattgccttctgatgaatctaatgttaaatgaagtatagatttctataagaacataaaaaagaggatccaatctagtcttagtattgtggaactcttccctgagaaagtgatgttagcgtcatagtatgatgctggtataaagatagacatagaaatgaagcagaaatagagccaaacatawatgatcaatttatttttgacagcaattmcaagattatttaaaaagaaaagaaaatcattttgactaaatgatgcttgaacaatatctgtatatgaaaaaaatgtactgcacattactccatatacaaaaattaatacaaagtaagcataatcataaacataaatctctaacttcaaatatctggaagaaagcataaaggaaaatctgtttaacattgtagtagccattttttgctaggacaaaaattattaaccatagaagatgaataaaacaaaacagtgacatttctctttatgctcatcaaaattcctaaaatgtaaaaagaatcaaaatatcaaaataccaagtgtgactgaggatgcagaataactataatgctcatacattgctggtggaattcaaaatggtaaaataactttggtcaacagtttgttaatttcttatgaagttagaaacatacttaacaacagaacatagtttttcttctagttatttacccaagagaaataaaaacatacaatacaaaatagttgtacaataatgccataacaactttatttattatagcaaatgaaataaacaaaccaaatgccagtcacaaagataatgaattaacaaattgcagtatatgtataaaatgtartacttctcagcaataaataaaataaactactggtacatgcagcaacatacgtgaagcttacacatgtaatgccatgtgaaacatcacacaaaaaattacataccatagaattccatttatatacaactatagaaaatatacatctaatctgtggtgctctatagcagatctgtggatgcctgatacctggggtgggaaggatcttgactgataataggcttaaggaaaccagttgwcataaatagaacactgatgtaacaatactagaattcacattcctttctagtgtacctaaagcatatgatatttgattatacgtcataaacaaagcatccacaaatataaaatgttttaaatcattcagagcttattctttaatcacaatagtattttaggttagaaatcaatagtaaaaggaagactagtaagtcctcatttactagaaaaatttttaaagactcgtttaatacgtgagttaactaaaaaatcagtgaaaacatattgaaatcattctccctgagttagagtatgattcaaaaataccttgtatgctcacttgtatactggcatttctgtctagtggaataatacagaacaaaaattaaaaaaaatgaaaaagtaaagatacaactgtctttattcatagatgatatgctttcatacatagaaaatctaaaagactatagaaaaatatataaggattattaaaaattgaattgaacaatgtctgtatgtgcaagtcaaagctgtaaccataggagaatatgctgagcttcattagtaattaatgagatgccaattaaacctcaatataatatctctacatacttgcaaaaatgcctaatgtgaaaaatatgggaaaaaaaatgtagatgaagatgtgtgacaattggaagactcaagcctgtaatcccagcactttgggaggccaaggcaggcggatcacctaaggttgggagttcaagacgagcctgaccaacatggagaaaccctgtctctactaaaaatacaaaattagccaggtgtggtggcacatgcctgtaatcccagctacttggwaggctgaggcaggagaatcgcttgaacccgggaggcagaggttgcagtgagccaaaattgaaccattgcactccagcctgggcaacaagagtgaaactccatctcaaaaaaaaaaaaaaaaattggaacactcatatattgttgctagaaatataaatttgcagaagcactttggaaatccctggaattatccaataaaactgaatatatgcattttcataattccacagtggcactctcaggtacatacttgataaaattgtatacatttgttcaccaaaagacacatactagaatattcataagttcctatttattttatatttatatattttaagtagctccaaactacctaaaagcctattaatagtagaatggataaactgtgatatttatatgtaattaagcattcaagaatgagaaataattgatcttataaatgtgatttgattgaaagaaaacagttatgcaggttaccaattgaaaaatttcacayatatgttatatatttaacatgtatgtaatctattatatatttagtatctattatatattatataatacatctagcatacattacatattaatatataagatgtctgattatatatcctatcacatatttgatatatatgtgtcattttatatattatgtgtatacatacatatatataaaggggaagcatttatatgaaaggaatcagatggcttaagaagtgataagtgaggaaaatagttttagggataatagataaccttttaataagtctggctatgttttaagatatggttttataaacacttatatactacagtgaaaaagtcagtagaaaggaatagaataaagatatattacaagaagagccaagtgcagtgacttatgcctgtaatcccagcactttgggaggccaaggaaggcggatgacctgaggtcaggagttggggactgacctagccaatatggtgaaaacccgtctctactaaaaacagaaaaattagccaggcatggtggcatgcacctgtaatgccagctacttggggagctgaggcatgagaattgcttgaactcaggaggtggaagttgcagtaagctgagatcacaccaatgcactccagtctggacaacagagcgagaccccttctcaaaaaaaagaaaagatatattagaagaaagaagttattaaatgtgcaaagtctgcaagaaggtagagaggaagagaaccagataattttcattttaatagaaatggataagaatgaaagatagaagttggggacagtttcatttttactgtttcgattttattgttgttgtctgtttgcttatttcatatttgttgtaagtgaagtaatctgcagaacaagtgggaatatgaggggctagaggtttgatgaaagtggaagtttagactagtgtttgggtagaatggatacaagaattagctaaaaacacacagatgcattttctgttagtttcaggttggggaccattaatttatctagaaactaatttgttcagtgagggtgttgtggtttggctttgtgtccctacccaaaactcatcttgaattgtagtaatccccatgtgtcatgggagggacccagtgggaggtaattgaatcatggggcaggtttttcccatgatgttctcatgatggtgaataagtctcacaggatctgatggttttataacagggcagttcctctgcacacactctcttgyctgccaccatgtaagacatgactttgttccttcttgccttgattgccatgtaagacatgattgtgaggcctccctagccctgtgaaactgtgagtcaattaaacctctttccttwwtaaattacccagtctcaggtatgtctttattagcagcgtgagaacaaactaatacaaggggattctctaaaaatggtagacagtcacctgttggctcagtgttagggaaatggataattttgttctgcaagacatctgtagtagagagagaagtgagctaagaaatattaaatattgccaaatattatcaaaatggtagaatgatcgagattgaaagagttgaaaattataggtacgtgraaatatctgtggtctggaagctctgcatgggttgtaaaactaatgtcatttggtcttttagtttcacgcagcctagttgttccttgcttatggtcaagaaagacataagtgtaggatcaaggatggaggctggtgctttgttactcttagctcatagatcctgaagcataatcaagatgcagggtttaatattattatacagcccgctatggagagggcagatctcagtgtcctgattgatggtgctgagaagaggaagctaaggttgaaacactggtgttgagagaaccatgccatacctaacccactcttgctggctctacatgggaaagaatatactaatttttctgaatctgtttaattagggctgtaatattttggaaaattggttcttcagctaagcatttgccttaagtcaacatggttgaaggatagctaaatattaggattattaccaatatgtatatttttataataggtcattttaaataaaagtaaaaggaattctgagtagccacctgaattggcattgtttgtgattatttctttttacgggatataaaatgtttctggcctagagtatctccttcagaaaaaaattagctttaggaaaaaaagcatcttatagatgctttttgacaggacaagattataactgaataaatgtcatatttccttttatgtatggccctttctgtagtgttacatttacttttcttttagttatttcatgcattgatttctcccctttcaacttaagttgttgtcttttgttgtcacattctaacggaacattgacaaaggacaaatctactgtgccaattatatcagtggcccattggaatgattcttcatatccaaagaatgaactaccttctcaatttaattagaagcttgacaatttcaatttggagatgcaacaccactttgcctggatttaacaaagctccttatctgatttgcctgtgaagccaccctggctgtttagcatttttgaatgcatctgaaaagggagaatgctctcaatgccaaccgttcttttaaaaatctgttcagaaacaaaagaatgtattaagccagtattgggataaaattagctcttaaaagagacattcagagtagatcataaaaacattgaataagttaatgcattttggttacagaaaatatatttaagcatttactgtggcataaaactactaccattaggtcaatcttgaggtgcaaatggcacctataagttaaaaagactacaaatatccttaagtctttttagaaatagtttatgctgtcagttgtaatctgccattacatatacatatgccctttgacattgcctatgctaacttcatttccaaatagtttaactgattacttttgatatggttaggctttgtgtccccacccaaatctcatcttcaattgtaatccccaagtgtgagggagcgacctgtaattccccacatattgagggagggaggtgactggatcatggaggcagtttcccccatgctgttctcgtgatagtgagttctcatgagatcgatggttttataaggcagttttccctgcttttgtttgctgtctctctcctgttgccatgtaagatgtgtctgcttccccttctgccatgattgtaagtttcctgaggcctccctgccagacatgcagaactgtgagtcaattaaacctctttcctttataaataacccagtctcgggtagtatctttrtagtagtgtgtaaatgaacgaatacaactttaaaaataactacattgagaagaaactctggagtcctaggatcaaatcctgttatttttgcaaaaccaagcaaacaaattgacttaattttattggagaataagaaaaaaaagtttggttaatcaggattgtatttatactgacacatttaaaagatttaaagataaatgttatgtacttccatgtcctagaacctataatgtgatttgtttatggttcttctttgccttattgatatgtgtattgagacccagrttttaaaatttaaaaatgttttgttatgaaakagtcttaatctaaatgtctttaaatggtttggggcctataagggtgactgagtacttctatttgctcttccaaagaaacacaacttggaaattagtatataaattttcaaaccacaatcctaacaaaatgcattggcaaataagatactctattgctcctggtagcaacatgcattacaaaaataagagcaagcttcttaaaagcagagttgctggctagtcaactttaaaattttagacactctgttaaggttagtataatttatttaactatttgatatcgaaaaataatcacatattggaagtaggatattcttggaggcaggtttatgtaatgagaaaaaacgcaaggtagaaccagacttacttggttccagttccagccctactatctaatatctgtgttactttgagcaagtcaccagaccttccagttcctttgtttcttcatccataaaatgaagataataagagtacttacctcatagggttgctatgagttactttatgtcaactgcatactacagcatataatagatattagcaattattttaagctcttctgacacttggaaccaaactcttgacatttgtctttcaaaaattgcttttgtgcaggaccaacatccaacaggggtctttgaattcaggtacaccttgagactcaagatcataggctacatttggtaccaatttaccaaaaaggttactggacagaccatatatctttccaagcagcatcaggtttttctctcagcaggagtctcagaagaagcagttggcatggcagttcacactgccctgtgattgggaagctgctttcccaggtgacagaccaggtgcaagaaagtgagatccacaccagtggaagtgaggttcacgtaggcttagaatcctcatgtaaggcgtatgtctggtaacagtcttgaatccaaactatagggagttagactagtgtcctacgagtagaaagcattctagtgttttgacacaatctctgtgagaaacttccaaaagcaagagaaggaatatgtaccatgtctttttgaatattcctcttagctatcactaattacaatagggttttggcaagggtttgctagcagacattccaaattgacatagttgtcaaggatttataggtatttagtgtttttgagaaaagatccaggtattctatacaaactacttacatggacgaaatgttaacattttatgaggaaacagaaaatgtattttattgttgctaaactccacctttttgtagtaaatggctattgatatgtttttaagagcaagtcctttatccgtaaacatttgtagaattggtccaatttgtaccgttgttaaactgaaaccatataataccacaaagcacagaagagacactataataaaagtaagatttatacaggataatatttaacaggattctatttaaattggcgtattagggttatttgcaaaacacattacataattagcataagagttaattgaacataatcacttatccatctagatacaaaaaaatgaggcagaacttattgatttatgtttkggcatagacaatattgagcagcttattgtgacattaatagactatcaggctcagttatttttatttttattatttatttatttttttatrtggggtttcactgtcacccaggctgcggtgcagtgacgccatcttggctcactgcaacctttgcctcctgggctcaagtgatcctccctcctcagcctcctgagtagctggggcaacgggcacatgccaccatgcccacgcttggcaataattaacaaaacctcctggaataatagctcttttttctcttttttccctacagttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacaggagaggccagagagtcctgtttatctgtaatacttcatgtacacttatcatccttatcttgaattaaaacactaacatgagctcctaacttggttttttaatagaaacaaaagacttttataaaatattttcccatttaatctccatgctttctttatctgatctaacctggcacctaaccaggcagaaatgtatgattcctgccatagcaaaaaaaccaccttttaatctctagatagctgtactcattgtcaacttattaggctaatatccattataaactaatcaaatttgaatagttaggctacttgctggattttgaaggtcaaccttgtttattaataaaatgctttcttaacattataaaggttacaatgagttctgatgccacatactcaccttttgggtttccaatgtgttagagagttctgtacttttgagtgttaggcctatccgaatacatatgtgaaagaagagttatcacccattgggaaaatgagacaacaaactatatcccaaagtgagttatattaataataacagaagtgtaagttctgtatgaccctatttttacaaacataaaaatacatttttatcagcttgcaattgtaattaaaaggaaaatggcagtttgaaaaatcttttgacgttgagtaaaatataactgcatgaactgtaccattgaactatgaagcagttaatggcaatgaagctggagtgattttaataacgttcttttaaataaaagtcactggggtcattttacaactccagtcactgtgttcattcctagttgagttcataatggacttcataatagtcttagagtctagtgtacctctctctgtcattctctctctctttttctctcccctgatgacctgcctctctctgtctttcaaaaatgtccttaacagaaactctttggaggccataagttttgttttcattttttctcattcatagagttctgattcacagactttaaaaaacattttctattctacattatcataatagtattatattgtacctttttacttctaaaacattgccattgatgagaggcgtctcagcaacgatgtaaccttagattgatgagaaaaaaatttacacatacaataccagttgatattaggagaaccagtttgggtaaaaggatgcatgaaacatagaaaagcataaagattgacagtacgatatgtgtggaatcttaagcataatggtatgggaaaagaaggatctatttaataggtcattattaattatgcaggaaatgttaaatttcttgtaatgaattatttcaatcttccaagtagctggattgcctgagctcagtgtaaaacttcctaggaggtgaaggcaataaactcctccctgttttgcaccatagactggcctacaataactattctgaacagaatgcactgcccagaagaaaaggcagtgaagaagggaattagggaattcagatgactctgtttttcagaattatctagatgattgaggcaaatagagattttcttttattgaaatgctgccatcattttctgctctaagtgtagatgttgcacgagtgacatctgtggtatatccttcttccagatagaagtataaatttataatttagtggggagaggaattttcttttaatcaccaaactaccagctgtatagaaaatttttttgaaatcaccaaactagcagttgtgtatcttagctcctaaagccacattcacaagaatcataagcatctcatttagaaaatctaatgtccaccggacccaacatcatctttccacatgttggagtttagaacatgcagtattggacaccaaaagaacagaaataacttgaaattatacaattaccaaataacctccatctctttgataaaaatgactttttacccaaagtgagatgtgaacaagttctcctctttaacccaggcagattttcagcttagctcaaagcaaactataattaaataaaacaataaaaattttaactcaatgaatatcctaggagttaatctgctgtggtaatcgatagtgacataaaaacaagatgcatagagctgaaaaaggcatctgtccacctgagtgaattcctgtagtaggcagcatttcaagatttagtttgattcaaacctgctgataaaacaaatgcttatatgcaagaaaaactagcagcaagatatgaataaatctccccattatgtagttaaaaactaatcagcatgacacatttatatttaggtatttcttctgcagaggattgccagaaatttcttaatgagagtgataatttggtgatccacctatgtaccttttgatgtctcatcacagagattagtgcttcctctgataatacatttgcttgatcctgctaataagaactcacctttctttttaacgaaatcaatttgtgttaatttacatagggaaaaacgttccttgagagggaggagaggggtgtttaccacccacaggagcagttccatccctggttacccaccagtatccctgccagatgttagactggaattagaatgaaaatttaaaaaaaaacgaaataataatccactaaatggccttctaattagagaaatttgaagatttctatcaaatataaaaagtgagaaatagaaatcattccctttaatttatgacaaattaaaattattgaagtaaaatgtttctaagtcagtttctggatagttcttgaatgagtcaagaaaaaactcaaacactaaatttctaagctaatttgttcattattcctttctgtttattatttattatatgagtgcaaattgcaaatgtattagaaaagacaatatagccttcacattcacaagtgtgccttctggcctttgaaatcttttaacataagatcaatataacatatttgttccccataaaaatctcttatgtacagggaataaggtcctccatagctacacagagacacccattcttgcagtctggcattcttaacacctttagcttcaaaggcagtcggtttcaatttcaagctaaaattgtgaatatacaattaagtgcgcaacttgggccttcagaccaaataattaatgctcctcaaattaaataatgagtggctgaaaagcctaatgtgtaacaacagagtaagtgacttcaacggcttcctgaaccttcattttgagggtgttctcatctcacccacctctgggctaggtatcctctgttaattgctaacaatttcctaccaaaatagtgcaatcaggactgcccatcacagcaaattactccaattaatgccctttcctcttctgtgaaccaaaaatatctctctcctgtctctcatctctatcccaggtataaattgactaataaattttacagagttttagtcaaaattatgaattttaatttccagcaacattattcctttagtctttctattccccaaaacattcttaaattttggtatcaaatgttcatttctgtcctagagattgtggttcccatggctacagatttttgtatagtggtagtatgagtggaataagatctgagacttttcctggtgatatccaccattctcttgtgaactcattgcagaataaacagcctctttcactttcattgtaagtagttctttaggttggcaaagcaggcaccagaatctgaatttgaatgaaatctgtactttcttttgttggcctattttttgccaagacagcctgcctattgtatatttaggaatcaaatattcattttttctgtttgtaaagccagaaatatttcagttaaaaagaatataattttatattattttaataattctttttaagtaaagtaggaaaatttctgccacctgagatgttactgtttttatttatatgaaaattccatttttttctttatgactcttttcccataccattatgatatgttcagcattagtattttccattttaccactaaacaaataagccaggactaataacaatagcagtttgagagtttttattttggcattttggttttaattaggaaagaaaacatggatgctattaaaactagttgtagttaaaaatgttttgaatgaggctactaacgctatcttagtcatctcaaagagaaagagaagaagtaaaattttaaatacctttttggcatttttaaccaattcatatgaacaaaaacatatattctattaaagcaaaataaagaatagtttaaaacactagtcttcttgcatgtgaatattttccccctaacagacaagatagaatccatttctggacactctaaaagaaagtaatgttaattgagagagctgtctccaaatggaactcaacctgaccagaatcccatccgcaggcaagagatgggctgtggggccgaccataagttttattctgagacgagatgctttatggctgctggctgcattatggcatctagcagtccccactggtttgtgggaacaaaacacatggattgatattcaatatgagtttggtaagttggagaaaaatggagacgatacggagtagtctaaaggcacaacaaataagaaggtgccagaggtagggaagggtctgagaggggtagttgcagaagcatttagctttcatagatgaggggagagttttttggttttatgaagattaggcagccctcctgaggaaagtattaaggatagaatgagacacttgtcttggtggtttggtgaagtcgtgtcgaaggcaaaaggatgaactacacatattttgagcatgatttagtaatattgtttgcaagttgagaaacagaaattcagccattctcctgactgatggtaggtgaaattcttcccaatattagagccaatctgggttaccatacgttcatatatttaacagctatttgttaaacaactgtgatgttccaggcactgttctaggttcttaggatacaccatataacaaaacaaatagtgatccttgccctcatgtgccagctctgtgttaaatgctaactattatcttattcaatcctccaaataaccctataggatatatatcattccacagacaaggaagctgagggttaaatgggataagaatcttgctcaaagtctcactggctttaaaatattaatatatattttacatcattcaagacagatatataattagctgaatattctcacctctattaactgaatgtagagtgtcaggtacatgggaagtaagttatttacgtgatctgaaataagaggacaacctttgccaaattacttttattaccatggagaagaaagcttcaatgaaatgcctgtttcagcccatcttcagtattggttggttaataccatttgttaacaccaatcctttcctcttttactgctaacatgtgactgtgtttaaaattatagattgcagcagagtgttggccaaggattattgtagtaggataaagtttccctgtatttgaaatttacccaaactgtagcaaatacatctttccttctttatggaggtcacacgtgtgcatagtatgtgcctgaatacaggtaaactttgtgttttaaaattacatggccttttttagagtcgactgaaggctagactcttcttgcccatgttgctggataggctttcaaatctcaggccttggagagttaaatgactttctgatatttcttacggtggagccacataagaaatacacacattcctagtttgagcaatggatgtgtatattggggatcttcacttttatgtatctggtagtcatgatggtgcctattcccaactgtaggaaaggaaagccctcaaggagaaaattctctttcaaaaaggctcagatttctaacaattatgtctaaatgtttcttcaatttagaacatgtacaaaagctacttaatattagcagagtagttcttgtgttttcatttcaaatgaaatattcccagttccaaagtttatttccttggcattttcaagaaggatggttatttttagttctggttatttggtgttggaggtctgtgacacttccttatacatttaaagccccctttgaatagttg

SEQ ID NO: 10806 - DNA, 166020 bp, Homo sapiens
  misc_feature (1)...(166020): n = A,T,C or G, or insertion/deletion polymorphism (see Tables 1-2)
atccactcccccttttctggtgtctgtagctgattttgatgagatccccctgggcccccacccttgtatgtggtagtgatgggactgccaatcaggccccccaaccttcttctggccgggaggtaagagtgagcccctgcagtagagtcctactggcctctctcccgggagtatctgaagcagagtgacaccgcttcattgtggcagtggtgcccaaaactaaataatctgttatttcccactcttgacgctgatggttccagtacttgcccaggtctggttgttcagcatttcctttgattttgtaaattgcctacactcttcccaaccttctcttcccctctgcattttggaattcaattagccagagtcaaggaaccctgacaggcacagcctttatcacactgcctggcatacagattctggtccttggattgtcttaaagtcagggagggcagagcgtgcatccctgtgcccaccagtaccttggtgttcggtaggttgaagagtcgaaagcaataaatggtggcccagtaacacaaacccaaagctccacagtttgactaagatggattggaaacccatgagagaccatataggctgaagacaaaaatcggatcaagaaatatttaggtacggatataggttcataaagggtctgactccaatgctgagcatctgtggaacaagcttatgtttttattcaggtcatccatgctgggtaccatgcttttcataaagaaaaatgcaggggccaggcacagtggttcacacctataatctctgcactttgggaggctgaggcgagaggatacttgagcccaggagtttgaggctgcagtgagctatgagtcatgccactgcactccagtctgggtcatagtacaagaccctgtctcagaaaggaaggaaggaaggaaggaagaaaggaaggaaggaaggaagggaggaagggaagggaacagaaaataaaaatgcaggcgtagaaccaccatgaatttaaccccgtgtggtgtttctgacactggtatacttgttgcggtatctagcctcaaaaaatggccatgcctaatcaaccatgctgcttagtgctcatgcccctgtgtcatccactcccacactgagcctggcctggccctgggtgaccagtacaacatggctgaagtgactctgtgacttccaaagctaaatcacaggaagccctgcagcctccactttgttccctgggaacacttgccctggagacatttcctctttgactcttgctgtcatgctgtgagatacacaagccacatgcagaggccatgtgtaggactccagaaaatagcccacatcaactgacagccatcttccaggttcctagggccacccagacctcctgaatctaaacctgttttaaaaagccttccaggtgattctaatgcacattaaagtttgagaagcatttctttctttctttctttctttctttctttctttctttctttctttctttctttctttctttctttctttctttctctctctctctccctctctctctctctctctctctctctctctttctttctttgagacagagtctcgctctgttgcccaggctggagcgcagtggcgcaatcttggctcactgcaacctctgcctcccaggttgaagtgattctcctgcctcaacctcccgagtagctgggacaataggcctgtgccgccacgcccagctaatttttacatttttagtagagacgatgtttccctgtgttggccagactggtctcgaactcctgacctcaggtaatccgcccgccttggcctcccaaggtgtgagccactgtgcccggcctgagaagcatttctgttattaatggtgctctgatttttttttccactatagcccatctcaataaaacagaagattctttggctcatatggccctcacttggtctggtctcactttccagggagatggaatttgataataagaaaggtcttggtgactggtgggcacctgctacttttgcctataccatgttgcttccttattcctctttcacagtgccctgcttttttgctttcttttctctctctttttttttttttagagaagtcttgctatattgcctaggctaggatacagtggccattcacagttgcagttgcagtcatgtacactatagcctccaactcctaggttcaagtgatcttcttttttttttttgagatggagtctcgctctgtcgcccaggctggagtgcagtggcgtgatcttggctcagtgcaacctccgcctcccgggttcaagcgattctcctgcctcagactcctgagcagctgggattacaggcgtgtgccaccacgcctgactaatttttgtatttttagtggagatgggggtttcaccatgttggtcaggctggtcttgatcttctgacctcgtgatccacccgcctcagcctcccaaagtgctgggattacaggcgtgagccaccacgcccagcttcaagtgatcttcttgccccagcctttggagtagctgggacttcacgtatgtgctgccacgtccggctaatgcgccctgctttttgctggagggcttgtcctctccctttccttctggtcatggtgggactataggcaagtgtcccacctccagccctggtaagggcaccagtcaggctggaacatcacagtatcacttccattggaacacagacaatgggggacactgacccaagagagccaatcagagttctttctggaacagccagaccaagttgaggaaaaggatcctcaccaggtggtgtaccggagactctgtgagcccagagctgataaccagccatgcctgacgctgtccattgctagactatctggttgtgcgagccaataaattcctttaaattgaagccatttgaaatttggcttctgtcactggcagccgaagagtcctgactatgacaagcaaatctgaaaggatgaggcatatgtctagtatagcaatagatggttgatagattcatagttgagctgaaattcagacatgagttgtagatttgctataacaggctgaaagctcagtcagtggtgtatgcttcctggcacactatggtgttcatgtgccacctggctagctctggcccaaaagatgcaaatgagagtccattggatcagggttctgggaaagcttttgctttctgggtataaagggtcagactcagctgtcacatgcccttttttcttttctttcccctccttcctgcctgaaatgcagtcatgatgcctcgggtggagcaggaatcttgctagcgtgaggagcaggccacatgctgagagagtggtggagcagaaagcaggaggcagcctgatggtcctgggagctgttgtcccatccaggatttcctccctcttggcttcttgatatatgaggaaaagtaaaatctgatttggttgggcaactatggctgggtttctgttacatgtagccaaatgcaaccctaacatagacaatgccctacactcattgcatcccaagaaaagcctggaattttcagatcaagttttagcctatcagtggcccacacttagagacttgccacatttttcaggtgagggacctggatccctgtatttgtttcttgtcactactgcaagaaattaccatatacttagtggcttaaaacaacagatttattattatagttctggaggtaagaagtcctaaacttgaagtaccagcagggctgcattccttctggaggctctaggggagaatccaattctttgccttttttagcttccagaggccacctgcatttcttggctcatggcccctttgtattcaaggccagtagcacggtatcttcacacctctctctctgacctctgcttctgctgtcacacctccttctctgactctgactctctcctgcttccctctttcccttatgaggactcatgtcattatactgggcccacctggaccatccaggataatctccctacaggagcataggctctgcaagatctaagtcccttttgccatgtcaggtaatatatttagaggttgtggggattgggaggtggacatctcaagggggcactattctgtctactgtagtcgtagaaatgaaaagggacttgcccaagagtacccacagagctgactgaaaagaaacaactatgggtaggctcacaccactggcagaagcaccccttttcctcctccttggcatgaagctaaagcccagccattctccaaggtccatttcaggctgcccctgcccagaagccacagctgccctcctaggcctgcagaggtcatcctcttgactgtgtctgtgtcactcattgccacttggcacacatttggtcagcagtcgtgaaggtcttccattgttctctgcccagtcttgatcctggaaggcaaggatcacaccctagaacttttttgtgcccactgcacagagtagggtctcaatacgtgtacggttcatgatgttcctagcagattctccaaactgactcactcagcccctggaacactaaaaactgcatttcccagactcctttgcagcgtgggctaggttccaccaagccagacacagtgaaagtgagtgggtggccacaggtggagggcacagtggtggatatgttttgttcttttgggggcagctatgctgggggctgcactaagtgatggggcagtggtcccaatggagtagtaaaattaagtgttgctcctggctgtgtaggacttagacccgtcatctgtaagctccttcacctcatgtaaacaaaacccctctagctggagtggtgtctattgtctgcgactaagaacccttatataaggtatactactccccaaccccattagtggaaatcccaaagggtaggaactatattttatttcacttgtaaacagctcccctagtaagcatgtcaacaaaatatacacaattcattgaaccccataacatttcaacgaattcctcatcctttctgtgaatcaagagcctgaaaagaaatggtgaaataatatgatcctctcttctttgaaagctcaaagctatgttggaccagaagtaaagtgttctcgtttctatttaataacttgaaaggttccgaggggccattgaggaaactcctcccttttaatatcaatgtgtatttattgcaaaaataatgtagcatcgagtggtattttatagcttatccaaaaacctcctgggtttaacgcattgtgatagtcccgttttcttctcagcccaggtcctatgcatcctcatctatgcagggctgttatctgcatataattttttttttttttaagacaaagtcttgctctgtcgccccggctggagtgcagtggtgcaatctcggctcactgcaacctccgcctcccaggttcaagcggttcttccgcctcagcctaccgagtagctgggactacaggcatgcgccaccacacctaggtgatttttgtatttttagtagagacaggggtttcaccatgttgaccaggctggtctcgaactcctgatctcaagcgatccacccgcctcagcctcccaaagtgctgggattacaggcataagccactacgcccggcctcaattttgtattgtactttttctttctttctttaatagagacagggtctcactatgttgactaggttggtctagaactcctgggcacaagctgtccgcccgcttctgcctcccaaagtgctgggattgcaggcgtgaaccaccgcccctggctacagttgccttcttgtctcaatttgcctttgacctttcttagggacttgttttctgcttttcctgctctttgtccgctgatctcctgggaagaaagcttccgaaaaggacaccgtttcaggggcgagtgacgccggggtgcccaggccgcgccccagttccgggtttgcacccggtcttcttgccctgccccgctcgcgggactacagttcccaggcgcccctgcgcggccgcggcgccggcgcmggcgtcggttgggacgcggagcygaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccaggtgagtgggccccgggacgccgctggggccgccgagctctaagctcagcccgctccctggctgccggcagggggcggggcggcagggggcggggccgcggcgcaggccccgcctcggtctcccccttcccaccccggtgcgcgcacagtgctgaccacggacgaccccactgttgcccccggcgagcaccaggactctgctggttagggctgcgcggtcagacagggcggccacctggtacgtgcgctgctgagcgcttgacctgcggccagtctgaattgagatgtgctgtaagcgtaaaatgcataccgattaacaagacttagccgggcgcggtggctcgcatctgtgattctagcacttgcagaggcagaggagggaggatcgcttgaggctagggggttggagaccaccctgggcaacatagggagaccccgtctctgccaaaaatttaaaaattagccgggtgtggtggtgcacgcctgtaggcccagccacttgggaggctgaggcaggaggatcgcttgagcccaggaggtcaaggctacagtgagctgtgatcaccccactgtactctagcctggactgcagagcgagacggtctcataaacaaaacccccaaaaacaccagacttcgtgagtaaaatgtaaaataaaaacatgaaaatgggttatgttgtttgcctgttgaaatgatatactttttgtttgttttgttttgttcttttcagatggagtcttgctctgtcgcccaggctggagtgcaatggcacgatctcggctcactgcaacctccgcctcccgggtgcaagtgattctcccccttcaggctcccgagtagctgggattacaggcacccgccatcatgcccagttactttttttatttgttttgtttgagacggagttttgctcttgttgcccaggctggaatgcagtggtgcaatctctgctgactgcaaccgccgcctcccaggttcaagcgattctcctgcctcagcctcctgaatagctggaattacaggcatgtgccaccacacccggctaattttttgtatttttagtagagacggggtttcaccatgttgggcaggctggtctctaactcctgacctcaggtgatncacctgcctcggcctcccaaagtgctgggattataggcgtgagccacatgcccagttgataatatttttaatatactgttttaggttaaaatatttgaaattaagtatacctttttttttaacttttgttaatgtgcttattagaaaactttaaattacctttgtggctctcattataattctgttggactgcattggtttaggtgagaggaggaggaagagaacatcgtgccagccaagacttgaccatgaggacacttttttttttttgagacagttttgctcttgttkcccaggccggagtgcagtggygccatctgggctcactgcaacctctgcctcccaggttcaagtgattctcctgcctcagcctcccaagtatctgggattacaggcacccgccaccacgcccagctratttttgtatttttggtagacatggggtttcaccatactggctaggctggtctcgaactcctgacctcaactgatccacctgcctgggccttctaaagtgctgggattacaggcgtgagccaccgcacctggctgacacttttctttgtataatttttttttttgagacaaggtctcattatgttgccagggtggtcttgaactccttggctcaggcagtcctcctgccttggtctcccaaagtgctaggattacaggcatgagccaccacacctggcctaatttttttttctttttttttttttttttttgagacaaggtcttactttgccacccaggctggagtgcagtggttcaatctcactgcaacctctacctcaagggctcaagagatcctcccacctcagcctcccaagtagctggaactacaggcacgtgccaccatgcccagctaatttttttgtgttttttgtagagatggggttttgccatgttgcccaggccggtcttgaactcctgggctgaagtgatctgcctgcctcagctcccagagttctgggattagaggtgtgagccactgtggccagccagaaggacactttcagtagcatggttggcaccactggacctgggctttgtaaggcctcctgttggcatcccaggtcagcactgccatgtgttgataggcagccgggaagggctaactgccaggacttggcctcccggagtcactagctgaggcaccctggcttggtagcctgatgtcactgggactcaatatacctatctgtaggtggcaattaactgagtctcttggtccttcttagagaccccattctaccaatctgcatgtctgatgtctgggagctgctgagataatrgggacccaaacggtcccgcatagtgaagccggaggtgtttgggaggctgggaactgggaacagggagacttggcttccaggagcaagcacaaagggcagcccagacctaggacactccgctgggtcctgggtctgctctcagtgttggctgaagttcagggttaagtgcattcctgaccttattctccattactccaaagctttagactagctcagtcacagatgagagcattctgtgagtggcactggtgggaatccagcagagggctctgggcagtgttttggggtgaagtgggcctcatctggggagcaggaagccagagctcaatgctgtgactggggcaggcaaggcctcatgggagaccctgccactcattgcttgcngaagatacatttgacattatctaccagtggttccacttctgagaatttgtccttgtctcatgcgtgagaaatgacatgagtacaaggtcattcctggcagtaccttttaaatagcaaaagactggaaacagctcagatacccatcagtaggggagtattagggtctgatgtgtggaggggagagggacagtaaagctgcaggcacacaggtaaatcatcctcacaggtgggcacacgggtaaagcgcatcatcacaggtaggcctaaggggtgtgaagacgggagggtactgagagtgtgatggacgagggtggcctgtgctagagagggggtcgggacagctctgaggagaaggcactggacagacccggagggataagagggaactgtctgcaggaagaggcggaggaagcgcattccaggcagaaggaatggtagctgcaaagacctcaggaagagagcacttggcgagttcgagggcgtggggtgggggagtgggtacaccaggcaggaacttgaggggcacggagaggtgtccggactttatcctgagtggcaggaagtcagtgaagactctagataggcatatcatgtggtctgatttatatgttttaaagaaatacaaatgtaaaaagtgagacatacaagtcaaatgaaagcaagggagatttcctttgaaaccttggagagaaggcctttacatccaggccttgaaatctagaaagcaaaaacaacgaacaagcagcccaatagcaatatgagcaaaagatgcaaacaggtcatggaagaggaagtgagagaggctccgccttactcaaataagaggtgtgtgatctcggctcactgcagcctctgcctccygggttcaagccactcttgtgcctcagcctcctgagcagctgggactacaggcatatgccaccgtgcccagctaatttttggtatttttagtagaggcaggattttaccatgatggccaggctggtcccgaactcctggcttcaagtgattcacccaccttggcctcccaaggtgctgggatcacaggcgtgagccactgcgcccagcctgagaaatgcaaattaaaactatatcaagctgccctgtttcatcartttgacaaaattggccaaaatccaaaagtttgagaacactttctctgtgagagtttgtggaaacagaccctgccacacattgcttgcagaagatacatttgacattatctaccagtggttgcgcttctgagaatttgtcctatctcgtgtgagaaaggacacaagtacaaggtcattcctggcaatgccttttaaatagcaaaagactggaagcagctcagatatccatcagtaggggagttttagggtctgtctgtttatacagcagaataacatgcagtgtaagaaggaatgagtaccttgtntatagacatattactantggagacagcaagcacacagcaggatgcacggtgcnctgtttctggtatagaaaatgcagaaatgcaagaatgtatttctcctgctgtgtttgcataaagacactggaaggacgcaggctgcttcagagtctgggaagagctggaggataaggaaagtgggggccactgtgtggttggagacagggtaggagaaagactcttcactgtataactttgtataccaacgtttttgtttttgtttttgaaacagagtgttgctctgtcacccagattggagggcagtggtgcaattttggcttactgtaacctctgcctcctgggttcaagtgattatcctgcctcagcctcccgagtagctgagattacaggcacctgccaccatgcctggctaatttttgtatttttagtagagatggggttttgccacattggccaggctggtttcraactcctgacctcatgtgatctgcccaccttggactcccaaagtgctgggattacaggtgtgagccaccgygcccagcctgcatatcatttttaagatttttaaactatgtgaatgtgttttctattcaaaatattacaattcaaatattaaattgaatattaaaattcaaaatattaacgtctgggcacagtggctcatacctgtaatcccagcactttgggaggctggaggtagaaggattgagaccagcctgggcaacacagcgagaccccatctctacaaaaaatacaaaaattagccgggcatggtggtgcacgcctgtagtcccaactacttgggaggctgaggcaggagaactgcctgagcccaggagtttgaggctgccgtgagctatgaatgtgctactgcactccagcctgggtgacagagtgagactctaaaaaaaaaaaccattgttttttaaataaaatatttcaaggagatctctctggctgcagtgtggagaacaggctggcagtagggcaggaggtgggggggcttggactgggtagaaggcaatggagatggggaggaaggcatgaattaaagaggtgttttggaagcaggacctatgggacctgcggacatacggggtattgtgggggtcagggagaacttgaaataaagggtggtttccggtgtctgactggaacagctggcagggtggagagggggcagggagggggtcatggggcgggaaccatgatggctcatgatgtatgtcaagttcctggcctggtgtttggcacacagtagacccacaacagtgtaacattaaagaccactttcttttctttttcttttttttttttttttgagacaggatcttgatctgtctcccaggctggagtgcagtgacacaatcacggctcactgcagccttgacctcctcctaggctcaaaaaaatctttctacccaagtttcccagatagctgggactacaggtatacctccacatgcaggtttttcttttgtgtgtgtgtgtgttttttgttgttgttgttgttgttgttttgagacagtctcactctgtctcccaggctggagtgcagtggtatgatctcggctcactgcagcctccgcctcctgggttcaagggattctcctgcctcagagtagctgggattacaggtgcctgccaccatgcctggttaatcatttgtatttttagtagagacggggtttcaccatgttgaccaggctggtctcaaactcctgacctcaagtgatccactcgcctgggcctcccaaagtgctgggattacaggcatgagccaccrtgcccagcccccaagggacagtttgagccctggtctgcccaacccagacccctacttggaatccttcagggagaagggggtgttgggaaatgtcacaggcttctctaacagcttattttgagcagatgacccccacgtgatatagaactgtccaacaaacgtgcagattccaggttgtgacattggaaagggttctgttaacttctctgggttctgggttggtgtcttctgactgattgattgccaggagggttttgtttggatttgctttggctcctgcagatttatctagctgggggtgtctctggtagcagctatactgtatacatctaacagcaatgtaataayaatccygaaatacaccacagcctgttwtgtagctgggagaggctaaaatctcccttcccaaaagcatatgggattatttttggtgaggggacatcacacccgtgatktgggaggttttgttattgtgctgtctgtgggcctgcagaaccgatggcctggtctctcaaccccatgggcttcccatgccataggaccaagtccccatatcctgccttgtccacgaggaccttctcaactgacctttgtggcctcttccactggcccccagttacacagacttcttggtggggttttcactgaaggggccgctgagctgtccagcacccacaaacctgtttccgcccacaccagcgtgcccttcggctctcggcagaccttggcagggcccccttcagcctttctgttggcttttaagggcaaggcccctccactctggcccagtgcctctggggccagatcatcaccctcagggcccgggaagctccgtacaccctccctcgcatgcctgtggggctcgtggcagatgcccagagtggctgcgaaggtggtgcaggaaackccccctccaggaaagtgtgcctgcttttggaattttccctggggattttccagagatgcaggacacctgttttcctcgcctggtgattgagccgggaagccttcatggagcaggccctacttgcccaggtgaagtctgtgtggcctgcagccacgggggygagtggccctgcgcctttcatgctgtggcctccttgatatgtacagcctgctttgaagtcctgcaggagctcaaaggaagttcctggggtgagaccagccgccgcagagggaaaagtgtgattggagtggggtggggggtcttagggttggcagggggaayacatgcctccgtggcagctcccggcaccatgggctccctggcagcatcgtcygttctctgagcctgcgaggggcgacacactgtcaccattcttcttcttggattttctgtgrtgatgggtcctccgattttattgagggccacggagcacgggggaagtagaagctcaactttttaaaataatatccacagcaacagcagtcaccccgcatcgagggaggcctgtcgtgcgccaggcaggtgcttaaccacccaccttcccttcacaccagcccctgaggtggggggggcttcctcttttcaaagtgaggaccaaaaatcggagagattcaggaactggcagaagtagaaaatgttgccgagccctcattaaagatgcatgcacacacacacattcgttcatttattccttttttatttttttttcattcattcattcctttactcatacactcaacaagcaaacattgagtgcctctgctgtactaaagacaccatcctaggccctggggatgtgcagcagtgaacaggtggagccgatgctgcagtcatgggggaccrgcaggcgacagcgtgcactcrggaaggctagagcatctgagacaygcagygaggtggggagccctgggctgggtacctggcctcgcagatcccatggcgagggagctgggattggaggatgctgagcgagccagccaggcaggcatctgggctaagagcatcccagatgaaggagcaggaggcccaaacctctgaggccacactggtgctgctggccaggcagggcccacttgctgctctaggacttgtgggtgggcgtggtcacaggccggaggacatctgtaaccggccgtgtccccccaacaggccctttattgaagccctttcatgggcggattgggttcccngaggggagccattcagaggcagggcccagcacagcgaggggtgcagaggccggcctcggggccctggscctatggctgggaggcatctgcatgtgaaagggggtgggcatttactgcatcctgtcttgggccactaaagcacatctgctgggcccagcccaggcccggctcggcgtttttggagccggcggaaggaagaagacttggcccagggcagcctcataaagcarttcccacccaggaccgccccgatcgatcggcctggtgctgtggagccaggcccacagcccttccgtccagtagcacctctcaatcccctgtgtgtctgggtgccttcgggatcctgataaaacgtaggtgcctcctagtaggtctggaacagcgaaggccagggccaggggatctttgaagtccagctggtcctggcaccccagtatcccctccttcatgcccggcttccctggtaccatccagccctagggacacaggtccctgggagtagcagcaatagtaacaacaacaacaacaacaacaacaacaacaacaacaacaataataataatgtaggctgtgggcctgggctggaacttcatctctattgcctcatccaacccccacacgcggtgtggcacctgccggaggggtctggcaggacattgtagggagagggccatttgtttgcatttgtttaagccaacaggagttttcctgatgcaacctggaccttggacaaggggtgtttgtcgagaacgtgctgtcgtcacctgtggtcccatttgctgtcaggaggtgaagcactttgtcttcagagatgggagccggtgctctttcaccctgggttctgtgatttcagctgtcatttcaacattttaagtttcataagaaataggtggcctccttatgtaaacattctcaccagcctgtgaatatacagagtgaaaagtccaagtcctccatcctcgaccaagtcccagtgacttccccagggtgacacaatacatccttttccttcgtattcctcaaaagcacagaggattttgagatgcagccttccctgactcttgtccagttctgcgggcacctgccccatcactcttgaatgccaccgccccaccattgcccaaggcatgtgtttggttagtcacaggtcactggaggctggagaccccttgcaggtccccgggccaggagttttgaattctttgtagcctcagagcacttatccaaccaaatgaaattttgagtagaactccaaaattatatatatataatatatatatttatatattatatatatatttatatattatrtatatatttatatattatatatatttatatatattttatatatatttatatatatataaattttttttatatttatatattttttatatatttatatatattacatatatttttatattttatatatatttatatattttatatatttatatattttttatatatttatatatttatatatatatttatatatatttatgtatatttatatatatatttatatatatttatgtatatttatatatatatttatatatatttatgtatatttatatatatttatatatttatgtatatatttatatatatttatatatttatgtataaatttatatatatttatatgtatttatatatatatttatatgtatttttatatacttatatatttatatgtatttatacatatatatttatatgtatttatacatatatatttatatgtacttatatatatttatatatattttcttatgtatttatatatatttatatatatatttatatatacttatatatatatttatatatatttatatatatatttatatatatatttatatatatttatatatatatttatatatatatttatatatatatttatatatatatttatatatatatcttatatatatatttatatatatactcatatatatatttatatatatatttatatatatatttatgtatatattatatatgtatgtatatttatatatatttgtatatatatttatgtatatttatatatatttgtatatatatttatgtatatttatatatatttgtatatatatttagtgtatatatatatttatatataaatatttatgagaacagtgtttgaatagtatattatttttaatagggatgggatcttaatatattgcccaggctggtctcaaactcctggcctcaaggagtcctcctgcctcagcctacccagtagctgggattataggtgtgtgccaccgtgtctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatacagagtgaaaagtccaagtcctccatcctcgaccaagtcccagtgacttccccagggtgacacaatacatccttttccttcgtattcctcaaaagcacagaggattttgagatgcagccttccctgactcttgtccagttctgcgggcacctgccccatcactcttgaatgccaccgccccaccattgcccaaggcatgtgtttggttagtcacaggtcactggaggctggagaccccttgcaggtccccgggccaggagttttgaattctttgtagcctcagagcacttatccaaccaaatgaaattttgagtagaactccaaaattatatatatataatatatatatttatatattatatatatatttatatattatatatatttatatatttatatatatttatatattatatatatttatatatttatatatatttatatattatatatatttatatatttatatatatttatatatattttatatatatttatatatatataaatttttttatatttatatattttttatatatttatatatattacatatatttttatattttatatatatttatatatgtatttatatatatgtatatttatatatatttgtatatatatttatgtatatttatatatatttgtatatatatttatgtatatatatatttgtatatatatttgtatatatatatatttatatataaatatttatgagaacagtgtttgaatagtatattatttttaatagggatgggatcttaatatattgcccaggctggtctcaaactcctggcctcaaggagtcctcctgcctcagcctacccagtagctgggattataggtgtgtgccaccgtgtctagctcagaatggaatatgttttctgtgttcaaatttataatgtttgttctgaggtcaactgatgagaatgatggaagtgtttttatgaataacaatgttgggctgggtgcagtggctcacgcctgtaatccctgcactttgggaggccaaagcgggcagatcacataaggtcaggagtttgagaccagcctggcccacatagtgaaacccccgtctttactaaatatacaaaaatcagctgggtgtggtgttgtgcgcctgtaatcctagctacttgggaggctgaggcgtgagaattgcttgaacccgagaggcagaggctggggtgagccaagattgtgctactgcaccccagcctgggagacacagcaagactctgtctcaaaaaaaatgttgaggtctgcagcagtgaaccacacaacacagtttatatgcttagaagtttatgtgagtgctggaagcgagcttattaggagggatgagtgaatgttttctggtttatccagacttcagactgttagacagctatgaaagaatgacttcgctctgtttggtgctgacattagtttatatgatatgagtgctgtatataccaagtgaaaaagctgtagaataatgtgtataaacttacttttttttttttttttgagacgcagtctcgctctgtcacccaggctggagtgcagtggtgcgatctcagctcactgcaaccttggcctcccgggttcaagcgattctcctcctcagcctcctgagtagctgggactacaggcgcctgccaccacgtctggctaacttttgtatttttagtagagacggagtttcactatgttgaccaggctggttttgaactcctgacctcaggtgatccgcccgcctcagcttcccaaagtgctgggattacaggcgtgagccactgcgcccagcctaaacttccatttttgttaagagaaaacaaaggaaacacaaccacccccgtatatctggggtagagtcataatagaatcacaaacttgaactgtatggaaagagactgaggaaaatctgatggctgcttgaaagctttcccgtggctctgctggcaggagtaaggtctgcttctcagtttctgatctcagccttggtgggcrggggtcaccctgtgaaaatcaagggcagccagggtgggtctggcacaggattattggtttaccctgcaggtgctgcctctggttggaagcccttggccaattacaaggggagtgtggcacaagttacaaagctcatgaatggagtcctgcccctacccccagtgccccacaacgtgcaagaagccatattggcaaagcagtgccacacctscccactgtggtgtgcagggtgatttcccaggcccccggcaacaggcacgttgctgtccagcttgtagaggaggaacttaaggttcacagaagtgataggacttattcagacaccttttgagggggactgagggctgctgcttctgccagggcaggcaccacctcttacctgttgcaaagcttaatcctgtcacagaaagtgccaggtgtcagctctagtgtgagagcgtgggtttccaatcccagcwctgccccatagttgccatgtggcctcaaggaagtcccttagcgttccgtcaccccattatggctgcagctcaagggccccagtttcctatgtgtaattcctgtacccaggctgcaagaattaagtgaaatattttctcttaaaccaatgtttgggtggggcgaggcgactcatgcctgtaatcccagcactttgggaggccgaggcaagtggatcacctgaggtcaggagttcaagaccagcctggccaacatggtgaaaccccgtctcactaaaaatataaaaaaattagctgggtgcagtggtttgcacctctaataccaactactcaggagactgaagaatcacttgaacctgggaggcggaggttgcagtgagctgagattgcaccactgcactccagcctgggcaataccagcgagactcggtctcaaaaaagcaaaaacaaacaaaagccaacgttttcctttttttttaagtttttgttttcttttcctttttaccttaaactatcaggagataaaagccaacgttttacttattccatatctaggagctaaaggagcattttgttgttgaagggtcaaataattttgaagagtgggttgctttgccctttttttttttttttttttttttttgagacagggtctcactttgtcacctaggctggagtgcagtggcacaatcttggctcactgcagcctcgacctcctgggctcaagcgatcctttcacctcagcccccaaagtagctgagactacaagtgcacaccactgcacctggccaatttttgtatttttagtacagacaaggttttgccacgttgcccaggctggtcttgaactccagagctcaacggatctgcccacctcagtctcccaaagtgttgggattacaagtatgaaccaccgtgcccggccatatgaagtcttgtagttgttgaactcggtgtacrtgctaaaccaaagcacacagttctgctcaaggagctgtattttccacatctgtttgtattttcatgaagccaacataaaaggattctcatcccagttctgtccctagacaagtcactgaayccctccaaaccacaggtcccatctccaaacagcaggtcccatctctaaaccacaggwcccatctccaaaccacaggtcccatctgtaaatggaaacatgaacccacctctcagactgtcaagaggattcgatgtgaacatgcsgttggggctcggtggaggaggagccagtcaccgggcgctgctgtagccactgctggggctcagttcaccctgggctccctgctggtgtaaactttcccctctttctaaaggtgcccctgggcgatacactctgggctcctcctgctggcctccttcccagggcacctggcttcctctcagaatgtacctgccccaacagtgggtttgtcagagacgtggttgtcattgtcaccaccacagcaattactgccatttatttagtatttgaaatgtgccaggtgcttctcatgtcttttttttttgaaatggagtctcgctctgtcgcccaggctggagtgcagtggtgccatctcagcgcactgcaacctctgccacccaggttctagtgattctcctgcctcagcctcctgaatagctgggattacaggtgtgcaccaccacacccagctaacttttgtattttaaatagagatggggtttcactgtgttgttcgccatgttggccaggctggtctcaaactcctgacctcaagtgacccacccgccttggcctcccaaagtgctggggattacaggcatgagccggtggtcaggagttcgagaccagcctggccaacatggtgaaaccccatctctactaaaaatacaaaaaataagctgggcatagtggcgggtgcctgtaatcccagctacttgggaggctgaggcaggaggatcacttgaacctgggaggcagaggttgcagtgagccaagatcatgccactgcactccagcctgggtgactgagtgagactccgtctcaaaaataaaataaaataaaaaataaataatatgatcttcatgacagccctgtccagtagctactgttggtgcctcattttacaggtgaggaaactgaggttgcagagggttaggtgacaagccacagtcatacagggaggaggtgtgtctgcttcccgagctgagctcccaccttacttacaggggcctggcctttgtcccctgcagccrccatggccctcagggacgtcgggctgctgctgaggctcctaggctgaggagtggaagaaaggagccaggatccccacccctcacccccacatgccacgaggcatttcctgtccctctgggccttagtatccccctctgtgaaatgagacactcgggctgtgtggtctccaaagtctctggctgccgattcccatgtacttcattctaaattgcgtttattgattcctgggacatcgatgcttgtgggatcaacatgtccctgtgatctgggctccgtggcacaggcacttcagagaacactctagatgggagttctgccggcaggtgaggaggcgcaggtacgggagggtgtgctgcgtgttttataagtgccctagctgggggccggccccagcttgacctcattgccgtcccgctaaggtgactgcccagctgacccagaccaggaggcccagctaggtcccagctcctgcgtcactgtgtctcttctctccattcaaactttggactctgatgactcaaggctctgtgcaggtgctcaacagcgtctagtggacctgttgccctggccggtcagctggaaggaggagcaagtgcaggaggctcagctggagccagtgtgaggccgtgccctgtgccaggggcccgtggcatctctgctgtgcccagcctttacctcgtctccttcatggcagccctggagagctggaaggctgggcaccaccatcacccatcactgtttatggctcgggttccaagactccaccagcctggtgcgcgcgccagggtgggaagccagaccccacgcccaggggacagatgccgatctgttgctgctcctacctgcaggtggtcccccagcccaagctggtgtgcttcatggtgcagggcacggggtgggctcatscgcacatcagtgtgggcgtccccggggcatatgtgaataactgtatttttctattgaaaaaacaactctgctctgcttacggggctcctgcttgaccttctgttttggaaaattggatttttggaggaaatcagcaccttgtgggtttcaattctccaaacatgcgtgttcaatctccattgctttccaaaaggggagcgactgaagatctgaaaattagacagtggctagcactgcccagaggccccgttattaaaaacatttcaaggcygggtgccggtggcttacgcctgtaatcccagcactttgggaggctgagactggcggatcacgaggtcaggagttcaagaccagcctagccaacatagcgaaacccgtctactaaaaatacaaaaattagctgtgcatggtggcacgcgcctgtagtcccaactactcgggaggttgaggcaggagaatcgcttgaacctgggaggcagaggttgtggtaagttgagattgtgccactgcactccagcctgggcaacggagtgagactctgtctcaaaacaaaaacatttcatgccagtggcattgctgagggcctggggctggtgctgcacctgcatctcttttcactacaacccccggggaagggggtggtcaatgtcctttcccctctctgaggaaactgaggcattgagcttgtatttctctgcactggttcccatttcagtagtaatagggaccctccagcacaccaggtgatgtctgcaaygtggccccagaggcaggagcaggctgggagttaggaggctgaagcctgatgtgggggagcgctgccccccaaccccactccctgggaaccaaccctccacccctttgccctgctgcctccacacccctttcctctggctgtgaatttctccattaccaagtgggcccgtcagatctggaacttgggtcagttaggtgcttctcccagtaaagcacctactgtgctgggtactgggtactgtgcccggtagattttgggcaggattctagagagcatctggcaaagttgctgcaggaaagggccagtcactgcctgccagtctcggcccctgtgaatgcacgagttgacatttctcaaattccagcctcactttgtgggccaggcagcccttctgacctatgagctgccaaactgagccttttgatgacactgcccccgaggattccctgcagccctatgtcctcctgagcacctggtggcccctctgtggcctccgagaccctggcctgggtgctcactgcccctcatccctacacaggagatgctggggtgactcctctgttggtaaaccaaggctctggttgctgaggatggggctggtcctgcgccagggtgcccccaggtgctgatcttggctccactgtggttgggcaccaggcatggcagaggtgctgagcagacaaaaccctgccctcccaagccccgggcttgcagaggaggcaggaggagggaggtggtgatgtcaggaccagagcagcaccaagggctgtgtgggcgcagctcggaggatgggatctggctgggtgcatggctgtggggcctccaggaggaagaggtgtatgaaccctgctttgtaggatgatcagggtcaggccccaggggagcatgaaagcaaagactcagggtgctatgagggcctctgggtcacacgaaggtgaccagtaccggggctagagggcagggggcccagctgggaggggctcatgctgcccttttcctgaggccccctgctgcctgcccagtctcccctccgagggatcccattctccctccagcctcaggaccctcggcggtccccagagggctagctattgagctgtcccaaggtcactcaggatgtccaataattgtcctaacagtttacctgctgtggaacagtaatgagagggttttcattatttgcgggtgagcgctcctggcagatgccaacagccagcagatgtggagagtccgaggtgatttgtaagggccggttcatctgatgcacggtaattgccccgggcgatgttgtcactcagaggctcgtcctggcctgctgagatgaggtaaaggtcagttcaaagatccagtttgggccaggcgcggtggctcaggccgggtgccatggctcacrcctgtaattccagcactttgggaggccgaggcaggtggatcactggagattgggagttcaagaccagcctgggcaacatggtgagaccccgtctctactaaaaatataaaaattagccgggcatggtggtgggcacctgtaatcccagctactcgggagactgaggcaggagaattgcttgaacccaggaggcggaggttgcagtgagctgagattgtgccattgcactccagcctggctgacagagtgagactgtctcaaaaaaaaaaaaaaaagatccagtttggctacaggaagtgggagcaaatccccactcccatgggactcctggggaggaggcagcgtgctgaggtgggggccatggtctcagaggggctatctggcagccaggaccctgcagaaggcccctttccccaaggttcttgggtggtggggtsggaacagcccatcccagagctgggcttgtccttctttgcaggggctctttgtacagctctctgcaagccttgctggggtcctggagccgcacctgactagggctttcctgatattttggaattcttgtacttcatgcctcccaaggcttagtctktgacatctggtggcaggccccacggagggatgacaaggntttgcttccttagctgtcctagtcggcctgggctgccataacaagtgccattgactggggacttcaacagcagacgtttattttttcacagttctggaggctggaaggctgatatcagggggtcggcatggccagtttctggtgaggccccttttctgggyttgtaagcaggtgccggcttgctgtgtgctcacatggcctctttgtgcattcatgagggtgctctctggtgtctcttcctcctaggacactgatcctgtcatgtgggagtcccacccttatgccttcatttcacctgaattactccacaaaggccctgtctccagatgcagtcacattgggggttaggactccccatctgggctcacaggccttgctgcttacaagctgtgtgaccttggtcaggtctctgtctcctggggcctccatcttctcctttctagagtggagataatggttcttgcctcataggctcgtttacccagtgggtacgacttactgagggccacctgacagccaggcacctgggccttggggatgtccattagggacagcaaataccttgggcacgaggacaaaatcagatcatggatcctgagtgacaccaccgtccttacccagatgcaaggctcagtataatgttgtattaatattttactctttaaacaatagtgcctactttctttattttcagtaatttaaaataaggaagaggcaacctggggctggtccctggtggtcagaatgggtctctggtgacggctcaaagsggggtgtggtccggggcgcagaaggacagaacccaatgggagcggacttaccccagcatttcacatccgatttttcaggganagatttngtctctaaaactagcacttgatattataanagcatataggctgaatgaacttatattgctatttcagaggaggccagtggcttaagagtcccaaagtgagttctgtgacttactcatgtttcatccacatctgaagttgtgtttggaataacagatgtgaggcactgtcatctcactgtcacatcgattgctcactgttctgagaaggtcacatcatcattcattagcaataattagtcccaggggaccccctgcacttcttcactcaactgctccattaacttgggtgcaaatcacacgttccaggtgccaatcaatggagatctatccataatgtacaaggtgacgctattagttacaatatattaactgcctaatttaaaaataaaactatctttatgaagggcaattaaccactaagtgtaattgataattcataaacctctgattaggaaagacaaataataagaaaggaatgaatcacccatcctattgaagaagacnttgccagcctctggtctgcattcactatgtggtcagcagatctacagatttcttcctaaattgcacctgtcagctccagggctgggggtctggaggctcatttcagtgcagaaacatgtgttttcaccactgaagcctgtctgtttctgttgggggttataaggaggctgcaggctcaggacaccctcagggaagtagtgggtgaggtcatttagacttctcagtcagtcagtcattcagcaaatgttaatgggggattgtggagtgccaatccctgtgggaagccctggggatgccgtggagacccgaatagattcatccctgaactcctggagctcgtaggccagtgagaaagacaattgcgtaaatcagatgattggagacactggttagtgttacaaacaaaaactgacagagacagggcggaggcaatggcacactggatggtgggaggaagggacattggcctgagtcctgccacctttttgtagtagctgtcactaccactcatggctgtatttggggccctctctcactggtggggaatcgtgcctggcttatctgcccccyttttttttttttttttttttttgcgrcagagtctcactgtgtgacccaggctggagggcagtggcttgatcttggctcactgtgacctccacctcctgggttcaagagattcttctacctcagcctcccgagtagctaggactacaggtgcccgccaccacacctggctaattttttttggtatttttagtacagacaggatttctccatgttgaccaggctgatctcaaactcctgccctcaagtgatccacccacctcracctcccaaagtgctggggttacaggactgagccaccatgctctgccttatctgccctctcagtkgtcctccactccagcctcatttcctggctccaccttccacataccccacgctgctcgagttctttctatccgagagggtggggccagtgcacacctgcctgtgcgcaaggtgggtggcccttcccaccacctggcctgccctttcctgccatctccttgtccgtccctcaggtctccagttgggcctgaatccccagtcttttaagaccccacactgggctgtgtcctttccccactatgtgggagagctccaggagtgctgatttcctgttcctgactccactgtgtgtagatatcagctccatctccaaagtctcaggctcaagagcggaacagaaagcccttgacatttctgggattcagtccctcacccataacatggataaattacattcacactgggttcagtttgagttgagtttttagttgggtctcacttgctcagatggaagttgatttcaagccgtagttctagtaactgggttgaatctgcgtgtattcatttcattgggccacatctgtaaacagaacttgagcacatgcctcctctctatgtgtgttttctataaattttaaattattcatttaacactattgcttaggttataaaaaatacacaacttgaaagaataggtgaagagccaagatgtctgcatctttggagatcagtggaatgtgtgtgtttcgggacctgtctgagaacagtgccagatgcaattagcatggctgattaattttactagggtttcttaaaagtgcctcccggcccttgggcttgcagcttgatgtcttttccacgagtccacactgcagctccatgcagatgtcaaatatgaccrctgccttgttggggccggtttgtccrggaagggatcttgtgatcttggcgagggagccaggtcctgcctgtcaccctccccccaggtctgagtgacccaccccgcctgcctctgtaggttcctctagcacgctcgggtcccttcctggtgggcgccaggtcctccagcctcctctccctgcacagaagcaccacaccctggccctctctcttgcttccccagggaggcctcccctgaccttcctaccccaccttgtcaccctctgtctgctcaccctgtttatattctgcatagcgtctctctcttctcagtcacaaattgcccttcctttgcagggtctcttgttcctattccaacctcctcctattccaacctggatggtggcctggagatcagggaacttttccatgctcackactacagctctgtgcaccaggccagtgccaggcacgtagtaggygctcagtgacagtttgcagaagggtggatgttacttcatttggtgcgttctgagaacttgcccaggtgcagcctggawtcgcgggtctcctatgaagtcaggagggaagaagctcggtgccgcyggccagtggcagcatcctgaagttcatgagacctccaggctgggtttgggcagggtccacgtcctgtctgtccatcccggaatgttggtgtccctgatgactttggcaaacctttctccattgacagtgatgagaagacaaacctgtctcgggccatctgcctttgtactttttgggaagtatggatccagagttagtaaggcgtggacgtgtgcagctcacttgcaagtggaaatgccaaatgtggtggaaagggacagagaaatagctgtggacattcagaggtggcccctagccaggctgagcaggattgtggagaggaggtattgcatggatctcaggggctgggtagaagtggccaggcaggtgggccaggcacggtggctcacacctgtaatcccagcactttgggacacctgaggtcaggagttcgagaccagccttgctaacatagtgaaaccccatctgtactaaaaatacaaaaaattagccaggtatgatggcaggcgcctgtaatcccagctgctctggaggctgaggcaggagaatcgcttgaatctgggaggcggaggttgcagtgagctgagatcatgccactgcactccagcctgggcgacaagagcgagactccatctcaaaaataaagaaataaaaaaaataaagaagtggcacaggtagagaggcggggggacagagttgcattccaggcaaggggagaggcaatgaaaaggggggtcaggtggggaacctcggggagcctcaggtgtatgaagtccagtgaggatggaaaagagttgtcggggcgtggtatgggggtcctctgagaagggatctgcttcagctcagaaatcccagcctgaacacatcctggatcagccaggaccccctcaggggctcgcagtggcctagtctgctctgggctttgctggatgcccttcgagaatcaccgcgcaacctccttcagaggcccaacactccacgtgctgacttcccgggcctgtgtctcccctgccgcagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcnaggcctgcgaccatacctgctcatccatgacrgtaggcctgtcggacaccaggacctcacgggggtgaaagctcccctttcccagggtggrggctgtgcagagagcctctttcactgggccaaaccactgactgagctaggccaccaacactcatgggttgggggtaaaaacctcatgggacttcctgctgggggctgggggcaggttaggacccagctctgtccattccttggcctcacaccagagggtccttagagcaggttctggatggctcctgggaggaaaatcctaggctctctttcctgatctaggatggaccaagcggccagggaattgtcaaggtggcggagttctagctcctgttgagaaagagacagagagagagagagagagagagagaaaatgagaatgagaatgaatgaatataaatgagaagctacattgaggtccatagcttctaacgtctggcaccatagccttcaactatgtgaaaaccagccctgctctttggaacagtttgcaaatggcgtaggaacaaggtttgcatcctgattttagtctgaatgcaagaacagacagcccctttgaccctcagtggggaggttttcttggaatgaagcagaaggaacaatattactggtgcctcctgaatatttaaaaagaagagacattancyattccagacacttmtccattggtccactgcaccttcttccttcctctgcacttgatatttttagttttacaaactgctaggcagaggcaancatggttttttcctttccagggcaaggtgggggctctcaagaagtggcgggtgctccctggaaagcctagatgtcgacttcatagccctggtgccagttaagggtgacaggcctggcctttagaaatcatgtttctcaaaattccttctctgtaatctaggatccctgctagtgcctttagaacatggtcttcaaagaaagaagatttaagaaaaatatcttgccccaccctccagaaaagggttgctggacccgggagtggagctggaagaagccagcaggagagggaagtgggcatccgcttggagggtggccttggccagtgaatcagacaagcagacggcaaagctgggaggctgaagggaggatgaatgcccttcctcagctgtaatcctgcatccgtgttttcaataactagacccttgttttcagacttggaattttttttttcagtcattggtggattttctgtctaacattttatgaaaattttcaagcatccaacaaagttcaaataatttttacttggaatagttttggtttttttttttggagacagagtcttgctctgtcacccaggctggagtacaacagtggtgtgatcttggcttcctgtgacttccgcttccctggttcaagcgattcttctgcctcagccccccaagtagctggggttacaggtgtgtgccaccacgcccrcctaatttttgtatttttagtagagatggggtttcaccatgttggccaggctcgtcttaaactcctgacctcaggtgatccacccaccttggcctcccaaagtgctgggattacaggcgtgagccaccgcctccggtcttacttggcatagttttatacccttcacctagattgtcaatgacattttttgatattttcttcactttatatccatccatccctccgtctgtctatccatgttattatttagatgcatttccgagtaaaatgcagacacgggtatactcccctatacacttcagcatatcattggagtttggtatttgtttacggtttttcctgtttgatgtamaatttacatacaatgaaatgtacacacgtcaagtgtacttttgctgagttttgacatatgcatgcacccatggaacccaaccccgtgaagagctagaccatcaccatcactgacagctctgacagctacctcgcaccttgcccaggtggtcttcaccccttgtccccttagaggcaaccactgtttggattttttccgttataaataagttttcctattctagaattttatgtaaatagaatcatacagtatataattgtgctggggcctccagtgctacccccaggctgaatgattcattagcaggactcacagaacttagaaaagntattacactcccagttagacttattacngtgaaagaataaagattaaattcagcgaagagaggagacacatggggcaaagtctaggagaagacaggcatgaacttccagttgtcccttcgaaatggagtcctactgggcacacttgattctcscagcratgatgtgtgacaacacytgggaagcattggccaccagggaagctcactggagcctcagtgtccagggtttttgtgtagacattagcacctgtgtgactgactttagcgactcagtctccagccccacagagtccaaastgatacagctgggccagggccgcagggatacagaaacaggtgttcactgtaagccaagctgttagcgtaaatgatctggtcagactgagagagcagggcccgaggccttgagcatacaaaaccccttatcaggtagaacattgcagtggctcagaggttatctcccaggagccagtcctgaagacaggccttttttggaatgtacagggtttgagcaacctagtcctgctgagttaaccctttccgtcacagtagtcttttgtgtaaggcttcttttacccaacgtaatgtttttgagactcatccatattrttgcatgtatcagcagtgttgttcatttttattgcagaatagtattccattgagtgaacagaccacagtttatccattcacatgttgttgatacctggattgtgaccagtttcagtctattatgagcaaatctgctatgaacattcttacacagttcttttgggtaaatacctagcagcgaaattactgggtcatagggtacatgtatgttcacctttgtaaaattctgccagacctttttttcagagggattgcaatattttacacgtcctccatctgctgcagctgttcagtatcctcaccagaccttggtgttatcagtctttttaattctcaccattstggtgggtatgaaatcgtatctcattgtgtatttcagtttctttctttctttctttctttttttttttgagacagagtctcrctctgttgcccaggctggaatacagtggtgcaatctcagcccactgcaacctctgcctctcgggttcaagtgattctactgcctcagactcctgagtagctgagattacaggcggccgccaccgtgccgggctgattgttgtatttttagtagagatgggattttgaccatgttggccaggctggtctcgaactcctgaactcaggcgatccgcccaccttgacctcccaaagtgctgggattacaggcatgagccaccgcacctggcctcagtttcttttcaatttagaaaggtcaacatctagtcctaagagagatgacagcatgtttcttctaggatctgaaaacacagatccaatgatttgatgtatccttgcaaattttcctattttaatttaaaatgggggaagacaaagaaggagaaggaggaagagagtttcctaagggagctggtgaactggacctgtggggatggaattctgctttttcttcaggacatatgtgtggggttgcctgaaatgtgtcaacggttcttacagtttgggaccagtagtgccaaccctccaaggcttgtgcrgccccatttcctcctgctgcaggctctcagtgtcttctgagcagatttcccttctcagtagcaaagctgtgggtttcctgcctgcgatagtgacctcagggagctcctggggctgatgtggtattgggatggagggtcctgggtgtgtccacctttctcctcataagccctytctgaggagccgaattccctcctctgtcaaataggaataacccttctgtgtctacctcccatggcagctgtgatgatcagaaagaaatgcatctgagaaagggggaggacatgtgaaaggtgtccctggtaggagatggggaggtaggccatgtcctcccagggctccgtggcactctgtctctctctctctttccaggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggtaagttggctccagggagagtcatttctcggtgctttagatgatgctgtgccagtctccaacttgcggaatcaggcagagaaggatgcagaaggggaggtgggaggagcaccggtgatcttcttttccctccctttttcatgctttctctcttcatttctttattcctctcctttaatcatttctttaggaaataggaacactgtcttcaggagctggttgatcaagcttccatgtggagtctagactagaagagggcgtcattgcagagggagaccctctggagatctcagaggccaagtgttgattgtcccaagtttagagcaaagaaggagaaggtgcatttgcataggatgtagcagggtgttggagaatgctctcaagggttgtctaattagtaaaacataggcttgagggcctacccagtctgggcaccgacagtctctggccacagatcactgtctctgtgaagttgtgattttgtgatcagtgttttgtctgagcctttagcacatgccttgccatctctttcttaaacaaaacagtgttggttatttttaacatttttcttacactgagatagcacatgttcattgaagaaaaattagacaatacagatgagcaaaagaagaaaccagaaagtatttttagtcccactgcacgaggaaaacacctgtccctattttggtgtatgtccttgcaagtggcttcctgtgcgaatagactattatggatggagatgttcacagcatcgatgtcacacttgaccttgttttgtcacctgttttttattgttcaccaaacaatatttgtgactgacttagcatgcagcaaatggatatgtcttggggcatggttatctatggtgtggctatcttgtatatatatatattttttaagactgagtctcgctctgtcacccaggctggagtgcagcggcgtgatctcggctcrctgcaacctctccctcccgggttcaagcgattctcctgcctcagcctcctgagtagctgggactacaggcrcccgccaccatcccagctaatttttatatttttggtagaggcggggtttcaccatgttggccaggatggtctcaatctcctgaccttgtgatccgcctgccttggcctcccaaagtgctgggattacaggcatgagccaccgcccccaacctcttgtaatttttttctttttttttttttctgcttataagtttattcaatgcaaaataaccctcaccagttttactgaggtggctgaccatgtccacgaccaaatacgcctgtaaactgaaattcggttgctgacccattcccagcctcagctttctcactggcaccagggggcagcactccatctgtgggtgtctctttctctctatggctgtctgtctgtgggtgtctctctctgtctgtgggtgtctttcgccatctgtgggtatctctctctgtctgtgggtatctctcccatctgtgggtgtccatctctgtctttgggtgtctctctttgtgagtgtctctgtctgtggttgtctctgtctgtgggtgtctctctgtgagtgtccctgtgagtgtctctgtctgtgggtgtctctcctcgtctgtgggtatctctccctgtctgtgggtgtctctgttggcttccccacttgtgggtcttgcaggtcggtcacgctccagacctttaggccgcagcctgccagtctccagaccgctgtggcatggggtagcagacacgctctccaggggcagatggtggtaatcgcagagattctggatccccatgtgggtgaggtaccagtagaaatgtctccaggcaaactccttcctgcaacctcaggacctgagagactgcctggccttcatgacgtgaaggttgggcacattctcatctgccagctccgggtcttaggcaggtggacattcttcttggctaccgtgactccctccttaaaaaggagttcataaatagcaatctggttcttcttaggcatcaacatctctgcagctgtagggtccaggtccggggctggaaagcatgatttttttctaactgatctctgctgatggcatctagattgttcctggtttttcaccataccagggctgtgatgagcatcttggtgcatttcggatgacgtctccagatacagttacagaacgagtatttttgaggttcttgaggcatgttgccaagttgtttccagaaagctgcacagacttattctgcacagcctagaattctagaatcacagggttctgcacaacctagagttctggaatcacagggttctgcacagctagaattctagaatcacagggttctgcacagctagaattctagaatcacagggttctgcacaacctagagttctggaatcacagggttctgcacagcctagagttctggaatcacagggttctgcacagctagaattctagaatcacagggttctgcacagcctagagttctggaatcacagggttctgcacagcctagagttttggaatcacagggttctgcacagctagaattctagaatcacagggttctgcacagctagaattctagaatcacagggttctacacagctagaattctagaatcacaggctcccagggttgcaaggacactttggagtgtctacctcagcatctcatgaagtgtgggaattccgaggcggtggcggaggaagtgttttccatcttcggtgctttcgttgcttctggtgacagcgctcactgcctctgcttgctgtacgggaccagctgatggaaccgacagggagggactttttatctggccattggccactgccacacactttgtgtaccccgttttgtgtaattctgactacaaccttgtgggatctaggcaggtcattgctgttttgcaagtggggttgttgaagccacaggagatgaaataagctgctgtcccccagccattgagtgctgayaggatcaggagtgccagttggtgtggctgaccccagaccctgtgcgtgttacctctaagctacattctagagcagactttttgcccacacaagccttaaatgtgggctggggacagtggctcacgccggtaatcccagcactttgggaggacawggtgggcagatcacctgaggccaggggttcaagaccaggctggccaacatggtgaaaccctgtctctactaaaaataaaaaattagccaggtgtggtggtgcgtgcctatagtcccagctactcgggaggctgacgcatgagaattgcttgaacctgggaggcagaggttgcagtaagtcaagactgcgccattgcactctagcctgggcgacagagcaagactccatctcgaaaaaaacaacaaaaccttaaatgtatttttgaggctgtgtttaaaaatggggatattttacacaaaatatccagatttctggattcttttgaagaatcagaagatctgacaatacggagcctcacattcctgcacacacagcagccatcgctggarccactgcctccattagtttgaatttactgcagaccccactcctccctgtcgtccctgtctccagaccacagagttagttgtcattgatcgtgtgccatttgttgtttttttcaaagtagagaagtacttcttcacgctgtgtctctatcaaaaatggacaagtgaaagatgtttcaagaaatgaaaagattttctttttagtgacaaaaaatttctagtatgtttctcatataaataaaatgtgtcctgtatgtagtcagggttcctcagagaagcccgaagctacaggatatagatatgtagagagattgtggaggcttggcgagtccaaaatctgcagggcagggctggcaggctggggactcaggaatgcgcgcagcagagtcgtaaggctgtgtgctggtgggattcttgctcggggaaggtcagtctttgttcttgtaaagcctgcaactggttggatgtggtccacccacattgcggaagggaatgtactctcctcctagttcaccgatttaaatgttaatctcatccaaaaacaccttcacagaaacatccagaataatgtttgaccacatatctgggcaccgtggcccagccaagttgacatattaaattaacccttgtagtccctttttaaacttacacccattgcaatttaggtcgctgctatggagcaagccacagaacctggcctcttaactcatttacccgggctgacccattaggcctttgagtcaccaacacctcactagagaacaagcataatgaagaagctctgctgtaattcgttaatgttaacacttttttctttaaagatgtctcatgctgagcttcgtggcacacgcctataatcccagcactttgggaggctgagatgagaggatggcttgagctcagaggttcgagaccagcctgggcagcatagtaagattccgtctctacaaaaaagaaaagaaaaaaagttgtctcataattattaaaaaccactattccagatcatggataataatagtcagaacaggtatattgttgaaaaagaaaaaaaaaaaaccggaagcagtcgctttcagctttgtaataccgcagcaaatgtcatagtagacaagggtttgtttaaagtaggagattagtggcgtctctgctgatgggggttctgggtgtttaaaaaccagagaaaggaaccggcggttttagggactaggtcccagcttctcaggacagcctgaggaccccccaagagctgccatcaccatgccgtcctcggctgtgggtcactgctggtgaggtccatcctgcactgcgggacacaggggcacaggctgagcggtgcccaccaaggaggcaggagcagcgggtggaggcgccggggcagactgtccctctcctggaaatggagtgatttacatttggcatctgtttggaccccagagtgggaattggctttgtaatttcttctgtcatgccgctctcagaaaattaagctgtttacccgacagactatggaaggttaacggctcttctgggaaaggtcaagtggtcatttgcagggaggctgtgctgaataatctgaaacggcagaagaataaagcataaaatcgcatctgactcctcctcccgggcttccccctttctttccagcatccacgggttcctctttgtggctagaacattcacgtcctaagtggggctgccgttggctgggttaaaccagtaaccagtaacaggagaaatacgtcgcatctctagtgtgtggagattaccgggcctttatattaaaaaaaaattttaagtgcttatatttgctctgtctctaaaaaytgtttccaggtaacagttggcctcaagatgcctttttgtttttctgaatgaataaggaataaagaaaaattctgggcactataaaatcaagcccagattcagttttttaaaaaataaacgttaaagtttctcattttgatttctggaagttcgtgttctccttggactctaaagattagcatgcaaagacaaggttttgattgtgtattttcagttgcacgttcagtttttttaaaatcccatccaggactaaatttaaacataagaaaatccaggtttctttcgctttcgaagaggctgcagggaacttgaggccagaggaagtggcgccgcgtgggtccccttaggaggttttgccagatgatgggaggtgcttgctcccgtccacccaacctgtagctcctccagccggccccagggtagctgagggacaggggtctgggcccagaagcccccagaatcctcagctccaaacagagctgtacctgtcgcaatggagtagttttgttgatttcaggttttcttttgttgctgggtaagcatttcctgtgtggggtatattctttcctccgtcctggcttacttccacacatcacttcattagggaggccctccctacccacctcgatgccctccttctcctggcacaggtgggcaggaggggacgagggtcatggcctttgagggcctgcagagggccttgcctgtggtggcgtggccaccctggtcctcagcagggtgctcagtggattccaaggtgcwccctggacccggacctccccttcacttccttttagctcaggtctcagctttccatgcctctgctgcctccctgaacccagcctgtcccccgccctgttcaagcagactgcccctcccctgggtcctgccctttaaagtttgtctgtgggcttctttgcttccccaccagactgtgagtccctgtggagcaggctggggctgggagtatccctgagtcctgcaaagggctgtggagcatctgggatcgttaatgccaagggggaccaaggtaacctgggccatttgcagcaccagccagtgcaggccccaggacccggtgtcccctcactgtttcctgagaactctggaccccactaaggaaaccatcagaccaaagtagctgattgtccaactgggaaaaagaaaaagcagtacttttttaggccatgtaaatgcaaaatatacatttgaagtctgcgtttaagacatgaacttagagatttrtaagcctgtttttgggggtcactctaaaagggagggcattttcaggtcccccctctgtgagcattcacagcatcccagccagcctgtatccctgtgccgtgaccccagagcacagagcctcagaggctgtggaacaggcctggggttcacgtggagagtcccaagcccacgtcatgacaggagatgcccacaccttcaacaaacagactccaagctccaaagctgcctaacaggagtggcagggggaccagccctggcaaggcccaggtttggctgaagcccgtacctgcagcccagcttgtaagtttagccgggaagcatctgaggcaggcagtggaggacgcacaggggtgagcggttcatctcacaggtgtggctgggtgcctgctacagcttcaaggcatcaggtggggcagaaagggacaggcagggtgcccaggagtggcggagctggaggaagggcacagccccagggcagctcccgaggagctcagttctcacaccccaggtggtcacagaacacatttcagcccccaaattgaacagggctgtgttcattttttccttcccccagctcatcttattgcttgtgtcagcctgggtgaaaggttatttataataatattctcctgtctcatctgggcagcttctgcatggaaggtaccgagttaataactttgcatgcgttattttgttcaagcttcacagcaatccgtgaggtaggtattgtttgttgttcgttttgcccattttacagattaggaaactgaggcccacaggcgtaagcaacccaaagtcacaccgttagaaggcagtgagatctgaatgctcaagtcagcatgcgctcttcttccctctcgttttctgcatacgtgctttctccacgtctcccatatcgtaagggcatggcaggaggagagggaaactgatgtgatggtggatggcaaaacattttagtggttccaagaatcaagcccccttgtgtattcttggctttcaatgaactgcgtcttcagagcagcgcaggttaaaccactttctcgcctcattgtagtcaattggcttagttcagccagagccaggtctggcccaccatgtgtctggactgtgagtgccttgaggctcagtgtgacgcgatcgtagggtgagcctggccgggctgcagccagccaccaagccagccctgggctcaaagagcagtgaggccattttgagagaggaatgctccctcgtgcagagcctgtctccacctccatgagacgggaaggaacagtkgtcttctcataaaagcatctggcgcccatgaaacctggcacctcgcttgacctccggctaacgggatgcggcagggtgctgtggaactaatggagttctcttcttcagccagcaattaggggttaattattagcaattaggggttcgccacataccccgtggacctgctgttccttcccaggacacaggtcacttgtcattctctgtgttagcaactgaaaccgtctgccttctgggtcccctgttaatcattgcagcagggtccccacgagtctgacagcagggttgcgttctgtgcgacctgtggcatccctggagctgctggctgctgcgctcgccccactgggtgtggcggcctgccgcccggctctgtggtgctggtcccctgcggtcattctcagcgtagcgcctggactgcccctcagccgcrgcttggctctgcagccagcgggacaggcccggcgctcagctcccgatacttagcatcctgcggtcagctccccgtgctcagcatcccgtgctccgttctgctctctcctaggcgttactacaaggagacctctggcctgatgctggacgttggtccctacatgaaggcgcttgaggtaccagccctggttctgtcccaaactctcttcagacctcagggcacctgggactttttgggtctttgttgagaagaggctgtgcttaattaacgtacaaatggccttttgggcttccacaaaggctgccttcctattctgggctcccctggccgggccctcgggccctcaggccctcagctgtcctcctccctccccatctctcccttcccatccttcccatcctccccatcctccccatcctccccatcctccccatcctccccatcctccagtgggcgcagccccccctgcccgccgtggaccctgccgctctcccagctgctctctgccacactcctctcgggcttgtggcttctgtatcagtgctgaccaccgctctcattcctgaccctgggcatctgcagcacctcaagcttgacgggtcctcactggcctccttcctgacttccccttcagtttccaaggccatctgtggccaggcctccgggtggggctcccctgggtccactctggcccaggtcccattagctgccccaggtcagcctcacatcccgtcccatcctcacagctgcagcccctcctgcctgcctgccgtcaggtgggagggagaggcagacgagcagatggagccctgtgatgagctgcgagtgggcaggggagaagagggggagaagggatgagaggacggaattgcaggcgagtgagcagagcactgctctgctggcccttgggagccctgtagttttgccagctcttggatgccttctgctgtgggtaggcctttgagtggatggcagggtgcctggtgctaggggacctgagtgacccgggcagccctttctggagttgtgaggctcctgcctgtgagatgagttctcaggcccacagcatcctgcttcttcaaggcccttgactcttgggggcacatttgggacagtgtttccgtggctgggcatacacctgttccttgatcccaaacttatgccatgtccctctctcttttcccagtatgcctgtggcatcaaagccgaggtggtggggaagccttctcctgagtttttcaagtctgccctgcaagcgataggagtggaagcccaccaggtaggttggcgccttgtgaagtgggtcaggggaggcagccccgtcagggaggccgccccgtcagggaggccctggagcttggaatggattrcaggactcaggcagcctgtggggttggccaggcagccaagcgtgggctccctgtgaaagctgacctggctgggaaggagggggaagacagcaaacgaaatccactgaatagtttcaaccgtgaagttactttcagtatgaaagcaagaagcagaaatgcctgcggcttttcctgagtttttgctgcttctctgaaaggataagaattgacaagtcctatcagtgtgttaatatatctcactggcaagacagtgtaacagcaagattacaacaatatggaggaaataataaagtcactcattttgcgacctttatattttgactattttgggatagattgcctttcaaacttccaaattttagaaaggaaaaagaatcggttatgattttattgtctacacctaccccaaccctaagtgagtctggcttcgtcctccagtgggttttcttttctttttcttttttttttttttttttttttgagccaatgtctccatttgtcaccctggctagagtgcagtgtagtggcacagtcatggctcactgcagcctggacctcccaggctcaagcgatcctgccatctcagtgcccccttaacccccttactaaccaggccccccccccgccaaccccaactgagtagctgggactacaggtatatgccaccacgcctggcaaactttttttttttttttttgagacagagtctcactctgtcacccaggctggagtgcagtggcgctgtctcggctcactgcaacctccacctcctgggttcaagcaattcttctgcctcagcctcctgatgagctgggactacaggtgtgcaccaccacaccagctaattttttatttttagtagagacagggtttcaccatgttggccaggctggtctcaaattcctgacctcaggttatctgcccgccttggcctctcaaagtgctgggattacaggtgtgagccaccatgcccagccccggctaacttttgtattttccatagagatggggttttgccatgttgcccaggctggttttaaactcctagctcaagccgtcctcctgcctcggcctcccaaagtgctgggattacaggcatgagccaccaacacacagccccctccagcaggttttctgaaagattgtaaggaatagtgggcagccggcatggaggctgacgcctgtagtcccaacactttgggaggctgaggcaggtggatcacttgaggtcaggagtttgagaccagcctggccaatgtgatgaaaccccatctctactaaaaatacagaaaaacaaaaaaaattagctgggcgaggtggtgcatgcctggtaatcccagctacttgggaagctgagggatgagaattgcttgaacctgggaggcagaagttgcagcgagccgagatcatgccactgcactccacctgggtgatagagtgagactccttctttaaaaaaaagaaaaaagaaacagagtccacagctgccccaggctgtcctgctgcctcctcagaagtgggcagcagaagcatgggttgggggtccctcaggtgtcaagcctggtgcatgtttcccctgtgtgcatttcggtccagaacactggtgcctcatggtgctttgagaaagatggcccaaagctgccaaaatctagacactgcacctgcacctgccctgagatccatagagatgtcagaagatgcaggctgtctggagtccccagaaaacacctgggaaatgtcacattagtctgttgagaaggaaaggtttgtgttttgaatgagtgagaactgcagcaataaataacctggctttttactaccttgcttcatagggcagaatttctttttttattagagatttcaaacatacagaaaagtagagagaatgatacagacaccccattatatccatcatccagcttcagtggttaagattttgccacattcctttcttctatcctcttttttttccttttaaaaaatttactggctgggtgtggtggcccacgcctgtaatcccagcactttgggaggctgaggcaggtggatcacctgaggtcaggagttcaagaccagcctggccaacatggtgaaaccccgtctctactaaaatataaaaattagccgggtgtggtggtatgcacctgtaatcccagctactcaggaggctgaggcaggagaattgcttgagcccaggaggtggaggttgcagtgagccgaaattgtgccactgcattccagcctgggcgacagagtgagactctatttccaagtaatagtaatagtaatgataataataaatttacttatttttttgcttcatattttaaagcaaatctcaattgtatcctttcatgttgtagcatgacatttaaaaatcacgatttttggatgtaaatacaatacattaaaactcctaacatggccaacaggcatacaaaaagatactcaatatcatcattcatcaggaaatgcagatcaaaactccagtgagataccacttcacactaagatgactgtatagttaaaaaaaaaaatagaaaataacaagtgttggcaaggatgtagagaaattggaacccttctctattgctgctgggaaggtgaaatgacaatgctgccacggaaagccacttggtggttcctcaaagttaaacatagaatttgccgtatgactcagcawcccatttccaggtctatacccagaagaactgaaacacgtgttcaaacaaaaacttgtacacagatattcatagcagctccatacacaatagccaaaaggtaaaaaaagccaagatacctgcccatcaactgatgaaaggataaccaaatgtggtatgtccatacagtggaatattattcagccataaagaggaatgaagttctgacacatgctacagtgtagatgaaccttggtagcattatgctaagtgaaggaagccaaacacaaaaggacacatattgtattcttccatgtatagcaaatgtctagaatgggcaaatccatagagatggaaaggagattagtggttggcaggggtcgggtgcaggggaatggggagtgcagcttcagggtacgaggtctccttttgggatgatacaaatattctggaactgggccgggcacagcagctcacacctgtaaccacagcactttgggaggctgaggagggtgaatcacttgaggtcaggagttcgagatcagcctggccaacatggtgaaaccccgtctccactaaaaatacaaacattagccagacgtggtggtgtgcacctataatcctagccactcgggaggctgaggtgggagaattgcttgaacccaggaggtggagattgcagtgagccgagatcgtgcaactgtgctccagcctgggcgacagagccagactctgtcttaaaaaaaaaaaaaaaaaaaagaaaaatattctggaactggacagtgatgatggtggcacgacgttctgaatgtgctcgatgccagtgaattgaatactctggtcacggtcataaattttatgtaatgtgtattttaccacaataaacattttaaaaccacctaaaaaattaacagtgatttttgttagtattatttaatagcaacccatatttaaatttccttgactgtctcagaaatgctcttttaccgttgatctgttggaatccaatctgaagaagctccgtgacttgtgtgtcgtttttatgttttctgagcctctctttttagccctccatcatagaacatttgaaatatctatgtcagtagagagggcagctcagggaactcctaggtacccatcactgtgctttaataattatcaactaataaccactttaaaattgttttcaacttttcattttgaagtaacttgacactcacaaaaagttgcaaacatagtacaaaatgttcacgtgtaccgttcagcagcttccccatcatcatcgagcagtgataaaaccgggaaatcaacactggcacaaggcggttagctaacctagagagcttattcagacaccaccagtcatcccactcatggctttctggggacacgttgcatgtagcagtcatgaccctagtgtcctttatctgtgaactctgatcacctgttgaggaggtgtcttccagagttctctactgtcattgctatttgtccctttcagtaattatctttttttttttgagacggagtctcgctgtgtcacccaggctggagtgcagtggcgctgtctcagctcactgcaagctccgcctcctgggttcacgccattctcctgcctcagcctcccaagtagctgggactgcaggcgcccgccaccatgcctgagtaatttttgtttttgtatttttagtagagatggggcttcaccatgttagccaggatggtctcgatctcctgacctcgtgatctgcccgcttcggctcccaaagtgccgggattacagacgtgagccaccacgcccagccttttttttttttttttttttttttgagcaggaatctcatcctgtcacccaggctggagtacaatagcatgatctcagctcactgcaacctcctccacctcctgggttcaagtgattctcctgcctcagcctcctgagtagctgggattacaggcacctgccaccaagcccggctaatttttgtatttttagtagagacagggtttctccatgttggccaggcttgtcttgaactcctgacctcaggtgatctgcctgccttggcctcccaaagtgctgggattacaagcgtgagccactgcatccaaccctaataagtatcttgtgggaaagttctttgacactatgtaaatattctctttctgatcattagttctaattttggcatctcttgataattcttttatttttttattttttgagacagagtttcactcctgttgcccaggctggagtgcagtggtgcctgggctcaccacaaccccctcctcctgggttcaagcaattctcctgcctcagcctcttgagtagctgggattacaggcatgtgccaccacgcccatctaattttgtgtttttagtagagacggggtttctccatgttggtcaggctggtctcaaactytcaatctcaggtgatccgcccgcctcggcctcccaaagtgctgggattacaggcatgagccaccacatccggccttcattggtgtattttatgtgtggcccaagacatttcttcttccagtatggtgcagggaagccaaaagatcggacacccctgctctagaggtttatgaccaaaatactgtatttaaagctgctgggaataattcttttttgtgggtggtattcccccaagtggacgctctttgaattcattttcattttgatgtttagggaattggcttaacatttacatttgttttgtagttatgtaaaacatttatatggttctaaaatcaaatccacaaagcaagacatattcaaagaagtccaacttcttttccttctattttgtttttacctgtctctggtaggtagccatgtttataaatattaaagctataaatattttataaatattatagctttttttatttaaaaaataagcaactatgtatatatttgtattcccctcatrggatgaatttaagagacaaattctcaaaataatgtgttttatatatagagagaaaggctaatgctttaagtttaaaaatcagtatttaaaagtttataagtaggctgggcatggtggctcacacctrtaatcycagcactttaggagtccaaggagggcggatcacctgaggtcagaagttccagaccagcctggccaacatggcraaaccccatctctactacaaatacaaaaattagccgggcctggcagcaggtgcctgtaatcccagctactcaggaggctgaggtgggagaatcacttgaacccaggaggcggaggttacagtgagccgagatcctgccactgcactccagcctgggtgacagagtgagactctgtctcaaaaaataaaataaaataatataagtggtatgatcacaaccatctcaaacagcccccttcccccgacccaaaacccaaacaaaaacaaaaccctgccactgcctggaaaataagacctggccaggtgccatggctcacgcctgaaatcccagcactttgggaggccgaggtgggcaggtcattagagcccaaaagtttgagaccagcctgggcaacacggaaaaaccccgtctctacagaaaaaatgcaaaaaaaaaaaaaaaaggcagatgtggttgcatgtgcctatggttccagctacttggggggctgaggtgggcagattgcttgggcccaggaggttgaggttgcagcaagctgagattgcaccactgcactccagcctgggcaactgagcgagaccctgtctcaaaaaaaaaaaaataggaaagcaagaaggaaggaaggaaagaaggaaggaaggagggaaggggaagggaagagaggggaggagacgagactggctgtccagatggcattgctggtgatatttggatggtctgaccttgggtggtctccctgcctttttcttgtggcattttcagttattttcacagtcagcttccttcacatttcgaatgagatacagcccacctcaccgccgaaagaagacccctcatgggggtctggtgaatctgggtttgtcgttttcggatgctggggcagtgcgtctgggagggagcgggsctgtggattcctggtgggtcaccgtggctgcttgaggctttggtccctgccgctgccatccaccctgagcatctgtggccctggagagcgaaagacttgtttcctctggtggntccgagcatatgtggcaaagctgtgtcttatttacctcccacatcatcatcctctcctaccctcatatgacatttctgcctgtccccttgacagtggagtagcagctgcatgttccgaacgtccccaccctgccattttcctaaaatgctcactaacgttatttgactctcaggatgtgtagacattttaaagctgtatttcaagataaggccatttcaaatgaactgtgtcttatgcacagggtaataattctctgttcctggcttttttatttttaatgaaaaatgcctgcaaggacctctcttgctgctgaatgccaggctgtggcaaaccttaaatttttccagctgctttaatcaataaagttatcaccagtcatttcccttgatcactgctgcttcccgagaccctgacctgcttcttgctgctgagttttcagtctgcactcagaatagatataactccccaaatccaattttcattttaacctttcctcagtggcctagaaatcacagattgctggtattaygctaatagattggaaattcaaacctcttagaggcaacctggccctttctaggattcagtaataaggcaaagaataacataccttaaaggttacttctagaaatatctaattctcacggtttmagcttctgaatcagtggatggttttatagcttcatatgagcacccaagtgatgtgaaggttttggcagttctccatcatcataagaagttctgtgggatgcaaatcctgcaggtttagtggagattgagactgttcaaaccagagcacttagttatatgtgacagccaagaaccctcgcctggaggggcccgtttcacaggtgaggagcctgaagcttagagatgaaacaccttgtcataggcgctttgcattcccaccatgaggttaagacaggatttctcaggctgggcgcagttgctcacacctgtaatcccagcactttgggaggccgaggtgggtggatcacgagcccaggagttcgagaccagcctgggtaacatggtgaaaccctgtctctacaaaaaaatacaaaaattaactgggcatggtggctggcacatgcctgtggtcccagctgctcaggaagctgacgcacgagattcgcttgaatctgggaggcaggggttgcagtgagccaagatggtaccactgtactctaggctggacaagagagtaagaccttgtctcaaaaaaaacaacaaacccccccccmaccccgcggtttctcaacctcgacacttggtgtttttggactgggtcattttgtggtgaggggatgtcctatgcattgtagggtgctaaacagcatcccactgtccgcccactacatgggaccacccccttcccaagctgtgaaaccaaaattgtctgtagacattgccagatgtgccctggggagaaccgcagcattaagcggtattaagagaacggttacggagaactctagtactgaacccaagattactttgccaatgaggagtgaagccaggcaccaaaccatcgtcttccagccccntccagtgctctttgccatagcccaactctcagggaggaccagcggtgcagcagaatttcttagggaggtggggagggtagggaggatttcaggttggggggtagggaagatttcaggttggcgggtagggaagatttcaagtggggtgggtaaggaggatttcaggttggggggtagggaagatttcaagtggggtgggtaaggaggatttcaggttggggggggtagggaggatttcaggtgggggggtagggaggatttcaggtagggggtagggaggatttcaggtggagaggtagacaggatttcaggttggggggtagggaggatttcaggttggggggtagacaggatttcaggtgggggggtagggaggatttcaggtgggcgggtagacaggatttcaggtgaggggggtagggaggatttcaggtcggggggtagacaggatttcaggtgaggggggtagggaggatttcaggtgtaggggtagacaggatttcaggtgggggggtagggaggatttcaggtgcaggggtagacaggatttcaggtcggggggttagagaggatttcaggtgggagggtaggcaggatttcaggtcagggggatagacaggatttcaggtggggggatagggaagatttcaggtgtggagggtaggcaggatttcaggtcgggggggtagacaggatttcaggtgggggggtagggaggatttcaggtgtggagggtagacaggatttcaggtgggggggtagggaggatttcaggtgtggagggtagacaggatttcaggtggggggatagggagtatttcaggtggggagggtagggaggatttcaggtgtggagggtagacaggatttcaggtggggggatagggaggatttcaggtgtggagggtagacaggatttcaggtggggggatagggagtatttcaggtggggagggtagggaggatttcaggtgtggagggtagacaggatttcaggtggggggatagggagtatttcaggtgtggagggtagacaggatttcaggtgtggagggtagacaggatttcaggtggggggatagggagtatttcaggtggggagggtagacaggatttcaggtgtggagggtagacaggatttcaggtgggggggtagggaggatttcaggtgtggagggtagacaggatttcaggtggggggatagggagtatttcaggtggggggggtagggaggatttcaggtgtggagggtagacaggatttcaggtgggggggtagggaggatttcaggtgggggggtaggcaggatttcaggtcgggggggtagacaggatttcaggtggggagggtaggcatgagggctgcagtgatcttcatggctcgcaccctcagaactgcctgtgaaaaatgggggtgaggtttgcaggcttatccagaggcctggccatataaactcaaaggtgccctaccatttcgttccctgattctcagggcatcagtcctgactataggggtctggggacagtctgtacccctagggggaggctggtgagtggggagtacatgtctgtccacatgggggccactccggcccagttctttctgctgtggcctccctcccccatgggtgtttccactgaggcctccccacgaactctgttggctgagccccacctcccagccgtgggcattttctttggattgtcagtgtggggatgaccctgctcaactcctgactgggagcaggctggcctgctgggccrtgcccacttccagcactgaaagaatgggcccaggacgggggtcagccctcctgcagccctggtttgaattggaaactctgtccaccgatgcctggcacctggcacctagccctgcagctgtgggtctgaaactgacgggagttgcaggagcttccggccctggctttgtctttgtgatgtgtcctagtcataaggtgctctgagacctcatggcttagttttccttcagagttttttctcccttggaggcttttttttttttttaagtagattttattttcttctcaaaacacaagtatttaaaatatctgattatgaagcaactcatgctcattaaaggagctaagaaaaattcaggaaagtacaagaagaaaagaaaccactcatttcaccagcccagaataacacaaatcatgcttgatcttgccaattttttgtgtctatatatacatttttaacacaaaattgggataatcttgtatctgctgtttgaaatctgagttttcccccttaatatcctattggggacaatttttgttaacttatattttaggttcagggatacgtgtgcaggtttgtgatacaggtacattgtgtgtcttgggggtttggtgtgcagattattttgtcctccaggtcataagcctagtacctgttggggtagtttttcaatcctcaccctcctcccaccctccaccctcaggtaggccctggtatctgttgttgccctgtgtccatgtgtattcagtatttagcccccacttataagtgcaaacacacagtatttggttttctgttcctgcattagtttgcttaggataatggcctccagttccatccctgtagctgcaaacgacatgaccttgttcttttttaggggacagctgtctttgtgcttattgaagcactttaacgaagcagttttcacagctgcatactattccactgttcagactcccgtcatattcttgaccattycctattgatggagatgaggctgcttccagtttcgctcttgtgcgtaaccctgatgaacacatcttgtatgtacatcctcttgtacatttctaattatttgctccaaatcctagtggtgtggctgggaggctgtgatgcatgttgcttatttctgtttcagaaaggtgtgtccgttcaccttcctgacctgctgcgtatacagatgcttgtttccccacatccttaccaacaccatgatttctggctttttttttttaaagtggtctttgagttttgctgttagtcttgttccttatgaaggtgtccgaccacagtggcaatyactcagcattgcactgtctccaggtctctgtgggagcctgggttcctttggggcctggattcagggctcatcctagagtgagctgtcatctcagggcatctccctgggggatatgtgcmccccrgagctgcagttacagacactgagctcactccaccttcaccacccagccctgctgcttcccgccctaatcctcctggcagagcccctggataaggaaaatatttgtgaaccacggaagctctttggtgctggaattttgcactccaaagcatcgccgcctgttagatgatgtttccctccagcacctaggacactgaagaggagaccagggcaggcaggcagatgcgtaagagggaggattgactgctgtagcacccgacccaggacacctgcctctgggactgtggcgcctccatccggctctctggatcctgggttctggggggtccgacctttcatttttttctccgcctcacaccccaccatgtcgtgtctgaaaggaagcgaagcccagccctggcaggtggagtatttttatttcccctgacagcgcacctcctgacctctatcttcttgccagtgattttttaaatcctaaatgatttggcaataattgctcctccttgcgtgattattgcccttcaccgatagtaaatctgggaatcccctggggtcctgagcgcactttggtatgcggagcccacaagctggcctggacaggcatcactgctccaggcagctgtgcacccagccggccctggcgtcccggcccccagcctccgcctccctcgccgacagcttcccggggctctgcctggaggcagcctcgctttatcccgcagaacctccacgctgttcctgcatgagaactcttcctccaagagaccacgttcctctggtcctgtctccgtgggccacatccacaaatgttccagcccaggaagaaccaagtctgtattctgggagggaaacctgtgtgctgtctggttttgtatgtgggaggagcatgcacacagtttcattttccccggaagcatggaggtgtaggatgacatgtaatatttggaagacccattgcatttccaaggaaccttctagcaggatggccctggagtctctggcagcagtggacatggtcctgaattggagtgctgtgaatgttcactgctgacctcacggtttgaagacaattccttgagaagggcagaggggacccgaatacgggggctctggccggccctgctgccagatgccagcagccgtgggggcttgcccggccagccctggcttttcccaaccctcagagtgccccttgtgcatgcagcagacactggtgctggtcccattcccgggagcacgcggtgccactggctgtgtcttgcctggccaggtgttggtttgatagactcgaaaacctcatttggatttggcaggattttccctaacatcagtcattctggaaaaaacactttgaatttttaccatatctgggtatttttaccatatctgggtacttgccactagctctatttacttcacgtttcttaaaattgattcattttattacttaaataaatgtattttaaaaggaacttttgatgactactataaatggaaaaccagaatctctcacttaccataatagattaatctaaaaataaagaccacatgattacattaaaatgtatgtccttgctctgcctggagtcaaatagtatgtcacccgtgtgcatgacacactctgggaagcacaggggtgggtggaggaaagatcagagaaaatccgtggaaagtatgaagtagagagcaccacaccaggaagacgtggttttatttcagtacctcatgtctcgcggtggcttgcggctaccagtaactggcagaattctcaacattgtggccctcagccacctcctccgagctctctctcagcaccaccatccgccgwggcttctctgagggaggcccctctggcctctgcttgactatgatacatgtcgagtccatgccgagtggcagaaaagctccgttttcagctgaaactacctccctggcctcagggggcctcattggctctgtctttgtactttctcaatggctcctgatgattccttggttatctgaaggcctgtttgggagacggttcccaggacagttgcttcaggcttatatgtgtgtgctttctggaattcacagcatggcgygcccyggtgartggtggggagatgggtagtgaacacgtgtggtagcccctgctgggcgtgtcccacctgtcctccatgtcctacaacctggttggccccttttgcttgtcagagcaaagctcagaacctcacctcctctgggaggcctttcctgaccacccacaagcccagtaggtcaggaggtcaggcctcacagcctcctgtgtgttatcccaggccctgatgatgagactgtggaattacctgattaatgtctgtctttagcacttgtcgtgagctccgtaagtgctgggactgcatgtgtctgattcacactgtgtgcccactgcctggcctggcactggcctgcgaaggcctagggcaaaggtatcaagtaaccagggcaagggtgcctgttgcaggtcgggggcctctctgatgtggtgagatagggaatttcctcaacgaaacatttcctcatgtttctgtttcctttgtaacatgtttaggccgggcgcggtggctcacacctgtaattccagcactttgggaggctgaggcaggtggatgacttggtcaggagatcaagaccatcttggttaacacggtgaaaccccgtctctactaaaaatacaaaacaaacagcggggcatggtggcagccgcctgtaatcccagctactcaggaggctgaggcaggagaatggcgtgaacctgggaggcggagcttgcagtgagccgagatcgcgccactgcactccagcctgggtgacagagcgggactccgtctcaaaaaaaaaaaaaaaaaaaaaaagtttaggtaatgtattatgtcctggccctgtgctgggtgcttcactaagatgatttcctttaaacgccacacctgttatacccattttacagatggaggtggaggctggcccaaggtcacacagccagcaaacaggagagctgggatctccaccccactgctctagctcagcgtgagacaggagtgagtctgtgcatctgctggccacatcgggcccgccccctctttctgtggtccccttcccccagatggagagcaaattccacctggacccgtccttgcaggcagagtccaaatctatgggacacacactcagtaagactcccctggcttgggcatgcttcatagtcatcgtttcattttgtcttgattttggtttgtgtatttatcggttagcccctcttagcatctgaattccagtgagaagacatrtagtttgtttgtttgtttgtttgtttgtttgttttaagacagagttttgctcttctcgcccaggctggagtgcaatggttgcaatcttggctcattctcctgcctcagcctcccaagtagctgggattacaggcatccgccaccatgcctggctaattttttgtattttaatagagacgggtttcaccatgttgcccaggctggtctggaactcctgggctcaagtgatctgcctccctcggcctcccacagtgctggaattacaggcatgagycactgcgcccascttttaatcagattttggagtaggggagtgagaggagctggttggtggtggtttttttttctttaaaattattattactttttttttctttaaaattattattactttttttttttttttttttttgagaccgagtctcactccatcgcccatgctggagttcagtggcacaatctcagctcactgcaacctccacctcccaggttcaagcaattcgtgtgcctcagcctcccgagtatctgggattacaggtgcatgccgggctaatttgtatatttttagtgaagactggtttcactatgttggccaggctggtctcgaactcctgacctcaagtgatccacccgcctcagcctcccaaagtgctgggattataggtgtgtgctaccactcccagctgttttttctttaaattacatatatttatttatattaaaaaaaaaaaaagagcatgagtccatttaagcaataacacatgttaatgtggcaaaaggagacccacaaatgactgacgtttcagccacactggygaggactgtatgactccctccactctatgtaggtgaccaatgggaagtcttgtttgcgcctcataagtgtgtccagacacagccagccgtgccgtaatgcagagcactcagctgctcaagacacatttgctgagcgtcaaccaagtgccagttgtcaacccagattccttgtcctgaaggagctcctacttctggaagggtgggatgagcagagtccattatgctgcactatgacacgggtggcaccagggtgtgatcccagagtgctttgggagagccacacaacccagcctgggggcagaggaaaggtggtggtcaccagagctgagtcctgaaggcctggggggaattagccagcagaggagggaggtgagcaggcagaaggtcagcacgtgcccacaaggtaattttctggtgttgatgtgtatttccagytattgtcattttcccttcgcccaaaggacttcttctacatttcttgtagggtagatctcttggtgatgaattatttccgcttcrgatgtctgaaatatctttatttcatcttcattttggaaagatatttttgctgggtacagaattctagatgggcagttttttcttttactgcttaaaagacggcactccacagtcttctcacttgcattgtttccaacaagaaatctaacgtcttaatcttcgtttctctgtacataacatgtctcttttgtctgactgttttataagattttctccttgtcactggctttgagcaatttgattatgatgtgccttaatacagttttctttgtgtttcttgtgtttggtgttcattgggatcttggatctgtggatttattatttttatcaagtttggaaaagtttcagtcactatttcttcaaatatatttatgtcttctctcatctcactttttttttttttwatctaatttagagacagggtcttgctctgtcgctcaggctggagtgcagtggcacaaacacagctcactgcagtctcaaactcccgggctcaagtgatcctcccacctcagtctcccaagtagctgggactacaggcgtgcgccaccacatctggctaattttttaaatttttatagagacagggtcttgcggtgttgcctaggctggccttggactcctgggctcaagtgatcctcccacctcagccttccacagtgctaggatgataggtgtgagccactgtgccccagctcatctcactttgaggaactctaattgcgtgtacatcaggccgcttgaagttgtgccatagctcactgatgctctgttcatttttgaaaataatttttctgcctctgtttcattttgggcagtttctattgccatgtctccaygttcattcatcttttcctctgcggtatctcttctggcattaatcccacccagtgtattttgatccctgacattgtagttttcatctctagaagcttggtttggattttttcttttatcttccatttctctacttttggaacacatgaaataccattacaagggctgactgaatgctctcgtctgctcattctcacctctctgtcagttctggctcagtttggataaactcatctttctcctccttctgcatgatactttccttctttgcacgtctgatcattttttattgggtgccagacgtgatcaattttaccttctttttgggtgctggatatttttgtgtgcccataaagaatttcgaactttgttgtgggatgcagttaaattacttgaaaacagtttgatccttccagatcttgctgttaagatttgggggcagcaccagagcagggttgccctgggtgaatcattcctcatagtgaagccagcggcttctgagatcgcactcaatgccctgtgcatcgtgagtgagctttcccagcctggctggtggggacataacgcagtcctgcgtgagacacaggcaccgttttccctagttatttggtgtgattctttcccaggctcagggagtttcctccctcacgtgtgctggcagtggtctgctgagtacttgaggggaccctccacgatctccacagctctttctccatgcagccttctcctctctgattccctgtcctgtggactctgctcctgggtctccccagaatcctagctttgtctccccagttcagggatcctactgggctctacctgggtttcccttggtattagtcagcccagtctgtcatacaaaacaccacagactgtgtggattcaacagcagaaactttttttctcactgttctggaggcttgaagcctgagatcagggtgccagcaagtccggtttctggtgagggctctcttcccrgcttgtagatggccgccttcttgcagtgtcctcccatggcctctcctctgtgcttgcatggagagggcactccagtgcctcttcctctggtaaggacagcrgtcccatcagatcagggccccctctgacctcattcgcccttaaagaattacctccttacaggccctgtctccaaatacagtcacgctgcgggctagtgaatttgtgggggacacacttgagttcacagcacccctcctgtgtccacagtctggaagcatcgaaggcagtaggctgggggcagtcacaggagccacctcatttgtttcctgcgtctcagaagtcattgtccttcgttgcttgatgtccggtgtcctgaaagctgttggttcataatttggttttctggttttttcaggtgagagagtttatcccagaggctagtttttgaaatgatacccaggctgtgagcatttcctctgtgtgtgtgtgaattttggtttgtatatattattttgtttttaaggcaataccttcaccattgaaagcaaaacctatataaagcaaaacttacaaagatttgccagagatttgcttcactttcatggaatcaagggcaaataaccaggttacagagtctttagggtcaggtgaaatttagcctgtgttccagcagaggccagacagcgttcagcatccccgcacgtccttggggcgccaaatcactttgacgtctgctgattgatttcaaattgcacagatatatactgttcaaagctgtggcctacgggggcagtgtgagatatattcaaggtgggttgacttttaatcaatacgatgacaatattatcttgtttaatttgtatgatggtggttgtaaacatcaaatcaagccatttattatgtcaaaaaaagatgaaggagcccgggaataaaactctcctgacatcacttctgagcgtatttcactgccgtgacaggccgtcatgattggggacgatatcgtgggcgacgtcggcggtgcccagcggtgtggaatgagagcgctgcaggtgcgcacygggaagttcaggtcagtgccagctggagtcatttattcaccttccttccaggggatgaccacattctcattctgttttgttcttcaaaataaaggggatattctttccaaatcaaagagcagtatgtgggcattcactatcttgtatgtaatggacctctaagaacagggctgagtggtcttttatagcagacagtgataaagtagagtggcttttgatacagggtctgggttttggaatggcgtgcagtgcagagagaaataagcaaaggcactatccatcctggcggcggcccaccagggagttgggccgaatttgtgctgctgtccctttggcaatttgatcagaccctgcactacggcagttacagctgtgggcactcagccccttggacagcctccctctccttttgttcactttctccactctgtaagacacagagagcctggagacgacagagggttgctcaggcatgccctggagcagaacctccatctcaagaagaaggttgtgttttatttgctggcaaaagtctgcctggtctggagcagctgtcaggggttgggagctcccaggcatgtggagggccctgtggtacccaagctccagctcgcctggtcatcgagaggatcttggacatcagagtgttgccttgccttatgctagatggtttcgattgtggccattcagagaaagtacatctttgcagatgctggggagacttggttgaaacatggttacctggaggtacttggatttggggtgggggcagttacatttgtcctgagagatctgcttaggcaggaccagagaagacagatcagagggcccgaccgtcgctctgaagtctctcctgcgggttgggagctgtggctgagtgygaggtgagtgaggaaggctcagcgcacctgggtccagggtcaggaagttggtcccttccagctacctcccagaccctcccaggcttcccccgacgtgtatgacatatgggccttctttctttcttgaagttgggttttgtggctccccttggttaggcctggcctaagggagtgagggagaccccactcacaagccacaggaacgtttttttccaagagaccagccaggggtcccccagtccccaatcctgcctttcctgcaaaggtcgcagagcctggtcttgctgctgctcccaggcgaggggctctccgctgacagcggacctcggggccctatagttgatgccgggtgctgcctggcgtcagccgtcaggagcccagcccggcgccccatgcgtctcagggcacacctgtgacccgtgagcacaagtgacacctccctgcttgggagcacagcggtgtggctcggcaggaggtggaaagggagaaccgtacygtgttgtgtactgggcttcttccagttccttggaggagaaacatgtctgtcctgaatgccacctcagttggggtctttctggccagcccaggccaggtgcccctataaactgagaatgggcctctgaagaaggccccccacagcccacgaatgcaggtgggcacgagggaggctgtgcccaccctacgccagcaagggttggtgcttttcagattccggttacctgcatgctatttaaagaagagtacgaggtgggcatcccccatgacactgtctcccggagagagagaaactctgtttttttgtttttgtttttgtttttttgagacagagtctccctctgtcgcccaggctggagtacagaggtgcgatcgatctcagctcactgcaacctccgcctcccaggctcaagtgattctcctgcctcagcctcccgagtagctgggactacaggtgtgcaccaccacgcctggctagtttttgtatttttagtggagacggggtttcaccatgttggccaggctggtctcgaactcctgacctcaggcgaaccacccgcctcttcctccggaagtgctgggattatacgcgtgagccaccgcgcccggccccagagagagaaactccatcaacagtttgccgaatccttccacactgccttctctgcatagataaacagactggtaatattttggttttttctttttataaaaatgggatgatattgttttgcagcctcctttttccttgaacactgttttatggcctctttctacaagtgtcttcataatgatttttttggtaatttttaaaatttcagtagtttttggagaacaggtggtgtttggttacatgcataagttctttagtggtgatttctgagattttggtgcacccatcacccgagcagtatacactgtacccagtgtgtagtcttttatttctcacctacctcccacccttcccggcaagcccccaaagtccattgtattatttttatgcctttgcgtcctcataacttagctcccacttataagtgagaacatacagtgtttggttttccagtcctgagttacctccattccttgaggtctccaactccatctaggtttgctgttaatgccattatttcgttcctttttatggctaagtagtattccatggtgtatatgtaccacattttttttctttgtttstttctttttttttctttgagatagagtcttgctctgtcacccaggctggagtgcagtggcgcagtctcggctcactgcaagctccgcctcccgggttcacgccattctcctgcctcagcctcccaagtagctgggactacaggcgcccaccaccacgccyggctaattttttggtatttttagtagagacggcgtttcaccatgttagccaggatggtctcgatctcctgaccccgtgatctgcccacctcggcctcccaaagtgctaggattacaggtgtgagccaccgcgcccggcctctttcttttttttttaacttttaagttcaggggtacatgtgcaggttcattacataggtgaacatgtatcatgggggtttattgtacagattatttcatcactcagatattaaacctagtacccattagttatttttcctgatcctctccctcctcccctcttcaccctccaacaggccccagtgtgtgtgttatcctgtgtatccatgtgttcagatgctgtaggaaaggaatcagtgtagtgccgggcacacagcaagccctcagcaaatggccagggtggggagcacgtgcggccactactgtccatatccatccgtatccatgcatatccatccatatccaccaagctccagacatggagtcacctgcctccattgaagaggatgggacttagcccatttgttcctaacgagatttaaaatgtcagaccttttgatttgtttgtaaggatgcaaatctgcctttgttaacatgcaggacaaagggagaagagtgttagcttggctaaggtagggacccagtcgctgggggaggccacatgggcatcaaaggaggtggggctctgcgtgtgtaggtgtgccccagttaaagggatgggaggtctcccagccattggtgactctctggagctgcactgtcagacacagtagcggcgagccgcagggggtgacttgtagctcgcccacagtgagacgtgcaggaagtgtaaaatacacactggatttcagagactgggtggggagaaaggattgtgaaagagctcatkagtatttttttatatcggctgcatgttgaaatgctgatatttcgtgttaatttcacccatttatttaaatttttgttaacgtggctactagaaaaggttcgctggcytctgcaggagtgttggtggccccaggtggcagctgccctcctcctgcactgtccccttctccctccagatggtactcttggtacacagatacactgaaatgctggaggggcgtggggtcctggatgagtggctgatggggcctcgctctctggagggctgttttgggactggaattgcctgcgtggtgctccctatggatgtgtggccagcctggggccagcacacagcctctggagtcagccrggcacctgccgctgggccggcatcccttccttccaggaaatacccccagccaggctctatggagcagcacctcgcccttccagggccacccccagccctctggcacctcagcacggccccattctgcacagcggtgagccccccaggggcagcagctgtgtctcctctgcagctgaggcatgtcgtcgcaaccctgtgctgagcctctcctctcctgcaagtggcccaaagaggcctcaacaggggccaatgaccactggatgggtcagctgggcatcagaaggccttccaggctctgtcctctgttggtggccttggcggaaatgggagaatgaagggggaggaggggtggccttgtcctgggcccaggtggcagagagccctgcagtgagtaactgcgctcacacttggtttgaggccagggcagcatggggaggccgtccaggctggggcagctggcgggtgggggcagcggtcagtcctgccagtcactggcaccaggaagggggagaagccagagggatgactgaggcctcccactggtcctgctgtgggacgtgccctcagccaaggtcttctagtacggagcacgcacacgtgcacgcacttacacgtacacacacacacacacacaattgtttctgaggcagctgtcaggagtctgagaggccgagaggtggctgaggagtgggattcggccgctgactggcagtgagatctccttgtcaccttagatgtatccatttctcttgttttcattataaaatggcccaaagagagtgaagcctcggggttgggagagattgcaggtggcttagctctggagggaaagttttgcagggcctgctccccaggaaagcatcatccccgggcaggggtgtctggagcttggcccaacagggctgcccaagagccctggacagggaagcacaaagctttcttttcatacctgctccctgtggaaatcctgcccagccagggggcggccctcacctggctggcaggtaaaggccttctgggtgttccctgcctgccctgttcccaggactcctggcgcattggacatggctgctcccccagactcctcgaggtcccatccagccacagcgttcctgctgcccaggccctggacaacagtgtctcctccgtggggggtcctgtgccatgggtggcaaatcctcatgatgccatgagtcctgcagccccagagggtgctgctgccctgccgtgagaggctttttcagatgggacagctaggaccttggccaaggccacctggcaaggttttacagaagctggactggaacctggccgcccccagtcccctgggcgggtgcttttcctgcacttttccctggtagaatgtcctgcccttggggccacattttgcagcagtcacagggcctggcctcactccagggctccatgtttggatgcgaggcccagtgggtaagtgcactgctgcccacgcmcccccccmagcactgtctgctcctccctgcttgcctgcctgtcaaggcagccctcatcttccttggaggatggggctgggctgggagcctgcgccctcccattctgacaaatgagtagagggaagggacgttttgcccagttccaaggtgccctctctgtcctcagtggagaaggaagagccgctggcacatctgagccacagacccttcctgcctcttatatccccaccaacctgtgttcctgtggacatgccagaaaccaggccgtgtggcctctcaccaccccatcactctgttcgctgttccacgccacaccctgcagccaccacccagtcaaaggcgccactgcctgggaagcccctgcgctagtcctggtgctgctgtgtaaataaagccgcgatgcggagctcgcctctggtcttctcttattgtttacccaaggctggcagatgttttataagccccgaacgttcttgacaaacagtttgcccttcggagagggaaagtttcctggaccgtgattcccgacatcctgcaaggtcccttctagctgtggcctgggtgctgaaggggtttccccccagtggggtggccagccgatctaggattccagccgccttgcacaaagctggaagacgaggggctgcagggtgcatggctgtggagctggctgcgtcgggagggagagtgcccccacgcctggcctttgaccttggaagcggctgccgtcaaagcagcagcttgtcctgggtcttcccagacttcgcagtgacggatttcagagtgtttcctgttacgagaaggctgtggattcgctttggaacatgacagatttttcttctgtgctacgtggagygtgagggaaggaagtgaaactggtgttaatttttcagcagtcacatgtcaaagtgagtggctagcaagcaggggggtccaggctgtggtggccctggtcagccttccaggagtcaggaccctcctgctgccctcctgtgtaaacagaccagccagggcaatccgagccagccccggtggagagaaagggccagtgctgggcttgggagctcaccccaagttcctcgggtactcatcctggcagtgcagggaagggcaccgggaacaggcctgtggaaaaatccactgtgcaatgagtccgtgaatcccagacatcctctcagcagccctctggtcctgcccgggatagaggctgtggcttctggtgtaggtgggcacttctgggctcagaggggtcatttagctcacctgaggtcacacggagtgggacccaccccaatttaagcctgtacacttttttcttttgtctcttttggtaacagctttattgagaaatcactcccacgctgtataactcagtggttttcatacattcacagagctgtgcagtcgtcaccacaattttataacatttcatcaccccaaaaagaagcctcaaatcgtttagctattattagcaaagaccccccacattccacccagccccagacaatcactaatctactttatgtcatactttctttcttttgttttcatttttttttttttttttttgagacagagtctcactctgacagccaggctggagtgcagtagcatgatcttggctcactacaacctccgcctcccaggttcaagcrattctcctgcctcagcctcccaagtagctgggattatagccacgcaccaccatgcccaactaatttatgtatttttagtagagatggggtttcaccacgttggccaaactggtctcaaactcctgacctcaaatgatccccccgccttgacctcccaaagtgctgggattacaggcatgagccaccgtgtctggccttatgtcatactttcatttgaaaaatttagaaaaattaaattggcccaggagtttgagaccagcctgggcaacatagcgagacctcatttctattaaaaatcaaaattagccaggtgtggtgacacccacctgtggtcccagctactcgggaggctgaggcaggaggatctcttaaacccaggaggtccacgaggctgcagtgagctgtgatcataccactgcacttcagcctgggtgacagagcaagaccttgtctcaaaaagaaatttttttaaattgtggtaaaatatatataacataaaatatgccattaaacaattgtgatgtgaagtgaataaaatttgaatacacagcataatgaataacaaagcaaacactctaaggtcaagaattaggaggctatcagctccccagaagacctagtccctgattgacatgcccagtcctgcagrggcggccccgccttgccgtgggcacagtggccrcggtgactgggcctgctttcttctcccacatggctggcttccctccaacatggcgctggctcttccttctctgacctttatccaagtggaatcgcacactgtaccgttgagctgtggcttgttcatcgtgtcctctgtggctccaacacccctctctgcccgtccctcagagggaacatctgggtgggtcccagtttggcccttctgcactggctgccaggaatgttctggtttttgtctcctggacacatgggcgtgagtccttctggggcggatctgctgatagatggcagtgctgggtcatggaggagcatatgttcaacttgaccagatgaggccagacgggtttatgcccccaccacggggggaccctgttgctccccgccccgaccatcacgagctgttctgggagggaggcccatgttcttcccagtttacggtcctgggaggtttctggacattgtcagcatgtggcagtcccggacgctgggcctcctgagagagtggggaggagacccgaggcggaggcgagtgtgtgaaaggaggctggtggggtccacatggctcagcaggtgaacatggggtttccaggggcagacaccccatcgtggcccccatggctttggttggggcagcatcagcttcctcctctgctgggtttcctgccttctgttggctgctggggcaggggagacaggattgggaacagtcaccctctctgatactgaccctcattagcattcttggttcctgagcaaggctgcttcatgtccagggcaagaggggaaagatgttaaaacctgaacccccctgctgggcttggtgccgcctgtgggaaaaccggtgggctgagggctggggggctctgagctgaggaagggggtcccaggtggaggccgggaggtggctgcagagtgaggccacaaggcctgggggttggcccagaaggtaggacccctgtaggcagcctcccaaccccaggaatttgcctcttgggaacgtgcaggtccctcgagggtcctggaaggcgctggagtggtgggacagggattgagggagcgtcagcagggccctctcttctccctagagccgctcaacacgtgttgcaaggcacgtgctctggacctggtgctcacacgtgctcttctcccaagacactccctgaagcgcgttccccaggagctggaagggggataacgcaggtatgcctcatggcggggccagtgctcntgcttacacacactcngcctcagctcgtctacaccctgcaacagcccagagaagccacccgccttcttacccctaccatttagatttgcaaatggaagctcagagaggtgaagtaacttgcccaaggccacacagcctaccagtgtcagaatcgggattcgaacccacctctgcctgactccaaggcctgtgcccctgaacattctcaagccaccccccaattagccaagtgttgctggagctctgagcaggggccgggcctcacaaaacaatagtagccagtgtgggggctcacaggactggtcagctcccgccctcccccgctttggccccctccacacacacacgacctgctgctgagctggacataagcaggacctggctctgggggcttctgacctagggcaggccctgaagttggtcattagaccccacccacccasctgagagcctggcggagatgtgacaggtgacagccccagaagtcccatcgttgctgcctttgtggttaaagtccgctgaacccaagcgctctcttcccctccagtgtgtggtggggaggtggggaggggacccaggcagatctgggaagccgtggccaggccgcagcaagcaggggaagaaggggcccgcagtgaacttgcagcaggagctgtggccaccgtcctagccaggccggccacctgcccaaaatgttctctaaccttaacatgaacctgggccacttgggctctgctggatgcccmcagggctgccagagcctgcccgccacagagcccctctgagacctggagtctcacctgagccctctcrctgcccacagggctggcctctgcctttccgctgctgctctgcggctcggggacacggccagggctggtggcgcttacagcccaggggcaggggagggcacatcccccacagcattcaccattgctgctgtgttctgatgcatcagggaatctgcatttttgaccctttgattgctacatcttttccagcctggaaaagtgaagaaggaaggaaagggggctcagaggcccctgactcctgtccttgcaggcacagctggacgcagttcttattttcaaccatcttgcagcagtggttttatttgtgcacaggttcctctgtgtcatgggtgggtcccaggatgtgaacccggtgtgctcctctagctccactgtcctcaggttggggacagccagggacaaggccccctactccagctccaaacgtagttccaggctggrgtgccytttgcccaggcccagcctgrtagccccgggtgctctccctgacttttcatgagcccgggggctgaaaccagagcagcagggagacagaaaagcccagccccaccctccagagggggagtccagctgcccggagaccccaagagcactgccagaatctgggtatgagacccagtcccctgccgcgtgctaaccatgtaaccttggacrtgatctctttgtgcttttttttttttgtttttttctttttgagatgcggtcttgttctgtttcctaggtgggagtgcagtggcaccatcatggcccactgcagcctggaactcctgggcacaagtgattctcccgcctcagcctcccaaatagctgggaaasaggtttatgccaccacgcccaactaatttttaaattttttrtaaagatggagtctccctrtgttgcccagcctcctgggctcaagtgatctccccgccttggcctcccaaagtgctgggattacccggcttgagcatgatctttttgccttgcttggctctgggtttcctcatgtgtcaagtggggctgagccccagctgtgtgggctgaacaggggagggttaagctcggcccctagagtgagggcccgccatggtggtggctcccgtatggcatatttccctaacggttcccatttggtctgtcctgctagaccaggctggtgggacgtacactgactctggggttctrtccaccccgtgggtgtggtccaccacatggtcatkgtggctttctagggtagacttgaccttccccactgcctttatttatttatttattattttatttttttttgaaacggagtcttgctctgttgcccaggctggagtgcaatggtgcgatcttggctcattgcaacctccrcctcccgggttcaagggattctcctgcctcagccttccaagtagctgggaatacagatgtctgccaccacacccggctaatttttgtatttccastagagacggggtttcgccatgttggccaggctggtcttgaactcctgacctcaggtgatctgcccacctcagcctcctaaagtgctgggattagaggcgtgagccacagtgcctggccttccccactgcctttaaaatctctatggtccccactgcccacgggaggaggcccaaccctgtcctctgttagtcccctggtccccgtagatatttaccaagcacctactatggccaggcgctgttgaggatgtgggggatcgagtgaatgtggcaggtgtcccctgccctctagggctgttcttccttctagggagggaggttcaagcccctctcctgatgcccagctggcctcccagcgtcagggatctctgctctgttggtcccctggagtggccctggggccaccacataacacttttgtaagaataagagttattttttatggcacaatcgcccctgccctgggtttgtgaatttgggggattcttttttttttttttttttytttgagacagagtcttgctctgtcgcccaggctggagtgcagtggtgtgatctcggctcactgtaagctccgcctcccgggttcatgccattctcctgcctcagcctcctgaatagctgggactacaggcacccaccaccaccatgcccagctaatttttttgtatttttagtagagacggggtttcactgtgttagccaggatggtctcaatctcctgacctcgtgatctgcccrcctcggcctcccaaagtgctgggattacaggtgttgggggattcttarggaaaaccacctgaaagtgcggggttattaaaaacagaaaccaacccatgcacccaccactcacgagcagcccacacagctcccacctgaccagggctcccccttctcatgggtgagtgaaagttgctgaaaataggcctcctggtgaggaacctcccagccagccctgtcagtggcactgaggctgcyctccgactgtggcatcccccatgtctgtcctcattactnagcaaaaatttgtgcagaggagtgctctacactttccaagggtttaatccaggagctgagggccaggggctccatgactgtagactcaacatcctgggccacagccatccgtgagggggaggacgaggggccacgccctgcactctgtcccagcatcccctctccctggagccrtgcagagatggcctcatttcatcccacactcacatgcgggtcctagacaccrgctcatgcacayacacacacacacacacgcacacacacacacacacacmtgcgcacatgcacccacrcactctctttgcctgtgggagggcaggatcccagctgccccagcggggaaggggtgtggggaatcagccctgcagatgcggtgtgaggggcagacatggcatgctggtctttggcagtgtggtcccaagtgggggcggctggagaggtgccttgccacagggcccaggccacccgcatgcatcccatgaggcygtccaagcccgtctgccctgcatcagagaggacaccccaatgcggggagggaggaacctggtgaagccaggagcrgygggcaggggccagcaaggatccccaggcccccagggcagtgtgcatccggccttcttgcatgcccacctggcatcctgcctgccgcctcctgcctcccgccccacccctcctgcgtcccagcctggtggacctctcagggttcactctcatttcctcctccccacgccacctgctcgggccacaagagggcgccttgctgccagggatgggacaggccgggcctgctggagccagggccgatgcacgcacagctacatacactcacccgggcccacgtgtgctcacgaggggcccccatacccacacgatcccgcatccacatgtgcgcacgccaggccccacaggttctcaggcccaggccacacatccacaggtgcccactctcatgctggcctcatagtgcatgcacacacacacacacamatatacatacactcacgcccagacccccccacgccccaggccacacatgtgggcctgctcacaccccactcattccctcccagatgccgcrccacccccatgccctgtgtgccctctgcctctcggggccctggggccccagctccaagaaccacgggcttgctttagccaggcttccacaagcctgcccattcctcaggacactgaccctctcctctgccacccttcacgggtgcagacgatgagcatggagaacaccacagcgcrcagggccgagggccaccatcagagtctcctgcagccctggattccctgggcctgaagcaggcagagcggccaaggtagcctcatcagcctcaccagcccgtccttcttgtctccctggcaccttgtcagagagaggcctaagaacacgctctgggcattgggggcctcccagtgttccctgcgagtttggagaggccaggtccctgggatgaggacacgcccacccgccaagctcccctcctgccagtcccacctggagccttcatgcatgctgtctgcgcccttcacctgtcccaccacctcttcttyggcctgcctggatcctgccatatcctcaaggccttccctggtgatggaattccagagtcctcccaattgcaagggcctgagggatccgctgccctccaaccccacaccccgtctcaaggtcatgtgctaatcccgtgcaagctggggtgtgggctggctgccatgtcaagctcgtttctgttgtacccaaaacacagtctcacctccagaagaattacctggcactccctggagttcccgcagccttctcattttcaaataatttttcagatttccagaatagaaagaaattccatacacccttctcccagagacagaccccattcaagctttgccaatcattccatgaactcctctagagaggggaagacccagtccggggccaggcagctctctctggtctctctggactccgtcctggagcacttccctgtcctcgcctcagttctcacagattgccagttttgaagattacgagacagtcattttgtgtggtgttttctcatgatacaacccaagttacgcgtttggggctagcattgcttagaagtggtgctgtgcttgttctcataggcatgtaatgttggtttgcccaaatattgctgatgttaaccttgacctcttgtttaatggcaaccacataatgtgtttttcccctttgtgattgatacgtatttgtggggagatgctttgaggtgatgcgatgtcccactttcatctgccagttttagtgtcccttagtatttcttgtttgaatgaatgatttctatgatggtcgccaaataactccatcattcttccttgtatttactcctggtgttttactttaaggaaagatgttctcttctttccactgattgatgtatgccagtgtgggctcgtggcttcctatgtaattcagtgggttatcgtctgttaaccgtcatcactgggatattcagatggtccccgaygcaggcactggcagccccttcaggctggccctgtgacctttcggcacatcctcaccgttctttgagcccttccttgcattttggcccaaaaagatgtttcaggttcatttgttcagtctttgcttcagccctggaatcggccatttctccaaggagccccagttccttccagtggagggcactgttnagaatctcagcccagggccccaggtgtgcttgtgttgtctctgggcattgctgctcaggccctggcggtggacagaggtaggaaagatgcgcatggtatgcaggtgtgacacacacatgcgtycgtgcttaccctacccacctggacctgcccaaaagcccgagctcacagcagtgcctccgattccagtccagcagcacagggttccttctcacctcatgcctttacacgttcatgccttccttccacagcagggagaagcctggcttcctcattctctctccatctgcttatcgctctatcccatgtagagccaagtccctgaccttgcctgtggtggacactctgcgtttgttaaactgaataacaacaatcctccctattgggagaaaccttttcagcttcccaggccatttctgcatttgtggttctcttccaagcctcttgggtaggcatagaaagtcttctctgttttccagggaagctgcagactcacccagcntcacccagctggtaagggtgtagcaggacagtgccagcatgtctgtcccaactgtccctatggcccctatggaagattagctatgtggtggcaaagtgtcccgaggaaggggcattctgggatgttcasgtgctcgactgggctgggacttgtactttggaaatgagaagaagcccaggctcaaatctttgccccactgcttgctggcaggaagaccactgagcctcagttttctcatctgtaaaatggacttattttggacttacttcccaggtatcctcagcacctttattacaggagctccattaatacatggctgcaggaggtagttcagggaagcaatgggagtggaatgctgggtgcatcacggcctggggttgtcagcctggcctctgcaggcatctgagatattcctgagggcagattcagccaggccaacacttctggatagaaccacagggccataaactgagaccattgagggagactgcttggcttggaaaactcgcccagggaccatgtgctctgatttgcaaaatgcaccccccagagcggcttcctgccttcactttgtgcagagttgggggcggcaggggcgtggggggttggatggaccatgtcacccaaaagtttgtgtcctcggatggggaggggagagcgtctgcccaagcacagcctggaggcttcccttacttccgatgaccttgtggcagtcagtgtcacccggacagagtgtggcacgccttggggaccagcccctcccagaaggataggcgcttgattggaaacgttgacttttcatttaaataagtaaaggtcaaggcctactgcatggcgaggaggagatggctcttccctgcctctgtcctcccttacccccgtgtgagtggacaaaccccccgtcctcacccaggtggcccgcttctgccacccgcactatatccaagacacagcccagctttgcaggcacttgccgtgtgctccgcagtgtgcagggtgatgagatgaacaagaccatgtggcctgaagggtcccacgctgcagagggccccagcccagggccagaccccaagtgtgtgcctggagtgactcaggggtgcgcgaggaggactcagtgggatayggaatgcaggggctgaggcatagggagtgacacaggggctcagggctttcccatgagtcgaggctcattgggttggcagggaccacatctgccctggtcgatgccctgcccatgcaggctctaacggcagagtttggggattggggcgggggatgcagggggcctggggtggggagcttgggggcagtgggccaggcaaagcagagccctttgctgtgttggaaacccctcagaggccctaggcgtgataagtgagtgtgacgcaggagagtctcgctgcatgggccacccacaattgcagagaagacgccctgcatgtcataggcttggcggcccatgccgggaatttggcatggccgtctttcctccggtgctggggagctcagcagctggaggcagatgctggattgtctttctctaccgcagcagggcaggtagcttgtcttttagtttgttttgttagtctcctgtatctgtgactctgcagagagccaacggcaggaagagggcagcaccggcacrtcggaggccgaggacggcttagacgggaggtccggaggctctcagcctgaccagccctggcctagggccggggaaaggcctgggctttggggtcaagggcaggggatgagatctcagacccacgacctaaccattgacctgcctgggccacttcacccctgcatgcttccttccctgtctgtaaaagcggatcacgtgaggggccttgcaggaagctctgaggcccagtgaggcccccgggagacaggcgagaccgctgtgagcgcccgtccttcccgcccggtgcctggcaggttcctatgcgctctcggggcttcgggctggggccctgctgcggcgaggggggtgctccccaggctggcgctgtcggtggtgtggctttggctgacacgaggtggagaggatcttgttgacctgaccgtataaagtagcagtgaggccttacaagtagttctaggcctggaaaggaaagggaaagaaagagcaatggaatctggtattttctcaggtgtcctggactccatctgaamgatttcgccatgggaaacattccttcctgggtcctcggcgcctattgttacagcacgcaggcacccgggctgtggcctaggggtgaaacctctctcgattgtgtggccataggtggttacttaacttctctgtgcctcagcgttgccactgtgtgtggcgatagcaacatgtcttcttcctaaggttgttgggaaaacactgatcgcaacagtgacagatgcaggacccactccaccagaaattgttccatgagcttgtttacccaccagacgcctgtatgagagagaactgacatcgtcctcactttgcagagaggttaagtaacttgcctaaggtcacacagcctttgaaccctgggagtcgaactccgtcatctatgctctgaaccactctgccacatgtggtggttactgtcagttccatttgtttccacacagctttaagttagtcctgtggtttgcttttattttatttttaagacatggtcttgctctgtcacccaggctggagtgcagtggtgcaatcatagctcactgcagcctcgacttctgatgagattctcgcatctcagcctcccaagtagccgggactataggcacatgccacaatgcctggctaattaaaaaaacatttttttttttttttgtagagacaaagctgttgctatgttgcccaagctggtcttaaactcctggcctcaagtgattctcccacatcgggatcccaaagtgctggaattagcttggcgtgagccgccatgcctggcctagtctggtgggtgtttaaaccttgctggcctttaggggtgcatgctgtgaagacctgtgggccagaggccaggtatcaggaggagacactcaggcctgttgaatcagctcagtgccacagggctgcaagagcagctgcttcaggctcctcaggccgtgggcccctgagcaccagttctgctctgctccctcaggggaactggggagatcaaggtggggcccctggacctcccctaattcagccagagaagctctcatctcttccggggtcccaggcaggattcccctgggctggggtgggaggttctgctgctttaaaaccactggaaaggcttgagaaccagtgatcttctgccctgttacagacgcggaagccggggtggagcaggcctgtaaggtgggggctggggccggcactgggtcccygggcttttccacccctgccgcrtgtgcgtgcagactggccctgcggtccatgggcttgggcctgccttttggcttgctcccgagtattttgcccagaggccttgtggctttcagggatgctgtctggggctggaagtcagtccttgttttgtcctggcagtagtcagcaggagggagaagaaggggttaacctgtctggaaccaggaaagaggaagcggtagtgttcccgcatgcagtcccaaatagactcctgctcctgctccgaggccaccccagccaggctggatggaagctccccggctgggccattgttccggcccctctccctccaccctgagaaagcccccagcccggtgggtcagggcaggacatggacaggccaaggctttgggctccagggaggccaagctgctggggcccagagaccctgctgtgtatcccagagccagagaagaacctccctgagggctctgtgagccagagggctgggggatgtcaagagacaggcagggcagggctgcaaggttagagtgaggggaggggtacctggtgccattttggaagggacccctgaaggcaggaagcaggacagaccccccgccattggcagaagacctctggaatcctgagatacttaaattccctgcggcagctccaagcctagggaaccagacagatcggggaggattggctagaacagtgcatcctggtgggtcgtgttggaagctctctgaggtccctctgctgctgagagatgaaggaatggagccctggctctgctgtgggatgccaggctgcccaggctccccgacctctccagcaacaaaaatcataaacacagcatatgtaatatataaataataaaagtaacagccatcttttcagaataatctagcacttagaatgtgctagggaacatacaagcacttttctccttatttacagtaagccttaaggtaaatttcatcatctccagattttaagtaaagaatttgagaatcagagacattcacagcaacctggtgcacccggagcctggctgaccccagcaccgctgctggcggccccacctcnctcgcccagtctccctgcttccccagccaccgtccagctacctngagagatcctgggagcatggtgattgtggggtgcatgggggcccgtgagctgttgggggtgtcagggttctgcccgtgagatcctccttgttgccagacatgaggacctggactggcagctgtgggtggcctcatgaatcagggatcagagatagcgggcagcaggcgggcccagcccggagcaagctgtgccattggcgatgcggggaggctggccccatcgaaggctggtgggactggtggagactcctgtccactgctcagcactaggcctgcagcagacaccatgagccccaaacttcccaaagcccttccccagtcccacaagatggtgtctgcggaccgtgcwsgtgagagatggcagccaggcagtccccacagggcacccattttcagctgcccccgcttctcagacaaggaaactgaggccagaaagccaggtggcccaggagctggcttccccatttcctgctcctgtgggccccactgcagtgcccatgggccgggctgatattacccgagacttcggagctctcacgggtgcgagtaatttaggctgcatggacacaagctgctggcttgagtcgccccgttatgaatgtgtgtgggtctgtgcccctttcatgtgctgccacagggcccacgagtgtgctgaaagggaaggacacggccaaggggccatggtggacaggagaccttcttgggggttcggtggtgtccttgaccccactctgactgagcactgccccaaggcactgccattccaggcccccttccctgagcctcccaccccaggcccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcaccatgtggggcttcaggagcttgctgagcaccctccccacccacggtcactctccctggggtctgtaagcctccctgggcctgagcagctcccagccttgctgctgcctttccacttcctggcagtgaggtctcctgggtgccttctctcagccctttgggatgttttttgtgaggaagggaggctttgatgctgtggagcatctgtagtgcccactccagtggcttcacaggagcagcaggctgtttgttctgagctgttccaccttgtgcctgccagaggggagatagtggacaggcctccctccccccaagtggtggggtggaccccctgcccgctgtggccccatacctgggggccacacaccactgccctgggccgtgcagctgctatgaagagtgtgctgctgagaccctggaagagacggaggatgaaattgtgttgccagatagtccatttgttgttctgagactcgcatgcctgggagaatcctgggaattaactagctccttctctcycatcccattttacagaaaagtgagacccaaggtggtttctgacttgcccagaggtcataactgcttggacagtcatggtcctcagagcccacgtttgctgaccagtgcaggctctcacagccactcagctcctgcagccgtggcgtggcagaggagggaagcacttcctgggatttatgctgcctccctgacatttcaaggcccttcatttctctaaatattggaggngttgaattatttttagttgagcctcaagggatcagagaataagcttgcagcaacgttggcagatgggcttcttctagcagagagtggttattcggggcctcttattgagagaatcgggtgatttgaggaaatctggggtgtcctgaggcataccagaggacccccaagtttttcctgtggctcgtctgccatcaggaaaccaaaatgactcccctcgtcctgagctctccagggtgtggacctggaatgcttaaggggaggcaatggcatatctttaagatgagcacagctccggagccactcgagcacccaaggccacgtcctgctcagggcacttcgggcctcagtttccttatctttaaaatggacagagttggccgggtgaggtggccctgcctgtaatcccagcactttgggaggccaaggctggcagattgcttgagcccagkagtttgaagccagcctgggcaacatggygaaaccccatctytactacaagtacaaaaatttggccgggcatggtngctcatgcttgtaatcccagcactttgggaggccaaggagagcggatcacttgaggccagaagctcgagaccgcctctactaaaaatacaaaaattagccaggcgtggtggctcacgcctgtaatctcagctactcgggtggctgaggcaggagaatcacttgaacctgggaagtagaggttgcagtgagctgagatcgtgccactgcactctagcctgggcgacagagcaaaaccctgtctcaaaaaaaaaaaaaaaaattagtcaggcatggtggcacacacctgtagtcccagctactcaggaggctgaggtgggaggattgtttgagcccagaaggttgaggctgcattgagctgagattgcaccactgcactccagcctgggcgacagagcgagaccctgtctcaaaaaaataaaatagacataataagagtacctaccacctacggctggggagaccagaatgagatatcctgccaaaagcactcaccgcacttcctggcacacagcaagggttcagcagttacccgcttctgctcattttcttggtgttctcatcagtatgattatttagggaaacttgggtccccagataaccgtggggaggggagggtttacctgcaggtgccctggcccagccgttcatgcagcgccgtgctgtttctgtgtctgtgcgcrtcggtggagatgctgtgggtgggtgggcaggtgtgccttgtgctgtggcctcccgagacaaggagggctcccacctaagcagggtcctgcagcccaggcacytagccctgccctggccctccaggtccacacggctgtgggttcccaccagggggcggcagggacttgcggccggggacccagcctggtttctcccgctttgcttcgtggccaggctagggccaggggggctgcgcaggatggggccttttcaccactgcctggagccgctcgcccaccaaccccactgacggctctcagtttccmtttccccgagcgcccttcaccctgaggcacagcacagcctcgtgctcctggccccactggcctgctcccttaagctgagttttgcctttgcagtttgagtgacatttttgctggggatccggggctgctcggggtggcctcgcacacccctgcactttggctgcctggaacgtggcttggggttcacggtgctccatggtttgactcacaggcagggttccagcagcagcagagagaaagagcatcttctccagccggccctacagaggccccgggaccccaaaggctgcactgaggtggccaccaaaaccagggggcagagtcctcctaagttctggccctagatctaggctccagatctcccgggagttggatccagaggaacctgggctcacttctttagcaggttctggacacacgatgcctttaggggctcaagaaaatgtttaatttattttaaaattagaaggaaaatatctctggaacatttagggccaaagaaaatgttttaatgttttttctcactttagaaataataattcaaaaatcnattaaattatttaacagcttttttaatggaggaaggggccccccaaatcacaaagtggccctgggccctgggatggccgggtgagagcctgccatacccacgcagtgtgcctgagtcctggagtgcgatgtattctgagccacccagaatggtgagtcaccaagaggcagcttggaggtgggccgctgcccctgcacactgtgcttgggggacacagccgacacgaccagcctgcagtaccaggatagacaatttgggctggagccaaacttgatcagagggaggctgactttatcgagggctsctttgtggcrggcgttcattgtggaaagagcccaggaaggagctctctgccttgcaagaacattgcctgtggctcaaaatggccacatgggatgcagttcctgaggtggcagaagagccagcctctgctagccccagacctaacggaggtgcggctcatggccaccctgaggaattccacctgggcgtttggtgtccctagcatatctcgaatggcaggctgaggctcgaaagtctcatgcctgtctgcaggacccccgcgtgagcctgggaccacccgtggggacagtgtgtgtctaggcaaatgccttgggcactcgagggggcactgaggccctggagggcttctgtgggtgggagttcccatgacgtcatccctcagtacaagctacgagggcttcttagaacacgctggacactggggagggctctaatggtatttgcacaaatttgcaatgttggagaccagagtggagtgggctgggcgggccaggccccggcccagatggggtgacctttccttcacccctacttccccactgcaagggtgctgcctccccagctcctacctggggagatgctgacatctggtcattcgcagagtgccctgtgcccacatgctgtccctgtccagacatgaaanggacagcaggagggggctttgaggggtctctcctgagacacctctcsagctgaggctcctggagttggaagcccctgcagactcggtggctgcctcaccaaaggctccatctgcatttgcccccatgaccttcccactgtgcctgggaccgcagttagagctgaccagcacctggggcagtctggggtctggggctggcgttcgggccagcatggaacacagatgccttcagtggctctggtgggcacggggcttgcacagatcggactgtgaccccaggctgtgggactcagccaccaagcgccttcacttatttactgaccttgaagttatncagcacttatgtgtttacagatacctgcacaacagccagagaggtacgaatacatctccacctacaggtgagggcacagagaggttaggacccacctgaggggatgcagccagcaggtgggacttgggccctggcagtctgtttccagcctgtgygctcaggtccagggtctccstgggactggagagggcgctgggggaatggagccgcctcctgcatcagagcttctcctgctccagttcagcctgcagctctcctgcatccccaggtggggaccagagagaggggcaggctggtaccagcctgggggagggggcagttaccagaagaccttggtccccatcccagccctgtgcaccctggggcccagccaggctggaggcccatttttcccagaagcccacctctctgcctccttccaggggctcaccccgccctgctgcctcttcttgatcgcctccttgcccctactctcccctctgccctctcgcctcccctcacgttcatggggttttgtggacgcgcctgcctgcctttcatcagtggtgtccagccgtctccctgaccgaggctgagggtcctgcacatctaggccccgtcacggtcgttctccccggtccctgcctgcccatggctcttgccacagtggggatgcagcagctctgggttgagtgtctgtcgttgcccctgcactgngtgtgccctgtgagtgggggctgctgtgccncacctcactgccacccatgcccatctcagggtgtgggcccagcgggtcctcaggctgtacctgtcagggggctggatacctggacagggccttgtccgagggttgactgggagagaaaatgcccccgttccagctcgggcagtacaagccttcatcctcccagactccacctccctggctgctccttcctgtatggcccccacaggggttggcagggcgcactcmccagagggacaggagtttgtggccaacctgagggtagacactgcctgtcctccagacccctagacacccccggtcggcccaggtgcggggtctgcccgcatcccacagccatctttccagcgaggacagtgcaggcgcaggtggctgtaccgtggctgcggtgatgtgctgactgggaacggcagaggtgccctgggaaggcggaggtctgggagccccacaagggctgagccttggggcctcaaaacagggagtcttntctgggctcagggcctttctggagatgggacttctaggttgccagggccactagccgtgaggagttcagctgcccatggtggcggcggctgggctgtatcttgcacttctcagctgtgtggaggggtccgtggggcctgtctgggcccagcacagcagcgcacagaaaagccactttatatatttgggattctattaatccttctagtttgtacattttttatggcaccttcaatttttttcttttaaaaattaawrtatttttttttctgataatataagaaatgcatgccttctttggaaaatacagaaaatcacaaagamaataatccacaatcccaccttccaaaaggaaccacagttagcattttgttcagcctgttttttaaaaaacaaacaaacaaaaaatgcatactaaaagcaacgatttataaactgtggttgtagagttaagctcatacccagagttgccggcatctcaccagttcctctcctgggacagtgattgtgccttcccagagctgccgcaccctggcctcgcagccaagcctggtgacagcagtggggtgaccctgcgaggcccctcggatggctgatgctgagagcccagcagagctggagggggtaggggcagcctccccaggactgatctgacagacgggtatgtgcctcacccggcatcacccaccggggaggcctccgtccrcccccatgcartcatgctgggtccccccatctcgtgtcttctggggaatggagcggaagacctcccctctctggaaccaggggtgggagggactgtgctccccagaatgaatattccttggctgtgggtgagcctgccagcccagagtccccnggggtcagsagcagactggcaggggccatggcaacgactgggacacctggggagccaggtgtccaggcaggctccagtgtccactcccaacaagtatggggcattgagatcctgggtggatcacaggggagcaggcgtgctcaagctgacacagcccaagctgtctttattcaccaccagacccgaatccacctctgggccaacagtctcaccctgcaggaggcctggcacctgtgtttgtattttatcaccatgaggttgtgtgggctgctgagagcgtgtgcagagctctgggcacaagcctcggctctgtggccggctgagtggccgggcctcggtgttctcgtctctgaagtggggagaaggctgcccccgtcacgggacctcacagtgttagatgagattgcagmtgcgatgaggtgggggcccagcaggcctgctcagggcgtggctgtccctcctggtgcagacaccatcacgtggaaggcgatcacatcgagtgttctggccactgtggcgcgagtgcatatgtgcgcagggctgtgcatgggcggcctgggttgggcttcctttctcggcttgtctgggaggacggtggctcccagtgggtgtctccctgtctctgccccactctgaggatgtgggtgctttgagctgagtgaaggaggaacttctctaggagagagctctgcctgccacctccctggtgcccccgcccccagagcagagctgtccttayagrgccacagcctctgctggccccgaagcccctttgcagtgaaggggggctcctgtgtgcggctccctccagatggacaaaaaccaggtttggatgccggggcctcggctgagtccctcgcttctctaagcattcctttcctcgtctggaaagtgggggtgtagtattgtgcgaacctcccaggccatcccaggatgaactgagatcatgcccataacatagacttccgcctggtccctgctcagagctccccgaatggtcattgccacatctaaacaaatttttctttcagctgggggtgctggcggcccctgcagcggtgcccacggcagcccatgcacccaggcaggaagctgctttgtgcaggagggtctttgtgcaggggcagtgtgggcgagcctggcagcctcctgagcggcaggactatgcaggcgccttattgagctgtcagcggctggcagctgctcccaggtagcaggaagaagggccgagctccacgtgggcatgaaaggcccagcgggtgtgtcagggggcggggtggggtggaagtgttagtgcgaatgtgagtgtgtgtgcacgcttgcaggataaagatgagtttttaaaatgtgtctcctgtggtttttgatttttttaatctttcccaaaatcaatacaaacaaaccacaggcataatttgggtctgtaaaggccgacgctgtcattctgctgcaagagggagggaagttcagttggggggaaaatgcagcrcttttgctgtcattaagtccaatggtggctggcgacagtcacggcgctggtggagctcagagcagaggtgggaggggtggtattgaccaggcgtgtgtgtttccggtgtgtgatgtgagaacccagggctcgctgggatgctgtcctccctccctccctccctctgccaagctggtgggaaggcccttgccaaagcgcacaagaccccttcacacagcaggggcacaagctcttcgaggcagagtcgcctgcaggtggggtggaaggggtgcgccccagacccaagaatcgcccgcctctccaagaccatccctggctgctggtgagcagggtaggagggttgttggcacctgctgtggccggggccgtgccaggtctgtacacattgtgctctttgctgggtggcagccaccacgtattctcaagggcctgtgctaggcctctggcgggccctgggttgttcccttccttatgagctcccattattaactaaagaagacactgaatgatctcatgtggttgtatgtttttttgtttgtttgtttgtttttttgagacggagtctcactctgtcgcccaggctggagtgcagtggcgcgatctcggctcactgcaagctctgcctcctgggttcacaccattctcctgcctcaccctcccgagtagctgggactacaggtgcctgccaccacgcccggctaattttttgtatttttgtatttttagtagagatggggtttcaccatgttagccaggatggtcttgatctcctgacctcatgatccgcccgcctcagcctcccaaagtgctggaattacaggcgtgagccaccgcgcccgcctcatgcggttgtatcttggtgggtaaggcaggtctttctatgacccacctgccagcctcatcatccgtgctccccacctcaccatgcatgcttctgttgctgtttgtccacaggcgtacttactttgttttatatcagtttttagatacaaaaatagtacaggtagaattcggtattctacattttcagggaatatcacatcacacacacgctgctctttcactatggttttcatgttttctgcacctctcccgctcttaccccgcctcccacccagatttagctctgttaacccttcaggcttctttttctgcacacacacacgcacacgcgcgcacacacacacaggaggttgtcctgtttggtttttagaaatggaattgtcctgttcctctttgcaccttgctcatttcacttcatggtgcgtcccagataccactttctaagtcaccggcagaagcaggaccttgtgcttcctgatggctgtgagctgtcgtggcggcacacctgtcctcggtgtggagttccagttcgttcctgcagtcccctgttaacagatgtttagactgtttcccttttttccccttttcattacaaacaaaaaaaattgctttcttaaacttattttcatgtttttaaactttctaatttctcataaatatttcaactttagattctgtgagtgagtctattagtgtcaggctttgcagaggaaaggaaagttctagaagagtctgcagctcgttctcccaccccctgcccccagtgtccacccacagaggtgtgagcatgcaaatagggtgagcttctgtctcccgtctcttgggtgtcttttccacctggggcctccctggggccatgctgggggagtgaaaggcccctccctggaagcccgaggcccctggcctggatgctgtagcttgcctgaaagcggaggaattctggctgcctggtggaggtcggggctggccctgcaccgccaggagaagcagtctgagggagggctgctcaggctggacccagccctgaccagcskggccatcgggcgtcctgggccctggcaggatgtcgttccagtgatacagcacttccttgcttctaaactgctgagtggtcagtgtcggttatcagctgtccacatatrttgcataatctcagatgctggcttgtaacagtgagtggaggtgggtggccacactgtccctttagaataatccacatggccctgtccaggcagggcagcctctgggctcccgcccaccrcctgatgcccctgtgcctggtgagcctgggcyggggtgtgttcgctgtggatgggtgtgttccgagttctccggtcagcaagctccctttgtctctaggggagttcctgggaggtaaaggggagccttttcaagccacaagatcacccagaaaacctacgtaagcactaaagttcagaaaaatccagccagccttggagctggggagactgcttcccttggggcccgggccactccagagccatttccgtgatggtaaaatgagtgggggccccatgctgcctctgcctcctgtgaacgccatcctctggttcttcaccttcaggctcccgcatgagctgggtggttggtgttaactcctctcttctctctttctasccggaaccccctgcccagagctccagggagctccaccatagccagkagagggagggctctgtttacctccttccaagttcccaattttgctctactgatttttgtctgcggtgcataatcaatcagcctggaccccagagaggccttctgtcgaggtgggtgggtctcagaacggcaggctgctccccctcctacctcggggcccccactgtgcacctgcagctgaggcatgttttctggggttcctggctttggcctgcacggctgggtgggaggagggcatgggaggtgatgctgctcactgagcagggcctgctytgaccacctcgggatcaagagtcctgttagatgcccaggtagagacccttgctgggcgggcaggtggatcttcgagaatggagctccgagggacaggttggctgatctcagtgaaccctgaggcttccccaaggccatacagcttgtctggcagagcctcagcaggagcccgggtccccggacaccgaggctagctctttctgctgtggccttctcacagaccaaggtgggatcncagccttggtagccttgaagtctccctaacctggcaagacagtggagaagggggacagccagcgggacattccactgtagaataaatacatgcatggcaaaacacttgayatctattaacttctaagtggcaagagtgattcttgtggttagacctgaatgggaacttgtaagtctaaagtgaaaatctaattagatttttcccacaaaacaattttccgcaacgcattgtggacataaaggtttgatgaatgtatagccaggcacagtggctcacatctgtattcccaacactttgggaggccaaggcaggaggattgcttgagcacaggatttgagaccagcctgggcaacatagtgagactctgtctctataaaaaaataaattagcagggcatgacggtgtacacctgtagccccagctactcgggaggctgaggcaggaggatcacttgagctcaggagttcgaggttgcaccatgattacacctgtgagtagccatgcactccagcctggacaacacagcaagaccctgtctcaaaaaaaaaaaaaagatttggccaatgaattttatcagctaaactgggatatttaagagaaaggaaggaactcctaatttctgagccctggttctgaaaaagctttcttttttctttcttcactttagtcttgttagcaaaaccttaacagttcatagaagaaatcattttttacttttttccccttaatctgagcacaacatctggggttgccatggtggtccattggtggtgatttgcaggacgggaccttacatctggggaaggggctgccaggctgggcctgcctctggccctgtgggcatggccggggtgggcatggccgggaaaggcatggcctccagaatcagaggcctgggttgaatcctggctgagtgcctagtggggcactttgggacaaatgaccacctttctgagccttgcttttctcatctgtaaatgggggtggcaatgcctacttagttgaatgttaaataaaatgaagtcgtgtctgtgaagcacctggcatggtaatcggtggccgtgaggatgacgctggcctcgcagggactgggtggcacaggtgrcctgaccttggcatgcagggtggatgggccaggcttccagccagtgctggatctcagaggcccaggggttagagaactaagggcctccgagccaggctcctcgttgcaaatggacttctctcctttgcgtgctgtgaactgggcgtgaacacctcctgtgatggggagctcactccttgccgagggagcctggtaagctgccggcacagtcatcctcataccctstctcctgacctgtgtcttatggcctctgcccccaggcagctgcggggcagggggctggggtgacccccgtcttggttgttgagcccttccactagctggagggtgactgtccccccttctcccccgacacaaggcacagcctttcttgtggctgtcaggagagagggcctgtcctcctttgcgcccacgctgcccctgcgccttgtggcactgcattcaaagtgagtgcgcctgcttttgtttcttcctaggacttctgaaaacgtgtgggtgggggagggtgtggagggttcgtgcaccgggtggygtggctgcagtggcgtgggaggcggccccagaggggcagaggcgcagtgtgtttatgtgcacagggccgttcccttcctgtccctcatgtgaacaccagtgtacaaatgtgtgcacacaggcgtgtcccccgtgccttttccctaccttggctgatcgtggggaagatagactcacttcccctctccaggcggcgattccggaaaggaggctctggaatgccagctgggggcagggaagccagggcagccaggagggacctagcaggcccacagaggtctgggacagctgagccctcctgcccacggccctgccatccctgtgtgtccccaaggtaacgtccaagctctgcagcagggaccagccctgggtcccacagaggaggctggtccaggtggtggactagagctccgcttgtgccagcctaggtgcagaggcccggcccagcccttcctaaccttgccgtcctgggccagctgttcggtctctgcgtgcctgtttctacacaacccatctgtaaaatggggccatgggagccaccacctcccccaggcctgtcgccatcactggcacctccaccagcattagcaccagtgtctccatgaagttggggttcctggggagatggctccccccagcctcgcctcctccctgcctcagagactgcgcagaaggagggcagctggrctgatgagcarctcgcctggggccccagagaggcccgatcccatcccgctggggcacgccccaggtccaagcctgtctgggcacccccagggctctggactcacctccacccctccctctgcatccttggtggtgacaccatcggcaagtttggcacccccggccctcacactgaccccagcaccccttccccaggctctggtggactccttgctcacrctgcctgctctgcagggtgggggcgggggggcagagcctgccagcccctcccacacttccctcaccagatcacaggaccctcggggtggaggctggtgcgtggggaggtaagggtcaggtggtgggaggccatcctcagcaggggtcccagagtgggagacccagagctttaggaccccaccatgcggaggggccagggtccctgggatggggagaggcctcagccagggtgagcagaagagctgcagcccctgagacccgcgggcttggccggccccccgggaagaagacccacagctgggagggcagttcatgcagggcaccctcccctccacctgccggccttggggagcaccaggcaaggctccctggggagcagggctgccacctctgacctcgctccagcctgacctcaccacggaggcgcacgcaggatgtccgcaggcccccgggtggcagcttcctacagtgcttttccaccagggaccgtgctgaggcccagggccctgagaccctcaggcccatcacagcctccccactgagcacaggcacgtccatcccctccccttctccacctgtcacctgtctgtcttccaggcttcgtgggacttcccagtgccccattcctgcttgtcagaagaggggctgggagaatggcagggcctggcactccaggctgcccctgccctcctgcgctcttgccctccagcctttccccaccctggaagtgagttcatgatgttaatggcagcagcagccatggtgcaccaggcactctgctaagcactttatgtacattcttaaattaccggatccccattacggaaacggagtcttaggttgaaaaactacttgaccaargtcatcccagctgtaagtggcagagcaggccctgaatccaggcaacccaggctgatcaccaccctgccaccacccacccctctctcacatacaggctctaggcctcctgtctatactggaatcccccacagcagatccacatggagctgtctaaagaagcacctgcccctcccccagacaaggcaagaaagccatctctacctggagggagagcagtgaggggcatcattaatgggctgttgggtgtcctgatttctttgagagaagacgagctgagcaggcacagctcttaatcctccarccactgccccccaggctggggcctgccagcccccgcccctgtagtcatttctaaatcgggtctagatggactggacrcgtggctgccagagaccatttgaaccccctacctccaaattccccarggtccccgcctgcaaaggaccagccccagcatgaggccctgaaagtggcaacatttcaatagcctatcctggacaatcaggacgatccctttrctaatttatatgctatacgtttggggtttaattggagcgtaattgtaatccatatgctgttaaggtaattacacttataaacctaatataatccatagatcaatgggtttggagctaattaaggcaaccgtaattaacatttaccaaaaaccttgcaattactggaatatcctttaagctggccttccgagctgataatgagcgccgctcagcgctccgcggcctcctagcgtgtctttattctgcacaagggggccttctggggacctcgatgttgggagggcagtcagtgcctgcttttagcacccagggactctgatcagggacccagctgatgagtggcagcaccatgggaagccaggtccctgtgacttggccatccccagaacacggctgattttctggctcaatagactcagcctgacaaaggggaacttggagaaagagaacaagaaatccatatgctgagctgggacagaacccaagtggggttctcaygtggggagcatatggggctttcctcctgcccaccccctgcacctgcagccaggatgcacctgagctcggactgccctgaaaccccgggaaaatcccaacagcggcaccatagggccaggattacagccattctttttttttttttttttttttttttttgagacggagtctcgctctgtcgcccaggctggagtgccgtggcacaatctcagctcactgcaagctccgcctcccgggttcacgccattctcctgcctcagcctcccgagtagctgggactacaggtgcccgccaccacgcctggctaattttttgtattttttagtagagacagggtttcaccgtgttagccaggatggtctcgatctcctgaccttgtgatccgcccgcctcggcctcccaaagtgccgggattacaggcgtgagccaccacgcccggcctacagccattcttgaatgttgtatgactcccggtgatattgtcaccttgggagctgcacagagacctcccccgggccaggcccctcctctgtctgcagaaggaggtaaggggcccaccacatctgtcttaccacaggctaagctgttggcatctgttcttttcctgctccaggagggacagagcccccctgttgtccttgcggcaccatgctctgggaactgggcgctcctgtggacagctccatgtgagtcttcttcgagagactccactgcagatagaagaaggcctcgagcctgtagttgcggggcggtggtcagcctgggctgcctggattcagctcctgctctgacatttacagctgggacgacctgggccaggtagaggtttttcaacctaagactcagtttattatgtatttattcatttattcattttatttatttattgacagggtcttgctctgtcacctaggctggagtgcagtggtgcaatcatggctcactgcagccttgaccttctggactcaagtgatcctcccacctccgcctcctgggtaggatgcatgcctgaggtgggactactggcatgcaccaccacaccggctagtttttaaaattcttgcagagacagggtctccctgtgtggcccaggctggtcttgaactgggcncaagtgatcctcctgccttggccttccaaaatactgggattacaggcatgagccactacacccggcctggactcagtttctataatgggatatggcagtttaataatgtgcatgcagtgcttagcctagtgcccggtgcagagccactgcttcattaatgctgctgctgctgtccttgtcatctctatcattgacagccctagacgagctgaaggggtgggcccaggtgggaggggccaggtgggcggggccaggtgggctgtctgcacctcgcttactcctgggtgggctgttagcttggcgggtcccagggctcacttttgccccatcatcatttctgtacactttttccatctctgggccttagggcctttccaaagactttgcaactctggcagatatttctagacagaattaggttctttaacgaaggaatgaggcaaatgtggacaggagattgttcataattgcggctgtcatttattgagcacctgctgtgtgctcttagcctctgggctaaacactgcacagacataattcactgattgccaacagcagctttatgcggctggcattttagtctcactttagggtgaggaaactgaggctcagagaggctgaatcactggtttgagtacgwccagcgagagggcagctgggccaggatttgaagccagccattctcaacaccactgtgctctctgcctcccgagtggaggccctgacccctttgctctcttcctgggtgggccagtggggatgggtgaggggtgagtgtgtcaatgtttccctcagcccagtagtggagaacaggcagggtgggcgaactcctggctggaccacagccacaggcctgcaggaggcacccttgccagggcgagtgagcactgtagtctgggagaccctagagtgagatgggggctctacaaggcacagctcctccctggaggaagggaggaagggagggtccctgccttacagggcctggccctccccacttgtccaaagcccggctgggtcctggtgtgtcagcgctttgcagtacaccctgtgctacccacccaacctgtgtccccgtctgatctccctggaccctcccacagcctgggaagggtcccccagctgtgaggtcagcatgggggaccttgctctgcagagggcacctgtagggctggccttattggagtccctcctttctaggcccacagtcctgcgctgcctggtgtgcggggcctgaatgtcattgtttcatatattttatctgattttctagttgctttaaggtactttgtctatcttgactgttaggctctttatttttcaaaaaaaaattcaatataatagtttgcattttttcttattgataataaaaccaytgacattattgagctcttgttctgggctcagntctgccccgagctgtttgtacatgttaccttgctgaacctgcacccaagtcctcaggccatattcccccttacagatgaatgaagtcactggcccgaggtcacacagctgggacgtagtgcaaccaggctgggccctagctggttgaccccagtgcccactatttatttggtgcttacatgcactggctcattttgtctctacagccttgcaaaggccacagttatgagntggcagaggtggtattcaaattcaggcccctaaacttgtgtctgtgttccctcttgaaaacttcagtaaactgaagaagtgaaaggcagagggtaaaccaccgaccagcccaccatccagaggtgacggtgacctctgatgccgctgggtgtccaccttccaaactgtgtgcacaaatgtgtcctctgtgttctagtccacaggtgaggtcaggagcacaggctgttttgggacatctcttcccagtgcccagttccagaacacccttccaaaccaccgtgcattctccgggnccatcgttttaatggctgcaccctgctcccgcgtgtggacgyatcctaaacagtcccttagtattatggttagatgctccatgtgtttccaattcttcattattgtaaacccaactgcattgctcatccttgtagcatagctttgcacttattttggatttttgctttaagataacttctcacacatggaattgctgggtcaaagggtatgcaaaattctaaggtgtttggtacttctgcagaattctccctccagacatcaagttgctctcccatctgcactgtggataattctgcaactctcgacaccctcaccaacaaataacaccgaggactagcagtgtcatttttaaaacgcgcctccatcartgggaaaagaatgggatcttctttgattgataatgagactaaaggctttttctgtcttcctcagtcrctgatatttgtttcttctataaattgcatattcatatcctttctcagtcttttttgtatgttttttaaacgaaggctcttctttaatgggaaatctgcatttcatcaaagatggagcgcagagtctgtggttcatttattctctggagaagatgcttcttttttgttctctaaccaatcagagaccagcctgaagatgctagcaaattaatttcaggcgcacgagacaggcggtcggtgctcatgaggatcctggctgaggaaatcacattttagtcccaactcctcgaagtgttgaggccgcctggagtccacgcggaccagggttcaaatccccactcggccacttcctagcagcatgactttgggatgtccctcagccatcagagacttcactttctgggctgtaccatgaggtgttggtgtgcagtttaaaggaagtttggacggctgtggtgtggatagttctgagtgctcagtaggcagacctggttttgagctgatagagaaggcccacgcgaacgggcagagctgggcctcgccagggcctggcactcagtagtgctcascaaatgcctgttgcacaagggatggtgcccaggtaacctgggtgagctacaaaccagagccgctggacgagttccaaagggaactcgggcgcactagccccctttgtttgtgtttggagtgggagtcaccatatagctttatttgattactttttacccaaatccccatatcctcaggaattcaaggacaaggatacataacaaaatgatttttgtctcagagtaaatcacagtccacttggaaaatctccatcctagaggagggtgagggtgcaggtcttggggtgaggctggggatgaagcctcccatgactttgtggttaccctgctggtgggctcactccctgcagggccattggtggagtcacatgatgccaggcaaggctggccaagcagggtacagagcacactgggggagggatggctgcacaggcgtggaccgtgggggatccagggtagggatcccacctgggggtcttgggctgagtggtggagcgtgttgcctgaacacatgagcccgtggacatctagtgagcttagggcatggcaggggtggggtgcgttgcctgcagcctggggcggcctcggctccttcatgtcagcgygtcctgacaccgtgacactgcgcatggtcacatggagcctgtcctcttgtatctgcttcatctctggctttcctgtccatctgcctggtgctttggagggtgtaccaggctgtgagggagaagcagccacgtggctccgttttcttgtgctgcagctgggccarcagatctaggggaaaggccacttcctagtggcctttctggtgggagggagtcatagtgatgagtctggaagctgagccctggcttgggagcagctggaaaggctgcctgtggcctccctgagtggacgtcctctagcagttgttcagcctccctgtccccagccagccaccacctagttggcactcccagtgggccccacgagccgcgtgttgctgtgcacagcccttacgagaatcccactttccagatgagggcgacaggaggaggaagcatcactcacttgcccaaggtcccaccggcaaggggctctgagtctggacgtggccctctgagctgctctgtccccgcttggcgttggagcgtctcagcctctcccaagagtgtgtgcccttgtgtcgctggttcagaagccagaaggcttccaggggcagacctaggcagaagccctgagtgggcatcctggtcagccctgtgggggttgggggccagtgggcaggggcactcaccatgctacccaacccccyatggcacccccaatgtggaacgcacgggctcaggactcacttttattttggtagagcttggagtccccatttccatgttttgtttttctttacagtcccagtgtcaagcttagtaggacacagatgtctcagcaaacaaaactaggagccatccgagcaggcccctgcggccatatgcattcccatgcgtagcgaaaccaggccctcttgccaagcactctttgggaggatatttggaaaaratgtcaaggcattcatttttctctcgaccttttctgttggaatcgtggggccttaacactggaagtaaaaggagttataagacacagctggcttcctgcacccgggacagccccagtggccaggcctggccctattctcccatctggccctcggtggtttctgcagaggttaccatgcacaagggccaggccgcggcccccacctatgtgcaaagaagttggcaatgatgtccaggtagcaggtgcagcgggcaaggtttctacccccaggctagttaaggacacaggagactcgaggagggagaggaccagcagaggacactctatgggggtggcttctggcaaaacagtgctatctgaagatgagtttgaagttaggaatgtttgctgagttggcctggatattggaagtgccctttcttttgagccctttggctctcttggcgttgaccatctgctggtggaacatgggtgggctcccagagcacctgcccctgtggtgtataccagctggatctcagctacacctacggacctgcactggtatagatttgggtcccaggttccccaccaggggcctggctggcttccccaggtccacacccttccagcgaagtcacatcacaagttgtgtggaaatggaggrcaccaccctggccacagaggtgaggctggtgaggcccagagtgtacctgttggggatgctgcaacacttggaaatccggctgcccraggctggaagccgtcttgctgcgtatgtcargtaggataatgagtggactcttttctcagtcctggaggacttcctcggccagtctggagtaagccatggctggggagatcagttcttggaagtgctgggttttcctgcatctttggtcctttggtggcacaggccttcccttgcaggcctttggcacctgtctggggtgtgtgccattggctcagtagcccatgggcagtaagttccgtggaatcaggcacattttcagccagcgctgccaagtgctccctgcaatggtgttgccacctgaggtgccacccaaagcagaaaaccctggggctgggcaagacagcagctttcaggagctgggaggaggcatcatttccactttccaggccctgcgatctggtttgtagcctgtaccagggcactggagtcctgccttggcacagctcatggtctagaggaataacctcaggtccaggtgagacactcagcctgtgatggcttcatatggtcactacgttgttgtatatggagagagnactctttcttggttttaaattttgtttttaattttataaatgtaatatattcacatggaaaatttggaaattataaacaatcaaaaagaagcagctaaaaaaagtcctttcataatccaccggcaacatcagttaacatgtggcatatttccttcccgtctcctccactcccattttttttggacttcttaaacataattgagattgtgttttatgtacaattttatagcatgtacttgttagctttgaaacagacccatctgcgtttgcaatttggcctgcagggaaaagaccagattgctgagtcttagctaaagctgtgggagaaggaaatctaaaaataccctcctcgttggcctgctcagggagcgccgtggcctcttgttctcctccctgtcagtacagcagaattagccatgactcagagtgggtctccgtggtgattctgcctctagagaacatgccgtgctcccgacgtcaggctcacaggtgagcnggggcactagccggggacgaggggctggagcctggccggcccaactacagaggggcctggggtttggctcctgccggaggagcccctctagggctctccggggtcttctgcagagcgaacactttgaggggagcatctgtcagagacacatgatgcttcttcacccaaagccccaccctggctgcaagaggagaaaatcaaaaccgtgaagagcattttagagacttccacttccagcaagatggagcagaagtgcctttccctattcctcctgccaagtgcaatgaaaaaccctggacgtcagttatgaaacaaacagaagaggctgaaaggaagagaggagaaggcagactgaccagggacctcaggacctggggatcagtggaggggtgaattccctgggtttcctttgtgccttgcacatctcagacgtggagctgaagaagccagcaagagcctctgcagaagcctgctctccctggctgaaggaccaagccaggggcacctggcgagacagaaaacrtttaggcaataactgtggtactccagccaaacaccacagaaaaccctgtggccccctcagctactcgtgccagcaagggctcagcagggakcctggaccaaaacactgaccaggctgaaatgagcccctaccactgggggtgtcagagaaggccaaggagggagccaggagcagggtgggaatgaggtcccccagctggagcatcagtggagaccacatggtaagcctgtgcttcccctagtcagtggtgacaagacatcccttcccctcccactggacgggcagcatcatactgaagagtcaggacttcatygccactcagaggttacaaggctatccgccccccccacaacagtgacaatggagcccgcatgggacacagtaatgagggattcctgcacctcccaaccaggggaaaacttcctccttgaagagcagtaatgagagcacctcccccacctcagtgtcagcagaggccaagtggggaacctggacgtccaccccacccaagcagaataaggcagcactaccctcttcccctgcctgagttgtgtccagagaaggccactgaaagggaaggtttaaataagactcagagtctcacaccacacacccaaaatgtccagcttgtggtacaaaaccacctgtcatgctaagaaccaaggaaaccccaacatgaataagaagagaagaccaacagacaccagcactgagatgacacagatgtcagggcaaagactaaaacagctactggaaaaatgcttcaaccagcaattgcaaatatgctcaaaacaaatgacaaagtagaaagtctcagcaaagaaatagaagatacagggccaggtacggtggctcatgcctgtgatcccagcactttgggaggctgaggtcggtggatcacttgagcccaggagtttgagaccagacctgggcaacacagggagaccttgtctctacaaaaattaaaaaattagctgagcatggtggcacacacctgtagtctcagctacttaggaggctgaggtgggaggatcacctgagcctgaaaggtcaaggttgtagtgagctgagatcacgccactgcactccagtctgggcaacagggtgagaccctgtctcaaacaaacaaacaaacaaacaaacaaataaatagaagatacaatgaagagccaaatgaaaattttagaactgaaaaatacagtagccaaaatagaaaactccatggatgggtttgacagcagaatcaaggggacagaggaaagagtctgtgaacttgaaggcaggaaaatagagatgacccaatcagaacagagaaaaaatagactgaaaagaatgaacagacatttcaccaaagatgatatccaaatagcaaataagcacataaaaagatgtcatgagtcactagggtaacgcaatttaaagccacaatgagacatcactacacacctatcagaatggctaaaataggccaggcgtggtggctcacagctgtaatcccagcattttggaaggctaaggtgggtggatcacttgaggccaggagctcgagaacagcctggccaacatggcaaaaccctgtctctattaaaaatataaaaattacctaggcatgatggtgctcgcctgtaattccagctacttgggaggttgaggtgggaagatcacttgaactggggaggcagaggttgtagtgagccgagatcatgccactgcacctcagcctgggcgacaaaacaagaaagataccatctaaaaaaaaaaagaaaaaaaaaaagaatgactaaaataaaaaatgccgatgagaacagtgagaatctgaatcactcagacattgctggtgagaaggtaaaatgatacaaatgctctggaaaatagcttggcagtgtcttaaaactctaaatgtaaaactgtcacatgactcagccatggtactcctgggcagttatcagagaaatgaaaaattataatttacacaaaaacctatacacaaatgttcgttgcagttttattgataatagccccaaactagaagcaatccaggtgtccttcagtgggtgacgagaggaactacatccatgtcatgcaatagtactcagcaataaaaagaaacaatctctctctctctcttattttctttttttttttttttttacataaaatccagatcctgcagaaaaaagaaacaaatttgatactcacaatgacttggatggactcccagtgaaaaaagcctatcccaaaaggttatgtactttctgattccatgtatagaacatcctcaaaatgacaaaattctatcatgcaaaacagatactgttggatggggtggggyggggcaggagggcagtgggcgtggctataaagagcagcctgaggggtcctggtggtgatggaaagcttctttatttcactgtatcaatgtcaattgttgactttgatattgttctatagttttgcaatatattactgttaagagaaactgagtcagtggcgttcttacaactgcatgtgaatctccaattagccccaaattaaaagtttactaaagcaacaattgaacaagaaaaagaaaagcctttgtacctagcaacccagaatgcctatgataagtggcaggagctgatgacaggcgttcttggttcagaacaatgacaactctgggacaagcatgccgctgggagaaagagaccaggagctgcacagccagacagatgcttttgcagtgggatggcrgtggggrgttggaatggttcatcatttactttttatatttaacacttttttttttaagagatggaatgctctgtcacccaggctggagtgcagtggtatgatcgtggctcactgcaacttcgaactcctgggctcaagcgatcctcccacctcagcctcctgagtggctggacctacaggtgcacattgaagcacccagctgatttaaaaaaaaattttttttttttttttgagacggagtctcgctctgtcacccaggctggagtgcagtggcgcgatcttggctcattgcaacctccacctcccaggttcaagtgattctcctgcttcagcctcccgagtagctgggactacaggcacgcagcaccacacccagctaattttttgtatttttagtagagacagggtttcaccatgttacccaagatggtctcaatctcctgatctcgtgatctgcccaccttggcctcccaaagtgctgggattgcaggcgtgagccaccgcgccyggccaatttttttttttatagagaygagtctcactgtggtgcccaggctggtcttgaactcctgggctcaagtgatcctcccacttcagcctctcaaagtgctgggattacaggtgtgccccactgtgcccagcctcggattgtcatttagcggtctgtctgaacatcagtctcctgacgtccttcctacagatatgaacagagcccctgctaggcatgagtattcggagcataagctcctggttccccagtgagagacggatgtgtaaggaggcagtctcagggtaggatgttgagtctgggctggggacagtgcactgtgccgtggaattatggagagtttttcctcctatctctaagtccaatgtgtggcatggttatattacatttttaggatggaaaagttataccatatatttaaatgaattaacagcatttgcaatgatctggatgagattggagactattattctaagtgaagtaactcaggaatggaaaaccaaacatcttatgttctcactgatatgtgggagctaagctatgaagacgcaaaggcatgagaatgatacagtggactttggggacttggaggaagagtgggagggaacgaggtgtccttgtccagcaggcgctctgtgtgaggctccatgcatctttatgcattctgctctgatgtttgcaaacacgacgcccggcaataagtgaggcccccctgaggtactcaaggggcttcactcgctgaagctcccctccccacagcaacctgagcttctgcaaaagctgagaagcacgcgtgagaagggcacctcccctgcttggaaataattttttggttgcagtagggggttttgtttgttgtttgttgcttgctgctcgctagcttgttcttgcagaaggaagagctggtctcctttgccatcccttactgagggtcgagaaatacagacaggtgtcttcaggctctccgtgcaggccatagtccccaagaattcacttgtgagcctctgtggcagtttatgttgaggattaggtttagtttggggagaggaggatccatggagctggggttccagatttgatgtctaattttagaaaggacactatttttaaatcaatagctgtgcagcctagcatatcactctgaccctgtgcccttaagggacgcactggggaggacattgttcaggacggagcctgacaagaaaggaatgctaccccacgccgtgcaccccaggcggccactgtcgtccaagaatttccaggtcttttctggtatcacttcttggcacaggcggaagaagccatgttcccatcgtcccaacatgcagctggggacctggagaccgctttggcctttctcaaggtcacaggaaggcagggggaaggctggcgagggccctgtggatccaccctgctccagcccggcgtcgggttacagcagtggggacaggagggggaaggggtgtcactgcaggagctaaggagaaatccagggttgacaccctcagaaactggagaagaccaagaaagcagagcggagagtgccccctgcagtccgcagagggcctttgccgaggtgggcctggagccgtcgccgtacccctgggtggcccgcaaggccaggcttggctgcctggcaatgtttgttgtgggcagttgccatgccactccggcggcagcaagagcagggacaggtgtggcagagcccggtggttccagcccagcctggcctcccagcatcaccttctccagttacttgaagtgggccaggtcctggagaccgggcgtgtggttatgggctctccagattcttggcgccttcctgattgcaggagtctggttggcatcatgggacccctgggagactcactttcaggaggggttgtcctttcccccctgggggacacactctgcttacttgtcccctgggagcgctgggcagggagactgcaggtgccagccactcctgcagcttctgcccagcctcctctggtgtcctctgcactgtcaccaagccatggcctcaagcaacttgtgggtgcctgtgatttaggccttggggtgttggagcctgcttggacccactggcaggagtcagttgtgatgtcttttgccagctctcttctgtagcttgaaattggccacggtggaagtatttacaccatggaagttggcaaatgcacggacccagcaccccyaccccatcccggagagccagttaccagcacacgtctgccttttggggtcttttgtgcaggactgatggatggagtcgcagcagacacttggcctggccactgtgaggctgtgtggtgggaggtcgggggcacctgagacagagggaggaggctgagagtctgagggggcagccagggctggagggccatttgggattctgttggatttccctgcactttgtccaggggcagaagcctccctcccaaggtcaggccccatttctagccgtgctggtcgcacatccctgtgagcaggggtgcagaagagaaatggtccctcaggagccccacacccgctcccatccagctctcctccagatgacatctccaggcactgggaccccacagaggcaggccctgctcagcctgcagagctcccggtggagagggagggcgggggtccaggtggcctgaggagaggggtgcaggccagctgagggggctcccagaactccacgagctcagagacgggctcttgcccttgcagccccatccttgggatgccccagcccttcatccagacctctgctgtgattgtgtcaggacctgtccctgcagtggactggaagctccaggtgggcaggccttgccgtggtcacctgtgtccacaggcctgggcagagcaaactgatgagtgtctactaaatcagagagaagacacaaccagggagcgagtgcacgcccgggccgaccagggctgcgggcatcatatcccgctcagccgctgcctgccctccacgcgcccctggctgcctctctcagcctcggccccctccactcatgagtgggaataaataagagagtagaaaacgtaagtgaggttcttgtctggccgccyggctcatagcaatgtttaatagatagtaactggtgttatgactgaagacgtcctttgtgggctaytggagttcttaayatccccgagtaaccacagggcaacgctctggcttgacaaggggygscactgctggtcagcagcccagccagccgcagcggccacttgtgttcccagctgtggcttgtgatctatggtcgactgagctgttactctcctcggttagacacgcatatgcacacacatgcacactcatgtacttacacatgtgcacgcgcatgcaacgcacaaacacatggacacacatgcgcatgcatgcacacactgtacccacgtgcacacacgagtgcacagacacgagggctcactgtgatctgctctaatgcatggtcttaatagctatataatattccacggttcttttttctttctttcctttttaagatggagtctcgctctgtcgccaggctggagtgcagtggcgcgatctcggctcactgcaacctccgcctcccgggttcaagcgattctcctgcctcagcctccttagtagggggggactacaggcgcgtgccaccacgcccggctaattttttgtatttttcagtagagacggggtttcaccgtgttggctaggatggtctccatctctcgacctcgtgatccgcccgcctcagcctcccaaagtgctgggataacaggtgtgagccaccatgcccggctggttcttatttctttaattttattgaagaataacatacctacggagccgtgtgcatatcataagggtacaatttgatatactttcatggagtgaaatacatccctgaaaccagctccggatcgagaagcaggacatttcccaccctcttcttgccctttgcctgcaacccccatccccggggtgaccattccccggcctctgcccccgggacagttttgttcgctcctttgctttatggaggtgaaaccgcgcgatgaggcccctttcgagtctggctgcttttgcttagccctgcgcttgtgagatccctccgcggtggcgtggagaggtgtggcyacttcccgcttcgtggcaagtcgtgttctgccatttctccgaataccgatggaggcttacmgtgctggaccatggaatggggtctggaatgttctcatacaggtcctgtggtgcaatgggcgtgtgctggcactgggattctgtgtctaatgctcttcatcctagacctgtgagaggagactgttgtccccagggcagtgaggaggaggccagctttggagtggtcaccctcacctcgccgttacacacgtcacttcatttaatttttaaacaacagtcctgctgccggtggccttttctgtgtgctatagaagtgagagcaggtgcctggggacacttggaggcccccctaggtttgtctgtaatgagcttgtgctggcgactggcatgttctgtcccccccayggctcccagcgtgctcccagcgccctcccacagctttaggcaattaagacacgggcttggagtggccattgcaggacctgctggtaatgggggtgaggggtaagctttgtttccaaggcaggtctgtgccctggggtcttgtccccctccacatgcacactgcctgggtggggctcattcctgcgggtaaggcccgggatcaggaatggctgtctttcttctgcccagagggagctgcttgtggcttgaggtggccctgagactgtgagacaggccactgggaggcccaggctctagcaaaagtggggatttttttctctccctagttttggatcaggtttttgaggttgtgcaaacgtaggaatgaggcctttcaccccgtcagttgtctgtcgggctgtgtcgcacagtggcccctcgggacagcctacagagcagctgtctcttccaggcattgctgcagggcctgctgtctctgctgtcctgggccaggcgctgagttctgtcgcrgaaagtctgagggcagagctgggagggcagcgtttccaaagcaaatggaaaaggcwaacgggaacgtggcgggcagggtgggcagggcagcctggaaacaccctttgtcccatgcagctcattcactyggccaggatttgccgagtggcttactgcactctgtggccctgaaccagggctgggggatctcagggacatgtgtgtccacagagatggtcacctgccacctccaccatcacagatgccatgaaggctgtgaagggaaacagacytgtaaggcagcggagccgagatggggttgatgagtgtcaccagtcacaagcaaggtgtctctgttctctcttctacatgttgatcgaggtataacacccaggaaaggacatcaagtgtacagtttgaatttttgcacacacgtacaccygtgtaacccccacacagatcaagatgtagaacattccagcacccagaagtttccccgtgccccttcccagtcagacccccygaycccaggtcacccctgccctgacttgcagtgtagagctcacccggccacttcctcttttgcccacagcaggtgaggagggccttctactgggaaaaactgtgactattaatttaggtttaaaatgtattggtaacaggcagatctggccagtccctccctggcttcaatctcyttggtagcttccaggattactcttagragggactggaggaaaagcccctctctgtccccayggcacccacagtgaccrtcacagccctcctctgggccctcactgccaccagtggactcactgtctccctctgccctgtgcacagcttcttaatttgggtccctctggtttagctcagtgcagccagaattcacccagtgcctatgtgagtcgggcactgggctggcccaggggcctttggaatgaaggggacagtcggtgagctgaggttgtccccaaatcagaggtgtgaccctatgagcagccaggtttttaattttgtaattgagatattcacatgccatacaattcctcttaaaatacacaattcagtggtctttaggtttttaatatattcacaatgctgtgcaactatcacctctaattccagaatattctgtcactccaaagagaaaccctgtacccattagcagtgacttcccactccccacacccccagcccctagcagcctccagcctctttcaatctctgtggattcgcccgctctgggcatttcatgtaaatggaatcagacgatacatggtcttttgtgtctgactccattcactttgcttaatgtcttgaccrttcatctgtgttacggtgtgtatcagagtttcacttctttttgtggctgagtaatattccactatgtggataggccacattttgttgatctnttatcagctgatggacatttggattgcttcctgatatggtttggctgcatcccaacccaaatctcgtctcgaattcccatgtgttgtgggaggtaattgaatcacgggggcaggtctttcccatgttgttctgttctggtgatagtgaattagtctcacaagatcagatggttttaaaaagcggagttgccctgcacacgctctcttctcttgtctgccgccatgtgagacatgcctttcaccttctgccntgacggtgaggcctccccagtcacgtggaactgtaagtgcattaaacctctttcttttgtaaactgcccagtctctctggtatgtctttatcagcagtgtgaaaacggactratacacttccactttttggctattgggaatagtggtgctgtgaacactaatgtataggtttttgtgtggacacgtttccagttgtcttggatatatacctagttgtggaattcctggctcatgtggtaattcatgtttaactttttgagkaacragcggccatttttaaagactggataggaatatgtaaggaagaaagtaaatttattcacttccgttcaggaaatttacctaccaaacaacatgctgaatgggaacctttaggggcttggctgaatggccctgcacaaggtgtccaggatgcactgcctaaaagctgtggaccctgtgcctgggaggaggaccagcaaagggcagagccccccgtgtttcagatggaaaggttaagtaatgtgactctggtaatgcagtccagttcatttatgagaycatggacctcttatactacagaytttttgtgttttttttgctgagtcttttgctccctaaccgtgttccctggctggccaccctgccagcaccacgctggccctcaggaagcatcatcagycagagacacaggcctttgctgtggcctcacatgctagcagaggaagatagacaacatggcgatggatgaggaagttgggttgtctgtaagaggatgagaagggctgtcattaaacaggtgggttcaggtgggtctcattgaaccatgagatttgaaccaagacctaggggggtgagtgagggkttggggaagggagattaatgcgagttctggggaaggaacattccaggtgaggaaacagccactgcagagccccttgggtgttggagraagacactcaggtggctggaggggtrggggaagcattggcagggagaggccagggctggcaggcctgccgaaggctttgcttctcttctgccaggctggccatcacgggccttgcacagaagagagcaatgacctgccttcaggtttcaaaaggtccctctggccgctgtttgagagaaggtcacagtgggatgagggcagagcagggcgactgctcaggaggcttttgcagtaaccgacggagtggtggcggtcactggcaccgagaagtgtacatgctgcaaagaaaatactctgttcaggagaccaggtgcggtggctcacgcctgtaatcccagcactttgggaggccgaggtgggtggaccacttgaggtcaggaattcgagaccagcctggccaatatgctgaaaccctgtcaatactaaagatacaaacattagctgggcgtggtggtgggtgcctgtaatcccagctactcgggaggctgaggcaggagaatcgcttgaacccaggaggtggaggttgcagtaaaccgagatcacgccattgcactccagcctgggcgacagagcgagactccatctcaaaaaaagaaagaaagtaagaaaggaaaggaaagaaaagaaaaaaaagaaggaagggagggaggaaggaagggagggagggagaaaggaggaagggagggagggaggaagaggggaggtggggagggctctgttcacataataaagaaatccagasgtttgaccatgggcgtcatttcatcactgcacttggcagaggtcatcgctgctgctcccatccagctcagtcctgtggtccctgtcgtgtgtagaaacacatactctgtacgttgctgggatcatagcagaatatcagctccaccaatcctggttcctcaatggcgacacccacgcactcagggcgtgtatcagtgtgcatggagttgcctcgcgttcaactgcgtggtgtgggtaacgcagttgtgccattgtgtgtctcacaattcccagactggtaaataatgttgcttctagttttttgctacttaagcagtgtcacagtgaacattcttttataaacgtgtttgtgttttaaaaataagcttattttggaataatttcatatgtacagaaaagttatggagttaggatgttttcatccactcttcatccagtttcctctatgaacacctcacacatctgtggtacatttgttacaaccaagaaactgacattggtacccacactattcatgagacaccagactttatttggatttttttctttttgagatggggtcttactctgtcattcaggctggagtgcagtggcacagatcatagctcactatagtctccacctcaagtgatcctcccgcctcagcctcccaagtaggtgggagtacaggtgcacgcccccacacccagctaattttttattttttgtagagacagggtctcactgtgttgcccaggctggtcttgaactcctgacctcaaaggatcctcctgccttggcctcccaaagtgctgggattacaggcatgaaccactatatccagtctttatttggattttactacaaacatatgcttctgtatacttgtgtgactatttgtttaaggtacagtccctgaagtgggattgccgtgcctgatccttgctgccacatcatcatcccataggggacagggccccactgtcccccatcactgaacagtgtgcccaggtgagatcatggacttgggccccctaggccagcccagtctctttgcagccnaggaaagtgaggcttagctgtcgggggctgtggggggatgcagcttgccacacttgacacccaaacgctgattttgtttacatgagactcaggtccgagtttatgtctgagacctgggaatcaaaaagccacccccacagcctccagggacctggctcccctggagccaccgtgctgccccacasgtgtcacccatggaggctgcaggagcacctggcgtggtccaggggacacgaagccctggtgctggctcctcccaacgcccctgtgagttctgcctcccatagaccacatgtgtcatctgtgtgcacatgtgtgaaacccgaaagacaagcagatgagacccgcctgccaaaatatttgctgccgcgcagaacagtaagtcgtttttgacatatggatctcagcgcgcagccacagcaaacaggcagcgtggcgctgaggggcacaggtttgctggggggcgtgagccgggagcatcgccagcagcaggctcncccccctgcgagggcycgcacggattcgctcgccaccaagagcagggccccaagaggggccctcggcatagtcccctcgagtccccagaacttcacaggcagagagcctggctcgaggatgggcgggagctcngtctggytttgatctgcgggaggtgttgtgtgcagaagctgtgggcaccgggggctgcayagcttcagacctggagcctgctcccagggccgayctgaacccggcacctgtgctgacccaagggtcaarcaaagtcctgagtttggtggcgccgagggaggggagtggtcgcatcccaccgggtgcctggaatggtgctggaggaggcagcatctgatttgggccccgtagggccagaggggggatttgtagggacagagcaggagggagtggagctgaggctgggggagggcatggtcggaggtccagaggtgggagaggggccgccatcctgaagcacacccctcctcgtcttcctgaggcctccatcccttcctgatcttccaggtcatgggctccaggcttgggcccactgctgtccttctccactctctccccagggaacccacctgggttgtggccttaaamccagccagatgatgcttctccagcctctgcctcctgccgggccctcccctgagctcagaagctgccatcagtagccatgcaacctcccccttgccatcatgaagtatctcaaacttggcagcctcgaaacagagcccttggggagtttaagcagaaacagaatatttttgcatagtcttaaagtaattccccccacccccaaatattgagcaattacaaagggcaaaataggaagtttacggtggagaatcctggtggacacagccttggccaggtgatcaaggttcatgtcaccagtcatgaagcggcgtgcacccctggtgtgctgagaagggcagcttacctcctgcaggtgcccttgccccaacgcaccactcagcctaaccatggggagcatccgacaaaaccaagctgtccgcatctccaaggacaggcacactggggsttagggcttcagtgggggcggaggtacagttcactccctaatacgccatttacttggagaagccctctccagctgcctgaggcagaagcacccggttctctctctgcaggacccctgctttgttcttcctaggatgcgtcagcccctgattttccatgacagtcccctgtgcccatgtcctgcagcctctcctgggggcaggagctacagggtttcttgactcctacctcagcactttggtccaagctctgagcagagacctctgtaggcgtctgcaggactggctggcccttgtgtctgtctttcccctcgtcctggccccctttgtccactcctgcaccagcttccctggacccactgccactgcgtcacstggtcggatctgtgtcccctgcactctcaccacctccaacttgcatcccggtcccccakaccctgacccccaaaggcattgtgcatgtggatgagtgagtgaaggaaaggctggcgtgttgggtgtgcgaggtcgcaggggcatgaggtgcctggacggcagagagccagggctkggtgaggacctgggtgccaggtcgggggtctgggcagcctggtggccccctgaaaacgttcacatcccttggggcctgctgtgatacatactaatcagtgcttcatgagaaaggtatgagccgaaagaaatgggggttcccactggattggtcgtttctgcattgtccggagctctcagacctggtttcttaaccactgtgttcactgaacaccccgggcttgatcagctgctgagggtgacttcacatgagattataattgtactgcctaatagagtgctcacacatgttaaaactacctggcaggcaggagtgagaatacagctttcccagaaacgtgttcaaagaaaaacccattaccaacccggcagaacataaagtactagtgtggggtatgaggcagcatgtgggggcgctggggtggcagcagggccagaccccacttcaggggttgcccccaggancccccttgcggtacccgtatatcccacccccagactcctttccatragctgctcccagaccccctcatatccatcctgcctccagaacccctatatcttgctcccactccytaccatatgctgttcccagacccccctccatggcctgcccccagatccccctttgctgccacccctatatcttaccccagactcccccatatctcgcccccagaccctcctccatggtctgcccccaggcctgctggtaatatgggatacagaggtctcctcactgcacacacaaaactccttccctgagcgagggataggcagagctgagggcgggggtactggggggctgaggggggttctttagggcaggagttacctgccctgtagacggggagaccacattagtgtttgtgcaaagccctgccctcgtgmacctgtccttccgtagcccacgataccycatccagcccgggcccgtgggtgggctgctgagcacccgaccacagccaggcctccatgtgccactgtcaaggggacttggcccgccatgatcctgagtgcacaggtacattgctccgccctctcaacagccacgacccagaaataaagtaggcactgtaatttgcattttgaggataaggaaaccraataatagagtctactgagcgcatactcagtctttccagaccctagaaagtaggtaccattgtcatcctcatttcagagctaggagagcagaggccagacaggttccatagcctgctcaggtgggtccgtgctggaccaggagaagggccaggtaggctgatgggtcctgagcttgtgctcccgaccgccaggctgtgtgtctgatggccgaggccagggtggctcagccaagcccagccarcccaagactagaccatccccagcgtccaccccagcctcctgggcacaggggtcacctcccacccctggcccacccatacagccttttcccatctaaccttttctttaaaggaaggcatcccttggaatgagtccaccctgagattttatggatccaaagaaaaaacttaattagctgcataaactgtcagttgagactctccagaggacacacctccggctttcaggttccccagggaatctgaggctctgaggcaggtggacagccaggtccctctttacccagcaccaggtaaccttagaggcctggccctgccttcctcattttgaaatgtcaccctgtggtcatctctccttccctgatgtgaagcagtgaccagttctgccccatcctacacatgtgtgcacacatacatgcacacatgtgtaaatacacatgcatgcacatgcatatgtgtgcacacatatgcacataccttcaccttcctatccctccccaggggaaggccttccttggggctgcccctcctccactctggcarcattgggacttgaatcttgtggccccgtcacaactgtactcagctactccagctccttgtgtgacctctcagcccccaggctctgagctacctgaggtgaggtggggccacactggtccccacctcggtgcagcacacacagccccatcctgggagtgccacccaggtttcctctaactgtgctttccaagggctggaaggacctcttcctctatgccaggtgtgctagagtggccccagccgagaacctgactgggaccaagccccaggacagtggtcaggcacacacctgagtcgctcttcctcccatagacacatttggagttcccactgccttcctaggccccaccacatgctgtcacctccaggaagccttcacagnttgctccctgctgatagccttgacctgcttcccrgggcatttgcaagggagtagaacgaagaccaagtccgtgcaggggctgctggctctgtgctcagcacacgccccgtgrccacctcaggggcggctctgcgagtccccacttgacaggtgagccacagggccacaggcatggcttggggtcctctgcggagcccgatgtgtcactggccctcacgtgtccttctccgatctgctcactcattcatccattcatttattcagcaggggttcttgagtgtctctgaggtggagcgtctgctgtgaaggactggcgggacgcaaacggttaccactggtgtgacgggctctgatcaggaggcacagggtgttggggagctcagagggtgacatctcaccctgccttggccagtgtgggagggagagggttcagggaggatgtaactgtgtgtgtggcaggtgctgtggtggcacagagctgaggggacataggcacagttgctggatgcagggcttacaccgcgccacgcgtcagaagctagcaggggctgagcagcatctctgccctccccgcttgcacccccaccatccagtgcagcccagcacctagggggcatggggccagtgcctggcacattttgtcctgactgtggaaaaaagctcttcacagccctgagtgctgctttagctttggccccacccatcttaggctgctcagaggcctcaggcctccctggagggccagaagggattcccaggggcaggatagcayggacgggkggtccgctgtgtaagcctgggaaattctggctgcttgaagctggcacactcccctgaggctgttccaggcacagtcactgggtctccccgtcgaagtggctctaaggcaggtcttcccggttaccagcaagcagatacatgttgtaaygggctgagagtgggtgtgtatctcatattccccagaggagcttacggacagcccctctttaaggaacatctcccgggccgagcgttctgagcgccctctgagcaggcagcccgccaccggggcgctggccagtctgagtcagtcctgcctgggaggcagtcaactctggggaaggcagaagaatcacagcactgagtgccgtccagtttcccctcaactatattcgcggacacggcgccaacaggggaaaacttacatagcacctattcattctgaggcctggccggcctctggaaatcagcatttcagtgttggccaggaaggaggccagaactgtgctgtagcatttcaatgtatggctgtcccacaatttatattccagtcccctgatgatggacatgtaggcggtttccagtttttttcatgatcanagatcacacttctgtgaacagctctggatgtgtctccttgtgcaaatatggtgctaggtgttcttcagagcatttttctccaaacttgccgggtaatatggtcaccttggggagnttgttaaatatacatatttccaggtctgntctggtgggtctgatatttggagccaggaatcttttctttcttttaacagatacttaagtgattcctgtggtccaggaagttttgcaagctctgatgcagaagagctcrcyggagcaaacatgtatgttctgttttactaattagatatacgctgttgatgactccaaagtggacgtgccatttctgtcccctccagcagtaggaaagaatcccattatcccacatcctggccagttcttggtattgtgagatttttttaaacttcttctcttaagactatgatggtattttgttgtaatataatccacattttctatattattactgtgcttgagcacttcttcaaatgtttgatgaccttgaccattgaaacttcctttttgtgaattacctattcatatcctttgtagcttcactgtggaatgcttgttactgatttgtagccattctttatacatttcactcccactcgtttgtcagttatatgtggtgcacacatctgctcccagtctgtggtttgtctttccactttgtttatggcctcttattgggacacagttttaaattaaaatataatcagatgtattaatcatgatgttgtagtttgtgcattttctatcttgtctaagaaattcatccctctccttgttatacttagaaagaaggatattctacattctccttcaggagttctaaagatttgctttgcacattcaggttccaaatctacttgaatttgacttgtgtatatggtgtgaggtagggatttgattttattttctatgtggataacagttgttccattatcacttttgagtagtccaccttttctctcactgacttataatgccacctctgtcatgtcagcttttcatatttatcagttcctgttaaatgtatctttaaagctttattgagacataattcacatgatacaatttacccatctaaagtgaataattaatgtttttattatattcatacaccatcgctatcagtcaattttagaacattttctttttttttttcttttttttttttttgagatggagtcttgctgttgtcacccaggctagagtgcaatggcacaatcttggctcactgcaacctctgcctcctgggtttaagcacttctcctgcctcagcctcctgagtagmtgggattacaggcacccgccaccacacccagctaatttttgtatttttagtagagacggggtttcgccatgttggccaggctggttttgaactcctgatcttgggtcttgggatccacccgccttggcctcccaaagtgctgggattacagacgtragccaccatgcccggctattttcattacccccaaataaaccttgtaccctttagttacctcctcatctctgtaaccctaagcaaatactcatctgctttctgcctttgtgggtttccctattctaaatattttttatgaatggaatcatatagtatgtggccttttctgtcbtcttttactctgcgtgttttcaaggttcatccatgttgtagcatgtatcaggacttcatttctttttatggctgaataatgctycactgtatggatagamcacagttatttattcattcctgtgttagtgtatatttgggttgtttctgcctttggctattgtgagtaatgctgctataaggattcatgggcangtttttgtrtggacataggtcttcatttctcttgaatatatgcctaaggagtggaattgctgggtcacgtggtatctatttttaatcacttgaggaattgccagactattcaaaygcagctgcaccattttatgccattttacattcccaccagtagtgtatgagggctgatttatctatgtccttaccaacgcttcttatctgactgtttaattctagccattctagtggctggtgaagtactatctcattcagattttggtttgcaattccctacaatgatgactagtgatgtcaggcatcttttcttgtacttattggccacctgtatgtcttccttggagaaatgtctattcaaattttttgcacaattttaatacatacatatatgtatatacacacacacacacacacacattttttctttttaaacagattctgctttgtcggccaggctggagtgcagtggcacaatcttggcttactgcaagctccgcctcctgggttcatgccattctcctgcctcagcctcccaagtagctgggactacaggtgcccaccaccacacccagctaattttttgtattttttagtagagatggggtttcaccatgttagccaggatggtctcgatctcctgacctcgtgatccacccaccttggcctcccaaagtgctgggattacaggtgtgagccaccgcacctggcctatttatatatatattttttaaagtcaggatctctgtcacctaggctggagtgcagtggcacaatcacagctcactgcaaccttgaactcctgggctcaaaccatccttctgcctcagtctctcaagtagctaggactacaggtatgcaccaccattcttggtgaatttttatttttatttttatagagatgggatcttgctatgttgctcaagctggtctcaaactcttagcctcaagcaatcctcctggctaggcccctcaaagtgttgggattataggtgtgagccaccacatctagcctcctttgcacattttaaaagtggattagttgcctttttatcattgagttgtaagagttgtttatatattctggatataaggcctttatcaaatatatgatttacaggtacagttgacccttgaataacatgggagttaagggtgcttgctgcctatgcagtagaaaatctgtatatacctttgacttccccaaaatttaactacagataccctgctgttgactggaagacttactgaaaacataaacaattggttaacacatattttgtgtatgtattacaccctatattcttacaataaaggaagccagagaaaagaaaatttaagaaaagcataaggggctgggtgtggtggctcacacctgtaatcccagcactttaggaggccgaggcaggtggattgcttgagctcaggagttcaagaccagcctgggcaacatggtgaaaccttgtctctattcaaaaaaaaaaaagaagaagaaaatatatttactgttcatgaagcagaagtgaatcatcatgaaggtctttatcttcattgtcttcacattgagtaggatgtgagtaggctgaggaggtggaagaagaggagggttggtcttgctgtctcaaggtggcagaggtagaagaaaaactgcatataagtgggcccatgcagttcaaacccagttgttaagggtcaastgtattttctcatattttgtgggttgtcttttcattttcttgatgttgttttttaaagcataaaagtttttaaagttttgatgaagtccatttgatcttttattttctcttgttgcttatagttttggtggcatatctaagaatcctttgataaatctgaagccatgtagatttacccctgtgttttctcctaagaattatatattcttagctgtaacagataggtttttgatacattgttaattcacttttgcatatggtgtgaggtaagggtacaacttctgttcttttgcatggtgctatccagttgtcccagcagcatttgttgaaggctattctttcccctttgaatggtcatggcacacttgtcaaaaatcagttgaccattgtagtaggctgttcttgcactgctataaagaaatacctgagcctgggtaatttataagaaaagaaacttaaatggcttacagttctgtaggttgcacagaaagtaaagcagcatctgcttctgggaagcctcaggaagcttccaatcacagtggaaggcaaagcaggagtaggcatctcacatggcgagaatgggagcaagagtggtaggggtgccgtatacttytaaatgaccagatctcatgagaacttactcactatcgcaaatatggcaccaagccctgagagatctgccccatgacccaaacacctcccaccatgccccacctctagcatggaggattacaattcaacgtgagatttgggtggggacaaatattcaaactaaagcaaccatacacacaaagttttatttccagatttacagttctattgcattgatcactgacatgattactgttcctttgtagtaagttttgaaattaggaagtatgaatcttcctactttgtacttctttttctagatcattttggctattctgggtcctttataattccatatgaattttagattcagcttgtcaatttcaacaaataagtcagctgggattctgaagggggttgtgtcacatccgtagcccaatttggggagtgtcttagtccatttgtgctgctataacaaaatacctgaaagtgggtaatctataaataagagaaatttagcttgggcaacatagggagaccccatctctgaaaaaaaaaaaaattaggcatggtggcgtgcacctgtagtctcagctactcaggaggctgaggtgggagaatcacttgagcccaggaggtcaaggcagcagtgaaccrtgatccactattgcattccagcctgggcaayrgagcgagactctgtctcaaaaaaaaaaaaaaaaagaaaaagaacagcaatttatttcctcacggttctggagctgggaattccaatatcaaggcactggtaggttggtgtctggtgagtgctactctgtgctttcaagatggtgcctcttggtttgtcctcacrtggcgaaggagggaaaggagaaacagggacgaacagtgttcatagcagctcttttatttataaattgctaatcctgttcatgagagcagagccctcatgactgaatcacctcctaaaggccccacctcgaaatactatcacgttgctggtttagtttcaatacatgaattctggggggacattcagaccgtagcagggagcgttgccatcttaacaatattaagtattttgctccatgaacatgggatgcttttctgtttatttagatcttctttaatttcttttaacaagtatcattaatccaaaaatctgaaatctggtatgctccaaaacctgaaactttctgagcactaacatgacagcaacagtggaaaattccacccctgtcctcacgcgatgggtcgcagtcaaaacccaatcaaaaccttgtttcatgcacaaaattatttaaaattttgtataattaccctcaggctatgtgtctaagcatatatgaaacacaaattttatgtttagatttgggtcccatccccaagatatctcatgtatatgcaaatattccagaatcaaaaaatatatakagagagaaatttgaaacacttttggtcccatgcattttggataagggattctttacttgtattttgtagtgttcacaatataaactataatataatacaaacaatataagctaaaatataaaatttgcacttccgttgtcaaatttactactgagtattttattctttttgagctaccataaatgggactgcattcctgttagattttttctttctttcttttttaagaaatggagacttaggccaggagcggtggctcgtgcctataatcccagcagtttgggaggccgaggcgggcagattgcctgagttcaggagtttgagaccagcctgggcaacacagtgaaaccccgactctactaaaatacaaaaaattagccaggcatggtggctggcgcctgtagtcccagctactcgggaggctgaggcaggagaattgcttgaacccrggagatggrggttgcagtgagctgagatcgcgccatcacactccagtctgggcgacagaacgagactctatctctaaaaaaaaaaaagaaaaagaaaaaaaagaaaacataaggagccttgctgtgttgctcaggctgacctcaaactcctgggctcaagtaatccttctgcctcagcctcccgagcagcaagcagggaccgagcagcagggaccataggagtatgtcactgtgcctggctagatgtgtgtgttttctttttttggagatagagtcttgctctgtccaggctggagtgcagtggcacaatcttggctcactgcaacctctgccgcctgggtttaagtgattctcctgcctcagcctccggagtagctgggactatagctgtgtgccaccacacccagctaatttttatatttttagtagaggcggggttttccatgttggccaggctggtctcaaactcctgacctcaagtggtctgcctgccttgacctcccaaagtgctgggattacaggcgtgagccactacacccggcctagatatgtttctaaaacaacattgtgtaggaaatttttcttaggctggttcaaggctaacatgctgaaggtcccaggtagtgaagcaggtgaaccctgaaggaccgtgcccctcccacacccaccctagcagctgttccacattgtagatggatccctgcgtccctacattgtcacctttctgtctaaatgagaggtggggagaaggaggggtgaagaccaatgaggttagtcacctcaaggggtggggccggtgcagagaaagatgggaactgttccctagtcctcttccttctggagttgggagggggaaatagccctgccccaacatgtgatccagcatggactatggtcagttacaaatatgagtgagccaggcccctgccctgaagganctcccagatttgtggggaagacacaaactcagcacagaatggaaaggggcctggggacacagtgctgtgccgagcttggaatttgtttcatgaagggacagccagcagtgtctgtgcaggtccagggaggctccacaggggaagtgagatttgagctgaggcttgaaagaaaggtggaccgagaggagacgactttccagggcaggaagtggcctgcacagaggccccgaggcgagaaggaccacaactctcctgtggacctcctctttgtacgatcagttttaattacgcaaaaaaattatgcagttaaagctttgctcatttaaacagaccttccctggattaagagtaattaggttttattgtcattgtcttgaaaattgccttgccatggacctgtgaacacagaattatttatatatgtgtgcatagaaatcatctcatggatttttttttaactgagatgaacttgggggattttaaaggtaacaaacaaccccttctggctggtgtgggggaagccctaatttgtagtgcttgctacttttttttttttttttttttgagacagtgttttgytctcgtcacccaggctagagtgcaacggcacaatcttcactcattgtaaaacctccgtctcccgggttccagcgattctcctgcctcagcctcccgagtagctgggattacaggcacctgccaccacacccggctaattatttttgtattttcagtagagatggggtttggccatgttggccaggctggtctcgaactcctggcctcaagtgatccacccgcctcagcctcccaaagtgctgggattgcaagcataagccaccgcgccyggcctccactttctrtggtgtaaatattcctaccatggctgatttcctctggggaagccatgtyccctccacttctaccttcatggtctttgcttgtttattttcaaatgtggcccaaatccaccctgaggcaggcgcagtggctcacgtctgtaatcccagcactttgggaggccgagacgggcggatcacctgaggtcgagagtttgagccagcctgactaacacggggaaaccccgtctctactaaaaacacaaaaattagccaggcatggtggcacactcctgtaatcccagccactcgggaggctgaggcaggagaatcgctggaacctaggaggtggagattgcagtgagccaagatcatgccactgcactccagcctgggagacacagccagactccatctaaaaaaaaaaaaaaaaaaaaaaaaaaaccaaaaaaacccaccctgagtttaaaagaaaaaggctaagaaatgcttgctgggctgtctcaggggtggcagtggagctcccgtgcctcccacagatgaggacgtggaggccctggccgagtgctgaatgcaggttgggggacagggctgccggcctctgtaaggatggggaccccagacccacccggtggagctggggctgaaggccgtgataaacacagcctcaccctggcattgcccacctccactggccaccagctttgacggacagccccactgccactgcccctctccaggcaggccacattcacaggtgttctgtacagagagcagaagtttgagaaaacgtgacccactgaacagacacttgctgaggcccgggggcttcatgtgtcaggcccagaggtggccacaggcacaacacgcgtccctcagccttgccacctctgctgccctccaaggtgccctgggtccagctggccagaagcactgctttctggagcagccacttatgcttttacttttttctcttctttttttttttaagactgagtcttgctctgttgcccaggctggagtgcagtggcacaatcttggctcactgcattctccagttcaagtgattctcctgcctcagcctcctgagtagctgagattacaggcatctgccaccatgcccggctaatttttgtatttttagtagagatggaatttcgccatgttgaccagactagtcttgaactcctgaccccaagtgatccgcccgcccaaagtgctgggattacaggcgtgagccacagtgcccggcccagctttttcattttgaaatcaatacaagtttttacagatgtctgcaaaaaatatccatattgatggatcctggctcctcagaatctgaggtttttacaaatgtctgcaaaaaatatccatattgatggatcctggctcctcagaatctgaggtgacagcagcttgcagaggacactgctcccccaacactgccttccaagggagacatgccctaccccaaggcctcccttgtcccctccctcctctgacagtcaggtccagggggtcctggagagggcactggcccaccctccacacatgttgcacagtgccctgggaatgaggaaggaagggcaaaggttagggaaaaccagacgtcagtttcttgaccagccacagccggtgcagcgcggttatttatagccctggtggagcgcccataaatcaaggctttccccagcagcgcggctgtgagggctccgagatgatctcatggtgccyctcccttgaaccatcccagagaaaggaggcctgtcaccttcaaggaccaatgcttctgccgggactcaagcagaacctgttcctgctgctgcaaggtttacaggcagccttggggacagtccgtgcagaaatgtcaggagccttttcctgcataaggcatctcagagcttatagcacctccttggcggtggccgtgctcgcagcctgatacatgggacctctgtctcacttgcagtgtgcaccgcaggtcctaattccttatctgttccaaccacaaaagcttccactgctggatggagccctgttatcattcaggcttctgagccacctggaaggcaaaggcctctctgtgaaaatgaaaacttggctttaaaaagctggcatgggctcagccatggagttgcttagatgtagttcacaatctcgcagacccacggcaggattccacccaggagaaggtcctggaggtggccatggggctcagcagaatgagccgggaggagcaggactgttgacacgagagcaggggtcaggctcagtgcacaggtcccagtgtgcagagctcacccggccccagctttcatcacccatctgagatcggcctccttcactcctgttctctgggacttccttgtgtgttagagactcgagcaagaccctttcttgtctatccccggacggacccgcctttcccgcatctctgggggtgaggtcggctctcgttcaggcctgcagggtccctggtgccgcagcccctctggttggaaggccccctrcgtgcagccccgtcctccagccccgctcggctctgaatgagttcattatgtctcagckcgccctggccgccaggctggcagttcttcgggctggcggggctcgggagctgtcagcctgccaaatccagttgtttgacttcatgtttcaaggccaaatcctttcaggaaagttctctccatcccaccactccaccgccccccgcccttagaaaaataaatgcgtgattgactggctttgcaggtttttyatccatcgttctttccaaagaatagtgtgaacagctcattcgattcgttcatgtgrcgtcctccctctcccaatccctgtctctctctctccttccacagccacatgaaattgaagtgggagaacatggtgtgtgagcattattgggggtggggtgcggagcaggcactggctttggttgaggtctgcaaaggaaagcacccccactgccaggctgctcaggagtggctcccaccctcgactgcggggaagtgctggaaccctcygcacgagggcaacctttcttgggctctgaaggcgcctctcatcctctgagccaagaagacttctgacccagaattctgagttgagttccgacgcaggcrtgggygatggtgagcaactccaggctaccccgagaaagccgctgtgtgaccccattaggggacttggctctcctgccaagcccccacccagcacctgtcccttgtgtcatgactggacttgttacttctagcccaggagctccaggtgaaggggactgtgttggtcctntctgcccaggactctccccacccgcacagtgtacctgtcccacagtggcaccaacaaggctcagctgagcccttgccagaggagacacggtgggcaccagccccagcgctgccacctgcctgcctcctctgccaccgagggaagccatgtcgccttcctgagcctgcttctctgtccacaaaacaaagactagataattagagtgcacacttggagggacaggatggcttcgtatccatctggctgtgccctgtaactcaagggatgggactgtgtcattggtaaacactgcaacaggcctcctttccaggaaacaggatccctgtctcagacagaagcagtctcgcccatcctggggcctgagagcatcattcctttgtgagactcaaatgtgaggaattcctgtttcctcaagtctgtgtggggagtgcagagcagccctctgagggggtagcgtgtgcaggaaataagccggggggaagggggcaccgcgggtgggtgttaactgctgcttcggggtccagtcctgttaatgaaagcaggggtgaggcaagsggggaagactctctgtacctgatcagtggcatgtgtgtggctccagccggcatggcctgagctgccggtgagggagaggcctcagggagaaaagacaaaagctggggtgcccctgaaggtggggcagagctggggcagtcaggggctcttccacaggtgcaggcctggtgctggaggacacagtccataccacctccaacccccaccacctcccctgccatggacagtgtggggcaggctcctgaggatgaggcagcctgacccctacccctgggctgtccccccgactcctggtttctctggaagcctggggttccaggccatgcaggtagagaacaacaggtttaggacaaagtcattgtggacactgaggcccagaaaagggacttgcccaaggccacacagcaggtggccagcactgtgtccgtgtctctgttattccttcctctgcttgctttgggtttattttgtgctccttttctacttccttaagatgggagcttcagtgatcaatttcagatctttcctctcttctaacaagcatttggtactatgaatttccctctgaatcctgcttcagctgcatcccaacttctgataccaggtaggagtaattgttctaagctccgcagctgactacagagagcggccacatttgagaaacattctcatcttctctctgatcttgggtctctgacaatggagctagcaacacttcctggttttaagggctctgaggagcaaattagactgtctggtggtgaagaactttgtttaggaacaatttaagatgccaacaggttcatctgctctcctgcctccttctccccaccttgtaacacaccctagacaagtcagcnctcaagtttatatggacaaataagcaagtaaaattagttaggaaatcaaatattggggttggggaacaataagagaaggcaagccctatgggatggtaaactgcagtataaagccccatttgctggcacagtgtggtctggcctgtgactaggtgagggacagtgcggggtggcctgcctgcatatgccaggttctgtgtatcacatctctcaccaggaaggcaaaacctggcagatggcacccnggcctgatggctcctcaaccctctcagcaccccaaagagggaagtcccatcaccctcactcacccagccccgggctggccctgtcagctctcgaactgcagcatacccgagctcttaaagcacactggacctagggctcaggtttgagctttcatgatgagaccctgaggtcactggcggggaaaatgagtcactggggcattccccgaacttgggaaaagccctgaccccagaatcctgagcctaaattgctgccaagttcccgatttcccttccagtcctcagtttccccttctctccggcaccctcctgaggaccactgagccccaaccaccaccatgcccatggctggtgcccaggaggtgggagctgtggagctgcctccaggccttcccggaggccccatggctgtcttacttggtttgtggcttcccagtaaacggtgggacaggaccagggtctgaggaaaagcaaagcagtgttgacagagtgtcctggagggcagcttgtctccctggcctggagatgaaaactgaagaaaacaagattccgtctaggaatcgtccagggcgcggcagcccgccaggagcccgggcagcttggatggggtccctgtgggcacaatcggcccagtgtggggcgcaccgccccaggcaggctggcgtcccgggggccagaatgaatggaccctcactgggccgctttgacagtttatgaggtgatgacgttgcagctatgattgatgaggtggcctcagtcggcgtttcggggaaccgggtacaagttgctagggaaatacagggggagggtgctgccctccccactggcccgctctgggtccctgtgctatgcctcagtctccccatctgtgtggaggaactgatgaagacagcacatgccccctgccctggtccctggattgcaagtccagacagaagagagcgtcctgggaagccagctgagagcacctctttctctttgggtcctgcagcccgtgggtggcagggcggtaaccccatctgcccagaaccaggctgcgctctcgggagggaaacagactcttatcctcttaggtacagcctccctggccgcctcggatgagcatctgcccctcccgggcctcagtttccacacctgagatgggagaggttgcatcctaaaggccctccatctctcaggttgggggatcactcttgtttccctgcagttgtttccagcattagagtcacactggggtccttgttctagcccccgcgtgttggctgcatgacccgaactttactcccatgtcctcctcttgggggtgtgacatgaggtcttccccaagtggccccgagtgaggcaccaccatggacctgatgggcagatcccccagggcactctatccagagggtggtggacccaaacgcgacgtccccagtggcggtggctgaggagaggggttggggcgaggaccagctctgggcagtctccaggtcatgcgcgtttgacgcaggaggttttgccggcgccaggggctccctcggctgaccgagggtgtcccttactccataaggtactgatatggtctgcggagcaggtggcatttgccatgcctgccctgcttgggtatttggccccagggccagggctgtccctcccacagctattgaacaccaggtccttgctgcgtctggctgggctgcagaatacccttgacctttcagcatcctcagtacctctgtggagtgctgccatgaccaaactagagactgttattattacgcacattttaagacagcatcggccggacgtggggggctcccaccagcactttgggaggctgaggcaggcggatcacttgaggtcaggagttcaacaccagcctggccaacatggggaaaccctgtctctactaaaaatacaaaaaaactagctgggcatgatggtgcatgcctataatcccagctactcaggaggcggaggcaagagaatcacttgaacctaggaggcagaggttgtagtgagccaagatcatgccattgcactccagcctgggcggcagagtgagactccatctcaaaaaaaaaaaaaaaaaaaaaagacagcatcactgtagccaagggaacttaaaagaaaaaagtgcatgtttagacagttgttcatttcctccagtttcctgccagcccccttctgtagctgtgggcacgtgcacatataagtcttctctttctcaccctgctcattgttcatagctgcataatattttacagagcagataaactctgccggccttaactactcccagggtcgaacgtctccttttctatcgtaaatatctctgcaattcctatagcttttttccttcaattcagtaaactttttttttttttttaatttgagatggagtctcactctgtcacccaggctggaatgcagtggtgtgatctcagctcactgcaacctctgcctcctgggtccaagcaattctcctgcctcagcctcctgagtagcttggaaaacaggcatgcaccaccacacccggctaatttttgtattttttagtagagaggggtttcaccatgttggccaggctggtcttgaatgcctgatctcgagtgatccacctgcctcagcttcccaaagtgctgggattacaggcatgagccaccgcacccagcccctttgctcttcctttgtcttctgccatgattgtgaggcctccccagccatgtggagttgtgagtccrttaaacttctttcctttaaacattacccagtctcaggtatgtcttcattagcagcatgaaaacagactaatacaccatgtcatttaatgaggctgggcctgcctctttctgatggaatgaactctccccaggtgacagcctctggtcccctctgcctttggagtgacttctcctgcatgggggttctgggcagggttggggggtgaacactggagagggatcagtcccagctctgttcttccccacccgctgcaacctggttggggacgcgaggagggcacccagcaggctgccagggggaggaggagggactgcagtctgggcccagagcccggttgtcccccatggagccacacagcaggcacctcagagtttgcatccattggagatggccaggagtctgctcgtgtgggaagaatggcttctgagcgccaaggtagcctgtgctggagccttggctgccatagaaggccattcacgtccctcacaccctggcctgtgctgctgggaaggctgtcactcctaaacagttatctgcttctgtgttaacctacagggattccctctttgctttggctgccagggaactcaaagctaagttttttcgctcacattcccaggcttctggtgtagatatctccrttcttccttactgtggtttctgagccatctggtgtagatatctcccttcttccttactgtggtttctgagccaccctgcaaacttcctctgcatctgtcccagtacaaatatcactgtgtgcccttytaggctatctgggacacttaaaaataaataaataaagacatctgtctgaggcttaacttgcatatagcaaagtgcatgmatctgaagtgtgtggctgatgaatctgtacacaccgctctccctgcacagccacccagatgaagacgaggagcacctccaatacscaagcctccctccacccagtcaacactcttctccagagggagctagcccgtgccttcacccccgtcttctgcctgacggtaaacttgaggtgaatsggctcctacccatgaacacccaccgttcatttcatccgtgttgttctgtgcagccagactccatcctacggcatccgtgggtgatgtttcatcacgaggctggaccacgatgtgtttatcatgtcactgttgctgtcacatgggctgtttctggcttggggtccttatgaacagagctgatcagaacatatctgtccatggctcttggtggacatagcctcatttcatgtgtgtgactcaggagtgaggttgctgggtcccgcggcattcatgtgtttagtgtaggagactcttgccaaacatttctccagagtgtctgatgtaccatgttgcgctcccgccagcctcgctgagttcccatagcaccatgtcttctgcagcacacgatgtggccggacctctccacgctggccattcaggtggacgtggagcggtgtcatttccttcctgaggggcctgcatgaatcccttttaggtggaacacacacagagtgggccggcgctcataagcagtcccgtgtgaatccttggagagctgtggaggtagcacagctgcatctctaggttggggccactcttttcttggaacaagagccctaaacgtgggaccctaaacaacacccagggaggagcagcctggcctatgagcagggggacaccatgaagctgggtggacgggtggggaggcccgactttaagggacctgcttcctaagcaaacaggccaggacagaggctgcaggtataagccctgccctgccaccatgatggtgaatatgaggtgtcaacctgattggattgaaggatgcctagatggctggtaaagttttgtttctggctggttaagtgtgtctgtgagggtgttgccagaggagactgacttttgagtcggtggacygggtgacggagacccaccctccgtgtgggtgggcaccatctcatcggctgtccttgtggctggaacaaagcagatggaggaaggtgggaagactttgtttgctgggtcttctggctttcatcygtctcccgtgctggatgcttcctgctctgggacatcagactccaggttctttgacctttggactctggtttagctggagctctcgggaggtgtcggcttccctacttttgaggattttggactcggacttggccattaccagcttctctcttccccagcttgcgtacggtctgtcgtgggacccgcctagtgatcgtgtgagccagttctccctaataaactccctttcatgtatagacatggatcctatgagtcttttccctctggggagccctgcctaacacagtggcatagagctccaggcaggcccctcacctggcyttcagcttcagtttctttgcctactgggctgaatattggtgtcaccacccaggatagcaagtccccatcagtgtcactgccacctgtcgaagagatcccccagcccagcactcgggtctgtgagtggcagtggagatgacactaggctctaagtagtggggctgcgtgactccagcgcccctaggaccagcaagggcacccagagcactgtgggaggactggtgccgcctccctgmccccctgctttctcctgggccactgggctagacatggggcctccctgcccccatrtggtttggcctgaaaaagagaggaggtggggtggcacttctggggcagcccagagtgagtgccctgccctgagcccagcgtgtgcccygcctgtgcccctgggtggggggtgcatacagacctcggggggatctggccgttggagtgcgcactgggagggacggagtcagctctttttaatctaaacacacaccaggtgcttaacgtgtttttatcaaaatatcaagcacagctgcaagaggctgctctgctccaaggccctacgcccaggcccgtccctctgccaaagcgagccttttaggtgagccctgccggccacctgctagcccaggccccggctcctggtgggccctggaycaggctgcaagcatwtccaagtgcatggcagtgagacgtccaggcctcccagccccaactctgagcctccgttgggtcagcggtaagatggggcagtggcacctacctccccggctgctgtgaaaaccaagtgagcggaagcatggcascccctcaccaggtccccagtgggaggactctcaatgattggcactgccaggagtaatgttatgagaggagcrtcccatcagcctggaggggacacaggctgggtcagcacccacaggggcttccgcttctctgtctcagggggtccagggtggccccttgccactggtccccaggcacagccrctacacaggtgcctctgcagggtctgggagtcagctgtccagggcctgcttggccaccgcagggcaggagtgtggcactgtgagcctggtggcctggctgggcgtggccttgaggttctattgataaccccatggggaaagcccccctgaggtgcttgggcatcggacctgcccaccatctcctgagrtggggcctgctctccagacagtcaggtcagcatgagttcccatgaggccagggccagcacgaggamytgctgggagcggtccatccacccatccgtccgtccatccatccatccatccatccatccctatccacctgtccaccctgatgcagttcctgccatccacgtgtccatctgtctacccgtacacctgttcatccccatccatccatccccctgtccatccctgcccattcatccaccctgatgcagcgcctgctacccacccttctctgtccatccccatccatccatctctgtccatccatctgtccacctgtccatccccctatccatccctgtccattcgtccacccatccaccctgatgcagcacctgccatccacccttttctgtccatccccgtccatccatctccatctatccatctctgtccttccatctccatctatccatctctgcccatccatccatccatccatccatccacctgtccatccccatccatccatccctgtccatccatccactcatccaccctgatgcagtgcctgccgtccacccttctctgtccattcccatccatccatccatgtccatccatccattcattgcccatctgtccactcacccatccactcatcccacccacccatccatccacccatccgtccccagccatccatcctcctgtccatccctgtgcatgcatcatccttccaactgtctgtttgtccattcccatccatctatccacccatccacccaggcgagcacctgccatgcccacgacctgcaccatctcggtgaatctccatcgtagccccaggaggggctcttttcagctgcactttcaggatgagagaagggaggctctgagtggccatttgcccaaggtcacacagagctcagggccagcgcttcccatggccaaagcccaggccccctctgccagtcccgcctccaggcttgcaggtggagcagccaggggttccgtactccctgccaggcagctgccagccctccccgctcccctctcagttcctcagcctggctatgggaggcccaagtcccacgtgtmactggaattcgggaggcctggctctcaaagctttctgtrcaaaacaaggagaaaaagagaagccacttttgctgtctggacatgctgtgggtgtcctggggaatgtgctggcccactgcttggggcctgacttggagtgcccaggagctgcgtctgcactgtggcttgaaccgagtgtcgtgctctgtggacagagccatccactctgggggtgctcntcccatggcactgtcagcccccattctggaaggtcccaactgggtcccccaggcctgtgtcccagagaccttccaggtcttcattcactgatcatgcatttattttgggggtaggataggtcctgaagaccacagggcagggatctctgagttggggcttttgcggagtgagggagtgagagggtgttcyaggcagaggaggtggcagagaaaggcaccaagtgaggcaggggcagttggggacatgagtgctcgggagcggggagagggggcagctggtgggtaagcagaggccagctccaaggcccccctgtgggccacattagggagacagggtctggccttgttggtagcgcggcccctcscagtgatgggtcccctgtcagacctccaggatcctgggttgctggtttggcgcagccccggcttctgtgagcttttgtttctgttactggcacctgcagctcttcctaggcccctgccctggggcactggtgcctgcttcrccaaaggcacagagggctgcaggygactggggcagggtggggggctygcctcttagggctcagcttcactggccagaaacagggctggctcgakctgggtgttggcctgggtggggtggccagcatgcccacacctctcagtctggatgtggggagaggttgttccatccagggcagttggtctccagaaggaaattctctgtatctgggtgctgcaacctaggtgcccggggtctcacgcagtggggcctccccggaggaggtgaagtgcatgtggcccctcgtgctggatggagctggactctagggaggaccaggagggtgagctcaggccagggcgccaaggccctgagccccaggggcctgcctgtctgcccatcantcctccactcatggggagggactgccccccagcccagatttctaggagggccgaggctcacaggaagccaatgccaggcgataacccacagtccccagtggtcagtaggaaggaggctgcctgcttgtgtgctcattaggagccaaggccatgaggccactaacggaatgtccctgatctcagggatctcagtgtggaggtggcagcacacaggtaaccaaacaattgtggcagattgatgggtgctntgatggggtccacacagttaccgtggagtgcagagtgggcacctaactgaggaggcaagggttggagggaggaaggtttcagggaagacttcctggaggaggtgacttgttcttagggaatgaggcccagggagctaaagctttagggcagggcagcagattcagagacacccccaggggtagggggaagtgcactagagtgncgtgtgcctggcgtgggaacagggagacattagagaatagtgggagtgtggcaggctgggcccgccttgcccctttcaaggaagcagctgccgcgtcacacgctgcagcgcagtgctgcccatggtttgtcggcccatattgtgggatctttcagattttctcaagaagccaggtttccagctcctagntttgaaaagttctatgtgcgcttgaccggggggccttacgtacgtgaattgggtgagggcctgagacaggcgggtgagcacttgccccacactccagccaggnttgggggttcaaggnaccgcatttgccacgtgagngagtctctggagaccaccaacccgctggtgggcggccaagcgtcaccaccagtccctctcagtgcgtcccacctctgttctcagcccctgyggtgcccgcagtcagtggggcagtgagaaccgcgcaggaaatagctggcgccatggtgtcggttctggttgacagagtgccacctggctaaacccagccgtaaataagccccgtttcctccctgtggacagagactggtgggtgccaaggttcacggcaaaaacccttccccgccaggccccactgctctctgcctggctggcacacgcccttgcctcaggcctggctccccgggtcctgttgaccaccaggctgcagatcccaaggaargcaggcatctgggtggccccacgtggagcaccagccatggggaggccgtgggctaccaggcccygcgtgcactcgcagcatgcaccactccttctccaggtcccgtrgacctccatgtgtgctgtgccccgtcctccgctgcactgcctcttcgtagtgccccagctccatccgggggtgggtgggagtggagacccctgcctacaggcctccgggtctagccagagtcaaccagcccaccagagacacccagatgcaggctatgccccacgtgcccagggaggatctgctgacgtgagcccagattmcgattcttgtgcgagggagacgaaccaggtttaaaccccagctctgccacttctggctgtgactttgagcatggctgttcatctctgggggtctctctcctcatctcagagaagcagatcatggtgcgcaccccatggcgcgctgtgcagagcacatagagacgccacccacagctggcttactgcagaggtgtgggcccattgtggtatcgctgatgtcctggaggccacaagtctgctagctagaggagcctcacctgcatcccggggcctgcccactggctggtggagagctctgggttgtgggcagcaggcaggcctatttccagtgagtctgtggctcctgggggtgtgtgagaccttgggcagatcccttcctgtgcctcggtttacccactagggctcagagccctgggggactggctcagtgagtgcctcctgcgaggagagacttttgtccttactagccagaggacaggtcagccggggcaggctctgggccctgggcaccacccactggaaggaaagggggttcagttagcccagccctgccccccaatggaagaaaattggggttcagttagmccagccctgccccaccccagctcttcacacatccagatccagatgggggccagaycaccaggagactgtarggatccaaggccgaggggcaggagacgcagtgcgcccctctcctatttctgggttgcaaccgcccacacatgtgcacacagggaagatgtctcttttggttggggggcacaggaccccacctcactcttagctctgagacacccttgtcaggcctcctggacaggtgggagggacagggcagggtggggtgtggccagctgcagtccctgggaggggtactggggctgggccaggccagggcaggacagagttggggaatccaggcccctcaccattgccctggctctttgtatgtagtgctgcctgcgggcggcagcctagctggacacctgcagtgcgctcatgcccagcctctgtgggtgtctggctcaccccacgtgggaggaaggcggcacgggtggtttgggctgggcaggcccagcccgggtgcacagctttctcatccacacacacattccatgtgtaggggctcagggggaggggtcacctcctccctccccacccctccttgttacagaggagcagatggccaaacggatgggggacaagcacctgacagggccactgctcctgctctcagctgggccagtgggaaagggagcttggcacctccaagggaggtcccagccaggggaagtgtgtccccatccctgctctggtccccaggccagagaggtgagggacccagagaggcccaggatgaggactccttcagkcctgggtttttgtttggattttttttttctgccaagtgacttraaagccgcccgagaaggtcctgtatgtgtgagcaggttgggcaaggggagggcgggtctccaagctgggagcctcctcgcggccctcgcctcggsnctgatgtggccctggaccctccggtccctccaggccacccttcgtgccaggacccagctggcttcaatggcaggaggtgccctgggctggagggtccccasgctgggctccggggctccaggttgactcagcagtccccaggcctgtgggcagagctggcctgggaggacacgggcctgagggctgagcaatccctgagtgagaacaggtagctgaggctggagcctgtgtcccccaggcasctgctaaggcccgggcctggggctggagtgctgggctcaggtgccatgtgagctctttgcaggcagggaccaggtcagagtcctttgtgtgcctcttgacccccaggtcctgggagaagaggggcttgggaggccttggctggatgcacaggctccaygggaaggagctcctgctcgggtttctttgtaagcagcacgacatggcaccttcccagaggtacatgggtctgggcatgtcatyccccgacctgcttccagaacccaggggacggaggtcggagcagcctgcctgagatctgtggccatctccactccgccacccagctaccccgtaaggaggccaccgaccctcgggcacctgccagggacccagctcaggccaggtcacgggctggatgtgggatgttctgggccttctgcccacctcactgggccccagcaagctgctgtcctgagggtggccgtgctgggccagcacgtggacagcagggaaccccatgggcacaggcctagtgtgtgtgatgtaccggtgcagaccatctgataagcagccttcagagaagctgcgggtgtgcaggtggaggcagacctcccagctgcatcctccaggcacttgccagggtcaggctctggtgaacacccttctagaaataaccccccaggcccccgggggtcttgggctcctggggttctgatggaaggatgccccttgcccggcctcactacctccacctcatgaatcaccctctgtccttgtcctgcaagtctgtcggcacagccgagctggcgtcaccctctgatgccagtgcccrgatccctgaattcactgggcagccgccccctgcacctggctcccagccaytgcctttccaaagcaaatggggacagggatacctgcccctccctgggtaggcagctgttgckgcctccagttgtgagagtctctgccccaccctgccccttcccctgcccctgcagggtagagaggaggcgggtgggccaccgactgggagtcccgggcagctcaggtccctcaagagcccctcggggagaggccgcacccgtctcccttggtcagtgttccccaggaggcggtgctggcctgcgtgtgccctggaggaggcggcagggagactggcctcatggggctcttttgctggggcctggccaccattttccttcgattggtacaaagactgtccctgtgaagctggccaggccccaggcacagaaccgccttgttttctgcctctcactcacccgttccctgcattcggctgacagagcatgagggggaggaatcactgatgacaggcactggcctgcccagctgggggcctttgtttattcatttggtgggcacttcctgggtgcctgctctgggtcaggcctgtgggggggaccactgagggcaggaaacctggcctgtccctccaggaagcgaagtcaacactggcacctgcagatgaagtggcagagcagcccccagctttgatggcatggggtggttggggggcacattctgcatgctcagaagagagagcaactcgccctgtggaaggagcatacagtgggagatggggacaggtgagtggggtcttgaaacgtgaacaggagtttgcaggtggagcaggtttcaagagcattccagggcacagcatgggcaatgrcagggagagctgggatgtctgaagagcagcggcccagacactgagtggctggcgaggsgagggaggtccgcgggtggggcccagtcaggatggactcatctgccatgctgaggagcygggctatgatgtgggcaatagggagccacagcagtttacacaggggaggcgggagcagctgagcatttagggaaaccactctggctgcaaaagaggagagggggccaggctggacggaggagccagtggagggggagggggaaggggaagggaacaggcttcagcagaagacctcctgccttcaaggggcccgggttaccctgtgggttccggtggttaaggccagcctcccggtcctgcagccacatgcctcccagctgtgtgcctccgcttccacctccgaaacccgggcagcaggacccaccctgcaggctcctgcgcaaggatgggggaggtacctggagggcccaccccacatcagaagcaggtcctcagccagagacacccaaatgcagcccgagggaggctgcccccaggagaggagaggagaacccgcagccgccccgcaggcgcctggggaaatcactcactgctcccacctcccagccaggccccgagggccaggcactctggcttagtgaagaagccacccagcaaaggcctggtgtctccacaccattctcgggggggacagcagcaaggacgatggangggagcagtgctcggccttaacgtccctgtttccggaagcgtccctgccccgctcagtcctgccccactccctctcccatcagtgccctcaractccaggcccttttctttctttcccagcagtgctgacaactgtgagtgtggaactggactgtgaaccctggagggcagatggtggaggtgggagggggcaggccagcgccagggtgagctgcagggtccccaggtgcaggggaaacgccaacttcgtgtgcagtcttgcctcttttgtttcgtttcagagtggcccccagagccaagccctatgctaccttacagatgaggaaactgaggctcgggcaggtgaagagaccggccctgggccatgcacttttttggggacagagcagggtgctcagctgtctgggggcctgggctgggcctggggcagggggaggagcagcgctgtgacccccacggggagccgtcagccaggcccgtagccagggaagggcggaggggcttaacgcaggcccacatggccaggacacagaaccrtgggggcagccccagcccttccctgcctgttacaggcccctgcccctgttcctgtgtcccatgcctgtcccctccctccatgtgtctgtctctrctygcctgccctctctctgccctcttttctctgcttcatcctctttttcygtttctgcctgtctcatggttcttcctgtccctgccctccctccctccgtgtgtggccgtgtctctctgtctgtctcttcctcctcctccrgctctgtcccagtagggccactccaggcaggatggtctgcggcccctcctgcttcaccctctccactctgtccccactgccgaggacacacctttgctgggtttcttggttcagcttttgtaccgtgacatctcygaggtccacaggtcacagggcactggccagtgtggggcagggactcctcctgcccaggccattggacaaagcagagctgcttcaggggctttggggccaccaggccaggaacaggtcccctcctgcctaccccagctccctgggagacacngcccacagcagcgtcacgtaattaagacataaaagtccacgatttccgctgcgtgtgggcaaacaccggccgggtgctaatgcaatcctttcttttagtggattcttgaatttaaatgatatgtaattaaacataattagccacggacgccattcggytaggtacacgtgcggagtggggctggccggattctcattacaaagcgtcatcttctatggggagacctcttgttccctctcggggctggttgcttttgcctggacaataagcctggccccagggcacctggggaaggtgtccaaggagggggtcctgggggccagtcccccgggggctcggatgatgaatcatgggcggtgtttgctggaagaatttttgttccgcttcgggcaacaaggaacccaaacctctcactgttgtggggagaaaagttggaaatcagatgggaackggctgcggtaccagagaggacgtcagamccgggccgcggcctcagcccccgactccttgtaagcgtgggctgggtgcacacgtggcggctgcgagcagtgctttggagctcatctccccagaccctagtgggagctgagggcagcctggcagggctgatgcaggcccatgcacacaggccaggcagaggtgagaccagggaatagaagcgttgcaggggcagagggcaggagggggcagagyctcggcgtaggagtgagcctactggtccttcccgcaggcaccctccctagtgccaggtctgctgggactccaggctgttggtatgccccctagggtcctgcttggagcctttctgaccctcctgatccagtgcctgtgccgggcttcctccccactcaccctgtcctccctgtgccccatgtagcccacacatcagtgtgtccgtccgcctgcctgtctgccccccaccagcctgtgtgcccaggggaaggctcaaggccggtcatgctctacctccctggccagcccasccccagcccacggtgcattccctggacaggattgctgagttttccattttagccacaacagcgcccacacccgcgccaaccaacctgtccttgccacgaatattggctcctgccctcctcatgggagcccatggtgcatgctattatgacctcggtctagaggcagggacaccaaggcacaggggcttagggaagttgcctgaggtcacgtggctggtagggggcggagccagctttatcctcatggcacagatgaggaaactgaggcagagaggtgttttgccagggggctratttactgagctagccagccgttctggttttgtctctgtctcgctcagngggbcccccaccccacccacctgcctacccagcttgccgtgtcctcggccagggccagcagtctcagaggtagagctgctgagagaagcctgtcatctgtcctccaagagggatctgagtaagccggagagcatcagcagcctcaaggggaccttggacccctgcccacctttcattctgtaccrgggcagggtgtgtctgcacagcctggagccaggtgtggctggcagccccaggaagacagggccaaccctgcccagcccagagcagccgcatctctgcagcagcggtgcacttgagtggaagcactggcttcccaagagtaagagcttgagaaggggcctgtccagagccctgggggacggtggacaggccagcccaggggtccaggcctttcctgtaggggccgaatcgttaccacttcaggctctgccagcttccatttggtctctcttgcatattactctcttctttttacacccctttaaaaatataaagacaggccgcaggtaggatttggccctctggcctacacaatagcaactgtgagcattatatgtggcttctctttctttttgagactctcatctgtcacccaggttggaatgcagtggtgtgatcacggctcaccacagcctcaacctcccaggctcaggtgatcctcccacctcagcctcccaagtagctgggactacaggcgcctgccactacacctggctgatttttgtacttttttgtagagatagggtttcaccatgttgcccaggctggtcttgacctcctgggctcaagcaatcctcctgccttagcctcccaaagtgctaggatgacaggcgtgagctaccacgcccggcccatatgtggctttttaattaaatttttgaggtataacattagtaaagtgctctaaaagtgaagaataggatgttagccccacccaggtcaagatctagaacattcctggcacccctattcacctttccgttaggaagctgccgtcccaccctctgtcactagtctgcctttgccagctctggagctctctgtaagtcagtcctgctgtgtgtattcctcgagtctggcctcagttgctcttcaggtctggggctcacccccattgccgcggcaggaactcaccccagattgagccgttgtggagtattccagtgtgcaattctgccgtggtctgttttcccatcctccccctggcgggcatttgtccagtgtttgacttttgctattgcaactaaagctgtgtggagcagtgtgcctttggtgaacgtgcctttrgtgaacgtgaggatgcatttctgctgtgtacatacttaggagtgggactgcagggttgcaagtggatatcaacacgcagttttccaatgtggcccgtaccatagaaggcctcgtggtgatgccgagtccatattccagcactgacgcaggattgcgtggtgccaagtccctatttcagcactgacgcaggatcacgcatgtcttcaatgcccctctcctagatcgtagacaccctgtgtggcatcacagaatgacacacacaagacaagaggcctctaaagccctgacactgacacgggttgttcttgctggggttgctaatggagcgggtgcgggtgtgggtgcgggtgagggtgctgatggagcgggtgagggtgcgggtgagggtgctggtggagcgggtgagggtgcgggtgagggtgctggtggagcgggtgagggtgagggtgagggtgagggtgctgatggagcgggtgagggtgagggtgttgacggagcgggtgagggtgcgggtgagggtgctgatggagcgggtgagggtgcgggtgagggtgctggtggagcgggtgcgggtgcgggtgcaggtgagggtgctgatggagcgggcgagggtgagggtgagggtgctgatggagcgggtgagggtgcgggtgagggtgctggtggagcgggtgcgggtgcgggtgcaggtgagggtgctgatggagcgggcgagggtgagggtgagggtgctgatggagcgggtgagggtgcgggtgagggtgctgatggagcgggtgagggtgcgggtgagggtgctgatggagcgggtgagggtgagggtgagggtgagggtgttgacggagcgggtgagggtgagggtgagggtgctgatggagcgggtgagggtgagggtgagggtgctgatggagcgggcgagggtgagggtgagggtgctgatggagcgggtgagggtgcgggtgagggtgctggtggagcgggtgagggtgttaatgaagcgggtgcgggtgagggtgctgatggagcgggtgcgggtgagggggccgcatactcatccccttgcctggtcccccaggctcctactttggtgtgtgctcattcaggagcagcagagtggccgtgcttgggacggccagccaagcgatccccactggtactggcatctgtaggtgcccctgcttggagcgggtgctggcaactgccctttgctggaaggggcagcaatgtccagcagtggtggaagctctcgaaagaacacagggctgggagtagaactcagtcagatcccagctctgctctccctgctgtgtgacctatagcaagtctctgaacctttctgagctgtttcctcacctgttcaagatgggggtgaccacttcttccttggaggatggaagggagagggatgtgaggctcgtgagtgctgtgctcggagactgtgcaggaggggaagcggccgtagccccatacaagcaggtgggcaaggaagtgggggcgctggaggggcttaggggacaaggggttctgtccttgggacctggacaagagccaaaaggtataccctcacagtcacaggggagcccacactgccctcccctcccagggactgcccctgtggcccccgtccaggtccacagcctcagcagtccctgagggccaggargtagcctccaggccactgggctgagaacccttaaaagaaaaagcccccctgcccatgacagtcattttagggtcaagaaagccctttgcagaaaccaaaccctttgaaagggccaacacggcttttagatgacgtgagaaccaacttcaagcacttcctctcagaccagggtggcagcttccaaagtgggggcgctgctgccgggagactgtggtttccctgcttctcagggagcttgggccaggccgtggggagatccaagcaacatgtccctcggtagtggtaggtttgcagacgggccgctccccacttcctgccaagctccagcggcacctctgtgggtgcaaggctgtggggaggggccttctggctcacagccctccaggctgcccacagcccctaggatgaggtgccacttcctcaaatgactgtcaagactgggatgggggccgggcacggtggctcactcctgtaatcccagcactttgggaggctaaggcgggcaaatcacttgaggtcaggagtcggagaccggcctggccaacatggcgaaaccctatctctacactaaaaaatacaaaaaaagccgggcgtggtggcgggtgcctgtagtcccagctactcaagagccgaggcaggagaatcgcttgaaactgggaggcagaggttgcagtgagccaagatcgcaccattgcactccagcctgggcaacagagtgacacttggtctcaaaaaaataaaaaataaaaaaggctctggatgtctccacgaacccacctgaccccttcctgctcctggggctctcctctcccacccacgtgtctacccgtagctcctgcctgccttcaggactcagcccacagccccttccacaaagtcccctggcagggcccggaggcctctgcactgtctcatggcttcattcctgtgtcctcagcatccagtgagacctcaggagatgcctggggaatggctgaaggctttggagaggttgctgcccccagaatcccagccagagggcagtttatccaggagcccggtgcctcctctgttgggtgggcgtggcctcagagggcaccaaccagaagacacatgctgtcactgacatgcgggcccccagcgttagggcaggcaggagctccgagtctctaccccagctgtccccacagtgcacatggactaggctcctcccacggggcactaggccaggccaggggtgtggggtgagcccctggggagcccagagcagggtacactcatgtccccaccatccaaggtgagatgtctgtgctggaggcccagagggagctgggccggctgtcactccaccacaaggctgagcaggctccccagtgggagacaggtttggggaggtgtccaggttgagggcacagtcaggaggggccatgtgtgcctgagtagggcagggggaggagggggatggccagtggccacgggccaggctgcctggcaggacctggaggtttcctcaagctaaggccaggcccatgttagatgctgggagggtgggtgtggctgcagaggggtcagcgtgggggcactgactaacctccggccatcctctccaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctmctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgygtccaaggcacacagggtactttctggacccactgctggacagacttgaaggtgtcatgcccggtgtgtgcaggaggaaactaacagttcagtaaactctgccttgaccagcagcctttgactcaggctttgactgctaggaagaaccgtatgggggaggccaccagcagggtctgggccactgtctctagtcctgccttatgcttgagccactgaatatcagaggtgcgagggacaagggccctgaaacacctcacctgctccagccccttcacttagcagatggggaaactgaggcccagaggggccagtgagctgctgttggccctatctggaacaaggcagtccagggcaaactttggcactgccttccctaacggaacagcctgtggcctgggggtggtgagctttgctttcccgaccaagggcgcggcggccttcccacaggggccctgggaacaaatcactcataactgaagtttcaggtttcagaatcagtcagctgaacagataacttgattgctccatttctccccaaatcagttcagaagctactgataacccttgagagactgcttctttattttattttattattattatttttgaaatggagttttgctttcgttgcccaggctggagggcactggcgtgatctcagctcactgcaacctccgcctcctgggttcaagctattctcccgcctcagcctcccgagtagctgggattataggtgcccgccaccacgcctggctaattttttgtatttttagtagagacagggtttcaccatgttggtcaggctggtctcgaactcccaacctcaggtgatccgcccacctcggccttccaaagtgctggtattacaggcatgagccactgcgcccggcctggagagcgcttcttatgagagaagccatgggtctccggagcaggatttccaccacatgaaggtggacgataagaaagtgtgggacccacgccggggaggggcaagtacagcccccgcaaggccgcccattaaatcaggattgggggaaacggtgacagtcttttcagcaagatgagaggccaccagccgggccagtgtcactggatttgagggagggccatttggccccttagttggaaaatatgcagatggctggctccttgatggagtcccctgatggcagctccttaggagacaatacaggacgttcaggcggcggctgcagttcagtggcagcctggaggggctgtgcgtgatgccgggctgtgcgtgatgccgggctgtgggtgatgccatgctgtgcgtgatgccgggtttgtgggtgatgccgagtttgtgggtgatgccgggctgcgggtgatgccgggctgtgcgtgatgccgggtttgtgggtgatgccgggctgtgcgtgatgccgggtttgtgggtgatgccgggctgcgggtgatgccgggctgtgcgtgatgccgggctgcgggtgatgccgggctgcgggtgatgccggggctgtgtgtgatgccgggtttgtgtgtgatgccgggctgtgcgtgatgccgggctgggggtgatgccgggctgtgcgtgatgccgggctgtgcgtgatgccgggctgtgcgtgatgccaggctgtgcgtgatgccggtttgtttgtaggtctttagttttttctttcttttgtgtttaatggggaagcttcccgccaagacagcaacccctctgggggaaggagttcaagctgagacctctttttttttttttttgagacggagtctcgctctgtcgcccaggctggagtgcagtggccaatctcggctcactgcaaactccgcctcccgggttcacaccatttccctgcctcagcctcccgagtggctgggactacaggtacctgccaccacgcccagctaattttttgtattttttagtagagacagggtttcaccgtgctagccaagatggtctcgatctcctgaccttgtgatccgcctgcctcggcctcccaaagtgctgagattacaggcgtgagccactgcgcccagccgagacctcctctttcaagttgctacccaggagtggggtgcccagagggacagcccctggaggtgcagccccctgctttgttggggcgggagcatgccaccctctgagccgcggtgggctcagtgaagtgggtgttgtcatccttcccactgcacgggtctagagtctggggtgcggtgagctcgcggcttgctgagggccaacagttagtgaggggtggagctgcgacttgcaggaaggtccagccccgcctcccaggccctttctagccccttctgttgccgtgctgcttcccacccttgcctggaatcctcctgtgggggacgcatgtggtggcccctgtggctgactttccggctgagccagggcaccagtgtcctcactctagagatgagctcttctgaggggtgaggtccagccacacctgtggtggggtggtgtagcccgagcctgttaccccgtctataaaacagagggattcacttcttttacaggcacttcctggccctgcggggtgccctgtctctggctggagctgatgagccgtggtgtgatgcttgcctgggggtcggtgttgcctagaagtgaggaatgacctccttcacccctggctccttccggcagcctggccacttccagcatgtggagggggcccgggccctggcagagacggtgtggaaccgccggccgcatgcggggctggagttcggggctgccaatgggctaaggccctgtgttcaacacatgtcgcggaactgtcgtgaaaaaaagactcaggaccacaggtccggggtgctcccaggggtctttcccaccgaggctgggagtgagcagcagcctaggcccagccacacctcccaggctcgggagctgccaggccaggcaaccgtgaagggtagcagggtggggggtggaggggaggacagggagagcaggcctctcgggcctcacccacccttgcaccttccagctctagggcccacacagtaccaagccctgggctcaatgtaccacttatgaaaactcaattcaaattggcttagtgcaacaaggtatttggtggtctcacatgacttgaacatccaggcctggctgtcacgggaaccgcatctcttcccattgcagctacttggcaggtggcgggatgtcccccagccaccgacgtccccctgcctgctccgcaaccccagggcctgcagaaaaggcccacgagactcagactggcagagacttaggcggaccaggaacaggggcgcagtctccgtcccacccaaaccctaaccagagagaacacggcacgttgtgccagacggaggacggatgccagcgagggtccatgtcctcactgccgacaaggctgggaactgggccaagtgaagcagaggcctccacgtcagatgtgagcgccaccggcccaggtgactgcagttcttccctccttccgttcggcttgagccctccagaggatcggaaaggctgaggcctgacctggtgccgctgtcctgggtgggtctgtcctgctggtcggttcctgcccctctcggggaggttggctggcagctggcaggtggaaagcctcctgtgttcacctcagggcagaggtggggacacagggcgggacgggcgagtgtggtgcccctctggggtgggtgctcttgggtccgcctcccgtgccagagtgcgtgtcaacagttccagctgcccctcagaactgtcctggtttaggaggtgaacacacggggcagcctacattctacgtggtttttttaacattataaaagcagcatgtgttattacaggaaatttaacagaagtatataaaaagaaaccagaagtcacccgggagtctgagcactgtgctctctggggcctttcctttcggccttcttccttccagccctttccctgcacactggacagagtggctgagtctctctcgtaagcccacagggttatgatcgctgtgcaggtaaggagactacacgtgtgccccatgtcagaagcacctgtgcctggcctgggcactgcactgggggtgaggcctggggccaggccccacgtgggggcagaacggagctatccatccagccagggacctcatctagggattgggggcagcaaggggctggtaagggccagaggtaattccagggccactctgtgccctaccctcaggtggggcacaagggtgggggcactgcgctgggtagaagccccccgccagcccctggcccaccagtcatctgtcagatacggaggcaggggtgaggggagggtgtgctggggaagtcaatgcatccagcctcgaatcagtgagtccctaggccttgggtaaggcagggctgcagggatggcagtgaggacaaggggctcacctccccccagcagccccacttcacatgtttgtttcttgagttcagtgctcatagacttaaaaaaaaaaaatcttgctaaaagcaaaaaccaaaagaaaagcgggggctacagagcctcattcccagaggggctgctctggccctaacaagcattctaggccagacttccatgggcagattgtgtgggcaagtgttgagttatggaaatcaagcaaacctctccacgcctgtcctccaggccgcaaacacgcccttctcctgagtccgggtaagcagagggccatgcacgggagacagtgggccacgccgggctgggcttcgtgcttctggggcccccgcaactcactcacgcagcagaagtctgcactgtgctgcctgcagcgggggcagaaacccggagccagtgagcctgtctgtgccacctcagctaccctggtgggtgggtggtgggggccatcccaggcccctcagggctgcaggccaggctgggcccatctccgcacgctgctgtgtggcctcacctcccagcgctgtcgaaggctgagctgctgtgctcggaagggcagactcctccatggcttctaactcaagtgacacaaggagtgtctccccactgctgtcctggggctcctggccctagaagggctccccatgatgcagctgtggccatgggcagccttcccccgtcccccggcgtctccacagctctgtgatgtctgctagccccattttatcgattcagaccccgaggcttggaggggacagaagggtccagtctaggtctctctgcgcccagagctaatgctcctgtgagcaggggggacctgccagttcaccacacccaacagaaaccacacagctggcaccaggcacttgggtattgaaccaggaagctttatttacacagtacaagtaacaagcaaattcctgagagactagagcggctggagtgcaagccacagcctgtgcggggaggccaggctgcaggggcgggcagaccctgggccccgggtctacgctttctggtcgccacacttcctgaagcacggcaacacccacaacatccagctcagggaagcccctgcagccccagaaacagcctatgtgctatctgtcgccccagcccccaggacagcttccccacacactgaaaacacaaatcatttgccaaaaagactatgctagaaggtcagactatcctatctaggctacaagatctccacttcggtctgccattaaaaaaaaaaaaaatctttctcttcttttctctttaaagaggcatgacagaggggtttgaccaacagcgtggacatggcaaggtgtggcatcattgccagtgtggggccagagggtgcccgagccccggtgcgcggccagcctgctgcatccctgccggctgacgtctggagtgaccgtcattccagtgaccacccccatagccacagacggcacgtcagtggaaacgggggtgcagcaggcatgacaccaaggcagagcccgcagcagggggcccggggttccacagctagggaagcttgctcagacaggcagcacacccagggcacggccactcacgcccccgcaccaggagacccatttggaagttagttagggtttgttttgttttctttttaatgtggacttcccctttatttaaattttctttcagtgtacaaattcacaaaactggctacaaaaatttggttt

SEQ ID NO: 10807 - DNA, 24730 bp, Homo sapiens
  misc_feature (1)...(24730): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgcccctagagaagacagacaaggaacagtggaacagttggcttgacgacagcgtcgggacccagccctgcgcaactccacctgcttctgggaacccagggggaagcaagggaagaccgtgacctttgccccgggactgaccgtccgttctcggccttaaaacccgacgttcacttcttttcatccagatctctcccaaatcaagaagcctaatcctttagttcccaaatcgaggcctcgtggtttaattgccccatttgctctgtcagcccaaactctgccaggcctgctactagagacccttttttatttttttaattcttgtggatacatagtaggtgtatatttacgggctacatgggatgttttgatacaggcatgccatggataataatcacatcaaggtaaatggggtatccatcagctcaggcattttgtccttcgtgttacaaacaatccagttatactcttggagwtgttttaaaatgtacaattattcttgaccacagtcaccctttgtactaacaaatacgatgtcttgttttcacactagagaccctgaacgctcgcttgtctgcctaacgtcctcacaagctgcgaggggctgaggcttggggatgcagcaggactggaggccaggccacctccctgcttagctcccaagtcctcttgggggrgcagtgactgacacaggcagggtacatcctgctgccagccttcccacccggggcccagaccccacctgccctcccgcccttggagggccggcctctcccaggccgctctgagtcctgcacctatggtgcgctggcgcagtgtttagcagccggacctagtgaggggaagcctggggtgcgtgttttgcacatgcgcgtggtgtgaatactccaccggggctggtttcaagttacccccagctggacaaccagtccacagaaattcccgaaactgtaccagtctgcttgtggtgtgagtggtgcctgtggcaggccctctgcagccagggtcggcgtaatggataacctgtgatgagttccattagagaaaacgtggaaaaagcagggatggatttacccttgtagaaggtaacttctacctttgtagaagcagaagctcacaaaatttgagagacctttaagaaaaataaaatgcttgctgggcgcggtggcttacgcctgtaatcccagcactttgggaggccgaggcgggtggatcacaaggtcaggagatggagaccatcctggctaacacggtgaaaccccgtctctactaaaaatacaaaaaaaaattagctgggcgtggtggtgtgcacctgtaatcccagctattgggggggctgaggcaggagaatggcttgaacctgggaggcagaggttacagtgagctgagatcgtgccaccgcactccagcctgcgtaacagagtgtgactctgtctcaaaaaataaataaataagtaaataaaaataaaatagctgggtatggtggctggcaccagtaatcccagcactttgggaggctgaggcaggtggatcatctgaggtcaggagtttgagaccagtctgcccaatagggtgaaaccctgtctctgctaaaaatacaaaaattagctgggcatggtggtgcgtgcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctctgttgcccaggctggagtgcagtgggatgatctcggctcactgcaaactccacctcccgggttcacatcattctcctgcctcatcctcaagtagctgggactacaggcgtcctccaccatgcctgggtaatttttttgtatttttagtagagacagagtttcaccgtgttagccagaatggtctcaatctcctgacctcgtgatccgcctgccttggcctcccaaagtgctaggattacagggtaagccactgtgcctggccaaaataaataaatttttaaaaattaaataaataaagtaaaatgctgagtacaaagttgagtaaagggcttcaggaggggtcatgtaggcagagtccctaagtgtttttagatttatgttaaatctgctttaaaaacagagtaaggggctgggcgcggtggctcatgcctgtaatcctagtactttgggagtccaaggtgggtggatcacctgaggtcaggagttcgagagcagcctggtcaacgtggtgaaaacccatctctactaaaaatacaaaaatttgctgggcatggggacaggcgcctataatcccagctgctcaggaggctgagtcaggagaatcacttgaacccagtgggtggacgttgcagtgagccgagatcacggcacttcactccagcctgggtgaaagggcgaaactccgtctcagaaaaaaaaaaaaaaaaggcagagtaagggagatcatgccagaggggtggccatgggggtttgtggggaaggtagggccaagcagagggaagggccagtcccaggctactgaggcaggagtggcctgtagctctgcaggaagagctgagagcctggagccctctgagcatcagggtgtgcagggggcatggggccagagaagggactgaggtctggtcaggtgcagctgggcagggggcaggtcctcaaaaggactttgggtttttgtttttttttttagacagagtctcactctatcaccttggttggagtgcartggcacgatctcagctcactgcaacctccacctcccaggttcaagctattctcctgactcagcctcctgagtagctgagattataggcacctgccaccatgcccggctaatttttatatttttagtagagacagggttttaccatgttggccaggctgatctcaaactcctgacctcgtgatccacctgcytcagtctcccaaagtgctgggattacaggcatgagccactgcgcccggcccccaggactttggtttctactgttgctgatgctgggagctgtagcagctgctggtgtcattttacaaggctcaccctgacacctctgttgaggacccaccatgggagtggcagacagagactagttaagaggttagcctagctacctagcgagaratgctggaggctgggaccagggtcggggcagcagaggtgtggcatgtgcagggctaggagtgcaggctggccagggtcctcagctccctggagggaggaacagcaggggtggggctgggttttggtgggctgaggggtgagtgggaagtaggagatggagagtggtagtggccacagctctttgaaaggctggaagcaaacggagcttgggtgatgtgggagatctgtggcgagtgggagtgtggactctgaaggcaccgcccaggtttgaggcctggtgctgctatgggcctgtctgcacctccgtttccctttctgtggtgaggattagcggcagcaaggaatgcagtggagccattaccttgtcaccttctgaggttacttgtgacgatgccaatgatggtgtgagatggggaggtgcaggcaggacagaaagctgcaggaatgggcaggcaagacctgaggcgggaggaaggctgtgctgcaatgcacattcttggagaccaagggtggggaaccgcccatgctcagcacctggcaggtgtgagggaccaggagcagggttgagaaggttgctgggggcgttgaaggccagccttggccgggggcgggcctggagacccagcactttgtgtgcagagggtgtcatggacacagaggcttggagatcctgagtgaggggcagtgactcaggccccttggtgggtttagtggggcgggtgattggccattttcaggccatggaggccaggggagtggagggccaccaggggacactcctgtctaccctgccaaccaggggctggagtgggccaggtagggccggtgggctgggctgggttggctggagggtcctgaggggtccagcctggccaatacctcctggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgccgtgcccgacgagctgctcactctctactttgaaaaccgccgacgctctggagggggacctgtgttgagctggcagagactgggctgtgggggcgtcctcaccttcagagagcctgcaggtgagagggctggctgaagggacagcctgggtgccctgatattctaatgcctgacatcctgccccgcccctgcccacagacgccgagagggtcttggcccaggcagatcaygaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcaggtgagaggcagggttggggttgaggtgctggctagggggkattccctgagctgacctgcacataccccacagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaaggtgagtggggctgggcagacccagccgaccgtccctctcctgcagaaatctgacaggctttctgtcctttcccttcctccaagtggcagaacgagtgttgcagcargagcaccggttgcagggctcagagctgagccttgtcccccactacgacrtcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgcyggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcgggtgagtgacccctcaggactcctcaccttcagccccctcctcctamtggggactcaaagtacctttcctgtgctctaaacctgcaaactccatctctgcaatggccctgcagctctgtggagcccaggcttcctgccaggcggctgaggagtttctgcggagcctgctgggcrgcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtagagatggagtcccacccctgccctcccctttctcacgcctctgccccaggcctcctctgcccttgcccagaggctagtggtcctgacatcctctccctacaggtggaccctaccgaggccctcccagtgctccctggcaacgcccacaccctgtggaccccagacagtacaggtggtgaccaggaggacgtgagcctgggtagggctccctgggagccctcagcacatcctgtggccctcacttgacctcaccccctgccctgctctgtgctcccatctgtctactgacccatcttaggcccaccctgtaccctaaaaacttgctccccatctttcayccattccaactcctcctgggtccagcccctgacccaatggcctctccctgcccccagaggaggtccgagaactgctggccaccctggagggcctagacctagacggggaggactggctgcctygggagctggaggaggaagggcctcaggagcagccagaggaggaggygaccccagggcatgargaggaggagcctgtggcccccagcactgtggcacccaggtggctggaggaggaggccgctctgcagctggccctccaccggtcactggagcctcaaggtcaggtggctgagcaggaggaggctgctgccctgcggcaagccctaaccctctccctgctggagcagcccccgttggaggcagaagagcccccagatggggggactgatggcaaggcccagctggtggtgcactcggcctttgagcaggatgtggaggagctggaccgggcgctcagggctgccttggaggtccacgtccaggaggagacggtggggccctggcgccgcacactgcctgcagagctgcgtgctcgcctggagcggtgccatggtgtgagtgttgccctgcgtggtgactgcaccatcctccgtggcttcggggcccaccctgcccgtgctgcccgccacttggtggcacttctggctggcccctgggatcagagtttggcctttcccttggcagcttcaggccctacctgtgagtctacctcctggactgagggacggtggggtgggctggttagcaggggctagtgccccaggcatggctctgaccccccgcttttccccatgcatcagtggcggggcagacgctgaaggggccctggaacaacctggagcgtctggcagagaacaccggggasttccaggaggtggtgcggrccttctacgacaccctggacgctgcccgcagcagcatccgcgtcgttcgtgtgagtccatgccctgtctctctggcctcatggcgtcctgggctcttgcaccattagcgccttgccaagtctgtggcctgtccctctcgcctacatcaaggtcagctgaccaggagctgacaggctcccagccctgttctctgcccagagggcgttcccaaagtgggtagggaaacaggagggaacagagtgggggccttgggatctgataggcctgagtgagggtccccactctgccactcgtggctgggtcagcagggactatgggaccagctccaggcctcagtttccttatttggagcatggggcggtgatgccatcttgtggtcattttgaggattactcgctccacagatgcgtcccttgtgctgttctgggcgctcttctgcctccacagaaaggcccgggctcgctgcggtcactgtgctgatgacactgcgcggggcactctcttttttgagacggcatctcgctgtgtctcctgggctggagtgcagtggcacgatctcggctcacggcaagctccgcctcccgggttcacgccattctcctgcctcagcctcccaagtagctgggactacaggcgcctgccaccacgcccggctaattttttaaaaaatatttttagtrgagacggggtttcaccatgttagccaggatggtctcgatctactgacctcgtgatccgcccgcctcggcctcccaaagtgctgggattacaggcgtgagccaccgcgcccggccttgcacggggcactctcaactcttgatgcccaaagttgtgcgtggggccagcagcatcaccctccaccaggagctggtcagaaatgcaaaaagaacctctggctgtccccagacctcaccaccatcatcaccaccatcacaccatcaccatgaccctcaccaccatcatcaccaccatcatcaccatcaccccatcaccatcaccaccaccatcacaccatcaccatgaccctcaccactcactgtcatcaccaccatcatcaccaccaccttcaccactcactgtcgtcaccaccatcatcaccacgcaccttcaccactcactgtcgtcaccaccatcatcaccaccaccttcaccactcactgtcgtcaccaccatcatcaccaccaccttcaccactcactgtcgtcaccaccatcatcaccaccaccttcaccactcactgtcgtcaccaccatcatcaccatcaccttcaccactcactgtcgtcaccaccatcatcaccaccaccttcaccactcactgtcgtcaccaccatcatcaccaccaccttcaccactcactgtcgtcaccaccatcatcaccatcaccttcaccactcactgtcgtcaccaccatcatcaccaccaccttcaccactcactgtcgtcaccaccatcaccaccatcaccttcaccactcactgtcgtcaccaccatcaccaccaccaccttcaccactcactgtcgtcaccaccatcatcaccatcaccttcaccactcactgtcgtcaccaccatcatcaccatcaccttcaccactcactgtcgtcaccaccatcaccaccaccactaccaccaccaccgtggccaccatcatcaccaccattagcatcaccactgtcaccgtcagcttcaccaacacaccgtcaccgctcaccgccaccaggatcaccaccacccagacgcactgacctcatatcctggtggttttgttaattatacgtacttggttcttccggtgagcaccttgatgactttaaatggtatgcttgaatttagtgagcaccttgatgactttaaatggtatgcttgaatttttttttttcacttgacagctttagagattgtttcttgccttcccgcatggaagatgaggagaatgggcctcgcttctctctcttttgcctcctccctcatcttccatctcaatttggtcagttacattatttttattatgtcgtaaaggtttctgtaactatcacaaagcctccatgcgtgggccataggttggtagacatactataataatgaaaaaacatttaccactgagccatagaaagagaagtgaaatcctagttattaaaattctgttctgtaaaaaagatgttctaggattcaaggctaatggcttttctttttttgactttcttcattttttccaggccattcttgaccaccgggttactcagtaccccgcttgtcaccttttggcacagactcttttgtttagtgggagtatctccttgagtgggtgctaaacatatttgacttttaaatttacgtatatgtgaacatatatgtttaaacatatacatttatatattaatatatacatttatatatataatttttttgagacagtgtctctctctgttgcccaggctagagtgcagtggcatgatctcggctcactgcaacctccacctcttgggttcaagtgattctgcctcagcctcccaagtagctgggattacaggcacacaccaccacacccagctactttttgtatttttagtagagatgggtttttttttttttttttttttttttttttttgagacggaatctcactcagtagcccaggctggagtgcagtggtgcaatctcagctcactgcaagctctgcctcccgggttcacgccattctcctgcctcagcctcctgagtagctgggactacaggcgcctgccaccacgcccagcttatttttgtatttttattagagacggggtttcaccatgttagccaggatggtctcaatctcctgacctcatgatctgcccacctcggcctcccaaagtgctgggattacaggcgtgagccaccgcgcccggctgagacgggttttttttttttttttttttgagacggagtctcgctctgtcactcaggctggagtgcagtggcacgatgtcggctcactgcaagctccgcctcctgcgttcacgccattctcctgcctcagcctcctgagtagctgtgactacaggcgcccgccaccgcgcccggctaaattttgtatttttaatagagacggggtttcaccatggtctcgatctcccgacctcgtgatccgcccacctcggcctcccaaagtgctgggattacaggcgtgagccaccatgcccagcgagacggggttttgccatgttggtcaggctggtctcgaactcctgacctcaaatgatccacccaccttggcctcccaaagtgccaggattacaggcgtgagccactgcacccggccgacttttaaatttatattgccctttacaattagaggtattttgcaactgtaatttgatgttggtatgaacttccatgttctcgtgtgtcctaatatgcccttatttgtcctcattcttcattactagtttggctggatatagtgttcaggttcaaaatatgtttttcctcagatatttgaagacattgctgtttttcttcattcttaaaagaatatttttcttggaaagttaaaaaatatccccccatggtttcttagcatctggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgggcggatcacgaggtcaggagatcgagaccatcctggctaacacagtgaaaccccttctctactaaaaatacaaaaaagatagccgggcgcggtggcaggtgcctgtagtcccagctattcgggaggctgaggcaggagaatggcgtgaacccgggaggcggagcttgcagtgagccgagatcgtgccactgcactccagcctgggcgacacagccagactccctctcaaagaaaaaaaaaaaaaaaaacttgcagggttttctttcactctgaaggttgaggtttcctggcacgtgggtgccaggggcgttgtctttcctcattgtccttcttggcatttcacggatcttgtgtatctgaagatgttccttcagctcagggaagcgtcttccctgtgtgtgctggagctccggccggtggagctcctgctatgccggctcagacctcaggccccctcacctgctccctcggagttcctttctcttccgttagcttctcactctgcatcagttcctgaactccatctagaacgctagctgggtcttcagtttgaaccacttcctcatttggctcaccccctctagatttagctcagcgtccctttctgaatgcaggagcactctggttttcagactagttccttttcatagcagctagttttgtttaatagacatggtgttcttttgcaactctctgaagaaactatttaaaatttctttaaaagtgtttcccagggctgtcaggttggtcacctgaggccttctctcccacctgggtctttcagcactgagaggtctgtggcatctcctcgtgttggagtcaagtcctgtaggcagcatagggccctggctcagcttttctctgcagaggcctcgcttgagtgggtggggtttgcccgcccgcagacctccacgggagggggaggggtcaggcctccccagcggccctctgaagtcacttgcttcacggaggtgttactgtctgctgctggacagagcatgatgggggctgcaagggctccctcaaaccctggactcctccaacagagggctcctggttgccaggctcagctctgccctgcgtcggccccagggcgtagggagggtgtttaatcctggcccgggccttccccgcaggtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacggtgaggcctgagccgggcaggggcgggggctctgcgcaccccgaccaccctgaccttgccccgtctcgccctgcagccacggtctacgggaagggcgtgtatttcgccaggcgcgcctccctgtcggtgcaggaccgctactcgccccccaacgccgatggccataaggcggtgttcgtggcacgggtgctgactggcgactacgggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggggcgcggcggccccctcctcggtgtccgctgcctcctccttagcccttggcctgagggcggaggcacagagcccacattgtgcccccgcgccagcccaccccctccgagacagagccccattcacctcccgcacgccagtgctcttggggacgggggctggggagtgtgcgcgcgtgggtatgcgtgcgtcctggttgcgtccgcggtgccggtgtacgcgcccccactgtgggccgctggagctgcggcccgggctccctcccggcctcgctgcagcagagctcccgcggcccacgccgctgcggctgcagctatttataggccttcgctgcggagatcgaggtgggactgcgggctgaggtggggtggcgtgatggggagtcctagaggtcgagagagcttggaggtggactgccggtgtccaggggaagggcttgggtgtccttccctgatgacccggtgagtggagggggcggtggtcagctttccttgatggcctcgcctgcctgcgattagagggttagaggcgggtccagtttgggatggaggcagtggaggccggcatctgagtgaaggtagtcaccccttccccttccatttgacagagtggaaggtggtctgtcgtgtgccggttgagcccctgggtgacagagtaggtgggtggggtgtgggtgactaagagaggagagtggcagtcagtgtgtgggagtgggggtggccagggtggtcagtgtcctggtgatggactggagggtaaggccagtggctggggggtcactgtgtaggtatctgaggagtgcgcgggagggggcaaggcagtcatggatggagagagggtaagtcagtgcctggggccagagcatgggggtcaatatgtgggtacagcagagtgcaggaggggtgtgggtgccagtgtccaggcgagaggctgggtggggagagttcagtgtctaggttaagaaggtggtgggtgggtcggcgtgcagagtccactcctgaacaggcagagatgtgacccctcctgctccccttccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcaggtaactgcgcagggccttgcctgtgcacctccttggcacgcgaggttgactgagttcccgctgcgtgctaggcgctggagcggggactgggtgggggaggcctagggggatctgcgggtcacggagggcctcgcgcgtcccaggtgagtgcaggcggcacagcgccacctgccggccgcgcccaggcggttcatgaggcctggggttgggcttcttgccgcggcgtccatccttgattttaacacggtccagtgcccagatgcaacaaggataattttttgggttccccaccaggccctcggtcttggctgccacaatggcggccaggtgggaatgtacaggagcagtgtatagggagggggtacctggttgtctggagccccagcctcttcctgagccaggatctggccttgctttccagtagctccccatccagggagaacgatgggaagcatccagcgagatgcttggggaagggggagggcaggagggaagtgggtgacctagagctgtgctaggagagggaggagcagtagctctctaggctttggcttgagagtcctgacctgttccagccggagggcagggaggcccctgcgggaggccaggagagggctgcaaggccaggtgctgagccctggggggatgttgcagacgacgggaagcggggctggtaggagcaggaaagagggaaggagagggtcactgctgtgcacccagctccagccccagggtctggttccatctgcatgaccttcagggcttttcacagcacacacggactttaaagaaagaagtcactttcttcccacttgaaagggaatcacttgtgtcgttcccacgcctgggctttcttcagcatcacctttacagttgtggaggagtgtggggggtcccgaggccccggctgaccgtggttgccttcggtactcactgcaaaggctttgcccccagccagcaccttccgcgccggggctctgcgtcctctgacggtttccttaggaccgattcctggaagcgggacttgcagttacaggacatatggcattaagcttggagaaaacacggccaggggcatcccagacagggtggccgacattggtgaaggcggggagagcgggggctttgccaatctgatgggtggaaagagttgttttaattatcaccaagcattttttccttctgtgaatgggctattccagtcctcgtatgtgtacttaatttttcttgtgtgtagtgttttaagggttctttataccgactcagtcgtctccaatgttgcaatgggaaagttctcagctgcacgcaggaagcaaggtggggggcgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgggtgctggaggctccgctgcaccccgcgccccgcgcccgccggcatggccggcccgctgcccgacgagcaggacttcatccaggcctacgaggaggtgcgcgagaagtacaaaggtacggccccccgtcccgctgcctgtcgggccgctcctgacagcccagccgccgagcaccttgtcgtccacggtggcggtcccgatcgccggcccgagcgcggccactccgccggcctcgtccgcctggatcgcccccaacggctgccagtgcctagggaaggggaggactcgctccgctgagcccccgaggccatgcccttaatagggcatcgcgcggctcgggtgggtggggtgggccgcgggcgggtgggggcgctcagggcttgtcggggtcggctgtctgagccaggatccggtgtctgtggccagcagacacatgggtcaaggctgagccatcccctgccccacctctggggcgcgtctgcatggaacaggggcagccccgccgcctggcaatgggtcacatagttgccgcctctcctcacctccctaaactggcgagggcctgggctgccacccttccttggcagggcaccccccccacaccccttctctgttcactaggggacagctgtgggctaggggtcagggtggcccctccttcctctctaggggagcatcagagtggcctgcccacctgcttgatgcctcggcagacccccttgccctagtccacgcccacggggagcccctggaccctcccaggtcctggtcccaccggccattcttgcagcccagctgcctggctcagcctgggtcgcccggctccaggcggttgtggacacagcattggctgccggcctgcagaggcttaggagcaagggactgagctgctggggagggtcgcggtgggggcccccaggcagagccgatcagagcagactccagctccacgtggctggttttgctggctctgcccccaagggcagctcagggagagaggtcctgctggggccccgtggtgccgctctccaccacaaccttgcccagctgggtaggtttcatggtgccccgaactcatctccttcaggcgtcctccagcgacggctctggggcagggtggatgtactgctgtggctctctttgacagtgctgtgcccagccgctttgcctgtgtgactagttcattcgggccaggggagacactcctgcacccttggggaggcctggagcgggcagcctgttgctcatgctctacatggccggccctgccttagagggagcacccggaggggtgctggggtatagggcagggaagcagccgcccacctgggctccagccctcctggcaagccccaggacagagctgtttctgagctgaccactctgttcaaagtgcgggaactgtgcaggatcgtttcctcctggagttcttcatctggtcaggttgctgggctgcctggggtgccccagcctgttctgggcattgtgctgaggctttcctggccccagggctgtctttcctctacctcctggggtgggaactacttctgattcatccaggggtgagccagacagatccctggaggttgctgggaccctctgtcagggtcctccctcccaagcgcagctcctctggaggccaggattggtgttgggcacactcgcagtcttggcccattgtctgccttctgggcttggtggtggaggctggtgagggggcaggggggccggggggcttgcctgaagtggagttgtcacgtgatggtgcagctgcccgcatgtgtgtggcactggcctgagagtggctaaacagcaaggcaggtgctgaggctccgtgagcacaccaggtaccccaagtctccttagctcctggcttgagacaaggggacgggaggggctgggctggtacctgtgtctgggagccacggaccaaggctgaggagggcctgcaggaggtcagaggtggcccctgtgccctacacctttccaggcctgacctctgtgagccccttggacctgctagagggctggagccccggcccttcctgtccctggggtggagggactgtgggagggcatggcacccctt

SEQ ID NO: 10808 - DNA, 53885 bp, Homo sapiens
cttgtaatcccagcactctgggaggccaaggtaggtggatcacttaagatcaggggtttgagatcagcctggccaacctggtgaaacactgtctctactaaaaatacaaaaattagctgggcctggtgggtcacgcctataaccccagctactcgggaggctgaggcatgagaatcactccaacccagggaggtggaggttgcagtgagccaagatcgcaccactgcactccagcctgagcgacagagcaagactctgtctcaaaagaaaaaaaaattcttaatagccccaaatataaaacaactcaaatgctcagcaacgtaagaatggctaaagtctggtctgttcatacaatgaaatggaatacagcaatgaggatgaacaaactactcatgtatgtgacgatgttgatcagtctcacaaacgttgtacagaatgaaagaaactggacacaaaaccagaccaaagtaacctaacattgttagaagtcaggagagtggctacctttggtggggaagagggaagacctgaagggagcttctggggtttgccatgttgtgatttttgtttgtctttttgtttttgagacagggtctcgctctgtggcccaggctggagtgtagtggcacggtgcgatctcggctcactgcaacctctgcctcctaggctcaagcgatcctcccacctcagcacccttactagctgggaccatcatgcctcgctaatttttgtattttttgtagagacgaggtttcaccatgttgcccaggctagtctcaaactcccaagcttgagacaccagtctgcctctgcctctcaaagtatgtttcttgacctgagtgctggttatatgggtgtgcccaatttataaaaagtaaatgagctttgtgagcttttctgcatgtgtattttaattcaatgatttataaagagtcagtcagtgtggctgggccatgatgagggaggggaaggtagtattgtcagaatggggccagggctcggattttaggattaagtctaagtgcagccttctgtttgaccagaatggaggcttctggagagccctggagcttgatgaggcagagcagaagggaatgagaagtgttcatcctcaggggggtaagccagaaggcaaggatgggtatgggatgtcacctacacaggaggtatcaataccaaatgtttatcaagcacataccatgccagtcactgctctaagtgaacagaacatatgtgaatacctgcccttctggaatttacatcctggtgggtggtgagtggagagaatgtgctctctaggcaccaggctgaggcttattataggggttattgcaccaatatacccaggtacttggtggctggggtaacatgcccctttcacttccatagtcccactaactgcagggggagggtagagagtgctccctttatacattagtactctctgctttggggtacactcgagttgggagactggccccacaaagcagcactggggcaggggaagccctcagggtcttcctcacttgcaggaaggctcatgcagatatggctcccgcctcagccacatgtaagtggatttgggttctcctgagacccagtagctagaagtagggcattgcctctagtggtgaatttggcaagccagattttcttcctgtagccagtggctggaggctcccacaccctccaaagccccaggcagggacaagcacagagatggtagcaatgaatatatgaggtggtgatttgaatgtgggagctgtggaaggaagagatgccaagagggtgaagggaagcccacacttaacagagatgcttttgaaagaaacaaactcagccagggccagaacaagtcccctactccatctgccagactgagagacagcaaccctggtgcaaggagacagcctatttccacagaggaagaaagtaagggagaaaagacttcttgatttcgagacacagaaagacaaagagaggaaagggggtgaggagagaaacagacacacgtgcacacacatacacacacacagatgcatatcttgagttagaggtcatccagatttggggcagaagggaatacaggcatccagactcaccaacacacaggacaggggcaaaccctaaagcccagagagaagcagagaggacagggaggggagacaaaacacccacccttagaaagagaaagccctgcactcaccctccaccttaatccctggtctccctggcttctcttcaaacgtaggaggtcccagtgaggtggtctggctctaaagatagctgccaacaatttcttcccatgtgccacgctgtcatccagaggagccccaagccgtcatgtaagaagctgaggttaggctgggcacagtggctcatgcctgtaatcccagcactttgggagaccgaggcaggtggatgacctacggtcaggagttctaaaccagcctggccaacatggtgaaaccccatctctactaaaaatagaaaaattagctgggcatggggcgggcgcctgtaatcccagctactcgggaggctgaggcaggagaattgcttgaacctcggaggcagaggttgcagtgagccgagatggtgccactgcattccagcctgggtgataagagtgaaactccttcttaaaaaaaaaaaaaaaaaggctgggtacggtggctcacaccgctaatcccagcactttgggaggccgaggcgggcggatcacgaggtcaggagattgagaccatcctggccaacatggtgaaaccctgtctccactaaaaatacaaaaattagccaggtatggtggcgggcacctgtagtcccagctactctggaggctgaggcaggagaatcgcttgaacccgggaggtggagattgcagtgagcagagattgtgccactgcactctagcctgggtgacagagcaaggctccatctcaaaaaaaaaaaaaaaaaaaaagtcaaggctgttctgctggagagaggccatatggaagaggactgaagtgccagacatgtgagtgaagaagccatcttagatacccagcccagttgagccttcagatgactccagtcccagccaccatctaactacaactacctgagacccctagaagagccaccttactgagcccagtcaacccacagggccatgaaagagaagactgaattgtggttttaagccactaagtttttaggtgtttgctacacagcaatatacagccagaacacccagggaaggttgcagcagcccttttaaagcttttgacacccccatcccatatccccttcacaacacaatcaacactagcgagtcagactttcagcccctttaattaggtgctctgagaagaggtcagaatggcaggcagggggtggggaaggcggtgcttcttgagccccacttagcaactggtcactcatcctctggcagctggatcttgctggggtcgaagcagttggattccatgatgggaaggccattggcctctcggtatttcacaagcctctcagcttcgcggcgggaccactctttcatcctggtagtgcaaatagcaggggtagacgtgagggagcctcaactgataccaatccctcatctcagctccccattcccaatggtgcaggaacaaaactcctggcagaatccccttcaacctccatccctgcctctgcctcttacccatcccacgctcttggacaccctgtgcacctgtagtcaggcagataggccacaaaggtgctgccaaggaccaggatgatggagacgccaaagaagaagacaagtcgcatgttccagacgtccaaaacggggtccttgtcataaccatgggagtctgggttctgtggagaaatagaggtcaatgagggcttcctgctgctccacaaagccttattctggccctgcataacttggtctccatgtgcccctctcactaaattcctctgtttccattcttgggatatgtcaagctccttcccactgcagggccactgcacttgctgctctctctgcctggaaagcctttcttccagctctagtcatggctggatctgtctcctcattcaaggttttagattcatcaccacttccttcaggaggcactccctagttaccttgtctttcaaagttgaagcataggaaactgctatttttataggtcacaaatggttgaatactggcaatttcttatagctcaagctaatgaaatagccccctacacccaagtcattctctatccacttatcttgcttaactttgtcttcacatcctctcttccttctgtctctttctagtctatgtttacctaagtagcatactttccccattctctgtatatcatacattctcatgttatattatctattatactactttgtattattgttttctaatattttactgtttattttctgtcttccccactatcatgtaagctctatgagagcatgggctttgtctgatttccacactgctgtatccccagggccctgaactgagcctggcgtacagcaggccctcaatacatatttacagaatgaacaagcatcctatatatccaagccccttaaccagaggttagtattgatgaagtacttattatgtgccagtcttttcacatagaaacacctcacaatatctcagtgaggtgaaacatggcaataataaacacattctagtgctgagtacatacttacgaagtgccagctgctgttctgaccatttttactcatttaattacatgaggcaggtggggtgtcctattttttagaaggtgtcctattactgttcccatcttacagacaaagaaactgaggcaccaagggtttatgctaccaagatcacacgggtgggtaaccgtcagtgctgcctgatttcacagcgtctgctattaatacagcacagcagacctggtagccctaaattcaaataccagttccacctccaccatgtattcagttatgtgagctagggcaatccacttaacatctctgtgcctcagtttcctcatctgtaggatgagtataataatagagcccacctcgaaatggggtttgtttcgagtataagatgagctaatgcatgtcaagtgtttagaacacagacggggcccggagcggtggctcatgcctgtaatcccagcaccttgggaggccgaggcgagaggatcgcttgagccaggagttcgagaccagcctgggcaacatagcgagatctcgtccctataaaaaaaaaaaaaagaatgcagacggcaacgagcaagtgccatatcggtgtttagtattatcgttgtactatactgcttctaacgtgttttgagcgctgtccacttgaggtgtgatttctgtctgcaaaataaaaccaatcctgcctctggccctggaacgaagataccgagagacaaaggaggaacacaaggtaggcaaaattcccaagtcttctaggctttcgccggccgcgcagtcctctactgcctaagaacgtcctctacagcgccccatctgccgatcccggactgaccccttcggggttccgtccccactaccccccccccccccccgcctctcaccttctcatacaagttttcgtcctcgggttctgggtcctcttgccacggtgtggtcggttctgggggccgctttcccgccacagcggacggggcgaccacagtcctggagaagctagattcccagcggacgcgggcggccgggagccctcgcgtcgccgctgccgccaaaagacggcgagcgctcaaaccaaacagcccagccgccatgacagatggtgctgcagggtctcaggggcggggaaagaaatgcgactgtgcgcagctgcagtgggtgcgagcgcgacaatcatcgccccgcctccgccacgctatataggtcccagatctgatttggttttccaatgaggcggggcgttgagcaaccctctttgcctccagttgtcgtggcttcgtggggccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagccctyccttgacagcccgggccgagaaggtgagcgtcgacgctggtcgtgggggcggaggtaaggggcccggggcggggacgtagaggaggcgcgagggcggacttcgggtcgggggagatgcgcggaacggaggggttggtgcaatgtctcaacccgggagggtttttttttttttggttttttttttttttttttttttttttggtgtgagcaaaggcgcgtgcgcgactgggacatgggatgggtgcatgcgggttgggggaagggagggacggatgggagtgggctactgtggatcactgtgtcggctacatcgaagtttatcagtggggaagcggttgtctgcgactttgagtttgtgcataggagaggggatgctgctctgtgttactctggtgtttatcggtccatggggaaatattctgtggttctggtctctattcctgggggatcggaggggggatgtgactctggtctttaccctttgagggggggcggtctgtgactctgatccttatccatggggcggggcttgggggacgactgtcttttgattgaccctaacccacttattgggtgggaaggggcatgcagggaatgtgtgtgtgactcattgccccttcttttggggagtttgtatctgtgacactgacgctcatccatggaaaggggacccactgtgtaattgtggtccttactgtgtgttccttctgtgatgtgggcccgtagttatttggggctcgtgtctgtgactggcccttggctgtggtggatgttactgtgtgactctggcccctttgccagagtctcttgaaggtttttgtgctctcagacgccagtgcctctgtgtgattctaactcttgcccacctgggagcaggtaactcgggttccctgtggcttgaggaggaagagaaaattggagtgtgtttgtctgtgtatgtgtgtgcacgagcatagagcaaaggtgtggcagcaacctagtgttgagcaggtgctattattgcctggctttacctgcttcttattcagagggtggggcctgaagatctgggattcatcctgacctctggctgggtcacagggttctcaggactccctgagttctcaccacagccctgagggttggatgaagtggctgctgctccatcccaatagaagagcacagtggttcagaacagcctccaaaagggccccttttgcctctggaaaacgggcttgagccctggggagggaaccaccttaggaccgggctgcacataagagacagggctcagggctgagccagttgctgtgtgagggccaaggctgtgttggccaggagcccagggaggtggcagctgtctcgtcgccaagttcgccccttcacacacccccccaagagcctttcatggtcttttgctgccttataggggacagccagcagcttgttgggaggatgagatggtcccttggggcctgtggaaggagcctggggcccccattgttgtgaagtcttgtctgatgtgctgaatctcaggcaagactttcagccctgagagtcccctacccccaccctgggatgcagccccaggcttgaatttgtctacctgtcttaggtggcaaagccctgatcacactgtgggtggccccgccaggtctctctgcaagatgccccctgtctgctgaagtccttgctgttttctagggcagtgggctctagccttatgtttgcggggaaagggaggagcaggccaagtaggggctaccttcatactgtgatgcacaggagtgctgggagctggaagacaatgtccctgggctaaggggcagcggagagccttgacaataagagtttctcaaggaggccctctcagtcccaacagttttgacccctttcttccctccactctccccagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacggtgagttatctgttctcagcttcccagacagcctaggcttgcgtctatgtgagaattgatccaagaaggtgctaggatggggcttctgggtagaggaaacagcatagcagatgatgggtttcttttcagcagacaggtgtttggcacctgttgtgagccaggacctgtgctaggctctgatagtgcagtgatgaatgagacatgagattgcatccttctcagtactcagggtgtcacagggacgctatgcagttaacgggtgggaggttgaggttggggctatagcctggggtatgagggatgggtgggaatggcaccatcagagtcaggatttgcccgggaccactaggggacaagccaggtcagatagtggaagactccagggacagtatgggctacagttggcatgatacttgctgggaatggatactctcagacagttatttcttcagctctgctatgaacaaggaatagctggaacactgggtaaaatacagaaatcctgagtaaaattcagtgatccctcgccatccaggtgattccgaggcaggtgacccagccatgacacttgaagattgcctagaaaagcagacctaactctctcagaaagcctctattaagactcaagagtcaatagctttataaaaagagaaaataatttttaaaatgttttacgaagtgtttcttctaccaccactccttttaaaaatgtagaattgtaatattttgttttctgaaaagtgagcccaaatttgagataaggtcatcacctagtgttattcagtcttggctttcattagaaatgttttttgaaagacatttgattttggacggtattcactagaagtgctctgtggccatttctgaatttgagtagctgacatacatactttgttcaaactttattaccaagtaaaaccattgacttttaaaagccctcaagtgcagaggtttgagttcatcatactttccagttcaaggtaggtttctgtcataggtcagcaaaaggcttcctcttgtcatgtttattttttcatttttattcccaattcccacctctgtgggcagctgctctgtcgtgtttgatatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatcatagatttatcatatagatcattttcatataaatgtatcatatagatacatgtatcatataaatacatacataaatgtatcatatagatacattttcatagaaaatgaaaatatgaagtgttgttttgagtgactgtgttttcagttgacacacatggcatggtgccacagtcttcgttttgtttcctgaactttgtattactcagagtgggaggttttttttgttttttgttttttgttttgagacagggtgtctctatgttgcccaggctggtctcaaactcctgggctcaggcaattctcctcccttggcctcccaaagtgctgggattaaaggcatgagccgctgtaactggccaacagtgctgtttttttttgtttgtttgttttgttttgttttgtttctttgttttgagaaagagtttcactcttgttgcccaggctggagtgcaatggcgcagtcttggctgaccacaacctctgcctcccggtttcaagcgattctcctgccttagcctcccacatagctgggatttcaggcatgtgccaccacgcctggctaattttgtatttttagtagagatggggtttctccatgctggtcaggctggtctcgaactctcgacttcaggtgatcctcccatcttggcctcccaaagtgctgggattatgggcatgagccaccacacccggcacagtgctgtatttttaacatctgtctgtattgccatgtatatgttactactttgtttctaattgctggcaagggcatcatggggcatgtctactgagttttacttaatacttcccccaagagtagatgcctgttgttaattttgatgtgctagcatcattttttttttttttttttttgagacggagtttcgctcttgttgcccaggctggagtacaatggcgcgatctcggctcaccacaacctccacctcccaggttcaagcaattctcctgcctcagcctcccaagtagctgggattacaggcatgcgccaccacgcccagctaattttttgtatttttagtagagatggggtttctccatgttggtcaggctggtctcgaactcctgacctcaggtgatccgcccgcctcggcctcccaaagtgttgggattacaggcgtgagccaccgtgcccagcccaacgtcaccttttttgctttatctgttaatgtatagtgttttttgtttgtttgtttgtttgttttgagatgagtctcgctctgtcacccatgctggagtgcagtggcacgatctcggctcactgcaaacttcgcctcccgggttcacaccattctcctgcctcagcctcccgagtagctggtgctacaggcgcccgccaccacacctggctaattttttgtatttttagtagagatggggtttcactgtgttagccaggatggtctcgatctcctgacctggtgatccacccgccttggcctcccaaaatgctaggattacaggtgtgagccactgcgcccagcctaatgtagtttttaccttttgcattcagatctttaatccatctagattccactcttgaatatggcatacggtaggctccggttttattttcttccatatagtaggcagtttttccagtaccacctcctaaatagtccattctttctttattgatctgtggtacctcatctgatttcaggttccctcatgtacatggatccgtcttgagtgatgtgatttgttccattggtctatttgcacattcttgtgccagcaccttactgtttttattattatggctttatagaatgtcttagtagctcctttgcacttatttttcaaagctggtttaatcatttatggggctttattatatatcaaaagttatcaaagtccctcaaaaacaacaagaattttgatcgatgttacactgaacttctctattaatttggggaaaattatctttgtaagtagtcatctcatctaagacctttgtagagaatattttgaaatttatgtaaagagcataaaaagctttcattttcataaatggaaatacaggtcttatgtattctttgttaaagtaatccctaggtacttcagtcactttcattatcttttttttttttctcgagacttggtcttgctctgtcacccaggctggagtgcagtggcgacctccacaggctcaagtgatcttcctacctcagccttccaagtagctaggactacaggcacgcaccaccacgcccagctaattttttgtagagacggagtttcaccatgttgtccaggctgatcttgaactcctgagctccagcaatccacccaccttggcctcccaaagttctgggattacaggccattatcttattttttaaaaaatatttttcatgctggtatttgctggggtagaggaaagctgttgatttctgtaagttacccctgctgtatgcccttattatttctaatacttcattgttgattctgatgttctttctaagtagttggtcatattgtatgcaaatctatcctgtcacttatttatttttcttcatttatagtattgtccaggacttttagtaccatattaaatagtataagtgatactgggtacacaaattaagatttactttggctggttgtggcagaaagtccaaaggataatggcttagacaagatagtttacttttctttcccataaaggcagtctgcagaagagcaattaatctagggctgacaggcagccccttctgtgtagccatcctcagcacatggcagttgagacagtaggaagaagggagaggaataaaagggaatgtgtctaaagtttctccattaagtatggtgcatgcagtaagtttttagaatgtatcctttaataaatcaagaaaattatctaatcttcgtttgctaagattgaccataaataagtattgaacttcaaaatcctgtgctttttttctccctttgtccattaatttcataaattgtggcctggcatggtggatcacagcaccttgggaggccaaggtggttggatcgcttgaggccaggagttcaagaccagcctggccaacatggtgaaacctcatttctactaaaaataaaaaaatcagccaggcgtggtgaagcatgtctgtaatcccagctactggggagactgagacatgagaatcgcttgaacctgggaggtggaggttgcaataagctgagatcgtgccactgcactccatcctgggcaacagagtgagactccatatcaaaaaaataaataaaaattttgtaaattgcattaaatgatatccttggcattcttgagctataccccacttgatcatggtatgtatgtatatgtttatgacttcttactttgaaaatatctcaaatttacagaaaggttgcaagaaaaagtataatgaattcccatatatcctctactcagaattacttgttttaagtattttgccacatttgctctatcactctatatctttttttttttttttttttttttttgagacggaatcactctgtcacccaggctggagtgcaatggcgtgatcttggctcactgcaacctccgcctcctgtgttcaagcaattctcctgcctcagccttccaagtagctgggattacacgcgcctgccagtacgcctggctaatttttgtatttttattagaaacgaggtttcaccatgttggtcaggttggtctcaaactcctgacctcaggtgatccacctgcctcagcttcccaaagtgctggaattacaggcgtgagctaccgcgcctggcccaccctatagctctatatctttacatagacacacacacacacacacacacacacacacacacacacacacgttttttttaatcgtttgagttggtggcagccatgacttttctttttgagtcagagtttcactcttgttgcccaggctggagtgcaatggtgcaatctcggcccactgcaacctcttcctcctgcattcaagcgattctcctgcctcagtctcccaagtagctgggattacaggcatgcgtcaccacacccagctaattttgtatttttagtagagacaggatttttccatgttgatcaggctggtttcaaactcccgacctcaggtgatccgcccatctcggcctcccaaagtgctgggattacaggcatgagccaccacatccagcctgacatgaccttttaagtctggcagcatgtacgtcttaagaacaaaggtgttctcttccataaccacaatatacttatcaatatcaggaaattaaacaattatatagtacttttattctatataaagcccatattcagatgttatcactcttctcaataatgtcctttataatggttttccccaatccaggatccagtccaagatcatgtattgcattgagctccttgtctcctttaatctgaaacagttattctatctttgtcttttatgaccttgtcatttttttttttcctgaacctatggattatattgaaagcatgttttaaagttagttgttttatagaatgtttctcagtttggatttttctgatgcttactcatgagtttttggcagaaatgttatttaagtgatttatgtatatttttaaaaccttgttagattttattagccattgtatcatctaggatatctacacctgtatttatcagtgaggtagtccaatatttttattttcagtatttatctggcattggaatcaaggtagcctcattacatgaattgggcagcctttgttattctctctttattggagaaacttgtataagaattatctgtacctcgaaaaacttggtaggactcacctttaaaagcatctggaggctgggcgcagtgggctgaggcagttggatcacttgaacccaggaattcgagacgatcctgggcaacatggcgaaactctgtctctacaaaaaatacaaaaattagctgggcgtggtggcaggtgcctatagttctaactactcaggaggctgaggcaggaggattacctgagtctgggaggttgagactgtggtaagccatgatcatgccactgcactccagcctcagtgacagagtgacaccctgtctcaaaaaataataaaataaaagcatctggagctggtttttgattaccatttcatctcttctgccaattttagcattttatattttctagaaatatactcattttgtgaagatcctcatatatgatgattcagtccagcatcctagaaatgctttataaaagggatatgcctttggaaggtgtttgttcagagtgctttggtggccaattaaaaatattcctttctatccaaatatgttcccttcctgagtttagatagcaagagttcaatacctgaatttatttggtttggatattggatgtcaagagagttcaggataatttcatctgaaaatttataaatttattcatatctgttcagttcttgattttttttcctttttttttttgtttgtttgtttgtttgtttttgtttgtggagatagtctcactctgtcttccaggctggagttcagtggtgcgatcttggctcaccgcaacctctgctttccaggctcaggggattcttgtgcctcagcttcctgagtagcaaggattacaggcccgtgccaccacacccggctaatttttgtattttagtagagacggggtttcaccatgtttgccagactggtctcgaactccgtacctcaggtgatccactcgcttcagcctccgaaagtgctgggattacaggtgtgagccaccatgatggcccagttcttgaattttgatgactacagttcaaattgattgtatcaagaaccttataactactcataccactgacagtgatttcttctctaggcatttacggtagggaaacaatttggggccaggtgtggtggctcacgcctgtaatcccagcactttgggaggccgaggcgggtgaatcacgaggtcaggagtttgggaccagcctggccaacatgatgaaaccccatctctactaaaaatacaaaaaattagctgggtgtggtggcaggcacctgtaatcccagctactcgggaggctgaggaaggacaatcgcttgaacccaggaggtggaagttgcagtgagccaagatcacgccactgcactccagcccggaggacagtgcgagactccctctcaaaaaaaaaaaaaaaaaaaaaagagtttgggttccaagctgagttcgtggggacagggactttattttgttcacagcagtatccccattacctagaacagtacttatcgtatagccaatgttaggttaatatttgttgaatgaatgcatgaacaaataattgtttaaaaaaatggaagtcaaccaaaatgtttgaaaacatgtttaatggatatttgccccatttgttacttatctttatggtgttttccatagtttagtgtgaaatttcaagcatgtagcaaagtttaaagaattttacaatgggcctggtgcggtggctcatgcctgtaatcccagcactttgggaggctgaggtgggcagatcacgaggtcaggagatcaagaccatcctggctaacacagtgaaaccccatctctactaaaaatacaaaaaaattagccggctgtggtggcgggcgcctgtagtcccagctacttgggaggctgaggcaggagaatgtcatgaacccgggtggcggagcttgcagtgagccgagatcgccactgcactccagcctgggcaacagagcgagactccatctcaaaaaaaaaaaaaaaaaaagaattttacaatgaacaccatatatacccatccactagattctttttttttcttctttctttcttttttttttttttgagatggagttttgttcttgttgcctaggctggagtgcaatgacacaatctcagctcaccgcaacctctgcctcctgggttcaagtgattctcctgcctcagcctcccgagtagctaggattacaggcacgcgccaccacacctggctaattttgtatttttagtagagacggcgtttctccatgttgctcaggctggtctcaaactcccgacctcaggtgatctgcctgcctcggcctcccaaagtgctcggattataggtgtgagccaccgtgcccagcccactagattctactattaacgttttaccatacttgctttattacatatttacttctaagtttctcgtattttttacactctatagagatttataatttttacaaagccagatttattcattttccttttatgactgctgggatttgtcttgctgaggaaggccttccccactcttaaggtgatacatttttttcttatgttttctaatatttgttttctttttttaaaagttcaacttttattatagattaaaggatacacatacagtttttttttttaactcagtgaagatgtctgcacagcaggaatcatgtgggatgggatggccctttttcctaacgctggaccacttgatgttctcttccatcttcccccaaccctcatttagatcatgacatcagaaaatcaggttaaagttaagaaaaagaagaatcagatcattggggattcttagtagtagcatcgccattgggagctgctagcccagcgggtattccccatgccacccctctggatcttggctccatgggtactgggaggaggccttgttggccagggaggccacgctgtgctgctagaagctgggcgacatactggtggtgcagcagagtctcgggtgcggcagcttggaggtactacccacataggcattggccttccagggtgcatcctggcccatcatgctgctgcagcagctgtggctggtgctgcatgtctgcttgcctgctaggctgctcgccggcttggccaggagcttgctgtgcctcagtggggccacatcccctgtggctgctgtggctgtgctctggtcttggaaaatggtggcgatgtggttccagaggtctgtgaagaacctgctcacaccctcgtaggctgggaaggcgttgatgtcgatgacggcatgctgccccatctggttgttgatgatgatgtcggtgccgaacagcaatactcccagtgcctgccgcagggcccgggggagttcccggatgacctctttgctcggctgctcttgaacagaccagaccccttgatcttgtccagctccatcaggaccaatgatgactctggctttgacacactgtggctattgaggaagatggattcgtggtcacattgtgtccgcggagaatttcttgagcaagggcctctggaccacggtgtaggacttgctgaccacgaacaccttgtacagaacggtgttgtggttgatgaaattctagaccacacagggtggctgtatgccattcaggccctcctgattgaatacagtagacatctcgtgagagttggtgccgtgagccactctagttttgcacatgaacaggaaagccaggctgttcttctccagcagccacatggtgtcatccccgcacaggcttgtgacctccatgaagggcagcaagcagatcctgccgccttccatgtagatctcaatcttccagatgagtttgcaggacttggagcggtcgagcagggttctgacggcagggaaggagtccaggacgatggtttcagggtgggcatcgatgtagtcctgaaacctgtgcaccagctccagggactggctgtcattctggtcggcttcaaggatgacatcagtcaacttgtgaatgatgacgtccaggggtccctgctcctcgattggccggctgaggttcagctgcatgacttttttttttttttttttgagatcagtctcactcagtcgcccaggctgaagtgcagtggtgtgatctcagctcgttgcaacctctgccccccaggttcaagcgattctcctccctcagcctcccgagtagctaggattacaggcacttgccactacggctagtttttgtatttttagtagagacagagtttcaccatgttggccaggctggtcttgaactctcgacctcaggtgatccacccgcctcggcctcccaaagtgctgggattacaggcgtgagccaccgcgcccggcctcagctgcaccacttctatccctcacttcctgcacacctccgctaaagccgggaaattgagcttcttgattttcttctcatgcagccagtagccaactctcttccctttcataaaggtctatatcttcctcctcgggcaaggagcctgggtcctgaggaaattgcccataggctgagtctgttggccagtgagcgctgggagcgtgcgggcaccccctggtggcaggggtgtggaaagggctcggggtgcggggttagggccgcgtggtgtcacggtctccacaacccccccacccctggccacccagctggagctcacggcccacatacaggttgttctttttttcatacgcagtttcactctgtcgcccaggctggagtacagtggtgcgatcggctcactgtaacctccgcctccctggttcaagcaattctcgtgcctcagcctgcccagtagctgggactgtaggtgtgcaccaccatgcccagctaattttggtattttttagtagagacgaggtttcaccatgttgcccaggctggtctcaaactcctgacctcagtgatctgcccccctcggcctcccaaagtgctaggattacaggcatgggccaccgcatctggcctgtacaggtttttttacatgggtaaattgcgtgacactgaagcttgaggccccgttgatcccatcacccaagcagtaagcttagttcccgacagatggtccttcagcccatgccccccttcccaccttcccggtctagtgatccccaatgtctgatattccaatatttacattcatgtacattcaacatttaactcccatttataagtgagaacatgcagtacttggttttctgttttcgtggcaggtggcttaggataacagcctccagctccatctatatggctgtgaaggacatgattttgtcttttttatggctgcatagtattccatggtgtatatgtaccacatttttctttatcctgtccactattgatgggcattcaggctgattccatgtccttgctattgtgaatagtgctgcagtggccaggcgccatggcccatgccagtaatcccatcactttgagaggccgaggtgggcagatcacctgaggtagggagttcgagaccagcctgaccaacatggagaaacgccatctctactaaaaataaaaaattagccaggcgtggtggcacgtgcctgtaatcacagctactcgggaggctgaggcaggagaatctcttgaaccaggaggtggaggttgcggtgagccgagattgcaccattgcactccagcctgggcaacaagagcgaaactccgtctcaaaaaaaaaaaaaaaaaaaaagtgccgctttgaacatgggtgcatgtgatagaataaattattttcctttgggtatatacccggtagcaggattactgggtcgaatagccaaagcaatcctaagcaaaaagaacaaagccagaggcatcacattgtccaacttcaaactatactgtaaggctacagtaatcaaaatagcatggtcctggtgcaaaaacagacacataaaccagtggaacagagtagagaacacagaaataaacccgcacacatagaaccatctgatctttgacaaaatcaacaaaagtaagcaagggggaaaggactccctgttcaataagtgctgggataggtggctagccatattcagaagaatgaaaccggacccttacctctcaccatatacaaaaattaagatgtaagacctcagactataaaaatcctagaaggccaggcgcggtggctcatgcctgtaatcccagcactttgggaggccgaggcaggcggatcacctgaggtcgagagttcgagacgagcctgaccaacatggagaaaccccatctctactaaaaatacagaattagccaggcgtggtggcgcatgcctataatcccagctacttgggaggctgaggcaggagaatcacttgaacctgagaggcggaggttgcagtgagccaagattgtgccattgcactccagcctgggcgacaagagtgaaactctgcctcaaaaaaaaagaaaaaaaatcctagaagaaaacctaggaaatgccctcctcgatacagggtttggcaaagaatttatggctaagtccccaaaagcaattgcaacaaaaccaaaaattgacaatttggacctaattaaacagcttctgcacagcaaaagaaactaccaacagagtaaatggacagcctacagaataggagaaaatcataagctacacatctgacaaaggtctaatatccagaatctacaaggaagttaaatcaataggcaaaaagcaaaatttccaattaaaaaatgggcaaaggacatgaacagatacttctcaaaagataacatacaagtggccaacaaacatgaaaaaatgctcatcatcactaatcatcagagaaatgcaaatcaaaaccacaaggagacaccgtctcatgccagtcagatggcaattattaaaaagtaaaaaaaaaaaaacatgttagtgaggctgcaaagaaaagaatgcttatatactgttggtgggaatgcaaactagtttggtcatgggagaaagcagtttcgagatttttttttggagagagagatttctttaatatttttatggtttctatttgggaatttaagttttcacccatccataatttatttggcgtaagaagtgaggtaaactttgttttcttagtgggcaacacttttctgtgaaggatcagatagtaaatatttttggcattgcattgcaggactgtctctgttgcaactaaactgaaagcagtcacggacaatttatgaatgaatgaatatagctgtgttccagtaaaactttatttaattaattttttttttgaaacaaggtcttgctgtgttgccctggctggctggagtgcagtggcgcgatcagagctcactgcagcctctgtctccctggctcaagggatcctcccacctcagcctcacacacagctaatttctttctttctttctttctttttttctttttccagtagagacgaggtctgactactgtgttacccaggctgggtctggaactcaagggttactcctgccttggccttccaaagtgttgggattacagatgtgagccactacatctggcctccactaaaactttatttaaggagactggatttggtccactggctatagtttgctgattcctaggccagatagttattgtaactattatttattgactaatttgttttccccttgttagtttgaaatataacctttggcttatactgaatttccaagtgtgtttttgtatgctgtagattctattctatttcactgatctgtctattcatgttttaattaatttacctttataatgttttaatatttgctagagttcctctcaactcattagttttttttttttttttttttagtgagagagagagagagagagagagagggtctggctttgtcgcccaggtgcagtggcgcgatcatggctcactgcatccttgacctcctggcctcaagtgattctcctgcctcagcctcccaagtagctggggatacaaacacgcaccaccacgcctaactactttttgtatttctttgtagagatgaggttttgccatgtcacccaggctggtcttgaactcccgggctcgagcgatccgcccacctcatcctcccaaagtgctgggattaggggcatgagccactgctcctggcttatcctttgttttttgtttttgtttgttttgagacagagtctcactctgttgccaggctgtagtgcagtggcgcaatctcggctcactgcaatctttgctccctgggttcatgagattctcctgcctcagcctcctgagtagctgggattacaggcacgcgttaccacacccagctaatttttgtatttttagtagagacggggtttcaccatgttggccaggctggtctccatctcctgatctcgtgatccgcctgccttggcctcccacagtgctgggattacaggcgtgagccactgcgcccagcctgtcctttgttttttaaaacaatgctacagtaacttttttgtacatgtgcaagtatgtgtatactttaaattcccagaagtagaactgtgggtcaaagggtatatagatttttagttttgtcagctattgccgaattctcctctataaggattattccatttttaactcctaccagcaatatgaaagtacctgttttccatacagtcttgctgtttgttttcaaacattggactgttgtaaatctgttagattaaaaatgttctatcaaatcttccttactagtgattattgtatagtacaatactatattatttaatagttatcataaataataattttaatataactccaaataatgtagatactccctcctctaggaggtagagcttaattaccctccttttgactgtgggctggtcttagagactcacctctaaagaatagagtatggaggccgggtgtggtggctcacgcctgtaatcccagcactttgggagggcgaggggggcggatcgtgaagtcaggagatcgagaccagcctggccaacatgatgaaaccccgtctctactaaaaatgcaaaaattagctgggggtggtggcaggtgcctgtaatcccagctacttgggaggctgaggcaggagaatcgcttgaacccgggtggaggttgcaatgagctgagatggcgccaccgcactccagcctggcaacaaagcgagactccatctcaaaaaaaaaaaatagagtatggagagagaaatagagaaattttacagggaagaaacctggcagacagcaccttaactaggtgatcatggttaacatcaccagagataagtcatgttgttatcatgtactcttctgtgatatgatcagaagggcatttcactatctcacttctgttgtatgcttctccaaaaaaaaaaaaaaatccataatcttaggtctaatcatgagaacacatcaaacaaaaccagttaaagggcattctacaaaatacctggccagtgctcttcaaaactgttaaggtcattaaaaacaaacaaggacagactgataaaccttcacaggccagaggagactgagggaacatgacaactacatgtaatgtaatatttaggattaaatcttggatcagaaaaaggatattaacgagaaaattggtggaatcctaatataatctgtagtttagttaattccttagttttgacaaatgtgccttagttttgttaatattaggggaagctgggtgaagggtatacagggattctttgaacttttctgcaaatgtaaaattatttcaaaataagaagtttgacttcatcaaaattagaaacttttgtttatttttgttggttttatagcgatgagttttcggtatgttgcccaggctggtctcaaactcttgggttcatgtgatccgcccgtcttggcctcccaaagtgctggaattacaggtgtgagcccaccacgcctggccacaattagaaacttttggaagtctctctgaacctattctggttcagggactgctggtaacaacaacaaaagattagaaacttttttttttgagacgtagtctcactctgctgcccaggctggagtgcagtggcgcgatctcggctcactgcaagctccgcctcccaggttcacgccattgtcctgcctcagcctcccaaatagctgggactacaggcgcctgccaccacgcctggctaattttttttttttttttttttttttttttgagacggagtctcactctgtcgcccaggctggagtgcagtggcgcgatctctgctcactgcaagctccacctcccggattcacgccattctcctgcctcagcctcctgagtagctgggactgcaggcgcccgccaccacgcccggctaattttttgtattttttagtagagacggggtttcaccgtgttagccaggattgtctcgatctcctgaccttgcgatctgcccacattggcctcccaaagtgctgggattacaggcgtgagtcactgtgcctggccgattagaaacttttatacttccaaagacactatcaagaaagtgaaaagacaacccacaatgggaaaacatatttgtaaataatatatctggtaagggattaacatccagaatatatgaactcttacaacaacaaaattatccaatttaaaaatgggcaaaggattcatgaccagcttgacttaacatggtgaaacccctgtctctactaaaaatacaaaacatcagccaggtgtggtggcaggcgcctgtaatcactgctactcgggaggctgaacctgggaggcagaggttgcagtgagctgagatcatgccactgccctccagcctgggtgacagagttgtactccatctcaaaaaaaaaaaaaaaaattggcaaaaggacttgaatagacatttctccaagaaagatatacaagtggccagtaagcacatgaaaagatgcaaaataacaagtgttggtgaggatgcggggaaattggaacccttgtgcaacactggtaggaatgtaaaatggtacagctgctgtggaaaacagtttggcggttccagaaaaagttaaacacaggattaccatatgatccagcaattccactcctagatatatacccaaaagaattgaaagcaataattcaaacagatacttggacaccaatattcatagcagcgttattcacaatgtccaaaataaccaaggggtggaaacaacccaagtgtgcacgaacagatgaatgaacaaaatatgcatactacaatagaagagtattattccaccataaaaaggaaggaaattctaacatactgccttgtggatgaaccttgaaaacatgccaggtgaaataagctagacacatagggacaaatatatgattccactactatgaagtacctagaataggcaaattcattgagacagaaagtagaatagaggctgtggggtggggtgagaattgtttaatgggtacaaaggttttgtttgggatgatgaaaaattcctggaaaaggtgatggttgcataacattgtcagtatacttaatgccactgaattagataattaagaatggttggctgggcgcggtggctcatacctgtaatcccagcactttgggaggccgagacgggcggatcacctgaggtagggagttcgagagcagcctgaccaacttggagaaaccctgtctctactaaaagtacaaaattagccgggagtggtggtgcatgtctgtaatcccagctactcgggaggctgaggcaggagaatcgcttgaacccgggaggcagaggttacagtgagccaagattgcgccattggactccagcctgggcaacaagagtgaaacttgtctcaaaagaaaaaaaaaaaaaaagaggctgggcgcggtggctcacacctgtaatcccagcactttgggaggcygaggcaggcggatcacctgaagtcagaagttcgagactggcctggccaacatggtgaaactccatctctactaaaaatacaaaaattagccaggcatggtggcacacacctgtagtcccagctactcgggaggttgaggcacaagaattgcttgaggcccggcccagtggctcacgcctgtaatcccagcattttgggagaccaaggtgggcagatcacgaggtcaggagttcgagaccagcctggccagcatagtgaaaccccgtctctactaaaaatacaaaaattatccgggcgtggctgcgtgcatctatagtcctaactactcgggagactgaggcaggagaatcgcttgaacccaggaggcggaggctgcagtgagccgagattgtgccactgcactccagcctgggtgacagagcgagactccatctcaaaatttaaaaaaaaaaggatggttaaatggtaaatgtatattttaccacaatacaaaatgatctagaaaaaatatacaaaaattaaaattttaagtttattttaggccatgtgcagtggctcccgtctgtaatctcagcactttgggaggctgaggcgacaggctcactttagtccaaaagttcaggatcaggctgggcaacatagtgaggtcctgtatctacaaaaaatttgaaaattagctggatgtggtggtgcattcctgtagtcccagctggttggggctgagatgggaagattgcttaagcccaggaggtggaggctacagtaagctatgattgcaccactgcactcagcctgggcaacagaccgagaccttgtctcaagtaaaataaaatttattttgaaacagtctatccaatgtagttttaattctcatctttctctctctcttttttttttttcttgagatggagtctcgctctgwcactcaggctggagcgcagtggtacaatcatagctcactgtaacctagaactcctaggctcaagcagtcctttcgcctcagcctcctgagtagctgggactatagatgtacaccaccatgcccaactaatatgttgtggtggtgatggtggttttgtaaagacgggatcttgctatgttgtccaggctggtcttggcctcgagcaatcctcccactttcaccccgcaaagtgctgggattacaggatgagccatctcacctagcaaaattttcttttttttttttttttgactgagtctcgctctgtcgcccaagctggagtgcagtggtgcgatctcggctcattgcaacctccgccttctgggttcaagcgattctcctgtctcgccctcccgagtagctgggactacaggtgcgtgtcaccacacccagctgattttttttatttttagtagagacggggtttcaccatgttagccaggatggtctctatctctggaccttgtgatccgcctacctcaccctcccaaagtgctgggattacaggtgtgagccaccgcgcccggcaaaattttcatctttcattatgagtgagatagagcatcttttcagatacacatcattgatatttttatctgtgaattctgtttacttcctttccccatattttttcctagtttattgtcttttgacttggttaatgatgttttttatttttctgtttttttctccaagcaaaagtattttatttttatgtagttgaatttagtaatcttttctgtggcttctggatttggattataggtttccccatttcaagattataaagaaattattcagttattctatattttcttttatgatttcatttcttttttttttttttttttaagacagagtcttactctgtcacccagactggcagtggctcaccgcagcctccgcctcccgggttcaagcgattctcctgcctcagcctcccaagtagctgagattacaggcgtatgccaccacacccagctaatttttgtatttttggtagagatggggtttcaccatgttggccaggctggtctcgaattcctgacctcaagtgatctgcccacctcggcctcccagggtgccacccacgcctggcctatggtttcatttcttatgtttaaatctttgatctatttcaaatatatcctggtatatatgtgaagtatagtcataatatcttgcacatgtctaggtatttaacctttttgatgaattgtacttgggacctttctattttctaaacagtggttacattaatttgtacccagcatccttactgatttattatttataacaagtttttcagttgattctcttaggctttgcaggtatactctcatatcatttacaaataatggtaattttaccttctcctttccagcttttaacctcttttcttccttccctgtttaattgctttagctagtgtctttagaataatgttaagaatgctgttgataacggacattctaatgttgttcccgaccagaattggaatcctgttagtatagtagcattcttctgtggcatctagttttttctattttaaataaacatatattggttgctcttagaatgcttttttagtcattatttgttcaaaataattgttgagcgcctactgagtgctagggaatatggcagtgagctaagggtcccctcatttcctggagcccatattctagtaattttttaactcaccaaagaaacacagattaggccatgcacagtggtggacgcctgtaatcccagcactttggaaggctgaggtgggtggatcacttaagcccaggaatttgagaccagcctggcaatgtggtgaaaccccatctctacaaaaaatacaaaaatgagctgggcgtggtggtgcgtgcctgtggtcccaactactcaggaggctgaggtgggaggatggcttgagcttgggaggttgaggctgcagtgagccctgataatgccactgccctccagcctgggcaacagtgccagatccattctcaaaaaaaaaagaaaagaaatgcagatgaaatcagctttgagatcattattttacagttattgcggtaggagaaattttaatgaaagagctgctagtgtcggcaaggtgacagtgaagcaggggcaggggacgtggtgcaagacagggaggaggagcctcacccccggggatcctgcaagccgaatgagaccttggtgagcattttggtatttgatcctgagactgagggggagccactaaagggagtgagatgggtttgagtggctttgccttagaaagcactcacatttgggatttgggatgtagagactgaactggggaggtccaggtagaagtgaggagaacagccaggccacaaccaaggtgccccatgagggaagccagtggcatggaccagagagtgacatagggatggagagaggcaggttgcacttcagagatgtggagcagggatttaggaatccctgtatgggggcgggcctgagggcttccaaagaatagagtagggggagggaaaaatagaaagtttacagggtgagaaacctggcagacactgccttaaccagatgaccatggttaacatcaccagagctaagtcatggtggtatcatgtacttctttctctgataggatcagaagggcacctcacttctgttgtatgctcctccaaaaaaaccaaaaccctacgagaacacatcacctgggcctcttgcaccttttagaaagggcaaccttctgatccctccccatccttcttcctccactagtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggtgaggagggggcgcgctgcgccaggcctggctgggatgggctcccaagggccctctgtgtctggctgcagcaccgtgtgcaggcagctctccactcccgtgccttcagactgtgctcggtggctttgcctcacctggagggcctgttcccactcccctctctgagggctcctctcccaacctgggtctccctggcttccacatgcttggctctgtacttctgagggcccctggccaccactctttccctttctccctgttgttcagttcgggcccatggctcactgtgaaccctgtactgcccgctcccagccaacttgggcacttgaagagcctcttccatgggacccggcgtctggggttgggaggacaacaaggggactgcagaccaccaagctgaggagctctgggaggccagccatgggcattcccagtggtgatagagcccctagacagaagggaaggacccttctggagaagccagtgccatgttgggtagttcaccctagcctgcgggatgaggcgcgatgtttacaccatcagggagcccccacccgaggggaagaaacaggcttgccttaggggaatcccagttggaggggcagtcagggacctggtccatgcgagcaggcagctctcctgtccagcaggctgggaagggagttcttgcaagcccagccctggggggcagtctgtgagctgcccactgccctctggagggtccagggcaaaaacccctttggtggactgccaggcttctccagtggcagctgtcaagctgtgcccagacgtctccaggagcactgggccctggccagggtgggaatggagcaccaagttatctggtgcttccccactgtgggcgggagggctttggccccaggcctgctctgcttagtcctggaatggatggattgggcaacagcccagagcccaacagccataccgttttgagcgtggtgtgtggtggaggactggccaaggctgaggatcagggactgaggagggagtgtctgcagccctcacaccacctccaccagctcctgctgcctggctctggctgagatctgaagctgttcttatgcccccagcttggttgcagggtggaaccgtaggagacatgcagccttcggtggtacagtgaagcaattgagcacaccccctgagctggccagagaggagaggaaaatcaagggtggggtctggtgtgctgaccccaggccatcttgccccaaggaggtttaagctgtgtcttgtcagctacctttgggagttccccccacaccaatactgtcacctacctctccccacccactgaaggcagcccccaaaaggaccccatggagaatttacagtcccagaaagattgcaggccggggcctgcccaccctgcctgcctgagcctttagccggagcccgcacatccctggctttcagagcctgcctgcctcacagagccagcggccagctcctaggcctgcccagactgactgcccgtctggtgtcactcatctcattctgtcggccaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacgtacgtgccccccatggccccgggcaggaggccaggctgggtctcctccagggccctcaacttctccccacccctccctcacctgcaacctcagcgcctttcatcccttctccccctccagctcctatcccccagcactgatccgtcctctgtgggcaggtcccatcggccccccggtctggagggaggagtgtcagagaggccggcttggccaagggacattggccatgggtgtctggtagtggtgggtatgggcgggagaagagcagtcctgcacattccactggtcatccagccattttgcatgtgtgcatcatgggccagacgctcaccgggccagtgctggctattgctggtagcagagatgacactggggccctgtaaccattgggggagggatgggattttctgaaatttccttctctttttcccccatccttttttgtcagcagcctggcctggcctcagagccttgggtggctgctaacagcctccacgcctgcctccctttcctcctgtttccttttcatacatacttctcatgacagccacactgaagccccacgaggcctaccagaataacctccaagaatagtgtcctgatcttggtccttcttagtctactccgccgcccctcaccccctacccccatgaattctctgatcagccctcctctgaaatctgctagctgctcattttgtaacagagaaaatcccacttgtgtatttgagggtttctaaggtctggcccacctgccctgttcagggtcagacagtagctggttgctgacatttgttgagaatgtatctcagggtgggccatgtgttaggtatgattcagtccccatggcagcccagcagggaaggtactctttgtattccatccttcggatgaggaaaccaagccctgagtgggaatgtgacttgccccaggtctcatagccagtgagtggcagagcagagctggagtctgaacccgggcagctggaccctagagcccactttttgctgcttcctcagccttccctgagtttggagtcctgataagctcttctgtgtgtttttccttttcaccctgtgtatgggtgtgtgtaaggctaatgtcctgtctgttgtttaacctggtggggaaactgaggcccagagacatgaagactccttcccaagaatggctggcataggctcctggtcctcagtgagagacctcactggcctagagaccctgcctcacctgggccaaatcctgaattgcctctgcagtttccctctggcctactccatctgggaagcaatccccaggactacatctttttgctttttgtctccaccctaagttattgctacagtcatggtctagggcacatggctgggatttgctcagactcctgtcctccccagtttgacatttatgtcatggatctcttttgacgcaagctgcaggtcagcagggcaggggcgggggtgcgggttatccccttgccaagggcaagaattgcatcccaggtttccttacttcgtggctgccagcgagccctttgtcagatcaccctgcccaccgttcttaagtggctggctcacttgctctcttgttctctgtgcccctgagggtcgtcctgctgccatgctttaccttgctctgtgcccatttcttcatttgattcactttctgcaagtctggggctgaaagtcaagactgtgaactggtgtgggcctggggctgttgtcactcagggaaaagctgcgaaagaggcggaggagactgtgtgcacatcaccgatgacccctcgggatccagaggcctccagccagcctcaggtacccagcggccccattgtgctgagcctgccctactctgtatctccccgtatagatccgtggccagctgcagtcgcacggcgtgcaagcacgggaggttcggctgatgcggaacaaatcttcaggtgagcttttgttctagtgccctccccttcaagtggccagcctcagcctccgaatctccctcctgcctctgccttctcccccactccctccaccaccttcctgccacagctgggaatgggcagcgtggggggtgccctctcttctctcccactccccacactctcctcacagctccagccaaaagcctcttcaatggggctgtcggggcaggggtgcagctctgagctgagctgggtgctccctggggtcagggccagggccaggctcccaggcacctcctctctgggactctgagtatctgagatggtaaccccctcccatacactcccttccctctcctttcttctccttcctctgcccctcactttcccccacattttttggtaacagcctctgaccagaaagtagctctgacgtggtggtcccacatgtgtgtcccaagggggaagcaggggatggctcttatccaaggacacatcccaaggaacagccaggacttcctggcctcgcctgttccctccctccctccctcttgcaggctgcttggagctggcctgaggttagcagggtggtggtggggggagttgtctctacaggacctctgcccaggctccccaaggcaggcacagtggggcctcactctgcctgggcttctctctccatctctcagtctctcctccccacacctccatctctctctctctctctctctctctctctctctctctctctctctttctccctctctctctttctctctctctgccccccccaactatattattcattccatcctcctatgcatcctaacggttattcttttgaacattaagcatgcccccccaagcccctctcatccaagccctccccatgtatctgcctctaaaggacatgctatcctgaggcctcaaccctgaatccctttcccaagcctggaatcttggttgcatgtaggtcttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctctcttcccagttggtgtgtgtgtctctccccctaccgacctctggcctctgtttttctccctccaccttccctgccccacctggccatctaccttgccccccacgcccgctagtctttctctctctgattgcctctttctctttcttcctttttcctcttcccctttccctctctgccccccgtcctctcccctcgggtcccgcccccgggaacgccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagtgtcagggccgagtgggggtttctccccactgtccggcaagcgtcggtcagccgaacactgtgtgcctggtggtgtgtgttcacatgtgtgcgtgcgtgtgcccggcagagcagcaaacagctgcgcccgagagctgtggcgctttccctccctacctcccttcttccctccatccgctctccgacctccctccgttccctgtccctcatccatccagctgaagggctcgctcactctcttctcctatgctgaaacggtgcgtggggcactgctgcctggacctcactgtgctctgctttttcccgcagcactccctcaacatcctgggccagaaggtgtcgatgcactacagtgaccccaagcccaagatcaatgaggactggctgtgcaataaggtacaggggcggtgggcagcagttgtcatggacagagacagcaacagcagtggcggcgatctctcccttcctctcccgctctttctccctccatctctccccctcccccaatctctcctctccctctgtctctctctctctctctctctctctctctcattctctatcccttgctagctcagcttgagtagtcaccattcctagccagccatatacaaatgtgtagtgagcgttcacttggtgcaggctctgtcctcctaaaatgcagtcttgcctggagttccagtagactttaaggaaatatatacgtggatgatgaattagtgacagtgtagacttgaagtggtggtgtggagaatgtgggcttcagagccagactggctgaaatgagactatcccagatcggccttgattttggccaaggtgcttagcctctctttgcctcactttccccatctctaaaatgtgaatattaatgacacctctcccaaaaggtggttgggaggattcagctgtgttaatgagagagtaacactcagaacagtgcctggcccacatttaacacagtcgaattgttaactgtaatcatgaaagaaaagcacagagcrttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgttttaaaaaaaaaagtcccatcagaggattggtgcttaacatttctggagagataaagacaaagtgacagtggaactccttcctgtgtttccagatagcctcaaaaccagggaattctcttttttttttttttgagacaggatctggctctgtcgcccaggctggagtgcagcaatctgggctcactgcaacctctgtctccagcgctcaagccatcagcctccagagtagctgggaccacaggcgcatgccaccacacccactaatttttgcctttttatttttattttttttggtagagacagggtttcgtcatgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataagatcctccattacctaactggcttccttccccggccttggcttttgcttctccccttactctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagtcaggtgaggcccacctacctctcgtgctctccagggcggagcggttggggagaagggaagggtgaggggtctgtgctcagggcttggtatagggaggagggtgaccagtcgtggagccttccccttatcaccagcctgtctcccactgcccctgacagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacagtgagtcagttgttccttcttcctctgtgccctagggtgtcgggctgggctcaccaagaccagagaaatggcagtgagcaggacctcatcctcatggaatctccacttggtgcggggatagacatttgatgtagggagaacagggggagtggcaacatcccacctgactttgggggtgtgtcgggaaggttctcagcagacaggcagccaggctggcacctggaccgccaagcagagttgatcctggaggaagcagtgagggaagcggcagttgcaaaggcacggagtgagtgggggcagaggaaagggagcagtgggggcattgaagggcagggctggcaagagtgccaggggtgtcctctaacattgggccccttcccacagccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggtgagggcggcacagttgggggccgggcagccagggtcccggcccccggggtggagacgagggtccttttccccagcctcccaccgcggctgccagcctggaaatcgggcaatggagccgggggcctccccgggcctgacccttctgtccctgcctcccctcctcccacaggaggcagcccagctgctgcagatcctgcaggccctgcacccaccactcactatcgacggcaagaccatcaatgttgagtttgccaagggttctaagaggtcagggccccacctgtgtgccttcccacccttcccctccccaccctcccactcccccctaccgcttggggcctcctatctcactcccagtctctaacatcctcctcagggacatggcctccaatgaaggcagtcgcatcagtgctgcctctgtggccagcactgccattgctgcggcccagtgggccatctcacaggtactcagaccccttgtgcctcccagcgtcctgagacctgggctttctcaaccctcctgcaccctctctgaagcaggaaggctggcttgctatccatggatgcaaaaccctctcccagtagctggcatggctattctaccttgctcctggctctctagaccccctgggacattccccttcatcatcaccgcagctttcttcccaattgcctcccatgcgctcatgtacgacgccattgtgcctggcattctgtgctgtttggtggggtttttattgtcctgaataggtatgatatacacatatccttatatgtaatatatacatatatgatatacacgtatcatatgttcctgaataaaaataacgtataagtggttgagagaaaattgggagaagagaataaagaagtaagaagatggtgtcttccttggcctgacacccaacacacacgccacacacagcagaatcagcagaatcagccctggaacattttggcgttcatctgtttttctgtcttgtgtttgccactggcctatttgttctcttgtggccaggcaaccctcgctttccacttgtcttaaggctgcatgctttgtctgtcaggtagaaatactagccccacgtgtgggacagatgcttctagcaggttccccaccccccacccccacaccttcctgttctaatgaacccctcccacctgcccttcaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtgagccccagcatctctctctgcagctgtggtgggggccagcaggcataaagtccccggccccattattcacaggcattgtccctgccctgtccctccttacaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccaggtgagtgagccctgtgggtatgtatcccggggaggcaggcaggcggcaggggtggcatgggcagacactgagccctgttctcctgtctggccccatgaccagtcgtataccatcatgtcacccgctgtgctcaaatctgagctccagagccctacccatcctagttctgctctcccaccggctaccagccccactgcccaggaatcctacagccagtaccgtgagtagccacagcctgtgggtaggggtggggagttcttaataaagcagggaatagtgtgaccccgttcccctcaccccctagctgttcccgacgtctctacctaccagtacgatgagacctccggctactactatgacccccagaccggcctctactatgaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacaggtgaacaccagggtccagcagtcactggctggctgtgtggtgtcttccagcaacggcactctgtcagctcttgccctctcctgccaagggagatggcgggcaggtgtggatgtgggcagtgactgcttagcagaccatgctcttgccccagctctgctctttgctgaatggccttgagccagagcagtctcctcagtgtgtggcagggttgcccaactccaggaggtggcttgtgccatccgagtgagccctgtcaggtgtcttctgtcccatggtggggaccctcacattctgctggtgaatatacatgtatgccagagaaattctcacaggccataagggggtgggcaggaaaaaagccctgcaatgttttgtgggagtgggcagatggagggcacctcagtgtctctctgtggagaaagggtgtgacactgtgagcgtagcgtttacaagcaagcactaagtgttaccttagcaacctgatgaattctaaaaatggtgctgtgctggggggaacatggaaatatagaatgtggcattgtgtcatgcatataaagttatacacagataaacattcctatgcatttttaaatgataaaatggaaatgcacaacaaatgtgacagcgtgggtgtatgtcaggggaagaggagtgtcttcatccatttgctgctccataacaataccacagactgggtaatttataaggaaaagagattgatttggctcacagttctgtaggcagggaagcccagtggtgttggcatctggtgagggccttcttgccgcatcataacatggcaaagggcaagagagcatgcatgagagcaagagaaaattgggccaaactccccctttttatctggaacccactcagtgatggcattaaatggagactcaaaaggtggaggggggccgggagccgtggctcatgcctgtaatcccagcagtttgggaggctggggtgggcagatcacctgaggtcaggagtttgagaccagcctggccaacatggcgaaaccccgtctctactaaaaatacaaaaattagccaggcgtggtggcaggcgcctgtaatcccggctactcaggaagctgaggcaggagaatcacttgaacccaggaggcggaggttgcagtgagctgagatcgtgccattgcactccagcctgggcaacaagaacgagactccttctcaaaatatatatatattatatatatataaaggtggaggagatgggagggggtgaaggatgaaaaattacttaatgggtatgatgtacattatttggctgatggatgctctaagaaccctgacttcagcactatacaatctgtgcatgtaacaaaagcacttgtttattttatttatttatttattatttttttgagatggagtttcgctcttatcatccaggctggagtgcagtggtgcaatctcggatcactgcagcctccacctcctgggttcaagcaattctcctccctcagcctcccgagtagctgggattacaggcatccgccaccatgcccagctaatttttttgtaattttagtagagacgggttttcgccatgttggccaggctggtctcaaactcctgacctcaggtgatgtgtctgtctcggcctcccaaagtgctgggattataggcatgagctaccgcgcctggctacaaaagcacttgttaccccataaacttatacaatttctttaaaaagcagccgcgatctcttgaggagggcagagcctttgtgacctaatcacctctgaaaggccctgcctgtcaacactgttgcatcagggattaaatttatcttttgagatggagtttcactcttgttgcctgggctggagtgcaatggtgcaatctcagcacactgcagcctccgcctcccgggttcaaggaattctcctgcctcagccttccaagtagctgggattacaggcatccaccaccacgcccagctaattttgtatttttttagtagagctggggtttcactgtgttagccaggctggtctcaaactcctgacctcaagtgatccacccgccttggcctcccaaagtgctgggattacaggtgtgagccactgcactcagccgggataaaggctccacctgtgaacactgttgcattagggattacatttctgacacatgaactttgagggacaaaaaacatagcagagaacacagccagagaggggcttggcaagaagcactggtgactggtgacagaaaataggaacttgcactactgtgtccctcaccttctgattgttctgcctcagcttccactcatctgcctcccagatgggcccgccactctgtccacactgcttctgccacctcaccattgcaaaccagtgggggtgggggcacagggtgtgttcagtgatgaggtcaggagtagccaggtgccaagtgccttgcaggctgtggttgcgagtttgggtttattcttggtgtgatgggaggcgaaggaagggttttaaggacattgtatttgggggtgggagtggcttatacttcatgaaagagcgctctgctgggaaaggtggtcaggagccgtagcccagaggccagatgaagccttctgcagtggttcggactagggatagtggctggcccgtgtttgaggatgcagggcagtgggtcagcagatasagttagtagccccagggtcatgagggttctgggaacctcacctccaccctcacccccagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttcccyagcaaagaggcgctcatccggcaccagcagctctcagggctccacaaggtaacagcggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcagcaaatgaagtaccgggaccgtgcagctgaacgcagagaaaagtatggcatccccgagccgccagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcatgttggcctctcctctttctcgtgctctagcacagttgtatagcctatacagacacggggacccaagcagatggacaggggaccttatcaggccaaggtggatggcagtggtggcattcagtgtctggaacataatggctactagaacatggggttctgacctgtaccccgacccataatatcctggttatggcccctctcccttgttggttccagcaggttatgttgtaccaggaaatctagcaccaccaggcatgaagcgccccctgatcagagctaggactgggaacccccatcccctgtccttgctgccccctggctttacttagcctgcagtcccaaggctaaactgcattttgccatccctagatctggagacaatgccctcaggcatctccaagtagaatacaagaggtactcaggttccagttggcccagagccctcaacaggctgatgacagaggggtggaggtggagcttggcctgcaaatccaaggccaggtcccagggatgccctttgagaaccattcaggcctaccttctctgttgttaccacagtgccccacccctctagtcactgcaacccatgattcccaagtatgtgcttgtgctctcggcagaggttctgggtacagtggaccgtgacgctggggctgccctcttccaagcctcagagggccacagcgtgaaagggggatggtgctagaagaccagttggtgcaaagcccctcccccatttattaatatacattgtgacaccaccctgcaacagtcataggaggtggggttagaaggggacccctagaggtaggatggtgctgatctggggtggtgggtgttgcccaatgaaggaaggggatgggagaaaaaaagggtgaaggaaacaggattaaaaagaggcctcctgggcctgggcacagtgagttgcacctgtaagtaatcccagcaatttaggaggctgaggcaggcggatcacttgagctcaggagttcaagaccagcctggataacatagccaggccctgtctctacaaaaataaataaataaataaaattaggctgggcgcagtgattcgcgcctgtaatcccagcattctgggaggccgaggcagatggatcactggagctcaggagtttgaaaccagcctgggcaacaaggtgaaaccccgtctctacaaaaaaaaaagtacaaaaattagccagctgtagtggcacacacctgtaatcccagctactcaggaagctgtagtgggaggattgcttgagcccgggaggtggaggttgcagcgagccgagatcacgcccctgcacccaagtctgggggacaagagtgaaaccctttcttgaaaaaaagaggctgccctagtctcaggatgggtgtgtcttttagcagagacgcctccacattcccttccctcttcccaccccagagcactgctcccaaaatcccacaaggaaccctcaaagctcaactggcaggagtgcaaaatgatacagccactctggaaaactggctgcttcctataaagttaacatatgcttaacctatggcccagcaattctactcttagatatttagctccaaatacatgaaaacatgtcaacaaaagacttgcatacatatatttgtagcagctgtattcctaatagccaaaaactgggaacaacccaaatgtccaactagaggagaatggatacagtgtggtatattcaaaggatggactacagctcagcaatcaaaaggaacacaatgctgatacagatatcaaaggatgagtctcacatggtgagattgttcacatggtgaaagaagccagacacaaaaaacacataatgtttcattccatttatatgaagttctaaggcaggcagaacaattttatggtgatagtagaagagggttgaggtgaggagggtgtcactggaaagggttgcaaggtagctttctggaatcatgaaaagtttctatgtcttgattggggtgctggtcacatgggtgtatacctatttaaaagtccaacaagctgtataactaaaatctgagtgttttattgtatgtaaattatacaagaagttggaaaatcaccaccacagcaaacctcaataaataagaaggaaataatgaacagaaattgatgatatagagaacaaaaaatgacagattaatagaaaccaaaagcagaatctgaaaacaaaaattaagaggaaacacttttggcaagactggtcaattgaagaagatagaagatgcaaatgcaacagagcttttaaaaataaagaatgtatctgaaaatctagatgaaatgaatatattcctagagaaatatcaaatgccaaaactgttccatggagaaactgattactcaaatggagcaattagtaatatagaaattgaaatggttgtcaagatcttccctttccccacaaaaaaaaaaaaagggcccagatgatgtgtgtatgtgtgtgttcctttctttctttctttttttttttttagatggagtcttactctgtcacccaggctggagtgcagtggtgcgatctcagtttaccgcaacctccaccttctgggttcaagcaattctcttgcctcagcctcctgagtagctgggattacaggtgtgcaccaccacacccagggaatattttgtattcttagtagagatggggtttcgctatgttggccagctggtcttgaactcctgacctcaggtgatccaccctccttggcctcccaaagtgctgtgattacaggcatgagccacctcgcctggcccagatggtttttataagagcattctaccaaactcccaaggattcctttcttattaaagttaattcctttcttattaaagttgttctagatattagaaaaaagaaaagatgtctattttaacaggctagtgttagctgaagctgcgaaggaagaggcactctcatacatcgctggaggcaatgcaaaatagtacaaccctctcttccaccctccctctccctctcctttgtctattttcctgcctccacagggctcactgtgggaccacagatgcaccccactatgcccagctaattctttgattttttgtggagaccaggtggtggtggtggggtgtgtgtgtgtgtatgttggggcgtgggggggtctcactttgttgcccaggctggtcttgaactcctgggctcaagcaatcatcctgcctcagcctgccaaagtgatgggattataggcgtgagccgccgcgcccggccaagactccatttattaaaaggctaaagaattttgccaggcgcggcggctcgcgcctatagtcccagcactttgggaggccgagcgggcggtatcgcctgagctcaggagctctagtccagtctggctaacgtggcgaaatcccgtctccactatggtaacatgtaaacatagaaaagataacagtaaaattttttctgtgttataggaccgttgaccaaaatgttatgcagcacatgattgtatatccataatttatattactgtatatagtcacagatatctattataatacgggtttgtatgtgaaactataattttacttattgttatgtttatggtctgtgtatcttgctagaatgtcagctccatgagcccaaggaagaatttccagcacctggcccatgtcaaatgaacttttttggccacctgagtctcggtctccccatctgtaggatgggtgtgcctttccatgtggaggcacccacacgttccgtttcctcttcccaccctacagagcacggctccggcaattccacagctcaggcttacattttcccatattctggacgctggtgcccaccacgtgcaccaggcactggccagacagaactaccacccccagcatgccgcgcgcatttgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacagggggtgagctggagcaccgtgcccccaagcctctggacagcatttggaggagggtgcttccctaatcccaacttcggggaaacccctcatgggcgtatttggagcctccgggcccggggtgatatttagggggcgtctgcttttgagacccttaaggggtgccgtttggggacttcggggtgggatttgggagtctgtttcggggagcacccctcggaggcagggtttggggggctttggggagattcttagggtccgtgtatgggcacccttgtccgtggagcaggatttgggttattcttcaaggggagaagcaaagcttgaggttactaaagtcaaggcgggactgggggagggcttgtttcaggacggggtcctggtgacagaacaatcgggaccgacgtggcattgtggaggtgtcaggcctttgtgacctctggttttgtgatgaggtcctccccgcgcctggaggctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaagggacgtgctgaaggggcgttctgaagtctgccgcgcaaacgagttcattgatgattcgcaaaagttaagtagcaccctgagttttcagtggcttttctaggggttccgtgcttaattcatgaggagcgtggcttttgcagctttgtctgcgtgatccgcggttagctttcccttgcaggtaccagagttaaaacctggcgtctagcaaagggatgaggcctcctacattgttcatttcttatggcctggtaatcccagataatcagccggctctggattcaaatcccatcgatcctttccagttgtgtgatctttggcaaatcgttttgtaagcctgaataatgggtatgaggataacgataagattagcttacactcgtttagctacttagcgcatttaatcttcacgacaatcctaggaggtaggtcattattacccccactttatagataaggaaactgggacacaggaaggctaagtaatttgcctaaggtcacacaatcagtgagtggctgggccgggattcaaattggggtctagttccgcaatctgtagtcttaaccagatgccataatgtctcccctccccattcccctgcgccgccatttgatagtactactactactaatataacacttagcatgtgccaggcactggtctaagccctttctacttatttcttcatttaaactccatcgcaaggtaagttgctgttattcctattttatggatggggaagcagtggcccaagttgggggtttctctagtggctgagtattcataactaattttatattaatgtaaatatatatttacatatcttaacatattacttttatattaatatataatattttaaaaatttaacagtgccttgtgccagcaatgttctaaggctcatcccataatttatattctctgattttcttttgtttgagacggagtttctctcttgtcgcccaagctggagtgcaatggcgcgatctcggctgactgcaacctctgcttcccgagttcaagcgattctcctgcctcagcctccccagtagctgggattacaggcgcccgccaacatgcccagctaatttttgtatttttagtagagacagggtttcaccatcttggccaggctggtctccaa

SEQ ID NO: 10809 - DNA, 290892 bp, Homo sapiens
  misc_feature (1)...(290892): n = A,T,C or G, or insertion/deletion polymorphism (see Tables 1-2)
actcttaataccggactaagtataaatgtgcatcatgtaatattcaagaatcatgtgagtatcacagagctttagaactgcaatgagccttggacagagatcacctagccccaaaactgagagagacagtagattaacagttattcattaattcaagaagtatttattaagcacctgcatccccacactgttctagaagctacagattcagtgctaacaacacaaagttcttcattttcagaaaacatatattcgagtagacaaacaacaaataaatggatatatgatctgctaggggaagggacagaaaaaggaggccactttacgcagggcattcaaggaaggcctcacggaggcaacatttaaccagagacctgaggaactgagagatcaagccatatggaatctaggagaaaagtgttccaggtagagggatgcaaaggttctaagcgggaaatgtgcctgatgcatgtgagaaaatgaaagaggccagaatagctggagtagagtgagcaaaaggagggggagaggaggtgaggccagagagggagcagggccagatcatctggctttgggccactccaagaactctgaatttcagccaaagattcaagataatcaattcctaaaaataagtaaataaaaaacgaagtttagcttccacaaaagaatgtattatcaagaacaaaatctcatctgcatgcctaatctgaaaatagagttcccagcaattcaggatcattattaccttatttagaatcaaagtgtccttattctacaagaaatctctgcagttatctaatcgaagctttcagttttactaatgtggaaactgaggcccagagaaatcacatgagcagcccacttactggcagacctgcggctagaacatgggttcctgctttcctgtgcggtgctcttcagtagcccctgctgcctctgcacagcagttcggtgcttacgggtttcttgcttacctgtgtggtagccccccctggctcctgtaacctttataagtcagtaagagaatagaagagctgccactatgaggcatctctaggcctatcctcaccccagaacctgtcattataaactcctgcattttctagtttctcattccccacagagttgaagacagccaggcaggcaaggtgaaggcacatcaggcactgtcccaggcactgtgagggatgtttttgttgcttttgcttgcccaacattccttactccctattcccagacagggcactgccttttccatgattctggtgggggctacatagcatccaagccacctattaaccacagattgaggtggacatagacctgaccaattaaagaaacattcctctggctataatgactactgtaagagagagcagaggatcaagcagaaccaactagatttccttcctgggctttatggataagagctagagaaagaagctctatccctgaattttccagttatatgagctaaggtattcccactttgttcaggttaatttacattaggttactattacttgcaaacaaaagaactcggactcatgtaggcacctgcataccttttcttatttcacctaacaactttataaggttgctattactcactctattttagccataaggtaactgaaattaagtggcttccccaagttcatataacagataagacacattcaaatccaagtctttctgccccaggttccattcagtatgcagtattcagaattaactcaagaagaagaaactcactgccattcagaaaccaaacaaattctggtttaaaaattacaggagaatgtagtgggcagagggagagcagcattaaaccaggtcaaaggacctggcttctacttatggctctgtgctatgacctcaactgctacgactttgggcaagtaatttcatttatttgggtgttagttttcttatctattaacaaaatgaacacaaggtccttttgagtgaaaaaaaaaaaaaccacaaacaaacaaacatgggtctgctttaagcatacagattctactgttactatatgtcaagtagatttcaacttgaatgtcaagcctaataacaggtaacggctcctggggtacaatgttgcaaaggattctgagctatagggatccactaagaaattagcactggcttccatgatcacaaggaagaaaagaaagtaaaagctgcatacctgccacacatctgccatcactgaaagagtttcaccttggcaaagaaatgttaccatcttttacgaatgcagacagtacttctgcaccaccgctgattcatcagtacctgctcaggattttcactcattcctcacgcacttaactaaattaaggaatgaaagtgcaagaaaactaagtggtttggaaaatacagcttggtgccactaaagaaaatatgtctaaatggcctacatgaggaggggggaggtagtttgggggaacaataataatcagtctgtttttttaaaatacatacatatagactatgtgagtagggtaactcagaagctaccctacttagcttgtgagttaagtagggtattatcacgtccactttatagaaatggaaaacgagagtcagacttgcccaagttcacccatttctaagtagcagaagcgagatttgaacccaaggcccaggtctctttccaatcccatcatcctcactagtcccacacttcaaatgagttaactaatcaaattcccattgcagagtgacatattcattattatttggagttgttcgaataatataagttcctcccccaaataatttgaaaagtcgttactctccatttgtaatttaatgggtagacatgcatttgagtatatataaatttagtaaaattgagcataaaagttaaatgtttaaaagaatgatgcagaagcaatcagcctgttgttggaaggtagggactgcaataaaattgcagtttcaatgcaattttattcaacttaatataacctctacaacaattcagtgagatggaaatctggcatcaggcatatatttgaggaatggaatggaagaatagaaattgaaccagataaaacgcatcctagaagtaacagcaaatgcttcaaggaaggcacttaccaaaaggcatactataacttattacatttcattaagtctgacaaccagggctaaacctgaattagaatatgtgcttctggtatttaccagacttttctctataaggaatccaggccaaacaaaataacagccaaacttttgacatctaattgtagtaaaagcacaggacatccatcactagctcttctagttaaacttcccacaagagaagatggggagtggggaacggttgcaagaacaggagataatacacaaagcaatgacaacataaaatcaaaattgcttaaaagaatgtatgtttcctctacgtcagggggacagtgtccctgaacaacacagcccatgaactcacttaaggtgatgtgacacctactcacatcaatacatagcagaactgcaagttgcattgtcatgcggtccaaccctgtgacatatgcacaaagcttttctcaaacatctctgaaaagcagtcatcactctgtttaatcacttccagtgacagggaactcagcaccctatgggactgttactgtccctgaggcccattaactcaaaactcaaacacattttcaccactcagggagaggtggaagtgatcacagggctctccaaagggcttgccaacccaactgtgcctcctgtctctaccattcccaaatcccccctttccctgagcaggactcaaaattagcacagtgttaataaatcagtggtttcagagttagaagggacccttaaaaagccaatactgtgatattcataccacagttctacaaaaagaatctcaagaagtgcttgggccaaactgggagggagagtgtcctgtttctcttcctcttatttcaacctaggaagctcccactttaatttgttacatatagaggaccaaggtagttttttaaaaggaggaggagaaaaaaaggaccatttacaggtaaataaactgaggtcttaaaacttgcttaatgaaatcatatagctaatagttgcagggttcagacaacaacctcgtctcttggctccttctctggtgctttctctaccagataacatctgaccatctacagggcaaaattcaaactctgcaatgatacacaaagccctttaagatctccgcgtccaatttttatgagagtcccacattccagtctcactcaaatgtttattgaaccaacttatgtcagactgttacctacctccacagcttagcgcatactattctcttagcctgagatgtccttctgcactggaaccaactaatcctctttcaagatttgttttaggcatcatcgcctctataaagccttttctggtcctcaggtagaactgaccacattctttttgtgccctacacaacacctgcaaggctttatggcacttgttttatgtctatgtccgtctactccaccactgcttttacatcatattactctaacacgaggctggtcagaaggtaggtgcttcatagacggtcatcaatagggcgagtgtattcatctggtccaatcccctttctaatgtttaagtatcctctgctaactgtcattaatgcatgcatgactacattcattcaaaaatatctgagtgtctatacagtgccaagtgtatgccaagcagagaaggatttactgtgaaattaatgaggcttaagctttagggtccctctcttcaatcttccaaagctctgaatctttcttggtgatttttatttcttgaagagggcagacagaactatataagctgtaggccccacaaaacctagatacctccttggtgtcacgaacacaaaagggaacaagacaaacagctctccccttatggagttttctgtttaatgggaaagacagccatttgttcattcactcattcaacaaacatttactaagcaatgctatgagtcatgcattctgagatgaaaacaacactgtccctgcccttaaggaaaaggttcctgttcccagggagatgaagggacacctgctctgatcagggaacagaaagtagttgaggtgactgtaacactgtgtttgcgaaagattaccctaaacccgtctcaagaggaactgagtcctacttattgcagagacaaagggaagaaagagttcggctgaatacagtttttaatctcaactaggggtgggaggcagacaagtaaatagaacaggcaaatatggtgtggtcagtgctgcaacaggaagcgaaggactgtcaggaggtttcccctgagtgcaagtctgtagtgacggcgaactcatgacctcacaaagccgcccatgcactttccagatagagatttctgaggatctcctttcttgtcccccaatccctgtcgccgcaggagaaatctgttccccaatatgcgtcccccttcctcaaaataaggctgttccttcccccaaaaagctgtagggtctctgaggccaactcttctgtcccccttagagccacccccttcacacaatgcttacgggacggggtctggtttggggcccggggtccctgtcgcaggactgccccctcctcaacccgccgtttccatagcaaccagctcaccacttcgcgggcccggctggagaagtcgcccttgggccgggggctccggcggaacagctcgtcccggctgccatcgaccccgccgcccaccgccactcccagcgccttgttccgcgtcttcacggtcttgacgctggcccggaatagcagcgtgatgtccaccgccatagcgacccgcaccctcagccccacactaggcccgcccacgtaagcagccggcgaccgcggcgcgaacccggccgctgaaggactggtcctgccccacacgcctccccccggcaacggcgacgcgagaagaaaggttccggcctgcgccctgctaccgcggcgggaggaaaaaggttccggcctcagccggcgcacctggcggaggaggaacctcgcgacgcgctstcgggcatcggtttctcccwgcaaagcttggagggtttagctgcgcggagagctcagcgagctcttctgtgtctgtttggggcgtgtgggctccgggagcgtgaggaccgggaagctaggaggctccttcccttctggcggctccctcmctgagacygggcggtttggttgcgrgggaagtggagacgagccacccttgacctttgactgcaagaactcaccttgagcaggatagaggcacgtggacggtgaccctcgggatgcaataaatgctgagacagatcaggtgtgcaaggcacagagctagaggccagaggcctttcttctccaaccttcagtcacctctttttaaagtgaagccagcatcctcctcggggtttactgtgaaaattaagtgagctgacgcgtgctgtgttttgatgttgcttggctcctagtaagtggccaataaatggtagtaatcgttaataatgttattattataatcactgttatttgtggtaaaggaagaggctttagagaaaaggcgtcacctgtgcagagatttgaaggatgaataggaagtttagatggagacaaaggtraaagagtggccctaatgccgctggattctcttcatccttcatgcatagtttttaattgtaccgtcttgagccatagctattaaaattgacaactcaatcaatgagtttcttctgcattttaggttcatgttctgttttgtgttgttttttgagacgggggtctactatgttkcccaggctggattgcagtggctagtcagaggcgccatcctagctcactacagctggaacgccagggctcaaacgatcctcccggactcagcctcctgagtagctgggactataggcacgtgcaaccgtgcctggcctatggttcagttttaattcaaaatctcattgatttcttcaagatttcttttttcataaagaggaagcacaagtagaatatgtattaaaacagcagttttaatggtcatcaagataaaattttcacaatactaagatgttatttgccttttcgctctgattttcttatgagttgcatacagttgagtttgctggagactgtgatattgcaacggagtaaatgcagaacagctgttttctattaagccagactccaaaaaaagactttcaaaaacatcaagtttttgttttgatttctcatatagtaaatgtcgataatgtcaatataaaccaaaattgtttagagcccttaataatttttaagtgtgcaaaagagttgagaccaaaagtttgagaaccactgtgttaaaaaaataaagtttatcagaaatagatgtcaagaaagtatatatttaccagaaaggaggaaggaaaagattttttttttctttgaggcggagtcttgctctgtcgcccaggctggagcaagctccgcctcccgggttcacgccattctcctgcctcagtctcccgagtagctgggactacaggcgcccaccgccacgcctggctaattcttttgtatttttagtagagatggggtttcaccgtgttagccaggatggtctcgatctcctgacctcgtgatccgcctgcctcagcctccsaaaatgctgggattacaggcgtgagccaccgcgcccggccaggaaaagattatttaaacccaaactgtagccacttcttgcagtttaaggaaaataaatttccatacagctttcttccacctactgaggaaaagagaaagaaattacaaaatctctgccaatgattctatcttgcataaatggccctttgtttaatccagacattaatcagtttttggccatgcaaagttaagcctggggtagagtagaaggaaagagagattgccctgcataataaagtgagggggattgaattggggggaagaaaagagaagccagaacccagggagggggccgggaaagtacaaagtaggtaactgggaaggatctttgagtgggagggaggctgaactacaccaagccttcagtgagtggtgccttgtgtaaaccgtgtgtttggtgcagttggatattttgggtagaagggtagggacaaagatctaagttttctgtctggatttgcaagagcagagaagattgtggtggatataagacccaagtgagctcaaaacatcaggctgtaaatccacaagtgaccacaagtacataaaattcctaaataagtcacaaagatcttgaggaggctgctgaactttccacagaccatgggatatggggttgtgctttttacattttgtgtttactctttaatttaaaagagcaaagtgacttcagttgacagttgactaatattaagccccataaagctgagaggggatgtgggttaaaaggatgtgcagaaatgttgtgagagtatactactgcaactccagggctcaaacaatcctcccggctcagcctcctgagtatctgggactataggcgcgtgccaccatgcctggcctgttggaggtagcacacaactgcccagttggatgtagtatacaaattttgttttctttatgcattcagcaaacattgagtgggccagacactgttctgaaaaatacgcagtcgacttttgaacagcacaggcttgaactgcatgcggccactaatactcggacttccttctgcctctgccayccctaagacagcaagacccacccctcctgctcctcagcctactcgatgtgatgatggtgagtatgaagacctttactttatgatgatccacttccatttaatggatagtaaatatattttctcttcctatgattttcttaataccattttcttttctctagcttactttattgaaagaatacagtatctaatacatatgacatgcaaaatatgtgttaacggactgtttatgttattgataaggattctggtcaacagtaggctattattagttaagatgttagggagtcagaagttatacacaaatttccaactgtgaggggtggaggagtcatcaaggatcarctgtattggcacccctaaatatagctcactacagcagcaacacctatgcaaggagactagatgtaggctgccagtgaaaaccaacgtgtaatttctgggcagcaaatttaagagctaatgtatgattcacgatgctcttttccctctgctatgacaacccttaatgttccaatgttccatcagcctgagtccttaagtaaagatgacatggagcatagccaaccaaggacattgtattagtcagagttctctagaggracagaactaataggataggtgtatatataaaggggagcttattaaggagtattgactcacatgatcacaaggtgaggtcccacaataggccatctgcaagctgaggagcaaggagagacagtccaagtcccaaagctgaagaacttggagtctgatgttccagggcaggaagcatccagcacgggagaaagatgtaggccagaagactaagccagtctagtctttccatgttcttctgcctgcttttcttctggccatgctggcagctgattagattgtacccacctagattgagagtgggtctgcctttcccagttcactgactcaaacgttaatctcctttggcaacaccctcacagacacacccaggaacaatactttgcatccttcagtcaagttgacactcaatattaaccatcacagacatgtactaagattgagaattgtccacagatttgtgggtgtttgttaactgcagcataattagcctgtcctgattgatgacaacccatatctaggtatctaccaaaacaggaatattagatgtattctccactcaccatcgtaacagtattattcctcagtgaatgaagcatggagaggaaagaacagttgtgcctaaacctaaccaatggaaaagaccaggctggcagggacagagtggcagaaaccttggaagactgtgaccatggcagggtagaatttataacacaagaggaaaggccttcaaaaacatataccttcacgttaggaggtaaactcaatgaaattcattgaaaaccatttttcccccctcagggactctggaaaggaccctgactctaggggtgggaagctcaaagaagaagcttttgttcccaagagggaacctagataaagaattcagggtggatttctcttgtttttttttttcttttttttttctttctttctttttttttatttttttatttttgagatggagttttgctcttgttgcccaggctagagtgcaatggcgtgatctcagctcactgcaacctccaccttctgggttcaagcaattctccttcttcagcctcccaagtagctaggattacagacgtcctccaccatgcccagctaattttttggggggtgtgtatttttagtagagatggggtttcaccgtgttggccaggctggcctcgaactcctgacctcaggtgatccacccacctcggcctcccaaagtgctggaattacaggcatgagccactgaactcggcccaaggtgggtttcttccggcagctcccccagaagtttagctttgaaacagatgtgcaaaaaaaagcgagggaaaggcaggaagcaaacaggaggttgttgtggtccagccctttgaggtgtggcctttgtccccccaccgcccattgaagtaatatggtttggctgtgactccacccaaatctcatctcaaattgtgatcagaattgtatccccatgtgtcaggagagggacctggtgggaggtgattggatcatgggggcagtttcctccatgctgttctcatgatagtgagtgagttctcatgaaatttgatggtttcataaggggctcttcccccttcactctctctttcctgctgctgtgtgaagaaggttcctgcttcccctttgccttctgccatgattataagtttcctgaggcctcctcagccatgcagaactgtgagtcaattaagcctctttcctttataaattacccagtctcgggtagtatttttatagcagtgtgaaaatggactcatacacagagagtacctaaaggaggggctgccaccacctcattcctacctgattcttgttctagatcctgagcccgttgcyctagcctactggcttgtttcatcctactttgtgtctcctcccaccctgtaatgagccaaatgttggccccccaaaagatatgtccacatcctgatccctagaacccatgaatctgaccttactaggaaaagaagtctttccagatagagttaaattaaagaccttgaaatgaagaaatgattttggattatcctggtgacccctaaatccaatagcaaatatctttaaaagaggcacacagaatggaaggccatgtgaagacagaggcagatactggagagatacagccacaggcccatgaatgctgatggccaccagaaaccagaggaagcaaggaagtattctcccctagagtctctgaagggagcgtggccctgccagcatcttgattttggacttttgtcctccaggactgtaagaaacaaatttctgttaaatcacaaagcttgtggtcatttgttactgcaaccataggaaattaacgtgtaccctaactcttttccctgcccatccttcctccattacctatcctctacttcctgggtgtggccctcagcccctgtttgggttctcagctctgcaggtaagccgccttcagcttcactgggtctgtacctttcttgtggttgataagtcctgcggctgcctagcctggtgctcttctttccttccccatctcttctttgatctccccttggagagtcacaactgaccaggccccctgtcccacaaggaaaactagaggccagaatgaactggatctagccaaaaagcacaccaaagtgggctcttttcatcaaatgtgcagcagaaagggtgtccatgcaacagatatttcactctccctgtgtgactcagagaaggcagacatactcaactcttgtttccaacttctctatttaggagctattcgaatgcaaaagataggagagagcttgtgtgacagttctggcagtggctgtggcatctggagtgtctgcacccaaagagttgcccttctcagtctagaaagaccattctgccagacgcggtggctcacgcctgtaatcccagcactttgggaggccaaggcgggtggatcaccagaggtcaggcattcaagaccagtctggccaacatcgcgagatcccgtctctactaaaaatacaaaaattagcgggcaggcatggtgatgcacgcctgtagtcccagctactcaggaggctgagccatgtcacttgaacctgggaagcagaggttgcagttgagccgagatcatgctactgcactccatcctgggtgacacgcaagactctgtctcaaaaatgaataaaagaaagcccattctattatgagcagttcaagtaagtgcagagagaggaaggggacagttgcccacatagccaagtcagtcccagggatagtgaacaataagttgcctccagaacttcaagattaggagccactggataatgagagtcagcacagggacaaaacagatgtcaaggattcttcttttgtcatcctgagtccatgtgactaaatttcaagagggcaggttagaaaaagcaaagttgatggggcattacctgtggtttgaacttctacctgtcatatttcaggmaatcaccatgaggagcttgacttaggaaattaaggaagacgtgtccttttgttgattttcacatgggaagacaagggtgtgtgtgtgtgtgtgtgtgtgtgtgtgtgtgtgtgtgtgtgtgtgtgtgtgtggtgagacacaagggttgaaaactaactggttctcagtttgtggtgtttcctgccatcagcaatggccttggggatgactcccactcctcccttctagcccccaagaagactacaattgtctcttgctccaagttagtcttcaggaatacaaagcccagcaagtgcaggggggctcagtgtgatgtgcacacagtgtggcacagcccaagagtccggctttggaggcagygatctctcagaactaagaccaccctgaattaagaccaccctgtcagcatccccttactctgaccatgcagcatggtctttgggctccacaaatatccttgaagccaagagtcacaatttgggtgggaatcgcaagcccagccagcaggcaaagatggaggccagagggcagctgagcatccattgtcactggtgtccactcccagagctacttggaggtgggcactagcgaacaaaagccctcagaagagagaaggggacaccactgccctggtagcccccatcctgtctttggcctgtaggcctctgcacactgtaagcctagaccagcctcaactatatcacacattgacttttttcctctctggacaatggtagcctggagtattgtaatacccatggaatttttatagggtacctaagggatatttatcagatctctgagttctttccagaagtccaggaagtagttaacagaggatgactaataggaaacaaaaacacaacaccactacaacctgagattcagaaatggaaagacttgggtttgaattcagctaccctactcactagctgtgtgactctgggcaagttacttcacctctctgagcctctgtctgaaaaatgcagacaaaccctattaaccgctcctgatttctgtgagtagggatttctttttcacacctctccaatggaagcagccttagtcatctggttttggggcaacatcggccagtctgcatttttcagttggttgaagcgatctaccagttggggacgtttgctcttttgccttcaccctttaacctgagccagtgggacgcagtgacctggctgaggactgtgttctgcagactcatacattacctcagagggaagctaaraaccagaacgctgccagaactgtctctttcttcctctctcttcctcatcgtcattatcatctcctcaagtcagttttctctgcttctctgttcctacggctgaacaccagccccactcaaatcctacatttattaatatatgagatacccgttgatatggtttggctgtgtcctcattcagatctcaacttsaattgtatctcccagaattcccacatgttgtgggatggacctaggaggaggtaattgaatcayaggggctggtctttcctgtgctattctcatgatagtgaataagtctcatgagatctaatgggtttatcaggggtttccacttttgcttcttcctcattttctcttgctgctgccatgtaagaagtccttttcacctcccrccatgattctgaggcctccccagccatgtggaactgtaagtccaattaaacctctttttcttcccagtcttgggtatgtctttatcarcagcatgaaaacagactaatacagtaaattgggatcagtagagtggggcattgctgaaaagatacccgaaaatttggaagtgactttggaactgggtaacaggcagagattggaacagtttgaagggctcagaagaagacaggaaaatttgggtaagtttggaactccctagagatttgttgaatggctttgcccaaaatgctgatagtgatatggacaataaaatccaggctgaggtggcctcagatggagatgagaaactcattgggaatttaagcaaagttgattcttgctatgtcttagcaaagagactggtggtattttgtcactgccctgaagatttgtggaactttggacttgagagagatgatttaggtatctggtggaagaaatttctaagcagcaaagcattcawgatgtgacttgggtgctgttaaaggcattcagttttataagggaagcagagcataaaactttagaaaatttgcagcctgactatgcaatagaaaagaaaacccattttctggggagaaattcaagctggctgcagaaatttgcataagtagtgagaagccyaatgtkaatccccaagaccatggggaaaatgtctccaggccatgtcagagaccttcatggcagcccctcccatcacaggcctagaggcccaagaggaaaaagtggttttgtgggctggacccaggatccccatgctttgtgcagcttaagggcttggtagcctgcaccccagcctctccagccatggctgaaagggaccaacatatagctcaggctgtggcttcagagggtcaaagccccaagccttggcagcttccacgtggtgttgagcctgcgggtgcacagaagtcaagaactgaggtttgggaacctccacctagatttcagaagatgtatggaaatttctgaatgcccaggcaaaagttttctgcaggatggcarccctcatggagaacctctgctatggcagtgcagaagggaaatgtggrgttggcgtccccacacagagtccctattggggcactgcctagtggagctgtgagaatagggccactgttctccagctcccagaatgattgatccaccaacagcttgcaccaggcacctggaaaagccacagacactcaatgccagcgaagagaaagcagctgcaaagccacaggggcagagctgcctaagactgtgggaacccacctcttgcattggtgtgacytggatgtgagacctggagtcaaaggacatcattttagagctttaaaatttgactgtccgctggatttccgayttgtatgggccctgtaacccctttgttttggccaatttctcccatttggaatggctgtatttaccaaatacttgtatccccattgtattcaggaagtaacyagcttgtttttgattttacaggctcataggtggaagggacttgccttgtcttagatgagactttggactgtggacttttgtgttaatgctgaaatgagttaaggctttgaggaactgttgggaaggcatgattggttttgaaatgtgagaacatgagatttggaggggccagggacagaatgatgtggtttggctatgtccccattcaaatctcaacttgtatctcccaaaattcccacgtgttgtgtgagggacctaagaggacgtgattgaatcatggrgccggtctttcccatgctattctcatgatagtgaataagtctcacgagatctgatgggtttatcaggggtttccacttttgcttcttcctcattttctcttgctgccaccatgtaagaagtgccttttgcctcccgccatgattctgaggcctccccaaccatgtggaactgtaagtccaattaaacctctttctcttcctagtctcgggtatttctttatcagcagcatgaaaatgcactaatacacccccagtcacagaaagggtctaacttgatgtatcagtcccaagtcccaagctggcccagtttcagacagaccttcccctggtccagtcagctaggctttagcatctgagtcatatgggaccaacgtgactgtcaggatacatacactctctggctggggatttgtggggaggggatatgttaatattctattgctgctataacaaatgatcacattttggcttaaccaatttgaatttgttatcctacagttatagaggtcaacagtctaatgtgggtttcactgggctaaaatcaaggagctggcacggctgtgttccattctggagactctgggggagaatccatttatttgccttccccagctcctagatgctgcccacgttctttggttcacggccccaccctctttctcygaagccaggtatgatgggtggagatcttctcacatcgcatcactctgacactgactgtcctgcctccctcttccacatttaaggacccctgtcatgacattgggcccacccagatagtccaagataagccccctatctgaaggctagctgatcaacatcacaaattccatctgcaacctcagtgccccttgccaagtgacatacatattcacacattcagcaattaggacttggacatttttggggggctgttattcagtctaccacaatgaggtagctccagtaaaaagatggggtgattatgagctgggcagacaccccttttgtgtcttcctggaagacagagagatccacctactcttttccatttctcaaacaatgtttgtaggcctgctctggtaatactccargggtctacagaaattaagaaaacagaaccttttccctttgaggatttaacctagtaggagacacaccaatatccaaacacaaagcaatgttcttctgaaatcttctagtcctttctacctcttttaaggtacttatcccactctgctcaccccattttagaggcgtcaactcacaacaatgtgatcaacagtcaccaaagttcaagtcctctctctcccctccttctsctggcctccaggttgagaagtttggtgcaacttcttcccagggctgacttcgtccaccccaggagtttcatagagcacctcataaaaacccatttactggtttccccaacataatggcagaaataaactacttgatacacacttggaaatcccttccagagaacatgtgcattgttttgttggcatggcatcttggtttctaacttgaatttccaccgcctttgcttttttgacagtatcttccatgattaagatggccgaatcctccactttttattgagttggacagcaaatcacagaataaatgctttcccttgcactttaaaaggatttaataggaaaatatttttcctacatcctgtttcaaggggaaaatgtgattttaaggggcattttatagttcacaacaggatattgaagggcatttggttttgcttagtttattatgactgtgtttctccagcatgaagtagtgttttttgtgattatttagataagtgtgattatggtagataggcagctatcgaattatggaaatttaggactggaaagggccttaaatatcatccaggccaaacttcctcatttttcagatgagaaaacaaatgacttgtccaagttcacatgttgagttgcaggggaaaatgagattagaatctttatcttccaactgtttaatgtcccccaaacagttttgtgatgagagtaggagtaaggagagtagcatttattcaaggagatccctatgtatctgtaagcagttctgaatatgagaattggagtaactgatatgtgtggatttgtgtgtatttcattcattcattcatccattaagctagccagtcagtgagtcatattctaaacatattcccagtgtctactcagtaggtggcacgtgctaggtgctgaaaatataaaaacaaagctgaagtccccgccttggagcaagtcaaggagtaatggacagacaagtgtgtacagacataattataattaaacataaatgtgataatggagtttgttgttttttcatggcagcttcaaaccatgaaattaaaaagctactctgcagggacaggaaatgatcagcactccagaaatagagttggagagatgctttccttatggtccatttctggccatttcattatctctgtcttgatgggactctatggagcaggaaccacctcttagcctggcattgtggcaagagcctcagttctctgtcagacaagcttgggttcaaatcccagtcacttattaataatgagttctttcaaggttatttcctcatctatgaataaaagataaaaacgcatccatcaggttgttgtacatgtatattagtctgttctcatgctgctgataaagatatacccaaggctgtgtaatgtataaaggaaaaaaaaagagctttaatggactcacagttccacgtggctgggaaggcctcacaatcatggcaggaggtgaaaggcacatcttacatggtgacagacaaggagagaatgagagctaagcgaaaggggtttccacttataaaaccatcagatctcatgagactaattcactaccatgagaacagtatgggggaaaccgcccccatgattcaactatctcccaccagtccctcccacaactcgtgggaattatgggagctgcaattcaagatgagatttgggtggggacacagccamaccatgtcaatgtgttaaatgagatgatccatataaagtgtgtagcacagcatctggtgtagttagtcataaaaaaacccagccatcatggcaatggggatgttgaggatgaaaccagacagaagaaacttcagactggcaatgccaaggtagctggaggtggtgagaagtcttctttagattttggaaggaagcttggttcctttcagtcctctatatcacccaacsaatgtgtgktgttcaagagcgaagactgagacggtaccttggacaagtgtttggaattaaaggaagcacttagaaagtaattggccacatggtttgggtaaatctcagagaatgtttctaggatttggaatatttattctggagaagagaagatttaggggttggatgaaatgaaagtcctcaagcacatgaaccagtggtggagagcagctgttccctatttctgttttggactgaatgagaggaaacgagcttacattgaagcatgagggatttaggctaaacatgaagaagaatttcctggatgtgggtgttgttggactttggaatgagttaccaaggtgtctacaataaggacagtgtctctctggctgcagatcttgaagtgtggaagcattggctccatgcaggaatgtctacactcacacgctctttccaagtgggagagtctgtgacattaacgggatcttctaacgtgaggatatgagtctcagtcaaccccaaaccactgtccaaaaccttgatctagcataagaaatggttgtggtaggagctggatgactatctctggcaatctgcagtttgacattccacaaataccatgattgcttatgtaggctactccagcgaccaaacacctcccctctttgaaatgtattaagaaattctctgcagggcttctttcaccaaaagtgcatttaatagagcttggaatttcctcacaatgcatttatttttgttgatatatttttaggtctccattattacttgtctgcaccttcctttgctttgtaggcataagctatcaataaccgggcattgaccacactgtgggggttctccccttccctcccatggaagctaagtctttagctgttaatttcagaaggttttaagccaaccactagttttcattattgtacatcaaaaaggcaggcaaatcgcagcagctgtaagttcaaaggacacaaaggtctcactgtgagcatcacagcaaatagttttgggttcccctcaccccaaaagtagcccatggtgggttaagtttttatttttaaatagatttagagttgaataactagcccttgtaagggacttcaacaaagaggctgtatattggcacatattaaatatgcccctatacaccccaaattgttttgtccaaaatgtctcgtttattataatttcattgataaagcccttgattgtagcccagggactttcacatattggctgcctcctgttggacccacaggcctctattggtgattccaaatcagccgtgcatggcccttgatcccctcctgtagagggactgggtgatggtatctataaaccaacagaatagctcttttccagtaaatcccccacagagtccagaaaaatatgcaagcagtccttttacttcaagtttctacccacacagggtcaacagagggaggagaggcagaggcagctgccctagaagcagccatcgtcccagtcccatagccagtgtgaaatcttagccctcttttccttacacatggccgtggccgctcttctagtcagcaccgaaatctcctccctgaagagcttctttctcttcctcccttcttccttcctccatttcttggtccactgaagtccctggagatcccctgggtcctgtcctctttgagttgtcattgtctttgcttctgttgctcatgccagggctacaggaaatttgctgcgtccccctaggtactgttgtcagagtggactctgggtcaaagagtcagacctttcattggtgtgcttcaagtctaagctttkcaagctctttctctatgttacgtctgcctccttcctctttagtttgtcttttatttgtcctagccttgaggagtgaaggttccaggaaattgaggatgggaatatagtggaaaatccattccccacaggaaaatattctgaaatttctggcttgggtgacaggctgtcattgatagagctagataaygatgaaggtgatgataatgatagccaatcctatgtagcactcattaagtaccaagcactattaagtgcttgagggagaataaatcatacaatcctatgtggctcgtattcttgtcatatgcattttgttgatataaaaaaaaaatcaaggcacagaatgattaagacacatacctgaggtcatacagctagtaagttgcagagcaagaatggaacccaaggccgggcgcggtggctcatgcctgtaatcccagcactttgggaggctgaggctcgtggagcacaaggtcaggagttcgagaccagcctggccaacatagtgaaaccccgtctctactaaaaacacaaaaagtaaaattagccgggcatggtggcacacgcctgtagtcccagatactcaggagcctgaggcaggagaatcacttgaacctgggaggcggacrttgcagtgagccgagatcgcgccactgcagtccagcttaggcatcagagcaagactttgtctcaaaaaagaaaaaaaatggaacccaaaatgctgggcayggtggctcacacctgtaatctcagcactttgggaggctgaggcgggtggattgctttagggcaggagttcaagaccagcctgaccaacatggtgaaaccccatctctactaayaatacaaaaattagctgggcatggtggcaggcacctgtaatctcagctacttgggaggttgaggcaggagaattacttgaacccgggagatggaggttgcagtgagccgagatcgcgccattgcactccagcctgggtggcagagcaagactgtctcaaaacaaaacaacaacaacaacaacaacaaagaatggaacccaggcaactcatccccaaagtctcaggaagtcatcaggccacaagtgtgtgtggaccagtcaggtggaaaagtagagcggcaggggcagggactctggctttgaggccaagtgtgacctggagaaggagcttagggagccgtctcaccctttgggctcctggccccactgggctgctcctgcagctctgccttgctggctgaatcaacatcttttctccatttcagtttcattccctcttgcccacacatcttacttattaaagccacccgatcccaccccaggcatctccaggcttagtttgtacttcctgccctcaaagttactcctggtgccaggatctccgcctcaccattcttctcctgcctgcccatcctcaaggatggcaggacatgcagcatccctaggaggaatttggccgagactagaaaagcagggacgatgccgcctcctagggaaggagcatttttcacaaggcggttttttccctccatcctgctctgccccatctctgctccagctcctagagcaggaaaatgcaacagcctcatttagagaatataatttacataaaatagtttccaaatttattaaggaagcagacaacaaaaggaaacccacaattaaagaggctttgcacgcattcgatatctttccactggctgaagtatatcatcttcctgaattaacgaggtctgggcaaaaactgtagcacaaaagtatgctttgctttcaagacttcagggcctttatcatcctgggtggggcaggcagcaggggtggaattggcagggaagagttagaggccaatctgtctttttaaggatgtgttgccggactgaaatggacaggctggtactgtaggtacagctttttctctgtaaagaggggaagtgctttatatttggggacaccccagtttgttcattcagcaaatctttttaaagaaatttttttagagacagggtctcacactctgtcacccaggctggagtgcagtggtatgatcatagctcactgtaaccttgaactcctgggctcaagtgatccccttacctctgcctcccaaaacaccaggaatacaggcaggggaaggagcgtgtgtttgtatgtaactaagtatccatccattgattttactgtcatgtctttatcatttacctaaccctttatccagccatccacttaacacatacttttttgttctcaaagtcattcgaagcaagttgccagagatctggacccaagagcagctgggaagggaaggggttgggcaggttaccggagatgcccaggatgagcttcactgaagccacatgccactgtccccttagtagcttgtgatacagagagagcctggctttggagtcaggcagcactgggtttgaattctgactcattttgttaccaccatcgactaattcctttatcttatttcttgtttatcttaagaatggaatcacaaccacaagggtgttggtggattaactagtaatgttagtaatgtgcttatgatataatatctctcatcgaggtagacagcacatattttattcattgtctaagtatcgagcacctgctgtgtgtcaggcatcgccctacctgcaggaactgtaatagaaactasgatagccctgtcctcattgaaattttttcaagtactttaaaatttttttccagtacttttgctagttaaaaccctacasgaggtacaagatcaatgtacaatctgtataaactttgaagagcaaagcaaataaaagattatcaagagccagaatttcagggacagatgctcatatgatttcattataaaaagaaactaacatggaaaggaggcacgcagaaagtaacaagaggttttgatgtctgttttttgttttttagaaaacctatgagctgtctgtagaaaagaaaaagtaaatatgacctgatgtttcagcttcaggcataatagcccagacatttttgaaacccacaagggtagtttttrcttcttcagaatgtctttttttttttttttctccccacagtctggcttccttttcccttcaatggaataacatatacaaactctacctaagagtgctgtgtgaagtacatgccagcctacaagacatgtctctaaccaagtcgaaagagtgcagtattcgttcattcactcattcattcattcaacaaatgtttattaataggtattgtttaccaagcactgtgtgttaaggagaagatggtatgaaacaagcagacccaggcctcagggaagagaggctgttacattcagagacaattaccatacactacaatgaatgctttgatgaagggaggcaaaaaaacaaaaacaaaaacaacaacaacaaaaaccccacaacgatgtggatccctccctgtgggggtgaggagaaaggaaaacagcttcagggatctccaagcccttgtgccggccactcttctttcttctcttccttcctcctctgtctttcctttcatccttcctcctcccttctctttggacatcactaataaaagagaaacagatgtcagagacgtagacatggggagggctttaatatctagccttacggaacaaaatccttgggacccartagaacttagtgttgcagagctttctcctgagttcagctaaaaccaggctcttgtcacacgaccagggaagattaggctcccggacacatagaagggtgaggaaaacagaatttattgggcgaaaaggaaaaagaaagaaaaactctcagcgaagtgatagggggtcttgccaacaacctctctcctcacaaattgaatcctaggttaccacagaggccaggttcctctcccctgcaaacttcgtgaacttcccctggctctacccctttcccccagtaagaaggtgggcctcatttagagaaaatcgtttgggaaagggcaggcttcatcagggaccagcaatccagtttctcagccttcaggctgttttagccttggaggtggggtttcacctgggacacttggctgccccctgtctctaacattagatgtctctaacatctattcccctccctatctttgctggacacctgactctctcctagagcaacccagcaaacatctgtctgttgtgtacttaaatacccccacagattgggaactgtctcctttatgggaaagctctttatatttgggacaccccagtttgttcattcagcacattttcttttcaacttttttagagacaaggtctcactctgtcacccagaytggaatgcagtagcgtgatcatagctcactgtaacctcgaactcctgggctcaagtgatcctcctgcctcggcctcccaggagctaagggctacaggcgtgtgccrccactcccagctagttttttaatttttaaaaattttttgcagaggtggcgtcttgctatgttgaccaagtttgtctcaaattcctggcttcaagccatcctcccacctctgcctcccaaaacactgggatttcagccgtgagccaccaacgcacctggcctcattctccaactctttacaaagcttcaaagacatcccagacgctgggaatacagagaccaatcagatacaaaccctgccctccagctgttcgcagcattctcgctcctttgcggccacctcttctgccctgcttttccaccttgtcccttcttctgtcaagtggcttttggcttggtcaccactttgctggtgtttctctccagaagtgagtcccagacttcaggtgtggtctgactcacgtcctatcggrtctctccctctgaaaaccgtgcttgtattaaagcagcttgggagctcattaatgttcttggcagccaggtcctacccctgacagtgcaggagctgcctgtccacttaggggacccctgtctttttcacacgtgagtctgttaagcctcacctccctcatcgcctccatgtgtgcggcagttttcaacaaatgttcagagtacaacacctgcccttgttaaacgtaatcttgttacactagtccccttgttttaacttctcaaacattttgagtcttgctcctgttaaccaagaagacctagaaagctccacatctcctcttaaaatgtgtgtgtgtgtgtgtgtgcgtgtattcgtacgcacacccctgggtacagctctgaggaggccacctataggtttctgaacaatcttccatgaatacagctcattcatacacacatttatttattctgcaacatttattcaacattccctaacaaaactttcattcttgagcactttttgcccaagcattacagggataatagaagcaaacgaatccatactaaggagtgaattattgatagtgctcacctgcatttttttaagcagaaagtagtatttattttggcctaatttccacctgtcagaaaatcaaaacagtgatgaattgcatattgctataytacattttattatcagcatcaaaattcaagtgtgctctgcttaaaattcagaagacaaactttctcatttagaaaagttcattctgttagtgactgatcagaatggaataaaaatttcatgatgcatacatactgattgaatttttttttctttttttaaaaaaaatgtattttattctggattcaaggtgtgcatgtgcatatctgctacacaggtataattatgtactggtgggattgggcatctagtgtgtccattacccaaatagtgaacattgtacccaataggtattcttcaactctatcccccactctaatgatcccccctttgggagtccccactgtctatagtttccatctttatgtccatctttatgtgcccattgtttagctcccacttacaagtgagaacatatggtattcagttttctgtttctgtgttagtttgtttaggataatgacctccagctccatccatgtagttacaaaggacatggttttgttcttcttttttttttaatgactgcttcaccttcttcttaactatcccaaggtgtttggttcttaaactgattggtgaaatctagcagtcatagcagaagcaagtggagacaaggcttgtttaaatagtatcattaagctgactctgacagaggcctttccatacacacccaaccctctcccctatcagagcttctagagagggaggctggctaaccctgggatccagaaatatttggagaatcctcgggccgggcgtggtggctcacgcctgtaatcccaacactttgggaggttgaggcgggtggatcatgaggtcaggagattgagaccatcctggctgacacggtgtactaaaaatacaaaaaattagccgggcgtggtggtgggtgcctgtagtcccagctactcgggaggctgaggcaggagaatggcatgaaccccggaggcgaagcttgcagtgagccgagatcgtgccactgtactccagcctgggagacagagcgagactctgtctcacaaaaataataataataataataataataataatttggagaatcctcaacattctttctrctcatcccagtaacccacttgacagcatggagctcagaaatgtggggaccccagaagctcaagatcttcagccccaactcacaactttctcccttgccattggaagggattgaggaccttggctcaaatctctgtttctcaaagtgatttctggctcagcctatatccaggtggagtaaagcttttacttattgttttggagtaggtacagccggactagggtttgcaccccaggagttaggtagaattggagtagcagagcctttagcagatctgatctctgggaaaagttctaatgtggcaataataccacttttccataggattattacttaggttaaatggcataatggctataacatgcttaacacagtgccaggcttgtggtgtttgtaaatgttagctattattttagttaggaaagcaagctaatgcagaacatgatacctaatacaaaatcctccttatgcttaaacagagaaggagttatttttcgcatacagtaagatgtctagaagtaggtagttgcaggtttcagttcaggagctcaaaaatgatggggccaatgtctctgaaattctggacatttcttcctagatgcaagagggctgttagaactcaggcaattgcatccttgtttaagcctggagagagggggaagactgccttaaccacatctgacatctttcatcaggaaagaaaagcctttcccagaaatccatgagaaaatttttgtttaggtctcaagggccagaactgggtcactagctactccctagctgcagagaggctgggaaagttaggaacaggataatcatgattggcacaccagtaatgagccattgccaggaaggagtaagcagtttagatcgtaacggtgattaccgcagtgattgttaccagctctagcctgccttccatccatctacttctcatttgtagcaaattatcaagtggtctcatgccagttataaatattattcattgtactcacagctccctgcactaagccagcttttctcttaacctttccctgtccatctggataacatttcttattgttactccttccccaggaggatttctgtactagtcgctattgctgattatgctgtgtaacaaataacccccaaacattaatgaacattttttcctactcgcaggtctgcaggtcagctgaggggactctggcccaggatgtgggttcaggtctgcttttgtgtctctcattccagaaccctaacttagggcacaccatgtacctaggggatgctctcctcatggtggattaggagagcaaaaaaggacaaaaccacatgagcacattgaaagcttctgtttgcgtcgtgaccactcatgttccattggccatagcaagtcccacagctgggtctgacgaggaagattattcttcccaggagagggaaggagaaagcaagtatttgctgaacaggaatcaaatccattgcaccttctcaagccaaaactaggttaggagtcctctttgggcacccatggtccttaatgcatccttctgttacagctttggattctccattgcccttacctattccgttgtctgtcttccccagtggattgcaaaaagattgctatggctgagatgtgtaagtcttttatgagatctaggtgacagctgataagtgtagttatggtcatgatggtcaattctttaacagtttattaacaaaataacaaaagttacaaaatgaaaatataaaggataagttattcgaggactatggttggactctagttctgaacattatttaaactcgatgttaacatgctgtagataataacatatccacagaacagaagctaggtcttccattggccataacatatgcctctaaatgccctcccccctaccaaagtagcatccagaggtatgtgctattacttgagagatcattctgcaatttaaaatttaaactcgacaaattattaataccataaacatttcagtgtcaaacactgaagatgcaatgataacacctggctatcctgctcaggtagctcacaatctgaagggtagatggtggtgggagcagagcagttaacagataaaatgaaaagtagtaagtggagctcttatttgttgctggtgggaatgcaaaatggtacagccacttcagaagacagtttggaagtttctggcaaaactaagtatactcttaccataagatccagcaagcatgctccttggtatttatccaaaggagccgaaaacttacatccacacaaaaacttccactcagacatttccagtagctttgttcataactgccaaaacatgaaagcaaccaggatgtctttcaataggtgaatggataaacaaactgtggtacatacatgcagtggaatattattcagcactaaaagcaaatgagctatagaaaagatgtgggggtagatgctaatttgactccttaacttaactatctgaccttgaactagttacttagtctctagacctcaatttcctcatctgcagaatgtgaataatgagtgttcttgtgcaaattaaatgagatatgtatttatactagatattgtcattttttccttcagatccactgtccacctgctactccttggtctccctcccaaggaggctgacctgcatggaccactagaggctcccttgtcctttgcttttttttttggtttagccaatagggtgcccagacagaagatgagagggagggctgagagtgaggctggggatttattctgaatgcttgccctgcagcattgccttaggctgtcactattcctccccagaagctttctaggagactctccttctgtgttctggaaaactactccctaccctcttcccttcaggcttaaggacaggtaacagccctgccattactagctccagggcagagcatcatctctacaacctgccacatctttgcaaataatccctttattaaactttcctaagaaaatcccaatttaaaaaaaaaaaaaaaaaaaaaaaaaaagaaaagatgtgggggaaccttaaatgcatattgctagtaaaagaagccaatcggaaaggctacatactgcaagatttcaactataggacattctggaaaaggcacaactatggagacagtaaaaagatcagtggttgccaggggctcaggggagggagagagggataaataggtcgaacacaatatttttagggcaatgaaactattctgtatgatactgtaatggttgatacctgtcattatatcttcatcaaacctatagaatgtacaatacaaacagtgaaccctaacgtaatctatagattttggttgataataatgtatccatatttagtcatcaattgtaacaaatgtaccacactaatgcaagatgttaatataggggaaagtccgagaagaggtgttgaggaagttatatggtaactatactttctactcaatttttctgtaaacctgcaactgccccccagaatagtctattaatgtagagaacaaggtaataaagtgcaataaaagggatatgtacaaagtgttatgacaacacagagaaagcacacagggaaacccttccaggggagatgggtttgaactgagtcttgaaggacaatagaaattcaccaggtagagcaaggagaaaggtgaacctggcggaaagcaccacctgtaccaaggtgtcaatgacaggatcatcacctgttgtgtccactgaccaagtatctagagtgctgcctgccctagagagggcgctcaataaatatttgttgagtgaacggatggtaacttgacaggacataacacggtggagctttatttcctagctaggcataaagactatcgaaaagtgcaataggtacttttttttttttttaagacggagttttgctcttgttgcccaggctggagtgcaatggtgtgatctcagctcaccgcaacctctgcctcctgggttcaagcaattctccttccccagcctcctgagtagctgggattacaggcatgtaccaccacacctatctaattttgtatttttagtagagacagtgtctctccatgttggtcaggctggtctcaaactcccgacctcaggtgatccaccccactcagcctcccaaagtgctgggattatcggtgtgagccaccgcgccaggccaatagggccatattttataacctccccttcctatccatccttaatggtgaaaagggtatcaaatgtttccaattgctctttggctggggaaaaaacatcttcttgatgttgatattcatgctctaaaggtaattagatgccagagaagagaccggattgtaggcgatggcagcttgcttacagtatacatttataaacaagcaaaatcaaaactgtaaagtcgcatttcaagatggttttgtgtttctccacattgagccaacagcctgtggacgatatcatatactccactggaattggccgcctgggccaaatgagaaagctatctccatagaggctttgaagcagaaggtttgggcactgagcagggagggagaagcgccacccctgcggggcttagctcagtccacagggtctgggggaaatctcatgcaaaacacgagtgggactggtaccaacgtcaaagaagagacactttggaatccagcctctgtcaccaggagcttcccctccaggcctctggcagagaggtgtggtccttcctccctgatctttcatctcttggaatctctagttgctaggcgcgggtgaacagtgtcaaaacccagcccatgatagatttatcatcccccttactgagaactgcctatggccacatactgtgcttagcatgtacacattttggtttatataaaccttccaacaaggtgccaggtgggtaacgtgattgagattaggaaactcaggctgaggaaagttaagtcacttactcagtgtcacctgggaataagtggcagggctggggttagaactcccatctgtctggcttcaagcttatgtgctttccattatgtgcagccaccctgccaactactcagcaggggccttctgatggacactgtgagaggacaagacacaaaagaaatgtatacaatggagaagacaatgatacaaatgatacaaaggagaagacaatgggcttctcctttgcccctgagacttcctttgaaaaataatttgcaaaatcccgctccctgtgccttgctctagagtttgaaggcttgggcctgtgaacagtgagctctcaggaggcacagatcgctcccttaggcaccatgcttgagacttgaccacatttcaggctggctccgcctgctctaggctgtgtctctaaaggtggccccacccctgccttgcactaagtctttactcaagaaaatgcaatgctaccaaaccacaaaatgtgcattgtcccaacccagcttgcaccaaattgttttcaggaattctctagtgaccccttctgtaatttccatttccacataaaccccaggccctttttgttcccccttcttcacttccccagcatccctttttgttctctctctgttctcccttcagaagcctcagtcccctttaattggggctgagttctgtctgacctggaatctcccccaaagcaggagtctgaataaaacctgtcttgccacctttcacaagtgttttgcgctgtgtgtgtgtgtgtgtgtgtgtgttttttttttttttcattgatagttcaaatcctatttcctctgggtattgtctgtgtgtccttgggtgaatcacttcacttctctgagtctcaacttcctcatcttcaaaatgagaacgtaggtasgcccaccttgctgcaaggtgatgagggaaggccctcgccaggggcctgtcactccttactcaggaataatcactgacccatccccacagtgctggaactcttctaggcattgggagtagagagaagcaacacagagttcctgcccacagagagtggactttctagtgaagaaacaaacaacacacagggaaacctatctgtatttgtctgttttcatgctgctgataaagacatacctgagactgggcagtttacaaaaggaagaaaggtttaatggacttacaggttcacatggctggagaggcttcacaatcatggtggaagrcaaggaggagcaagtcacgtcttacatggatggcagcaggcaaagagagagcttgtgcagggaaactcccatttttaaaaccatcagatctcacgagacgtattcactatcgcaagaccagcacaggaaagacctgcccccatgattcaattacctcctactgtgtccctcccacaacatgtaggaattcaagatgagatttggatggggacacagccaaaccatattaccatcttaaaatatcaagcagtgaaagcatgatgaagaaagttaacacaggtggagggatgcaggtgaccaggaggaggaggagctattttccaagacctctctgatgggggacatttgcacagggagcaccatgtagaaatcttgagggttcacactccaagcaaagagaagagcaagtgcaaaggcccagaggcaggagagcactggacctgttccagaaacctccagcaggccaatgtagctgaaacacagccaggcacaggggctgagacagsaggtgggccaggccatctagggctcagggaccatggtcaggactctatattcatcccaaaggtgatagggaagcactaaggttacagtgtaaccatatccatgtctcaatcacctgcctaactctactagaaggagggaacgtgtcagtgctggttgaattgtgactttctcatggggtagggggtgggttataggaacatgagatataaaacgtaccagaaaagktatccaacctctaggcgtccccctccttggacaccttcaggttccatggcgatatgatttggctctgtgtccccacccaaatctcatctcaaatcgtaatctgagcagtggagtaatatgatctaagctttatacatcctatatatttaacaccatctcaaatttacaaaaaaagttacaagtatgggacaaataatttttgtccctgagtcatctgaaagtaagctgccagcatgatgcctgtcacccctggacactttactatgcatttccaacaaacagagagaatgaccatcaaaatcacgacgttcacaacatgcatttttaccatttgaacctcagaccacattcaggtttcatcctttgtcccaataatgttctttataacaaaaggagccagggtggaatcacacattgcctttagatatcaagctcctttagtctccttcagtctgaaatgttttctcagtctttctgtgattttcgtgaccttgactcttttgaagatgactggccaatcatttgatagaatatccttcaatctgcatttgtctgacctttcaccctgattagaattaggatatgcatctttggcagaaatatcacatgaatggcaatgtgttctctaggttgcatcctatcagatgcacaagaactcaatttgtcccatgactgatgatgttcacctgcatcacctggttaaagtggcatctgcccaccttctccattgtgaagttactatttttactgttcttccctctgcagttgataattatttttatataaatatcctgttcctcatgaaaccttcaatgtattcagttattaataacactrtggactcctgttttcctgttttattctgtgggccataattcttaactcycattacttatttgtatttagattactccagaaatgtccagcagtggcttctgtgttctggcatgtttccatcattgtttgggtgcttaatttctgggtaacaagatgttctaggctcctttctgcctcagtcccagaatcaaccatttcttctagggtgcatcttccttttagttgagatgaaatttggaatccaaaacctgggtacaatgtaggctcactgcttttggaatgtcagtgccctcaggttctctcaatagacaaaactaaggaatatatgtgtttatatacacatctagttgcaagtatacatacatgcacacatctttcatctatatttctatgtcgatttaggtattgaatgttatgagttcctatcaatacctccaatcgcaatcccctctacaagggtctttccagattctctctttccatatttgtaacttgatgctccaacagcaagaaatctttctcctttgcttttaatatatttgcctacctgatgagtccccatgggtataaataatcctccatctccattgccattctctcccttagaaggatgttattcttggtccactggggtcctgacagctggtgctaggccttctccatgcatggatgccctgctcatcctgcctggcctctgacatctttatggggtcacttttctctccttgtatctaacaccctacactgagctgccccttttggtgctttcttcatttagccagagctcaaacactcatgcctggcagccctcctccttggatgccttcttcaggttccatggtgatatggtttggttctgtgtcatcacccaaatctcatatcaaattgtaatccccatgtgttggaggaggggcctggtgggagatgattggatcatgggggtggatttctcccttgctattctcatgatagtgagtgagttctcacaagatctgatggttttaaagtgtgacactcccctctttccacccctcctgctatcatgccttccaccatgattgtaagtttcctgaggcctccccagtcatgggaactctgagttaattaaacctcttttctttataaattacccagtctcaggtagttcttcatagcgtgtgaaaacgaactaatacacatagcctgatattctgctccaggccaccctttgatagaggctctccttactccacctgtcccacctgaccagctgaaaggaggcacatgtatcacacctgttcagtggcagcttaggccctctctccttggaagggtatatcaattttcacagtttgtggctctgccattttcaaaggctacagtgaaatctgagcaggaaatgaaaatcatccatttctgcagtactccctgaaatcattacatcatcactaactttccccgagttcccatgtgatgttggagctggaaggcccccatttaccagaaccagatagcttatttcatgcctgtttgcttttgcacaggctgtctctctgcttggaatgcttttcccatgtgcgataaacccctccattccaaatattttaactctgtgaaactttctttgatccctaaatttgaccccaagttaatcatttttctccctctgctacaattttcacatttagcttttaaaagatatytaatatattgtgcacctcttatactaggctgtgaactccaactccctgagacaagttgttcattcattcgtcaaatatttattgagctcctaccattgtaaaaggctctgtgctaagtactaaggatgaaaatggagaacaagatgcagcactttccctcaaagagcttgcagtctagtggggagtttcattaggtaaccaagccatcctaatccatattgctggcttagagtctgacacatggaagatggtgaatgaatgcttattggaatttctaagactggtggcaagagcatggaacacagtactcattccctgctaaagactgttctcgctgtctctgtcctcaaggagctggttgtttactgggagagacagacaccaactgtatataaaaagagcactagagtgttttccaggccatgatgtggcacactcactgtgagctgctgcagcagacaccgttgggtctgcccagggccctcagatatcctgcatgcccttttctggctctgcatgcccatcctccatgcttctgtgagctccactcttaagactcaccctgcagccttcttggagggactaacctgggctactgcagccacttctgcaatggcagtgagcgtcagcatttcaaaaacagacaggcaggagggtaggacagcccgtgttccttgcctccaagcagatgtaacctactctggggagctcgggatcaggctgggactgggacttctgatgtgatgtccttgtgtggcctcttctcctttcctctcctgcttcctccactcccctcttgctttcttgtgagagcacttccttcataaatactttgcccagtcattctccacgggttagcatgtgggaaacctggtccagacactgcgttcgcaatacctggccctgctaatgtgtagctcacagggcaggtgtgtgctccagccgggaatccagccagctaagtrtctgatatagtttggctgtgtccccacccaaatctcatcctgaattgtagttcccataatccccagtgtcgtgggagggacccagtgagaggtaatttagtcatgggggctgttaccctcatgctgttcttgtgatagtgaatgagttctcatttgacagttttataaggggcttttcccctctctgctcagcactcctccttcctgcccccatgtaaagaagaacgcgtttgctttcccttccgccatgattgtaagtttcctgaggcctccccggccatgctaaactgtgagtcaattaaacctctttcctttataaattacccagtctcaggtatgtttttattagcagcgtgggaatggtctaatacagtatccaaccaatcaagtgcagcttcagagaccttgggctttaagaaaagggctgaaggccagagaagatttctcagtgaaggtgagttgagcagggccttaggggagggtaggtcattaggtagaaagttgggcattgcaaggcgagaaaacagtgtatgagctgctgtgaaagacatgggaaggggagaagctcaggctgtttctcctccaccagagaatgccctcctccttcctcccccttcctcccaacacacacacacacacacacacacacacacacacacacacaccagttttctcccggaaactgagctaatccagccacgccccgacagacatttgcagtgattttacacacacacacacacacacacacacacaccagttttctccctgaaattgaactaattcagccagggcccccctacaaacgtttgtagtgattttactcccagcgtggactctcctgcccggtcagcttcaaggattcctttggtcccagaaatagccaaggtggcggtgaagggaggagctgtttcatttccgaaatgaaaaagtttaagataattacacagacggcttgagcctgcaatggacaaaaagtttcattattggacccctttggggaaggcgcctcccatccccaaaggagcgggttaaccgctcggctggcgcggccccgcccgggtcgccgtctgagagggacggtcgcgccccctttgaagtgcggccgcgcctaatgagggactcgctgggcctcgggatcaagtgtcagcgccgccccagacgccgcagggcagacaaagggcgcgggccgcctggcggcgctgggaggagcgtgcggcccgcggcgctgagcgggacaaaggcggagacgggcgcgcggcggggtcccacgggcagaagagcctggcctccagcgcccggcgcccggttcgctgcctccggagcccccaagagcctctctgagggcgggagcggtagcgcaggccacgccgacggcgaccacaacgcgcctgcgccaagccccggccccagcgtaacctcgtgggtgacagtgtgacctgggttttctccgatacgcgcgatgtgcccgctgagggcaatatagcacccgcctcgcacctcacccttaggcgtgccaggcactcttctaaatccgagcttctattaacccatttcctgtcctgcatcactttgcaaggtgggtggggtgagtagccccattgtccagctcactccattctacagatcaacccattgtatagctcaccccactgtccagctcaccacattgtacacgtcacttcattgtacacatcagccattgtacagaccaccccattgtacagatcacctcgttgtacagatcacctcattgcacagatcaccccattgtacagatcacctcattgtaccgatcgtcccattgcacagattgtcccattgtacacatcactccattgcacagatcaccccattgaacacatcacctcattgtacagataacccctttgtacagatcacctcattgtacagctcgtcccattgcacagatcgccccattgtacacatcaccccattgtacacatcaccccattgtacagatcaccccattgtataaaccacccaattgtgcagatcccattgtacagatcaccccactgtacagatctgtgaagcgaggcgcagaaggagtcccagatcacagagctagaagggatgctgctgggcagggtggcctcagagtcccagacagatgtttaaatatttgacatttttgtcgtcttgtgtgtgtatgtgtttttaaaaacccttcatttatttatttaaatttagaaatatatttactttgattaaaaatatattacattaaagtattctttatcttggttattgagattttgggcgccctcttaaattttgggtcccaggcgagtgaggccctgtctggcttttatgcctctttactgcctgggtcgaggctttggatcctcacaacaagctctcgcaggcagggttactgaccccttggatatttcagaaggggaaaaactgaagctcaaagatgtgaagtgacctgcccagggatgcccagcagggactgtgacaccagctagttaaggtaccaagtcagtaccttgcaggcccttagctacctttgttttgtggagcctggccgtcatcatagcaaacttcaaaacacattacatatggcctttttattccataatatctgaaactatattttaaaaataattttgattttgcttttagttggctacaaggcactaatttacagtggctgtgatttcacagaaatgattgggtgtactgggaaattcttgcaaagtgagaaaattaaatccttttcacatgtaatgaaatttttaggaataattaatttagcattttaatgatgttgacacggtgctaccttctgtagacatttaattagacatttattagttttgactttgtagtttgctttcctcctggtggagccaaaaattacttttccaggtctccagcatttttgttggaaatcccttccagcagcatgggggtcccaggcaactttcttagggtacccaacccctaggatggtcctgcccacttcagtcccccacctcctccccatgctaggggtggggcacctcccatctttctagtgtcctggctttcatgtgagcaggaccttctcaggtcaggccctgctaagctgtagattccctggagtccagtgtgattgtaaccatgtctcaatcaccagcctaactctaatagaaggagggtacttgtcagtgctgaattgaattgtgagtttctcatgagaggttggggtagaagracatgagatattaagtgtaccagaaaaaggatgggtagttctggtgtgtttcagtcagctctggctgctataacaaaataccatagccatagggtggctcagataacattgacttctcataggtctggaggctgaaagtccaagaagtaggggccagctgattcttgtctggtaagggctcctgtcctggcttgcggatggctgccttcttgctgtgttctcacatagtggagagagagagggaacaagctctctggtctcttcctataaaggcactaatccagtcatgaagatcccaccctcatgacctcatctcaactaaactatctccaaaggccccacctccaaataccaaccttgggagttaaggcttcaacatatgaatatggagggaacacaaacattctgtccataacatggtgctactactcatgttgtgtgtccccagggaagtttctgcacctctctgttcctcagtttccccttctggaaaatgaaggtggatcagaaaatttcctatctgaagctcctttcagtgccatcattctctcatatgggttcatggaagaagcagtttggtttcatgcaactgagcattagggaaaggtaaagttctaatggcctactttcgcaaatggggtcaaatagatattttctccagtgatagcctgtgattctctgtgatttttttttctgggtgcactctcctcacttttccttgaatccttagcagacactgccatggtctttctgtgtgtctcatgccattgtgacttgtgtgaccaccaggcattgggcttggcatgtggcaggtgctcattgcaggagggaacatcttttccagatgaggaaactgaggcacagagaggtctgagtcaatgcaaaagcaatctaactgctatgatgtttctgcacagccttctctggaagaggagagattttatatatctgcaaattgcatggactttcttcttacctgtacccaaaccacagctgcatgaggtcagtgagggacactgtgttcccactagaacagctttcagggcagaagacagctttcctccttacaaaggaatctcacatccagtcctccacaacctattttacccaaaggcttctgactaaagacagctgtctgggggcccaggagccagggtgccagttccagccctggcacaagcattctttgtgacttggagcaggtcccttaccctcttggagcctttgtttcctcctcagggaaccagaagtctggactagatcagagcttctcaaatcatccgaggatcctgttaaaatgtggagcctgatgaggagacctgctgggggcagacatcctgcacttctaacaagctcccagaggatgcagttacttttgcccatctgtggattcactgaggagcaagcaggacttctaaggtcacctcttgctctgaagggacagaccttgagccctggcagtgggcacaaagagagtgacaaaaacaaaaaacaaacaaacaacaacaacaacaaaaacccagttgcccagatttgggtcagccaggagagcacagaatgtgaaatgattccagagggatccttccaaccacagatacaaaaatcaacatcgtcatcgtcaccatcagcaaacatttgtgcagtgctttcccctgtcctgagcagctgtcacatccttgaacccagttgacccctacaggcaccctggtgggagaggaggacacggctgaggaatccattcagtcccggtggaggagctgggcaagagcacaatagtccctgaaaggattgtttccatgcagccctttgattttcttagcatttttttttttttggtgcctgctttctgaccccttcttcctttgtctcctaatgcacccccaccccgctcctaattcttccctcccccaacacacacacacacacacacacacacacacacacacaaaaacgtcaggaggagaaaatcagtgtatccacccacagatttctcactttgatcctttcctgtctcaccgcctggaacccagcttcagagaccaggattctggctcgttttggggtgacccagtcacttccactcttctcacttgtaactatgcaattttccttaaggtgacatttgtgaaggatttatgttgtctgggcactatgctgagtgacttcattctcacttcaccctagggagtgggaactcttaactatctccacttcattggtgagaaaactgagcctttaggatgtttgcctgcccaaggtcacctagttagtaaatgatggagtcaggacattacctgaccttggctgactgacatcaaagatcattgtagatgaacgcacagttgtaagaagtaatacagagagatttgtgtaactcttatccagttttctccaaagggagcatcttgcaaaactgtactacaatatcataacaaagatattgacactgataaaatccaccagccttattcagatttcctcagttttacttgtcctcatgtgagtgtatttagttctttgcaattttaacatgtatgtaggtccatgtatgtagcgccacagtcaagatacacaacagctctgtcagcacaggcttctgcagcctttaataatcacatctacttctccatgtcacccagcatccctcattcttgtaacactaaacctgttctctatctctataatttcattatttcgagaatgttctgtaagtggaagtatatgcttctgggattggctttttgactcagtctaattctcttgagagtcactgagttatggcatgcatcrgtagtgttttttttttttttaattttaactgagtggtgttccatggcatagaagtaccacagtttctttaaccatttacccactgaagaatatctgtgtccagtttctggccattatgagaaatgctgctgtgaacattcacgtacaggtgtttgtgcaaacaaaagtttttacttttctgggaaaagtgtccaagggtataaagtccttgcttttactcccaacgttgtgtggccctctaggttggttgcaaagatcttttttaaaaagagcaatgtaagttgagatcttactatatatttgatactatggtaagtactttgcatggatcaactcataagtccacaaaacaaccttaggcttaagtactggtgatatccccattttgcagatgaggaaactgaggcgtagagaggctacatagtctaaggacacacagagtgtaaacagttgagccaggatttgagctcaggctgcctgactccagatctggctatttaaccagcctatgaatgaagtttcttgttttggcgaggggcaaacttcttctgaaagtagaacttgtatccagcaatttgcataactcaagtgcccagcactaagaacttttacaaaatgatgaatatccccttggaaccaccactcagatcaagatatgaagcctgatagatgccctgaagtccccctcctatgtgcctcctgtcattatcccctaagaaagggaaccgctatttgtactgcagttgctgtatattagttttgctcatttttggattttatataaatgaaaccatagagtargctgtcttttatatctggcttccttcattcaacaatgtgcgtgcaagactcctccctgtagccgtgtatagtagtcatgtgctctttcttcttgctgccctgtattccattgtatggatatgccacagcttgtttatttcttctccagttgaatggcatgtggtttgcttccggttttggctatcatgatttatgctgctatacacacataaatataaatatttagagttttcctagttatgttattattgatttctagcttaatttcactatgatcagagagtataactgtatgatgataaacctttcaaactcattgagattggctgggcatggtggctctcgcctgtaatcccagcactttgagaggcccaggcaggaggaccacttgagcccaggagtttgagaccagtttgagcaacatagtgagactccatttctacaaaaaatttaaaaaaaaatagctgggcatggtgatgcacatctatggtcctgaggttgcggggatagcttgagcctcagagattgaggctgctgtgagccacggttgtgccactgcactctagcctgggcaacagagtgagaccctgtctcaaaaaaaaaaaaaaaaagggaatatgtaaactgcagctgttggttgcattgcctttttttttttttttttttttttgagacagggtctcattctgttgcccagactagagtgcaacgacatgatctcggctcactgcaacctctgtctcctgggttcaagtgattctcctgccttagcctccccagtagctgggattacaggcacgtgccgccatacctggctaatttttatattattagtagagacagtgtttcaccatgttggccaggctcgtctcaaactcctgacctcaggtgatccacctgcctcagcctcccaaagagctgggattataggtgtgagccaccgtgctcggccagctctatttatttttattggctccagttcattaatcatgttaaaatcttttatatctttactgaatttctctctgctttttctttcaataactgagagatgtattttaaaatctccactaggataatggatttgactgtttctccttttgtcccactttctttgaggctatgttttttgctgcatgcaaattttaaattattatcttattaaatgactttttgatattataaaatatctctagtaacaaatcttgccttacagaatgtattgtctttatatgttatataactacatatgtatgtgttataattatgtagtgttgttattaagtatatgttaatgtagttatgtatcagcttttcctgtccttttaatttcagtttttcagactccttatctttaaggtaaatgtttcatataatcacaatgtaattgggttttactattttagatatctgataatttttggattgctaaaaaaattttgaaaattattccattttccccaccctgctaacttattcgttatgcattctgtattattcctgtacctgttcccgtagagcagcggtccccaatcttttccgcaccagggaccagtttaatggaagacaatttttttcatggatcgggggcaggggaatggttttgggatgaaactgttccagctcaggtcatcaggcattgttagattctcataaagagcctgcaacctagatccctggaatgtgcagctcacgatagggttggcgctcctatgagaatctaatgcagctgctgatctgacaggaggcggagctcaggcggcaatgctcgctcacccctcactcacctcctgctgtgcggcctggttcctaacaggccacagactgctacctgtccatggcccagaggttgggaacccctgccctagagagtagaatactcattgttggcttgttacattctgtttagttttggatgttaccatggcaagtgttgttagtacaacaccattagtccatttctctccttctgctttttgtgctacgttatcatgtatttaattctacatatattttaatttcctgagaacattgttacttttggtttaagttgtcagaatttacttatatttacccatataccaatatatttaccattcccagcactcctcatttatttctaccttttcgtgtttctatcttgaatcatttcctttaatacttcttttagtgttggtctactggcaatgcattttcaaagttttttcttgcctgaagtatcttcattttacctttattttatttttaattggtgtgatggttaatattaggtgtcaacttgattggattgagggatgcctagatagctggtaaagtattgtttgtgggcgtgtctgtgagggcgttgccagaggagactgacattcgagtcagcgggctgggagaggcagacccaccctcactctgggtgggcaccatcccatcagctacccagacggagttttactatgttggccaggctggtttcgaattcctgacctcaggttatccacttgccttggcctcccaaagtgctgggattataggcatgagccactgcgcccagcccagactatatatttttatgtttcatgctaacagttttcagatcctacccacctttcttccccttttactccacatctgggctttacctttgtgatctaatcacctcccaaagccttcacttcctaacactatcaccttggggcttcggtttcaacacatgaattttgtgggaggacacagacattcagaacccagcaccaaacaatgaatcaccacaatctagtcaagttgacacgtgcaattcgccaccaactgctccattttttctctcctgtattcttgtgcctccaattacatgttgttaaatatcttctacttggtcccatatatatgtctaattttctgtatttttatcctttttctctctgctttagtttgaatatttttatatttctattttctggttcacttgttctctcttctgataggtatactgagctaacaattaaaattttactttctattgtatatttttcaattttaggatttccaattggctatttttaaatagatgccagtttctggggattttctccaccactctgcctgtcttttggcattgtaatcatggctattttaaagtttatgtctggaaagttcaatacctggttcttctgctgtctgtttttactctccatttttctcttgattttcagcatttaatcatgttgcctgtcctgcctggtaattttttattgcaggctgaaaattgcatatgaaaagttatagagcttatggttggtgttatattctttcagaaagggtttaattttcttcttattggcacatagagtatggccaaatcatctttatctagtcacagctggcctgtttcacatttcctcttattctaaccctttttagggtttcggtggaaagcttgaggtgtttgttgggagccctaatccttaacttgctgtgaactccagtttttatttccccaaccccatgagactgccatgttctctgctcatcttttagctttagaagttgctttatagtggggttctctgggcctctttctgtgattacacaggatttctcttggggagaaatcatatacagactgtaggactcacttctctgtggttcccygtcatctggtatctagtcccttatgtcatggccactttttactccaaactctaatttttccagtctgcagcacaaaagagggtcctcatcagaaccacaccatgctggcaacctgatctcagctttccatcttccagacttgtgagaaatgaatttctgttatctataagccagccagtctgtgatattttgttatagcagcttaaactgatgaagaccaaaactggtaccaaaaagtgggggtgcctcctataacaaatacctaaaaatgtggaagcagttttgggtaatgggtagaagctggaagagttttgaagtgcccactaggagaggtcaaaattgttaagacttttgaagtgcatactaggaaaggtcaaaattgtcactaaaaacaaaaaacaaaaaacataaaaacaggatcttgctttgtcactcaggctggagagcagtggtgcaatcatggctcactgcagccttgacttcctgggctcaagtaatcctactgcctccgcctccccagtggctagggctactgatgtgtgccatcacacctgactaatttttttgatttttagtagatagatggtcttgctatgttgcccaggctggtcttcaactcctgagctcaactattctcctgccttggcctctcaaagtgctggaattacagcacttttggccactgtgcctggccaaaagtacttttaaagatgattcagaaaggaaagatgagaggtattgagaaagcttctgtcttcttagagaatacataaataatcgtgtacagaatgttggtggaaatatggctaataaaggccattctgatgaggtgtctgacaggaatgaggaacaaattgttagacaatggaaaaaaggcaatccttgttataaagtggcaaaaaaccttggctgaattgtctttgcattctagtatttttgtggaagataaaactcgtgagcagtgaaagtggatatttagcagaggagatttctaagccaagtgttgaagaagtcactggcttccttctgaccacttaaggcaaaacataagaagatggaaatggcttgaagatggaattatcgagcaaaaggaactagaacttaaagatgtggaaaattctcagcctactcatattgcaaaaatggagaaagtgtgtttggaaaataacactaagggtgtggctaactgaccatttgatatggaggtcagtataggtgtgaaccatggacttaatcaaccagcggtttcccagcaggacaactgtcagtttgaactaaataggaaggggatggtaaagaatgaaggaaagttgttggactttttggattttacaggacaggactatagagctattcagttgtgaatgtgtgctcttgttaaagacaaggggaagaatgaacccaagggcaatgcagaggtcagtaggttaccttcttagtttcaaaaggagggaccattgccttgctttcaacagaaatgagctccacccaaagctgttggggataccacctcctggcagagccctggagctgcaagtcctgtccagcagagctttttggagaagaccacctcccaagtgggtctgcaagactgtacctctgccccagtgtgtccagtggccctagaggggagagcatcaagccacagaggattatcttcagcctgaagacctggtgaaagttgtcttgtgaggtttgggactcccttgggatctgttaacccttctttcttttctatttctccgtgtcagaatgggaatgtctatctatgtctgtctcaccactgtattttgaaaacatgtttggtttcacatgtttgcagctgtgaattttgcctcagaatgaattgtactctgagtctcaccttatctgatttagatgatacttagataagagtttggagttgatgatgctagaatgagttaaaactttgagggctttggggatggaatgaatatattttacatgtgagaaggatatgatctttgcggggtttggaacagaatgcagtggactaatgttcgtgttacctccaaaatttctatattgaaatcttaatcccaatatgatagtatttggaaatcaggcctttgggaagtgattaggtcatgagggtagagccctgataaatgagattgatgcttttataagaagaggccatttcatatggaaccaaaatagatcctgtatagccaagacaatcttaagcaaaaagaacaaagctggaggcctcatgctatctgacttcaaactatactacaaagctacagtatccaaagcagcatggtattggtaccaaaacagacatataggccaatggaacagaacagaggcctcaaaaggaacatcacacatctacaaccatctgttctttgacaagtctgacaaaaacaagcaatggagaaaggacctcctatttaatacatggtactgggaaaactggctagccatatgcagaaaattgaaactggaccccttccttaaaccttctacaaaaattaactcaagatggattaacgatttaaatgtaaaacccaaaaccataaaaaccctagaagaaaacctaggcaatcatagggatgggcaaagacttcgtgaggaaaacgccaaaagcaattgcaacaaaagccagaattgataaatgggatctaattaatctaaagagcttttgcacaacaaaagaaactagcatcagagtgaacaggcaacctacagaatgggagaaaatgtttgcaatctacccatctgacaaatgtctaatatccagaatttacaagaaacttaaacaaatttacaagaaaaaacaaacaaccccatcaaaaagtgggcaaaggatatgaacagacacttctcaaaagaagacatttatgagccagcaaacacatgaaaagaagttcaacatcactgatmgttagagaactgcaaactaaaacgacagtgagataccatctcatgccagttggaatggcaattattaaaaagtcaggaaacaatagatgctggtgaggctgttggtgggaatgtaaattagttcaaccattgtggaagacagtgtggcaattcctcaggatatagaaccagaaataccatttgacctagcaatcccattactgggtatatatgccaaaaggaatataaatcattctactataaagacacatgcacatgtatgtttattgcagcactatttacaatagcagacatagaaccaacccaaatgcccatcaattgatagactggataaagaaaatgtggtacatatacaccatggaatactatgcagccataaaaaggaatgagatcatgtcctttgcagggacatggatggagctggaagccatcatcctcagcaaactaacacaggaacagaaaaccaaacaccgcatgttctcacttataagtaggagttgaacaataagaacacatggacacagggaggggaacaacacacaccagggccagttggggagtggggggcattaggacaaatagctaatgtatgtggggcttaaaacctagatgatgagtcgatagatgcaacaaaacaccatggcacacatatacctatgtaacaaaactacacattctgcacttgtatcccagaacttaaagtaaaattaaaaaaaaaaaaaaaaaaaaaaaaaaaaaaaaggactgtgatccagctagctttctttccactatgtgaggctactagtagaagttactatgcaacccaaaagaaggcccttaccataacctgaccatgctggcaccctgatctcagacttttagcctccagaactataaaaaagaaatgtctgttgtttataagccagccttttttataacagccagaatggactaagatgattcttcttatcccagtaagatgctgcctcatgctctagctcactgctttcagttaggtctctgtgaccccacattgtgaaatatactgcaagggatgaaacccacaggggatgcagcactcactttaatgtttttctctggggtcttgatccctcaagtctggcctgcctgggatattttttgatgccttcaaacagaccttttaaaaaattttcagcttttacagtggttcttggtgacaagttaggtctgataacagcaacctatcttcaggcagatgcaaaagtttgaattaagttttgcatagtacttggcatgtaagaagttttttattcagtgtgggttctcttccctgatgaaaaaaggttaatggtttgtctggacaggagaggaagaacaccctagcattctttgatttttttctagacatgcagttgttctcattgccctgaaaggaagctcacattagagaataattggtgtagagtcgttcgttgcatgcatcatgcgtaggaccagggtggggaaacattaagactagtaggcactacagagaccacagggggttcaaggaccctctcatgatgttctttagtgtgtgcctctgaaatttcaagcagagattgggcctacctgcacatgtgtttttatcagattctcaaaggatccttgagacaatgctaagatccagcgatctaatctgaggaactgaggcagcatgagagaaggtgtattcacctgccttgctgtgacaacacacagcctttcccatgtgcacatggagagagggagttctttggtgtctcttcctcttcttcttctttttttttttttcttggcgatggagttttgctcttgtcgcccaggctggagtgcaatggtgcaatcttggctcactgcaacctctgcctcctgggttcaagcgattctcctgcctcagcctcccaagtaactgggattacaggcacccgccactatgcctggctaatttttgtattattagtagagacagggtttcaccctgttggccaggctggtcttgaactcctgacctcaggtgatccacccacctcggcctcccaaagtgaagggattacaggcatgagccactgtgcccagcctcttcctcttcttctttttttttttttttttttgagacagtgtttcactcttgttgcccaggctggagtgcaatggcatgatctcagctcactgcaacctccgcctacaaggttcaagcaattcttctgcctcagcctcccaagtagctgggattacaggctcccaccaccatacccagctaatttttgtatttttagtggagacgggatttcgtcatgttggccaggctcgaactcctgacctcaggtgatctgccagccttggcctcccaaagtgctgggattacaggcgtgagcctccatgcccggctttcttcctcttcttataaggacaccagtccctattggattagggccccacccttataacctcatttaaccttaatcaccttcttaaaggccctatctccaaacaaagtcacctattgaggttctgaaggctggggcttcaacacatgaaatttgtggtagacaatttaacccataacagaaggactaaccaagattatggttagtgacagcactgaggctgaagacggacagcccctagtgcctccttgacccccaagaaggaggccctcagcggaaggrtgtgttttctcaagtccacagcttctgtgcctacatagtaggtgctcaataaatatcttatggatcccaggggttctaactgcaatctcctctcagtgcaatatatacattttcccttccctaaatgtaatgactggggcccagagtcagcaaatgattcacctgcgattacacagtgacttggttgcagagggagggctagaacccaggtctcctgcctccaaacccagggctctctccaccacccccaggtgggcctcctgccctcattgctaaaatcagagaagagggagcaaatctgtgagtctgggagtcagcaccgactcatttcctcttacaggatatttgtatttaaatctgtgtgccaggccaacgaagagaaatcgaagccatgtgtgtgcagtgggctcccagcagcctggagggctggggaggtcatggacctgaggccgtgagacagggtcacactggggagggctgattcatttggcctcctgactttcctatcctcccacccgacttcattttgtgatgctgcgattgtgtgtgtgtgtgtgcgtgcatgcacacaagcacacacatgcagaaaatttgaaagaattggatgaggtttctgcaacactaagctaaactaactagtgtctgcaaactaacatgtgagttttccagcctcaaatcccaaatgaaagaaatgccaagttagctcgtgtcttcatatctgagttataatttggaataaaaatgaaagtgaaatattcttaagatgttgagaaaaaagtttttccattctgtttccagaatagagtttaaaacaatgcagccacagaggcggacagctttccgtggaaaagagtagatctttcatggatggttgaagttgacaggcaggcatcctgtctttcagggctggggctgggaatggcgtttctgacttcgccattgatgggctagctggtgcttggcatgtgactgtcatctggaactgtgattttctcatcagctttggtttgctcatatggagggagtagcatgtgttaggagtcccatccctgccaactgtttcatacacattgcagcatttcatcctcacacccaccctgtcatgtgggtattaccatcccatcttataggagggaaagtaggtacatgaaggcactcagctttgaaggatgaagctggaagacaccaccaactcttctgcctctgtggtgatctttgcagttttttgagcaaggataactgcatgatcttcggcaagacctttaacatctctgtactttggtgtccgtgtctgtaaaggagactgttggagaccagaatatgccaccccaaaacatgaaggactgttgagccaaagacaactaagaagtggatgcaggaaggctctctgccctccctctatttgcctaaaagcaggacatagatttacaaagacaagaggtattccacctccactctgcagggagaacaaagggtaaccatggaagacaatgttagagccctattgtctggagatggcaccaggtccagcttcgttaatccaccttgatctgcctgttattgccttcccacaagtggctacccctagagactcaaagtcctttttccctttgtcttgtcactgtctaaaaatgtgctgggtttttttgtttttgtttttgttttttttgttgctgctgttgttgttgaagatgctatataagctataagcaggaatccaaagccaccttgagaactactcgttccctggttgtctgccatatatatgtgaaatatacttgataataaacttcggtttgtttttctcttcttgttagtctgtcttttgttacaggggtctgctccaactaagaacttatgaggattgaagaataaattatttttcttcttatacaggatcatgatagtatccactttagggcgttgctatggggattaaataaataaagccctggcgctttattaaatcaaaaaggtggcacctggcacatagtaagcactgaattcagtattagctgccaccactagtcctatcatccttcaaatctgcactgtgaagggtggaggcaagtccctttggctataagcaacaaacaccaactccggctaacagaagcaaaaaggcaagctctagggagactgtcctagctcttagattcagggaaaggctgacaaaccaggcttcagaaggacaggacctgcatgcctgggaggatatggggaagttgagcaactcaaagcccatgctggtgtcagtcagctccagctttccattctgtgtcacacctctttgttcacgactgaagtccaggagagggagaaagaggctgtataagtttcccattgctgctgtaacaaaatgaccacacatcagggacttcaaacaacacaaatactttctctcttacagttctggaggtcagaagtctgaaatgagtttccttggaccaaartcaaagtgtcagcaggcccgtgttccttctggaggctcgaggggagaatctattccttgccttttccagcttctagtctctgccttggctcttggctcatttctccatttccaaagtgagcagtgtagcagcttctctcctatctgacttctgcctccatccttacatcttcctgttaagagacttgtgattacatttggtctttgtagttaagccagaacaatccctcagctcaagatccttagtataatcacawctgcaaaatcccccttgccatggaatttcatgtatttgcaggttcctgggactgggacagggacatgtttgggagccaccattctgctgactgcagtggccacccaagtcctttaatttacatacctaccgctggcaacggcctatgtcagaaccactgggagggcttgttgaaatgcggattgctgggccccactcccagattttctgattcagtgggtttagggaaggacctgagaatttgcatttcttatggatttcaaggtgatactgatgctgctgttcctagaatcacattttgagaccccctgggctaagagaaggtagaattccttgacttggtttcccacagagcccacatatttatggggagagcaatttcctaaaagatccatgggaagcagaagccaggagagagggaagggttgcatgtggcagggactcccaggtccagcttgttaggggcttctgctctggaaaaatgtgtgatgcaccaaggaaggtctaagaggaaggtgctcagaatgatagaggagggtagagagaggctgaccgggatcttggtggtcactgagacccacggggtggtgggtcccgagtcctggctgggtgctccatggcctggccaccagtgctctgcttggaattctggctcagtgggaccctgtaccgtgtggtcccagagatgctgttattgggacaattttgcctggatcttggagccagaaaacaagccagagggagaatctgcttttaattctcagaaacgaggaggttggatcgaatgacctgtgggaccagctgacctgcctagcctgcgatcctacacgctcgagtcccaaagctaatgatgtcatagccctgggctgcgtccgatctgtgtagttaggttgatgggattaatcagctcatgttaacaagctgatgatcatgaaataaagatgaccatttcaataggatactcggggctgagggactgaagtgaaatcatttggacttctacagaggtcatggttgaattatcacaaaacttcctttactcaaagcagatgcttattaagattaatttagtgtgaaaagtgaaccagactgagtayaaaggacattgtctcctcaattatgtaataagacacctcctcattgtcctgtactcactgaagatgattgtgcatttcctcagggacatttcagcgcggtgagctgagccactgcgcaatccctcttttggggatgttcaatgaaatctcagtgttcacacaaagacaaagtgggcagagacaaaagggaacatcaactgggaaggggaaaagggggctgaagacagaacccatctttctgctaaaaccacacattcagcaattccagagatgtccsttgtctgaggatgaaaaaaagaactggggaatgactttgccttcttataatgatggtttgtgccagtgacggctcatggcagtggtcccagtatcttgggtccagagaggctgaacaggaccactggctaggaccacagctattggacctacgtaggctctaatcgtctttctgggcctctgcggggttggtcaccttctcactttttgtttttttttaacgtcagtaagttctattcctcttgtttgtctgtgttacaaaaaactccattttaaaacgtttttctctttgctccctagacttcccctgcccaggctctcctcccactttttggcttcctctcctagtcccttccctggctcctcttccaatgttgattgcatgagtattgctgttcccagggctccagccagtctcagctctctatttctactcatggaaacactctcttcctcaagttagttcatccacccacatggcttcttctgtcattttaagcctagagatacctgggaggcagtacagtacctcccagtagtggtatttttatttaatgaaataaaaccaagaatctcccaggtcagtactgagaggagagcttcttggtgaaatggggcagctggccacatggcccttgtctgagttttattttctttggaattcttactttctaactccccactcctctggggcatgtcaggaacaacctgctttcttgcaaatgtctgacttactaagtagaagcaaattcctttcccttagttttcctaaagcatggttgagatggaaagaagctttcttcatatgttctaagcacaaaggaaaacacaaagaggaaaacacaatgagatcaggaaaggtaaacaacttggcttacaaggtataaactaacagagcttgtatgaattgtctgttgctgtgtaatataatttataacataaagtttaatgtataacataatcacatattatactaatcatttccatgggtcaggaattcaggaaggccttagataggtgcttctcacttgagattttgcatgcagttgcactcatatgccacttggggctgcagtttcatctgaaggcttgactgtggctggaggctacgtttccaaggtggttcactcacatggccagcaagttcttgctggctattggctggaggcctcatctcctctgcccatgggactctccacaggactgcttgagagtcctcatagcatgatgactgactttccttggagggagccatcattgcaggagcagcaatgcttttcatctaacctcagaagtcacacatttccattttcttaatatctgattggtcacaaagaggcagccctgattcaatatggcagatgactacacagggcatgaatattgggaggcagagatcactgggcaccatcttagaatttggctatgacgtgagccaactttttcttcaggatttgcaggactgtcccactccatgaggatccctgggaagagaagctttttagaccattactttttgatttcacccatagccacaagttaagcactaacttgctgagagcatttagggccaccccttctccagctttatctttggacatcagagtggatgattaatcagtcttacttctcaacttatggtatactttcatcctttgtctatatgaggctccttttttgctttattcatttattcttttttttttaatctccagtctatacttgtactctctctcttgcaccccctccctgagaactgccacaggcaatcgctttgaaatgtttgatggctgtccttgcgtttttatgcatgcttataagtatgtagcactgttttgtctgttcatggatttgtctgttcatggagttttcatgaatattgaactaaaagatttattccgtatctcattttgttcattatctgtgcactccaggaaggatgtctgttacatttctgtcatccatcttcctagtgatggatggatacccagattacctccaaaccctctgttataagtgatacttcaaagaatcccttgtcccttcaggttctgagtgagtatttctctggagtttccatccaggtgagggtccctgggaaggcatgctcatactccatgtgactacaaaacagcaggcagctctccagggcactctcttctcccagactccagtccaaagaaaaaggatgtctgcttatctcccttccagccttcctgctcaggtccagggttttgattgagaaatgcagctcctccaggaagccagatgaactgtggcccacacagggatgacagttcacccttacaggtgcatttgcaggatataccctcacatggcacccgacatctcyagaaaatgactgccattgccgtgctctgagaaggcatttcctcctgctcccaactgcatgtttcaatcccttacctctctgctggaggtctgacctgtttatcccattccctgcaacacatccccctttgaatgttccaaaggcccctcagctgcaacttgttcatacgaagactctgccttcatggcaattagttgacccaatgattgcacaacatattaggtatacactgaaaagaaatgaaaacagatgtctacacaaaaacttgtacatcaatattcatggtgacattattcttttttatttttattttttaaaaatggagtcttgctctgtcacccaggctggagtgcaatgatatgatctcggctcactgcaacctcagcctcccaggttcaagccattctcctgcctcagcctcctgagtagccagaattacaggcgtccacctggctaatttttgtatctttagtagagatsgagtttcaccatgttggccagattggtctcaaactcctgacctcaagtgatccacttgtctcagcctcccaaagtgctgggatcactggagtaagccacagtgcctggcctcatagtggcattactcttaatgacaaaaaaaaaaaaaaaaaaagctggaaacaacctacatgtccatcaactgatgaatgggtaatcaaaatgtggtctatccacaaaatggaatattattcagccgtaaagaagaatgacttactgatacatgttacagcatggacagactatgaaagcatcatgctaagtgaaagaagtcaatcccaatgactccattttcatttcatttatatgaaatgtccagaacagacaaatctatagaggcagaaagtagattagtggttgcctggggcagagggggatgggagaccatgggtaatagctaaaaaatacagggtttctttttaggtgtgataaaatgtcctaaaattgattgtggtgatggttgcacaactctatgaatatactaaaaacccttgacttgtagactttaaataggtgagttgtatggtatatttagtatattttataatatactactgttgccagaaatatggtgtagttggctgggcacagtggctcatgcttgtaatcccagcactttgggaggcaggtggatcacctgaagtcaggagwtggagaccagcctggccaacatggtgaaaccccgtctctaataaaaatacacaaattagcttggcatggcggtgtgcacctgtaattccagctactcatgaggctgaggcaggaaaatcgcttgaaccagtgaggcagaggttgcagtgagctgagatcatgccactgcactttatcctgggcgacaagagtgaaactctttctcaaaaaaaaaaaaaaaaaagagaaatatgatgtagttgtgattcaagcactggtttggataatttaacacagtgattccactattagatatatactgaaaagaaatgaaaacagatgttcacacaaaaacttgtatatgaatgtccatagtagcattattctttttttttttctcacttcatgggacccatgttctgttcacccattggggtgctgctcaagttgaaagcaactttgaaaactgccttccacatgtataaaaccctggcataaatccttgtgccgtaaggaactttagcaagcacgttgtctgttgcctactcattttgcagaggaagaaataaaaactcagaaatgtcaggggacctgctgatcccatgcagcaggtttgcaacagagctgggactagacccgctctatgcctgacaatttctgctgcttaaacatttaagtagaagggtctggtcctcatccttccctccttgcaaagtgagacccgaactgtagccctggaggcctgaaggaatgaggcaggggtaaaactgtgctctggccaagaaacttgttcgttacaatggagaagcaaaccatgtctatcgccttctcctgagcaggcacctctgggcccctgaccccgtttgaaaccacagtctgaaacacgcttcgtctttgccaggacagacaaaaactcacattaaagaagcagtgggctgctgcccacgctgaggtgaggagtgggcaggaggctgggatatgcctccactcccaaggggcaggggctggccaaggccaagggcaggtgcagatggtgagcggggaggtgagccgagggtcactccaaggagagtggggacttttgtccctttttgtcagtgggaggctgggctgggagaggaggcaaggaacagcacactgtagaaatggagagtgaggaatgggagaggcccagagctcagtatgcaagctgtgtacagcggaggttgccggactgtctctgatgggctgctagtggggtggtgctggggaaggttgactcgctaaaagaaaggctgctgcagtcacatgttatagggtacatctgtgagaattagggaaaggaaattgctccgtgtcaatgcagtcttacccagggcacatggcttggggatgatgtatgaagtggactttagttccctgggtttagttcccttgttgtgcagtgcacggcttggacaaatacatgggtggccttgactaaaaggctttggttcaaccaggtgcttttctcatcgcagcttaactcctggcttcctaacactccccatgcgaggcagccccaattcacctctaaccctgggaggtgccaggaaacagagttggagccgcatctactgcttgacttctcaatgcaaacttaactattttaaagtgtacagttcagtggcattcaataaattcacaatgtcgtgcagccaccacctctgtctagttccaatacgttttgttattgcctcaaaggaaaccccgtacccacgaggcagtcactccccattcctcctcctccagcacctggaaactactaatttgttttcttttcctataagtttgcctattccgaacattttgtataaacagaatcagaccagatgtgacctgttgcatcttgtttctcccgcttagcatagtggtggaagattcacccatggtgtagcatgcatcagtacttgactcctttttatggccttaggacaggccagggcatatgtatcccacattttaccacattttgtttatccatttatctgttgatggacccctgtgctgttcccatcctttggctgttgtgaatagtgctgctataaatatgcatttacaagtttttgtttgaacacctattttcagtcctttggggatacagagccaggagtggaactgctgagttacacagtaattcaacatttaactttttggaaaactgccaaactgttttccacgacatctgcaccattttacgttcctgtcaacaatgtgcaaaggtttccatttctccacctgtgtcaacacttgttattttccattttaaaacattatagccacccttgttagagtgaagtagaatctcattgtggtttttgatttgcatttccctgatgacaagtgacattatacatattttcatgtgctcattggccacttgtgtgtcttcttcaaagaaatgtctattcaagtcctttgcccatttttaaattggttgtttgtctttttttgttgagttgtaagtgctctttatatattctggaggctgactgacttttattcttctaagtcaaaggtgctttagcccaagtcctgtcactcaaaaagaaggctgggtgcagtggctcttgcctgtaatcccagcactttgataggctgagtcaggaggatgacttgagcccaggagtttgagaccatcctgggcaacagggtgagaccttatctctataaaaaatgtttaaaaaattagccagggacggtggcatactcctgtagtcccagctactccagagattgaggcatgaggattgcttgagcttggaaggtcgaagctgtggtgagctgttgattgcaccactgcactctagcctgcgtgacacaaccacactgtagcctgtctcaaagaaagaaagaaagaaaagaaagaaagagagagagaaagaaaaaaagaaaaagaaagaaagaaagaaaaagagagagaaattctaaacataaatactatccctcccttgtttactctcgaaaatgtcaacaagctgctgggcaattctgtgcctcagtttcctcatctgtgcaatgaggttaataatagtacctgtttcctagggctgctttaaggatcggatgggatcatgtgtgtaaggtacttagaatggtgccagttgtacaatgcaaggtcgccataaatgttagttattgttattgttatcattataataaactaggacaatcatgatcatggacagcttcactttaggtcctaaggcygggcagaggtgagggaaatgaccccatttgtgaggtcctattatactctaatcacttccgttatattttttagatttctcctccccacatcyctttgaggtagataaaatggtgttcatttaaggaaactaggctcagagaggttgggtgacctgcccaagatccacagctcatttgtaagaacaggatggacatggatcagctgcccaggtctctccccarcccctttccatggtggcctgcatctggcagatcaaggtaggggtgtcccggctctgccagcatggcccaaagcaggacaatgctgaagagctgtcccagctccagaagcagccccaggatcatccaaggccatggctggacctacactgcagttcagcttctctctctgtccaatcctgattccatcttctgtctccgaaataagcatcctgctcatgcatatgtaggtgtgggttggactgacagctttctcgggaccgagaactttcagcaccaaaactgggaatgtcctgggtctactgggaagagttggttccctgtgcatgctgaactccaccagagtctgcctcctggggaccccttctgtgactgcagctcacagcgagctcagtctggtgctcaagatcaggctgtgtccgccacgcaccccagagaagttgtagaaggaaaagagaagctcagggctgctgctgctgtccactttgctaccttatgctgtccagcttggggcaagactcggttctttcccagattgaggtgaaagtcatcaaggcactagaaggtgaacgcgcgaggtccagggctgggctgctgctgccgtgttcttagctcctggcacgtggtaggggctgcaaattcgctcaagaggagggctgctcccctggccccgacagaaggtcggggagcaggaggcccaggcagtacagcctgtcacctgtgcttcatagccaaacccccaggcttttctggagatttgaaaagcagctgaaatggttttctgaatatccctcgtctgtccgcttaggctccaattgcccaggccgacttctctgttagaagccagctgatcagtttgctacaaagctgtataaacaagataaacgaagctcactgttcccagattgtctgtaaggttcccctcatctcttttctctcttttagaccctgggtttttttctctttgttgtttggggttttgtgggggttttgggttattttctgcctttgtttcctgacaatagtgtatggctatctcccttatgtgtgagtgtattgtcaggattcttcaataggatatatacgacatataacataagacatataacatgtcgtctacatcctagtatatgttatatatcccataaagctattatatattatatatatcctatatatataatatataacattacacacacacacacaaaataagaaattggctaatttgatgattatggaggctgaaaagtcctgacccaggaaacccaatgtagagttccaatctgagtctacaggcctgagaaccaggagagtcaatggtgtaagttccagtccaagtctgagtctgaaggtcagagaagactggctcaaaggcatttagacagagacaaagaattatttctgactcagccttctgttctgttcaggccctgaactggccggatgagaccatccacactggggtgggcaatgttctttcctcagcctacggactcaaatgcaaacctcacctgaaatgccctcacaggcacacccagaaataatagttaaccaaacatctgggcatcccctggcccagtcaagctgacacataaagtaaaccatcagagcgagtggatgggcatgcagcagtctaatctgaatgcgtctgggttgttctttggccatgctcaatacacagttattgactattgacccaatgaccagttactcaaaggggcaattgtatcagatacctgatactgttaggatgtgggatttgggatggacaatctcagggcgagttgagagtagttatagtcccagaaacttggatctgtctctgggttggaccatgtaccctaaaaacttcatgtccacccagaacctcagaatatggccttatttggaagtaaagtcttggcagatgtaattaagatgaggtcatcctggcttagtgatgatgtccttatcagaaggggacacagatacacatacagagaagacaatggcatgaaggcagaggccgagtggagtgatgcagccacagccagggaatgccaggaacctctgggagctggaagaggccaggaaggatcctcccccggagcctctggagggagtgtggccccaccgacaccctgacctcagccttctggcctcctgaactgtgagaaaataaatgtctgttgttttaagtcccctagttggttgttgcattattccgttttcatgctgctgataaagacataccagagactgggtaatttatacagaagaaagggtttaatggacttacagttccacatggctgcagaggcctcataatcatggcagaaggcaaagaggagcaagtcatatcttacatgggtggcagcaggcaaaaagagagcttgtgcagggaaactcccccttatagagccgtcagatctcctgagacttcctatcacgagaacagtacaggaaagacctgccctcatattcagtcacctcccaccrggtccctcccacaacacgtggggattcaggatgagatatcagttgtcattccttgcggcagccctagaaaattagcacagcctccttcttgcataagcatccactgggcctttttgcccctcaagggtgattgcctgatgccatttctctttctggaacactccagcagtttggcaagattcccctgtcaggggcctttcccccttacctatagatgctggatccctagtgtctggcttggctggattttagtagacctttttttatttttttatttcacagttgcttatcagggcaggaggttcagattaactttgaggaatcatttgtatttgagataggaaaggcctgctaactttgaatgactgcagaggggagctgaaatcagaacccatttgggtccttgagggtcataagagaagttttcttgcaggggggcactgctgagcaaaaccccgtgacctggggaggtttatggtgcccatcttgcagaaggagaagtcacacacaaatgcactgggatctgcaggcctccagtccctcccagaatgtaagctttgctatttttttcttattacaaaataaatatgtattcactgggagcaatgcagatgagaactaaactttttttctttaatcttgcccaaattcctatctaaggggtctggggagtcatgccctacaaatcataaattctcatcagatgggttttatttaaccctatatatggtgacttactttccatcctgactggtgtatcattacaagacaaggaatcaaaatattttactccaaaacatgtttmtttgccatattttgaaatggccctgcaaagctgttctttatgggggaaaatttgcatctgtaaagaatctctgttaacacagctagaactttttcttccagaccctcccaatcctgaagagactaactaagatctgaataggaaacatttgtcatctattgtctctaagggcagccactataagacttcaaagaactttggtctccgtaatgtttatcttaacctgaacattcccttcctgtcaatctcaggtctttagacaaactcaatcaattgtcaaccagaaaatgtttaaattcaccaatagcctggaagctcctgctttgagttgttctgcctttctggaccaaaccaatgtatttcttcaatgtatttgattgatgtctcatgcctctctaaaatggataaaaccaagctgtaccctggccaccttgggcacatgctctcggggcctcctgaaagctgtgtcgtgggccatggtcactcatatttggctcagaataaaccttttcaaatattttagagagtttgactgttttggttgacacagaccataatcataaaggggtaaaaatgctccttactgtcttgctgcctaacatgaacttcctagcgtgaacaccgcatcggctgttttccaattcctcctgtgtgctcatccatacccatagatgccttctttgcctgttttgacattaagaaccgtgtgtactgcacataccatcttgtgagctgccttttcacattatgacatattgtgcacatcattccatgtccataattatgaactgacatcattttatttatttatttatttttgagagagagtctcgctttgtcacccaggctgcagtgcaggtgcggtcatggctcactgcgatctcaaactcctgggctcaagcaatcctcccgccttagcctcccaagtagctgggaccacaggtgagcgccaccatgctcaatgaatttttttactttttgtagagacaagatcttactatgttgcccaggctggtcttgaactcctgaactcaggcaatcctcccacctcagcctcctaaagtgctaccacgtccagcaatatcaacattttaagtttccaccacagcctaccaaagtgctgccatgcctggcaatatcaacatttcaaattgctgcgtagttcattgttgccggtgcctcctttctttcacactcccctgctgttgggtttttagttagagtgtgcaggtggggaggatagacacgtatctggctgaggagtttcagcctgaaaccagtcagtgttaaattgcttttccttatgactttgttttcctagatatgaaatggaagcatctgtgtttttgctgtgatcagagtgacaatatgctatagaaatgaatgagagatggcgattagctggttagaaagtcctggattatgagttcaaagttctcaagtggggtgtgtgtgtgtatgtgttgtttggtgatctttccttcatcaaggacaatcaaagaggaagccgtatggaagcatgttgtttcctgttgggtaggctctagcatttgcttgtgttctatctccaatgggcaagtggggagaagggagtctatctccaatgggcaagtggggagaagggagtctctggaccctggagcactgctgtgtttaaagttcaaccacaacgactagctgaataaatgggggatgagaggggggttatctgagcttggtttgcctccgtttccccattgaattagtttcctgtggctgctgcaaccaatgacaacaatccgggggtcttaaaacaatggcgatttatcctctcacagttccaaagacagaaacccagaatcaaggtgtcagcagagccgtgctccccctgaaacctccagggacaaatcctccccagcctcttccagctcccgtgggttgccggcatccgtggcgccctttggcttgtagctgagtcactctgatttctgcctgtggtgtcacatggccttcttccctctgtgcttctcagtgtccaaatcacatttttttttttttttttttttttttttttgggatgaagtcttgctctgtcgcccaggctggtgtacagtggctcgatcttggctcactgcaacctctgcctgccgggttcaagctgttctcccaccttagcctcccgagtagctggggttacaggtgcgggccaacacatccagcttattttttgtatttttagtagaaacggggtttagtcatgttggtcaggctggtctcgaactcctggcctcagktgatccacccgccttggcctcccaaagtgctagtattgcaggtgtgagccaccgcgcctggcttttttttttttctgataaagacattagtcattggctttagggcctaacctaatctaatgtgacttcattttacctcgaatacatctactaagatgttgtttccaaataaggccacattctgaggtctgagtggacatagattttggggggacacttgcttaaccccctrgtaacattctttaggaggagatgtaatttggggaattagttaatacacagaaaacacttaaaacagcaactggcccaatgacatcctcaaaaatattggtggatgcatggttgagaccttcgaaagggctcaggaagctgatatggaactccccggggaaagtcacctcctgaccaggcatcccccgagtccccacccccaccacaccttttgagtctttatgtctcatacaccagaatattaggttttcctcttgcaacccttccattaaagaatggttttctggcgagttgtttatgcgtggaaaatacataaaaatttataaaataaacccatttacttccaggcgaaagttagcgttttgcccggagtgaatttttgtggctgagctataaaattccgaaaataagtgtttctaatgaaactgcgctaccctttaatgaatatcaccgccctcgctataacaaagaatgtacaatatttggcatgatgcactctggaaaaatcgcttaatatgtaatgtgagtgatggctgtctttgtgagccaagctctgttttcattttgtgggagtaattcagctcaacaaatatttttcaagtgcctaccacgtcccaatcaccgtgctaggcagtgggtatataaagttacccccaaccccaaaatgagtggggggtcctgttttgtaaacactaatgagctcttcaatgggcacatgctgggcaccctgctggtgttttatgcacattaacccatatcatcctaacagggttccggcaagggaggcccactgtctgtatccccatttccagatggggcacagaggtcaaagaaatttgcccactattatgcagccagcaagtagacagtcagggttcaaatccaagccgtcggttgcagagtttctgttcttaaccgctgtcccatacagcagcatcagagtcacagcacagggaggtgagttcaatgctactggggtcagcccagggactgcggaggcacagaggaggggcacccctcccacatagtctagggggtgcagagaaggcttcttggaggggtgggtatccttatggggaattggagccggggccaggaagaggagaggggacaagcgacacaggccctgagcttaacgacagcatggcgtgtgtgtgcatgcgtgtgtgctcgcgtgtggtaggtgtggcaggctcctgcatcgaaggtgggagataatcaagagatgaatccagagaagtgggcagacgtcagcccgaggcacagcgtgggcgctacccactggaactcaggaggagggcgggaaggaaggcctgagtcagggtttttaggaggagcagtaattcaaacatttcaggatatgccgcctggaggttctttgcagggatgagggaaaaaaaaaagaaatatagacgagaaaaaatacagattactatttcaaaattccacctagcctggctttttttccctctgtcattagatctatttgtgccgtctacttaagggtggagggtgggaggagggagaggagcagaaaatattactattgggtactgcactgaattcctgggtgaggaaataatctgtacaacaaacccgtgtgacgtgagtttamctatgtaacaaacctgcacatgtgtctccgaacctaaaataaaagttaaaaaataaaaaaaattaaaraataaaaaggctacagagcattagaaaaaaaaaagatctatttatgcccatttcatcatttagcccccaaagtctgaggttcttatgttttttgttgagtgcgggatgttcctgctgacatmatmataataataataataataataataataataataataataatactatcagccaggcgtggtagctctcacctgtaattccagcactttgggaggccgaggtgagaggatcacttgaggccaggagttcaagaccagcctgggcaagctagcaagacccaatctctacaaaaaatacaaaaactagtcccagctactcaggaggccaaggagggaggatcacttgagcccaggggtttgaggctgcagtgagatatgatggcatcactgcactccagcttgggtgacagagtgagaccctgtctctaaataaataaataaatatgtaagtaaaccaacacttgcaaatgcttcttatgggctgaacattgttgcaaatatcttacatgtttcaactcatttaatcttcgccaggactctgcgaggtaggcaccactggtatccccatttttagatgggaaaatctgaggcacagagaggtcccccagcatcatgaggtaggaggggttgagttaggatctgagtcctgccaaaagctccttccttcagctccatcattgctcctattggagtcttcccataggcaagccataccacgcttgggcgtcactggcaggattcaggtgagctgtggactgaattgcgttccccacaaattcctattctgaagcctcagcccccagtgtgatggtattaggaagtggggcctttggaaggtgatccggttttagatgaggtcatgaggctggggtctcaggatgagattagggagcttgctctctcaccaccatgggaggacacagcgagaagacggccacctgcaagccaggaaggggcccttgccgggacctgaccgtgctggtgccctgaccttggatttccacctgcagaatggtgagaaaatccatttctattgtttaagtcacttgatctgtggtgttttgttacggcagacagagcagactaagacaaggtgttccaagacactgaatctagtagccctcagagtggctactctgatgcaagctcgccagctgcttctggctggagcagcctccgttgtggacccagtgagccactagataaaatatatgtgtgtgtgtgagccatagccagatcaaggccgtgcttcagtgtgtcctgctttagaataaagggtgttgttaaactcatgacaaatggtactttctgttggaggtgtgaccttgggacagatactcaggggcaaaatccagctctgccactcccagggttctgtgtaaacttgggcctatttaacctctctgaacctcggtcctctcacctataaaatgggggtactgatacttatctctcagcattgatgtgacaattacatgaggtactctaggtaaagtgcccagcacttggtgaatgcctaataggtggtggggatttacattcatatgataaaattttcccttcaatacccagctcaggtgtctcctcacctagaaaccctccctggctctgtctgctgtcccctctgtgcctcacacacggtgatggccacgtcccacatttggttctgtgtgacctgctgacatgttcacctggctgcccagttgcacagacagattctttaacataaacagggatgggagaagggctgtagctatgtgccaggcagaggaaggaaggaaagaagggcatttcagaacaaggtagagaattgtgccaggtggcagtgactgggaggagaggggaagctggcgggtagggacgctggctgggtggcgtaaacaaggaggttttaggatgagcagggcactgggagctggggctttgtcctgaggacatgtgcacatacccctgtggggattcaagcggaaaagggcttgtttggatttgctaatatgtagacaggagccgtgactgcagcgtggagatgccccgtatgagtgagtgtggaaccagtgaggccaggcaggctgttggggtgattatggagaggagcctgatcccatggtggctggccatgaccagcatgccccgggggctgggagcacaactgtctggctgacacagaaagttcaggtagaggattagggtcgataattgccctccctggcaggcaacaggggtctccagacccctctccataggactcgactcttctctccccatccccagaggtgtgatggggaagcaagggctggaatttggaggcttttttcctttttttttttttttttgtcccgtgatcattagggttgctgataagtgggaattattaattaaagggataaagcgtgtgcttccaagggtgattaccattactgtaaatcagacttaatggctgcagaaattcattagggattcatttcctaatgataacgaattggtttgagcagatgtcagacacagccgtgaccgtaattctaatgccaggtgcaaggagggaaaagtgttatccctgccctatcctggggctgggactgaaaaatcaggtggcttcttggaactttgggcctcagccatgggtttggtgccacagcagccactggaacttgggcttctctggaaaaaattcccagccttcacgcttgctgtgtcttcttccaggagcaacgttcctgctaccactttccttgaacctcacttttcttggaagacttccctgactgctcccaggttgggtcaggggcccatctgagatcccgaagcactgagcacattgtgatgtcactgtcttcatcacccggactcccttggagccaggcactggcttaatcctatctccatttscccygtgcccagcacatagttagtgctccagatgatgggagactcaatggagagacacgtgagtggatggatgttttgctgaaggcatccaatgtggcagaaccggcagcagcaaactgattctgtctggaatttggaagccagggaggaacagcctcgaatggacagggtaggcccccaggttgtctggaacactgcrccctacttcaatctggcctccccaagtggacctttgtgagcccaggttcttctcccaggcacacagatgcctggacaaggcaggtcctggggctcatgaaattcccagraaattaacccaggcagcaggagctaaaggacaccaaaccagctgccaagcctgggtttcctcacctgtgaagtggggtctcagtcgtcattgtaaggtctagatgaattaatatacattaagagctagcacagtgcctggcacaggggaaacagtgaacaaatattagccattattatgattattattattttgctgaactgataagacagaattgccaactttgtgagcaggaggaaggtagataaggacccacgctcaggatgacagaccaggctttgaaagggtgcggtgcggtgcatatgggtaggaagggaaaaggagaagagaacagcaagtatatcccaagaggtgccttgtggtcaggcctcctggaaagggtatggtgtgccgagtcaatgcagaaggaaggacagacaggctgcccaagccctgcgcrgctcatgtagcgccaggtggcctggagtggcttaaaggtacagcctccgcagccctccagagcagctggatcaggaagcccagtgtcggtggggtctttacttaagcagacagaatagttatcctcaacacgtgacatgtgtctagcccccactgtgtctgctcgctccagccaagtgcttgcaaagtaattttattccaggtttgggtccttttatgaatgagtaaacgagcttggcaaggttgaatgacctgcccacgggcacttagccaagacgcaagccccatctgcttgcttccacaccgtctggaagcctcactggctgggttcaaaaagggaggggccaggcacagtggctcacgcctgtaatcccggcactttgggaggccgaggcaggcagatcacctgaggtcaggattttgaaaccagcctggccaacgtggtgaaacgctatctctactaaaaatacaagaattaggtgggcgtggtggcgtgcacctgtaatcccagctactcaggaggctgaggcaggagaatcacttgagcctgggagtgggaggttgcagtgagctgagattgcgtcactgtgcgcttgggtgacagaacaagactccgtctcaaaaaaaaaaaaaaaaaaaaaaagagggagggctcctctccagacatcaggctagttttgtgcatcccaaagggaggaaagtgctttctgatattgtacttcctttgcaagacctggacttaaagtttgggtccttggggattgccaaaacctcttgaaaatgtaatctgtaagtatctattaacattgagaaatacacattccctttgatccagcaatcccacttctgggaatctctcccacagaaatgaaaaccccaaaatataaggacataggaacaggatgtttattgccacactgttagtggtggcagaaacctggaagcaatctgaaagtccaccggaactggaaaggttaaatacgttatgatacatggctttttggaataccagtctttccaaaattagatttctacataattatctggagggctcttcctgacatgttattaagtaaaacaaacaaacaaataaccagataaccaccccctgaagttggccagtaatatgaattatacaatgcctcttaaaaaaaagacaagttttgaaatgttatcctatttttatttatgcatagaaaagaggtgaaagatatttacaaacgctcacagttgcttgattgaggagggatgaaatagtgtgattaaggccgacatgcacaccactggtagagcgctgaatgctaagaccccaccactgtttccttccactgcttaacgactgtgggagttggtaaatatcctacccccacagaacttcagcttcagcatcagtccaatggagcgaatcatctgcctgcctcataaagcctcccaatatccatgttttagtgggaagacttatcactgcatcatccgttcatccattcatgtgttctataagccctggcagagcagccaccatggcctggccctgggaatgggcagagtggtttagagatrgtgaagatttatcctgtgccccctagaaatttgcagatgtgcctccactgactacagaggagagagagggagggatgctgttgactttgaaatcagagagggcttcctggaggaggtgatgtttcagctggcgcttaaaggaggagggagacttcaccaggtggagtgtgatacagatatatattctgaaccaagggaatagttgagggtgagtatggggacttgagacacaaaagtattttttgaaatctgggagtagcttgctgttgctagattttgcacggctgtacatgcctggaaattattaagagtggaggcaggaaggagactggagccaggttgcgtagtgcctgacactagaaaatataactaggagagagaacacacaggtagctgtcaggagccagccacgtcttaactcagtgagttctcacaacagtttttgttgttgttgttgttttgttttgttttgttttgttttttgagacagagtctcactctgtcacctaggctggagtgcagtggcatgatctcagctcactgcaacctctgcttcctgggctcaagcaattctcatgcctcagcctccccagtagctgggattacaggtgtgcaccatcacacccagctaatttttgtatttttagtagagacagggtttcaccatgttggccaggctggtttcgaactcctgacctcaagtgatccacctgcctcggcctcccaaagttctgggattacaggcgtgagccactgtgtccagccacaacattttgatgaaaggggatttgtcccattgtacagatgaggaaattcaggcacagaaagattaagacacttgccaaagggcaattggccagctagttgtagaaagagaattccaacccaggcaggcgtgctccggaggatctttggctatcacgtccaactgtctctgtgctgggcaggctgtgctattctcacagatggtcttgaccagagattttgagccccatgataacagcagctctgtctgtgtttctggtggcaaatccagcatctacagttgagccagatccctggcagagacctgcccattcttcagacttggaaaaaatgaatgaactttgtgagagagggagtactatgcccatttgacagatgtggaaactgaggccttggataattaaccatctgcccaaagtctcccaggagatggcatgcccaggatttctctactttccccatgctgcttcacagggctcacagcaactccgtaacatcaaaggtgttgcacctttccagatggggaaactggggtctgagaagtcaggagcctgcctgagttctcatggttaagtggaaggagagaatggtctcatttgatgatgttggatctggcctaattcctcaggcacgttgttctcgagacacatctggatctggttggggaaggcccctcgtgtggaaggctttctttccgagtgcctttttatagacttggaatgaaattctcctgtgccttgcagattccagcttgctgcttcaaagatcatttcttctccaaacggaagacagaggctttttgtttattttcacaacagcagtagagacgggtgtacctctcttagacatctccattgctgtttgaaaatgagtctttacatggttgggggcaggaaataacagttgcaatgggagaaacatcgtgagatgtgctttagctgtgatctcacttaatgctcctgacatctctgctgggtaggtattatgcccccatttgatagaataggagactgaagttcagagacagtatggttattgcccaagaacagatgatggaggcaggcaggccgtgatgttggaatatgtcttgcacctggtaccctccttagctgttttctatgtggctgctctctgggtccaggatgctttccacctctcttctggtccattgcacattctagtctctgtgcctcggatcttgccctctccccaaagccttcccctcgctgcctccagattttcccaaactatacatctctttagccattctcctgcttaaaacgccaatgagtctccaaaagccttgggaggaaattcagttcatcagctccacttcttctctttggcattggagcttcttaaaaataagttttcggctaggcgcagtggctgacacctataatctcagcactttgggaggctgaggcgggtggatcatgaggtcaggagatcgagaccatcttggctaacacggtgaaaccccrtttctactaaaaatacaaaaattagccaggcgcggtggtgggcgcctgtaatcgcagctactcaggaggctgaggcaggagaatggcatgaacctgggaggcggagcttgcagtgagccaagatagcgccactgcagtccagcctgggcaaaagagcgagactccgtctcaaaaaaataaataaatraaaaataagttttcataggagtctccttttagagagaggattttatgacagaacagatcatgagatagaacaataaaaattggccaggtgtggtggctcacacctgtaatcccagcactttggaaggccgaggcgggtggatcatctgaggtcaggaatttgagaccagcctggccaacatggtgaaaccccggctctactaaaaacacaaaaaattagccgggcgtagtggcaggcgcctgtaatcccagctactcgggaggctgaggcaggagaatcgcttgaacctgggaggtggaggttgcagtgagccgagatcgtgccactgcactccagcctgtgcaatagagcgaaactccatctcaaaaacaacaacaacaacaaaaaacccaaaaattagtcaggcatggtggcatgcatgtgtagtcccagctacttgggaggctgaggcaggggaatcgcttgaacccgggagacggaggttgcagtgagctgagatctsatcactgtactccagcctgggtgacagagtgagactctgtctaaaaaaagaaaaaaaacaagagagtaagataaaacaatactaataacaagccgaatggtatcacagatttataccccactcctcaaacaggtgaagaaaacgaagcttctatatttccggtaaatggcctaactatgctgctgggtagctgtggaaagggagagggacatacaatttgatggtcatgatagctccatccctcccacaattcgttgtctgcttagtctccgtcagctgtgtgctcagatgtgcagagttctcctcctatctaagatggcagccacaaggattgggggaagacatggagcagtatctgggcatgcaggtcattgggctgtccctggatcttcttagctcctctctggcatatccagtttggtatgacttggctcctgggcccctgtgtggagtcccgtgagaggcagctgagtccaactggccttttggggtatcatcagggcactyttgcaaatagtcttggccatttgctcctgccctcaaagtccctgaattccatggctctgtccttctgacttggactctgctggtcccctggttctccctcacctcaccagggcacgtgggaacctgcatcctcattgatcatggagaatgagcagcacctcctcagggccagtgtctagayattctctttgctgatgccgcactattgctttcggccatatattggaagttgaaccaaatgcaatgtgcagcttctcctagaggcttggagtctcctctggctctgtatgagcaagcagctcgtaagcctaatgctctctagttttctcaaaattatttacatacttttacctcaaggtcatgggcacgtcctgtcctacctccttcttcctcctcttagagagccaggtgggttttatcttactccccttcctgtctagcaagaacttctaggtcaagccctcttcttcttctcctattccctaaggctctaaagcagaatggctcacaggcaacaacatttgcaataaggtagagaggataaaaaacacatctctatgatacatccaaatattattcatgttatagtaaatcagatgaagccttgagcttctcagcagccacgtaaggcttaaatatgagggaacaggggctcttagaagtgaagtgacttctgaaagatgcacagagaattaggaaagagtctgaattcaaccctggaaccctgactttcaggtgagtgcctggcccactaaagaatgacaaagccatggggagtggcatggaaagcatgagctttggagttagacaggcctgggtgtgaatcctggtcaccccagttctgttaaagacctcagaaaagttacctagcttcattaagcctgtttcttcagccaaaaattaatggtgttaacgcttacctctcaggatgggggtcacaaataaatagaacgacataaagtacataatacatcaatcagttaggatgtatttggctacaggcaaaagaacagccctcctcaactggcttaaccaacaattaacctattatcttacataaaagggagtctagaagtagggatgttccaggtttggctaatccagcagctcaaccatgtcaacacagaccgggttttctctgtcttgcctttttgccattctcagtgctttcatgggctccctttatgcttgcaatatgccagctgcagctccagacatcagcttctcacatacctatgtccagaagcagaagaaggacatttctcccttgtgcatttctactgaagactaaatatttcctgcttggcccctatcagtcttctcctcaagttttatttgctaaaacaggtaacatgttctgggtatctgtagatgggtcattaaaaaatcatcccaaaatttagtgacttataaccacaaagataatttattttgcttacaaatttgcattttgggcaggagtcagcaaggacaacttgattttgctccatttctaagctgaggtggttcagctggaaactggaggagggtctgatttcaatggctcatttgcatccctggcaagctggtgctggctcttggctgggayctcagttggggctgtgggccaaggtcttggttcctgtccatgtgtacttctccacaggctgcctgggcttcctcacagtatggtggctgtgttccaagaacaagtatcccgagagaaccaggtggaggctgtattatctttatgatgtaacttcagaagtcacattgaattcttactccatagacacaagcctacccaaattcaaagggagacaacctagactcatcctctcaatgggaggtcacatagttgaagagcacgcaggatggatatctactggtatgatcatttttggaaaacacagtctgccacgtatgcttacctcttaacaaattaataacaaggaggatgagctcaccatgtgtagttcggacctatctgcctatctggatttaccagagtaatggtggctagggccttggaagaaatggaaaatggctgttaggcaacccaaagtatttgcctgtaaagctgctcagcaaatgataacatgttattgtcactggtcatctagctctaagaccaggcaaatatgtattgagaatcctgtgtgcagctagttagagcagaaatgtcctccagaaagagtttctttttattttttatttttatttttattttttttgagatggagtctcactttgttgcccaggttggagtgcagtggcacgatctcagctcactgcaacctccgtctccagggttcaagtgattcttatgcctcagcctccctactagctgggactacaggtgtgtgccaccacccccagctaatttttgtatttttagtagagacagggtttcaccatgttggccaggctgggctcgaactcctaacctcaagtgatccacccgcctcagcctcccaaagtgctaggattgcaggcgtgagccactgtgcctggccccaaaaagagtttcttgagagcagctgtacatgctaagtttactcttctcctgcagttccctgccccattatgagctatcttcacggctttactttctctcatgcctgagggccaatgttttgttggtatgggatattctagtttgacaagttagtgaccagtagaggctgttctgaggcgactgctgccattgttctttcatggctgtctatttttcttgtagctgttttctggtgttagaaaattggattaagctttaatcacatttcctcctaaacacaaaagtccaaaattagtagcatatttctaacagacctcacttaaagccacatcaaattaaatagggccttttaagatgggtcctcctgtatgtgtgtgtgtgtgkatatatatgtgtgtgtgtgtgtatgtatatatgtgcatacatgtatggtgcagcatggattggaaaagtttaggaagtgaggtatgtttgtaaatactggaaagctcaaaattatttgaccctgtgatatttgacccatattcttgcaaattgtactcaacttggaattgccatcttatggatttgcagcccttaacccctgcatattgctttggaatttcattacaagctcttttgatgatgttctgtttttataaaccttgatgttatctgagcttgcataggatcaaaagctactgagggcagaagcctcctttgagacctcctatttagcccccagaactctctcaacttagacatggacaaactgaggctcaaggaggtgaaattaatttatctaagccacacatggtggtggtgtttgggttggatgttgaattcaaggctcctgatagcagaatggggaactagagtgcaagcatactttgaaggtacacaggcaggtctgaattccacaccaacctaccttacttactagctgtgtgaccttggctgggttgctaatttctttgcacctcagttccttctgcccctgcaaagtggggacaaatgtccttatctcagggtggttgcaagagtgaaatgagataaatgtgaggcacagagcccagagccaggctcctagaaggttcctgtcttagtccatgtgggctgctataataaaaatactgtagagtggatggcttataaacaatagaaatttatttcacacagttctggaggctgggaagtccaagatcaaggtgctggaagatttggtgtctggtgagggctcacttcctggtttatagatggcaccttctcactgtgttctcacatggcagaaggggcaagggagctctctggagtgtcttttttataagggcactgatcctcctcatgaaagcaccaccctcatgagctaataattccccaaaggccccacttccttataccactctgttgcccaggctggagtgcagtggcacaggctcagctcactgcaaactccaccttctgcgttcaagcgattctcctgcctcagcttcttgagtagctgggattacaggcacctaacaccacgcctggctaatttttttgtatttttagtagaaatggggtttcatcatgttgaccaggctggtcttgaacccctgacctcaggtgatctgcccgcctcggcctcccaaagtgctgggattacaggcgtgacccaccgcgcccagcctgggggttggaatgttgaatgggagaaggtgatgattgatttagttggtcaaagaccagattcttagtttcaggtgcccaagaaaaagtaagaggttctggaaggtgggtgtcacacgatgactgcacattcaggtatcgaagccctggcaggcggggagaataagaggctgcccctctgtgccttcgcccatgggaaatcttagactctattcatttgtcaagatcaactcaaagatcatgttcytaagaagtccttttatcctttctcctttgtgcaccttgggcattgtgcactgaattagggactatggttgactgcatgcaacagaaatattactggaggaccttaactaaatttttgtttcttcatataacaggaagtctagaaatgggaagacctggctgccatagcagctcagtggtgctyccagaggctcgggctccctgtgtctttctgttccatcatctgcagtacatggcacccattaacacggttgcttcctcgttacaagatgcatgtttcaccccaagttttctatttgagttctaggaaaaggaagaagaaagcaatagtaaaaacgatgtaaaagcttttctaaaaatccctggcaagctctacttacatgtaatcttagatttaagatcaaccaccaccctcactgagagggaaggcttatgtcctctccctttgaatgcgggtagggtctttgactgctctaccattagaatatagcagaagtgatgctatgctagtttctaggtccaggctttgagaaaatggcagcttccagttcttcttagaacccttgctcttgaaacctagccaccatactgtcaggcagtccaagttacccagtggagaaccccatgtagagaggtaccgaaacccccaactacagtttctaccctacagccagccacgggagtgaaccaccttggaaatggatcttctagatgacctgccccagttgatgccattgtagggctaagtgagccatccaagctgagctgtgcccacattcagatttgtaaagtaaattacaaactgctttaggtgatttgctgtttaaaatgaataggttttggattgttttgttgcattttaacagataatcaggacttatgccattggccataagtgtgtcacatggtgacctcttaactgcaaaaagatgctgaggaatatagaattttagcaaacacattgacatccaaaaagaaaaatcagagctctcttagtaaagaaaaagaaacagatagaaagtcggcagccagcattgctcaactggtacctgtaattttttatctgcttcattattgacgtgtctttcatcctctttgctgctgtctgcattgaaaaaaaaatgttgtttaccccataaaaaatttagcatgcactccatgtattcgcttgtctagaaattatatatttatacctacgaatatattatgaatgwtaaaaaccttacacaaaaatagaaatttcaaacctaggcacggtgatatgtgtctgtagtttaaataatcaggaggctgaggcaggaggattgcttgaacccaggaatttgaggctgcagtgcattgtgactaagtctgagaatagccactggactccagcctgggcaacataatgagacattgataatggtttggctgtgttcccacctaaatctcaccttgaattrtaataatctccacgagtcaagggcggggccaggtggagataattgaatcatgggagcagtttcccccatgctgttctcatggtagtgaataagtctcatgagatctgatggtttcataaagggaagctcccctgcacatggcccttgcttgccaccatgcctttgcccttcctttgccttctgccatgattgtgaggcctccccagccatgtggaactgtgagtccgttaaacctctttttttaaataaattacccagtctcaggtgtgcctttagtagcagtgtaaaaatggacgaatacagrcatcatctctagacaatttgattaatttaaaaataataacaatagccaggcgcaggactcacgcttgtaatgccagcacattgggatgccaaggcaagaagatcgcttgagcccaggagctcgagaccagcctggcaacatggtgaaaccccatctctacaaaaaataccaaaaatgagctgggtttggtagtgtgtgcctgtagtcccagctactcaggaggctgaggtgggaggatcacctgagccctggacatcgaggctgcagagagccaaaactatgccactgcatgccagcgtgggtgacagagtgagaccttatctcaaaaaaacaaacaagcgataataataatgataatgataaataaaaacttcaaaaagaatgttaaaagatactcaaaaagaattttaaaaagatttaaaatattctttcattgtgttcattcatagtactaaaacaaaaattattaataatgtttcgggtattttcacataatcttgaatatctccagacacaatatataatcctttatggagagaattattgctaatgttagtggtgttgctaacattgctaatgttagaggtgaattatattcagctcttttctcaatgagcactctctctctctctccctctttctctggttgactcccactgcctctgattagattctcaggggttgtacctaagggatgacaatgaactcatatttgaaggacaaacaccaaatctgctgttttcttgttctctcaggcttccatgtttacaattgtcttcaatccatggctcccttgcaggaattctgttcatctgtggctccacaatgagagttcgtgtgactaactagacaatataaagttgcaaattctcttcacagagcacagatagccacagagcactgagcaggctagtggatgcaaggcgccctcaccccctgggtcccccagcctctgtgaggagctctcactcttcccatctgtattagtttgttttcacactgctaataaggacagacccgagactgggtaatttacaaaggaaagaggtttaatggactcatagctccacgtggctgggaaggcagaaggtgaaaggcacatcttacatggagatagaccagagagagaatgagaaccaagcaaaaggggaaaccccttataaaaccatcagatctcatgagacttattcactaccacgagaacactatgggggaaaccgccccatgattcaattatctgccacagggtccctcccacaacatgtgggaaagatgggagctacaatttaagatgagatttgggtggggacacagccaaactatatcaccgtcagatgctctcaaatgcccaccagacatagtatgctcctgggcaccagggttgaccctcataataaatacagcatgactcaatttcctagctcctgctacttatctgatacaaatgaatataagcagagacttgagggcttccccacgccccagtgcatcatcttgcctgtccctagcatgcattttcgcccactttggagaccactggcctcttagattatgagctacttgtgggcaaaatgcatgttgtgctcacctctgggtcccttctgggactgttctggcacccagaaggggctcgctcagtgtttgttggacacatgaatgaaagaatacatgaccaggatcagtccatgagcagtcctagagcaggactgaagctctaggatggggctgggggtgacattctggaactgggagggcgagctgagggtggggacctgggagctcgttagagccaagggcacggaggacccactgaatctcttcccacttagctgcttcatctgtaactgagaatcatcatggtaatacgcaccacacctcttgtccagagagtccaggaaacaatgtacaagagagtgaatgaggagccttctgggccctgacactgtatgtgctcagtaaacatttgctccttcccctgggaaaatgaaataaaatatagtggcaaggccagtgcctggaggcagctacagtgtgtgtcttagtgtccttggctgccgtaacagatgaccacagacacattggaggtcagaagtctcatgtggctcgcattaggctaaagtcaagctgtcgacagggctggttccttctggctcttgcctgttccggcttctagaggctgcctgcattccttgccttctggctccttcatcttcaaagccagcattgcgtcattgcaaccactgtttctattttcatatctcctttttctgactttaaccctctgtttccctctgataaggatctttgtaactactttgggctcatccagataatccaggataatcttcccatctcaagattcttaattgaatcacatctgtaaagtcccttttgccaatcataggttccagggataaggacgtggacatctttgtagtggtggtggtagtatgctattgttcagctgatcacagtgaacaaccaacccgatttgcctgggactgccagactgattaactgatttaatttatagatcgtctataaattttcactctgtcacccaggctggagtgcagtggcgccatcatcgctcactgcagcctcgacctcctgggctcaagccctcctcccactttagcctcctgaatagttgggcctacaggtgcgagccaccacacccagctaattttttttttttttttgagatggagtcttgctctattgcccaggctggagtgcagtggtgcaatctcagctcaccgcaacctccacctcccgggttcaagcgattctcctgcctcagcctcctgagtagctgacattacaggcatgtgtcaccacacctggctaatttttgtgtttttaatagagacggggtttcaccatgttgtccaggctgttcttgaacttctgacctcaggtgatccacccgcctcggccccccaaattgctgggattataggcatgagtcaccgcgcctggcccacccagctgatttttaaactttttgtagagatgggatctcactgtgttgcccaggctggtgggctcaaggaaccctcccatctcagcctcccaaagtattaggattacaagcatgagccaccatgcccagcctgggatggccatttgaacactgaaagtcctgtgtgctggaaaacccctcagtcccattcatactgggcccgagggtcatgctagcaggcagcataacwttagtggctaacagaatgggctgtggaattagagacctgggttaggatctccctccagccactaactgggtgtggtacctggtgcaagttgctttagtctcagtttcttcctctgaaaagtggaaatgataacagcaccaacaggttgatgggagcttgaaatatgaaaatgtatgtaatggtgacacatacaagagtggcagctattactgtttttatatgaagaggtctacatggggtgctatggagcccagaggagccgctcccagccacagtccctaacccctcaggcctgagtctcctttctcctccaactccagcccagccgagcatggccctggctmccctgttacctcttttcccatggtccatgctagggcctgtgctcagtgagggctggacactctgtgagcatggccaggttctggtggccccagaagacctctggcagaggagaaaggctgcagcaggtaaatcagctccactgtgctgagctcagtcctgctcctgggctgttcgtgggggcgggcaggtgggtggggtcttcctgagttgtgagcccaccaggcctctcagccagcagttgtgggtgtggccagcggcctttgcaaagcttctagcaagaaggaaccttcctgggcatcttccctgcttccctkcaaaaggaaacaacacaaggaaagagctctccatatccacgtgtccaaacacaacagcttatttcagtgtattgtgaagtcattgtatttcactttgtgctgttttgcgggttggtatttgtttagctggcagatgtgctctgcatgaacaagtcaagggtgtttccatccctgattggctcatcaggagggggatatagaatctgggggcagtgggatcttgaccttggaggagcaggagcttgaatgagataattctgcaggtgccttgtgcgtgtatcttatctgaattttacttcctgccttgacatttggaagtgctgagcagtccagagatggctccctgcattagagtcccttgccttgtcaggcctttgaaatgagggtttgccttgatggaacagacagctttcatgatgcastgtctgatatattcagacttgtaatgtagggtgcctagggctgtggggtataatgggggagcctgggagagcataagctcctaaggctccctcttggcctgcactaagttagctgctgggccaggatggtgaacagacagacccagcagccaccctcctagagctgacagtctagcaggcagaccccctgattgcagagttacacraataattgaataaaaatcacaagtgtggaaaagcacagagcaagagaataggcctggggctggatgatgtatctctggtctcagcagggtgacagtcccctgcccagcttcactcctggtgctcctggcatacccactctccccccgccaagatgagcagcttctcattctctgaacagatcagccgtgtctttgcttgggctgttctcattgcctgataaactcctactcatcctgcaaaattcaacctaggtctcactccctccaggaagccctccctgccctcctgctggccctacactttagttattccctcccctgagtaacctgccattgccctaatcacactttattttaatttaccacatttgtttttagagtaaattttattgcaatgtcattcgcacaacataaaatttatcattttaaagtatacaagtcagtagttcgaagtatattcaccatgttgtgtaataaccattcccaccaattcagaacattttcattacctccaaaagaactcccatgcctatcagcagcccctcctgatttcctcctcctccagcccctgacaaccacgaatctgcttttgtgtctctagatttgcctattttgsacatttcatataaatggaatcatacaatgtgggatattttgtgtctggcctctttcaattaacataacgtttccaaggtttaccctcactgtagcatgggtcaatgcttcattcctttctatggctgaatcatattccattgtgtggatgtattgcatgttatttacccatttgtccattgatggatgttagattgtttccactttttggctgttataaataatattmctatgaatattcacattgaggttttcgcatagatatatgtgtcatggtttggatgtttgtcacctccaaacttcatgctgaaatgtaatttctaatgttgtaagtggggcctggtgagaggtattgaatcatggggcggatccctcatgaatggcttagcaccatcaccttggtgaagagttctcatttagttagttcacatgagatctggttgtttaaaagagtgtggtgcctcccacctcctctttcttgctcccactttcaccatgagatgctagctctccctttgccttctgccatgatcgtaagcttccygaggcttcaccaaaagccaagtacatgctggtgccgtgcctgtacagcctgcagaactgtgagccaatgaaacctcttttctttacaaattacccagcctcaggtatttctttacagcaacacaagaatgacctgataccatatgctttcaatttccttgggtatatacctaggagtggaattgctaggtcacatggttactcttatatttaactttttgaggaactgccaagtattttccaaagcagctgcaccattttgaattcctagcaggagtgtatyaggggttcattttctccaaattgtcctcaacacttgtcattatctgtctttgtgataaaagtcatcatcttactggaggtgtcgtgttatctcattgtggttttgatttgcattttcctgataagtagtgacattgagcatatttcttatgcttatttgcacactccatttgcatatattctttaaaaaactatctgttcaaatctgttgcccattttattttatttgagacggtgtttcactcttcttgcccaggctggagtgcaatggcacaatctcagctcacggcaacctctgcctcccgggttcaggtgattctcctgcccgagcctcccaagtagctgggattacaggcacctgccaccatacccggctaattttatattttaagtagagacagggtttctccatgttggtcaggctggtctggaactcccaacctcaggtgatctgcctgcctcggcctcccaaagtgctgggatttcaggcatgagccatggtgcccggcctctattgcccattttaaaaattattttttattgttcagttgtaaaagctctttatatatactggatactagaccctcattagatatatgacttgcaaatattttttctctcattctgtgggttgtcttttcactttcttgttggtgtcttttgatacagaaaagttttaaatattgttgaagtacaatttatatatatttttctttgattgtttgtactttaggtgtcatatctaagaaaacattgtctaatccaaggtaatgaagatttatacctattttcttctaagaattttatagtttcacctcttacatttaggtctttgatatttttcagttagtttttattgatggtgtgaggtaagggtccaaattctttcttttgcatgtggatgtacagttgtctcagcaccgtttgttgaaaacaccattcttaccatttgacccagcaatcccattactgggtatatacccacaggaatataaatcattctattataaagatacatgtatgcatatgtttattgcagcactattcaaaatagcaaagacatggaatcaacctaagtgcccatcaacgatagattagataaagaaaatgtggtatatatacaccatggaattactatgcaaccataaaaaaggatgagatcatgtcccctgcagggacatggatggagttggaggtcattatccttagcaaactaacacaggaacagaaaaccaaatactgcatgttctcacttataagtggaagctaaatgatgagaacacatggacacatagaggggaacaacacacattggggcctataggagggtggagggtgggaggagggagaggatcaggaaaaagaactaatgggtactaggtttaatacctgggtgatgaaataatctgtacaacagactcctgtgatacaagtttacttacataacaaacctgtacatgtacccctgaacttaaaataaaggtttttaaaaaagaaggaaaagataattcttttcccagcaaatggttttggcacctttttcgaagacaaattgaccataaatgcaagggttcatttctggactcactcttactctgttgatctatatgtctatccttatgttagtgtctcacagtcatgattactatgtgtatttttttcattttttggattatttatttatttaaattgtggtgaagtatacataacataaaatttttcctcttcataattttttagtgaacagttcaacaacattaagtacattcacactgttaggtaaccatcaccaccatccatcttgcaaaactgaaactctgtactttttaaataataactccctgttctccatcctccacccctggcaaccaccattctactttctgtttctgtgaatttgactactctagataycacatattgattattatagtttcatagtgagttttgaaattaggaagtctaagttctctgactttgtgtttttaaagtttgttttggcttttctgggtctcttacattttcrtataaattttaatagcttgtcggtttctgcaaaaagggcagwtggaattttgataggcatcatatcagatgcagattaattgaaaaatattgccatcttaataatattaagtcttctaatccatgaacataggatgcctttttaattatttgggttgtcattaatttctttcaactatgttttctagtttcaggatgcaagtgttgcacttctttggctaaatttatttttaacattttgtccttttagatggtatcaaaactggaattgttttcttaatttttgggcgaggttatgagccactggagggcagagtcagttggcacaggcagccagctgtgcatcaaacctagtttccctttccccaggcagctacatggggccctgtgtctgtgccactggaatgtgaatggaaatgatgtggccacttccaggcctggcctgccaacctcctggtataatcctacagatgatcttctcccacctcctagccagaggtcaattcccaggatgactgtggaagccactgtgtgacatggcagaatttccatcagcctgagctcctgaatgaccctgaagaagagagcagacaggtgtatctgtgagggagtgagaaatatttcataaagtcactgaaatgtgggagtttacttgttataggaggtaatatgattaaaatggatacaatcatccttatttctgaatctctagcaccaatatgtatcatacctaagaggtactcgatgaattttttggaatgagtgcactttaagctttcctggcttggcacttcaaagatgtctttgatttccccttttccctcttctcctacagttaagcaaatgtccgttgagtgaattcatcccaatgttgcctgcagtacaacaaaataatattttgggaaagcatcaaaaagtggaaatctgtaagatggtaacaagcatcctttcattcgcaaaaacctcttaggtagagtttaaaaattgtttttactatgttttatcttctgatcccatagtattcttatgaagtaggtacgacggttgctattgagagtcaacttgattggattgaaagatgcaaagtattgttcctgggtgtgtctgtgagggtgttaccaaaggagattaatatttgaatcagtggactggggagaggcagacccaccctcaatctgggtgggcaccatctgatcagctgccagtgcagctaggataaaagcaggcagagtaacatggaagcactgacttgctgagtcttctggcctccatctttctcccatgcttcatgcttcctgccctccaacatcggactccaagttcttcagcttttggattcttggacctacaccagtggtttgccaggggctctcaggccttccatcacagggtggaggttgcactgtcagcttccctacctttgaggttttgagacttggactggtttccttgctcctcagtttgcagacagcctattgtgagacttcaccttgtgatcgtgtgagtcaataccccttaataaactcccttttttatatacatctatcctattcatcctgttcctctacagaaccctgactaatacagtaggtataccagctaccccattcaactgatgaggacactgaggtccaggaatatgaagtccttggcccaaggtggacctaggtatatgggcccaggaacatgtctcattccatcacctccctctgagcatcaggggtcacactagaagggggtggccatggtaagtgtcttccctccctgtcattgcatatactatttcctcagcccagagcatcttccttcccttgctgattcctactccatccacacaattcatcttggggctcccaccttcaggaagccttccaggatgccccttccccactgagcttggggtagctgccttctcagaggccatgcaatgctttcttcgtcagaaccatcactagagtaagtgagagtgtggactctagaatggacttccagaatttaactagtgacttcaagtgactttactgtcctcagatgccagatggagatggtcctaatctgacatagcttgtgaatttgtcatgaggactaaatgaatgacacatgtgcagcacttggaatggtgccccccacatgcaagtgctcagcaaatggtggcttttctctatcataccacaacctcattgtctgtttatgtatctcttgactgtggctccttgaggcagggacctggtatgtcgtaggtgctcagtaaatagcagtaaaattggattaataattgcaaaatggcccaggcgcagtggctcatgcctgtaatcccagcactttgggaggccaaggagggaggatcgcttgagtccaggattttgaaaccagcctgggcaacatggcaaaaccttgtctgtacaaaaaaatacaaaaaattagctggcatggtggtatacacctgtagtcccaactactcaggaggctgaggtgggaggatcacctgagcccaaaaagtcgagggtatggtgagctgtgatggtgtcactgcactccagcctggggaacagagtgagactctgtctcaaaaaataaaaataaaaaattgcaaaatgagcagagctctcacctctctggcttacctctctcagtgtgtgggttaaatgcaggaatggaaaagagctctgtgccattgttcaagtcctgtaaaaatgtaggagattgggattaccagaataattttgtatcaatatgccattgttaacagtcttgtcccttgggtttgttgaagaattaacttcctacttgacagcattcgtggacatgatcttctcaaagacagaaatagaaatggagaaccaaccctttgattcaactttggttaaagtgaaaaggaacgggccgggcgcggtggctcacgcctgtaatcccagcactttgggagactgaggcaggcggatcacaaggtcaggagatcgagaccatcctggctaacacggtgaaatccagtctctactaaaaatacaaaaatattagccgggagcggtggtgggcgcctgcagtcccagctactcgggaggctgaggcaggagaatggcgtgatcctgggaggcggaacttgcagtgagccgagatggcgccactgtacttcagcctgggcgagggtgtgagactccgtctcaaaaaaaaaaaaaaaaagtgaaaaggaacgatatcacaacttaattggataaacctgggacagaagaatttgattataatgagtacttgacactttcaaagtgtcttgctggtgaggtgaggctgtttacattccacagctgcaggagcccagaaaacagagattttccttaggaggggaaaaggtcggtttacatttaattttatagaaagccttttgtccatgttttctgagatggagcaaaaacttcttggagaaacagtaactctcagttctttttggattctcattcattgataaatggcgaattcttgctaaatctctccagaatgtaaccatcagtctcaaagcatgtatacatcattgcacattaagctaccaaatattctatttgcactttaagctatgagatttttttctttttctttctttctttctttctctttctttcatcttttattattattattattatttttgacagagtcttgctcttgttgcccaggctggagtgcagtggcacgatcttggctcactgcaacttccgtctcctgggttggttgaagcgattttcctgcctcagcctcctgaatagctgagattacaggcacacaacaccatacctgcctaatttttgtatttttagtagagacgaggtttcaccatgttggccaggctggtctcgaactcctgacttcaggagatccacctgccttggcctcccaaagtgctgggattacaggcatcagccaccacacctggcctagatttttttcatagcagatgtagcttgttcatttatattgtaaccagattcaccagccttgaatcaattgctatatgcatggtttaagctcctctcagaaaatcttggatccctgaatctaggttttctcctttcaagctgcagataatgtaaaataatgcttctagtgcgcttaagtccaaacaaaatgcccatctagtttcttcaacacgggggacttcttggcactttggggaattaattttatgcaataagagatgagaattaagcagcttagttggagtgagacatcagatgtagccaggacccaccagccagaggcaatggggtggagtctgccaggaggcccagtgcattcacgacacagagagaggatgagttgctggttttttttttttgttttttgtttttttttttttttttttgagatggagtctcgctctgttgcccaggctggagtgcagtggcgcgatctcggctcactgcaagctccgcctcccgggttcacgccattctcctgcctcagcctcccgagtagctgggactacaggcatccgccaccacgcccggctaattttttgtgtttttagcagagacggggtttcaccgtgttagccaggatggtctcgatytcctgacttcgtgatccgcctgcctcggcctcccaagctggttttctttcaaacagaggccagctagagccagggacggcaactcggaacgtgtctaacgagatcctttctcagttgttcactcattctttatttcatctattcattcactcagaaaatgtttactgcatatctgccacatgacaggcactggtttagatattagggaaacagtgtatctaagaccacgattctctactccattatttgaaatggcaggaaagggaagaagaaagcaaaccaaacccacaatgactgccatgtaagagacagtagtaagtgctacgaagagaaacaaagcaggtgagggccagagaacaaggggtgctcttttagacggggaagtcccctctctggaaggtgacatctgtgcagagctaggaatgaagtgagagggtgagcccagaggttatctggcggaagaacattccaggcagggactcagcaagtgcgaagaccctgaggtggkcgtgtacctggaatattggaggaagagcagggaggcagatgtgctggagtgcagggagtgagatgaagccaaagggagctgggaccagcatttccaagagctttctctgatctggacctagggggatatgtggggagcacagagatcctatcgcccccatcagcacctccgatatgggcttcagacactcctacctggaagatgggcaactggcagaaacgccttgagctggaagcaggagcgtcaggtttgaatctctgctccttcctttatcaactgtcactcggctgagtggacctttctgagccagagttcctttatgtataaaatggagatcaccacatctacttttgaaaaactgatggagactgggcacagtggctcacgcctgtaatccttgaactttgggaggccaaggtaggtggatcacctaaggtcaggagttcgagmacagcctggccaacatggtgaaaccctctctctactaaaaatacaaaaattagctgggcgtggtggcaggcgcctrtaatcccagctactcgggaggctgcggcaggagaattgcttaaacccaggaggaggaagttgcagtgagccgagatcacgccattgcactccagcctgggtgacagagtgagactctgtctcaaaaaaaaaaaaaaaaaaagaaaaagaaaaagaaagaaaaagaaaggaaaccaatggagcacagtttgttctcttcattcctcagggaaaatccatctcttgctccttaacgcttggcctggttcctgcactctaagctgggagatagttgagacataaaattacaaaggtggcatgcagaactatagaacttacagagctttatacatctccttcagctcttccggcaaacagagagtgatggatgtatgtattattagtaattattattttcctgttttacagatgaggaaactgaggcctgggacctgatgtgagttgttcaggtggccaagggaggaactgaacacagatttgtgtgactccaaaacccaagtatttgggctgtttttttctccttttggtttgtcacttataacttgcctgtcccacatgtggccatgactctgactttcagttcacctgtgtccctgtgcccaaacctttgctttgtcagcctcccccattagactatgaggtgcttgaggacaggggaaggtgtcacctgtctccacattccattgaamaaactggataacactgaaagaggttgtgtgctgcaaagagcactgggctgggagtctgaaccctgccrgcaggtgaggctccttcttagcagacgtgactcrtttgtggagtagttgcattagtcaggggaggctaggccatgccaaggtgacaaattaacagacatctcagggacttgacacaccgaaagtatattcctcgtttgtgtcacacgtcagtgctctcctgcaagtggtgacttgggggtccaggcttcttccatcttgggacatcattgtcatcattgtcctaaacacatggctgccaaggtcactttggaaggtgcagggaaagtgaggatcagccaggatgctttttaaagaccaccacagctgagtggctttcacccctctgccatattcctttggccataactcagtgctatggtctccagtctaactgcacaggaggctgggaaacgctggccaggatgtgcccaggaaggagaaatgagtggtgggcctcaaggcttgtctgtgccacattcacccaatttttcaaatctcacgtctggacaagagtccaacaaagctagccatctcatggagacagtagggcaggagttttgcagttggtatttcgggacttactattgccagagtctcggggcaattccttttccactgttgagacttaattttccccttgataaatatgtggttgttccccatctgtggcctgtggatcccagtaggggtgaggggactgcataattattctgagtcttagcattcccctataaaccagcactgtggtagatggagggagtgtagatgctataggtaccaaatagaggcacacttattttaaaacctcgctgtttttgtcatacatgttctcaatataaacatggaaataatttatatcaggtgaataattgtgaaatactttaggttaaaggtcttcataatgaaaaatatctaggctgggagctgtggctgacgcctgtaagcccagcactttgggaggccaaggcaggggatcacttgaggtcaggagttcgagaccagcctggccaacatggtgaaaccctgtctctactaaaaatacaaaaatgagctgagtgtgatggcagatgcctgtagtctcagatactcaggctgaggcaggagaattgctagattgggcaacatagtaaaaaccctgtctctaccaaaaaaaaaaaaaggtggggcaaaagacttgaatagacatttctccaaagaagatatacaaatggcaaagtacatgaaaagatgttcaacatcactgctcatcaggaaaatgcaagttaaaattagaatgagatattatgtcacacccattaggatggatattattaaaaaacaaaaaaacagaaagcaagtgttggtgaggatgtggagaaactggaaccctggtacattgctgtgggaatgtaaaattgtgcagtcactgtggaaaacagaatggcaggtacttaaaaaattaaacatagaattaccatatgtattagttcattttcatgctgctcataaagacatacccgagactgcacaatttacaaaagaaagaggtgtaatggactcacagttccacatggctgggggtgcctcacaatcatggcagaaggcaaaaggtatgtctcacatggcggcagacaagagaagagaatgacagccaagtaaaaggggtttccccttataaaaccatcagatctcaggaggcttattcactaccacgagaacagtatgggggaaatcactcccrtgattcaattctcccccactgggtccctcccacaaatgagggaattatgggaggtacaattcaagatgagatttgggtggagacacagcaaaaccgtatcaccataggatcagcaattccacttctgggtgtatccccaaaagaattgaaaacagggactcaaacagatatttgtacaaccctgttcatagcagcattcttcacactaacattaatttccaccaaaaggtggatgcaacccagtgtccatgacagctgagtggataagcaaatgtggtctgtacctacgatagaagagtattcagctttgaaaaggaatgaaattctaacacatcctacaacctggttaaaccttgaggacattatggtaaataaaataagccaggacaaatactgtatgaggtagttaaagtagtccattcacagcaacaggaaggagaatggtgggtgccaggggcttgtggggtgaagatgggaatgttagtgtttaatgggaacagagtttcagtctgggaagatgaaaaagccctggagatggatggtggtgacggttccgagaccatgtgaatgtgtttaatgcckctgagtggcacatttgaaaatggggaaaatcggccaagcttgtggctcatgcctgtaatctcagcactttgggaggctaagctgggaggatcatttgagcctaggagtttgagaccagcctgggcaagatggtaccccatttctataaataaaaataaaaatgggccgggcgcagtggctcacgcctgtaatcccagcactttgggaggccgaggtgggcggatcacgaggtcaggagatcgagaccatcctggctaacatggtgaaaccccgtctctactaaaaatacacaaaattagccgggcgtggtggcgcgcacctgtaatcccagctactcgggaggctgaggcaggagaatggcgtgaacccgggaggcggagcttgcagtgagccgagatagcgccacttcactccagcctgagcgacagagcgagactccgtctcaaaaaaaaaaaaaaaataataataataataataatagggtaaaatggtaagttttatgttgtgtatatattataaagtgtgggggaataagaatgatgaagggctcctgggaaggccaagtgcttccctgtgaagcagggagcctgtggggctcggagggtggagtcaggcaagcggggcacagcagcggggcctcggggctttgagggcgctgggactgacctttctcccatttgctcctgctgagggccccagaggccagctcggcctggcctgaggtctcaaaggcatttctgaaatgcctcactccagagggcaccgcttcctgccacagtgacatgggggatggtccggggaactcatcccagctaagtgacctctctggctggctggcctctgtccgatgccaggcatcatctggaacctctaaaaagttcatttagcacgagggcagaggcatggcattcagggtctgccccttaatgggaaaccaactgtcctttagaaaaaggaattaattcaaaatcagttcgtgggatcatamatcaacagacacgttccaaaaatgttcgaatcattgcaacttcagggggatctgaaaagctctccattgtaaacagacaaattgtttgggataaaaggagagaagaaactctggtgatcccaacttcacaagtgaactggctcttttttaagccagaaggggtgtctattgtaggaatttttgtttccttttcccttttgtatctttgggcttcaaaggggatggcgagaggttaaaacacagcgagagaggctgcccttgtgatttttcagcctgctggaaacagaaagataccaggaatctactgaggtgatgcagacatggggtgttggctgggattcctcgcggaatctgggaatcatatcggtgtgtggggccatggggcctgcggcgctttacaggtttcccgagaggaaagcaaggcccaggaagcttgagcaccttatccagtgccacctggctactaagggccagtccatagtggtggctgatttgcctccaaatgaattttctgatgtgcgcattttgctgcaagaaagacacgagttagaacgtgctgaatttcaatcccggagcctcccaggaggaggcgttcatttgctccccaaactttcactgtggtggccagagttctcagcccaggacacctcctgttgaggacctgggagctgtctgggatgtttgcctgtttctcactcctccaccccttccctcccctccagagtagccagttcacctttaaccagtttctttcaggcgcgcagatggtatttcaacttcagagggagcgacagagttggggggcctttatggatctgtgacccccggctctttgagttgcacaaactagctctcccccaccccggtccagcggctgccagccccagcccccttcaaaggccggctgggtgccacgcagcaatttccgctgccgaatctgacagtgacagttcactgggaccttctctcgctctctctctctgttctccgtgctggggccttctcaactttaagtctgatagggtcttgtcacaaagtctggctggaatgggctgaagggagacagaaactgataaattttcttttgatctcagatctgcaaagccgctcagaaaaaataaatcgcaacagtgggcccacggtggttggtcagagccagagaagccagaaaagkttccttctccagctcagggttccctgattccccctggtacattacatatcaaaaggaggcgggtgcgctggggagggatccctggctcagaacagggcaaggaacctaattaggtgaaaatcatttaaatggttttcacagcatcgtttgatttaaagcatttatcaccacctaacgcataattaacagcaggacaagcgattgaacaaaggctstcttctactcagagggattatgttaattttcattaatcttatatattaccatctctttccaaatgaatgttatcttaaaggcccaaatgccttctttgatcttggggaaaggaaaaaaagagagagagagaagaaaagattgtaacctatgtttgtttggaaatgacattttaacaacaggctccaagtacaggatcagaagtttttggtattcaagagttaatccagccacaaaaagaaggaaattctgtgyggaggaatcaggcgctgcgcttgcctggaaacacaggattgggccagatgggttgtctgaggtctcctttagtttgattgtttattatggttctaagggaatatactcagattctgccataacattctcacgttgttggacgtgtctgccccttgccatcctagcccagagggtcccttacaataattttaatttaaaaaaaaaattagtgaagacaagtagttatagaaactggcttaatatgaataataaccacacactgtgctcttcatctgataattaattacttgacctgtattatgtcatcaaatccataccacagcttgattgtcatcctcacattgcagatgaggcaactgagccatgggggaaactgaggtagcttgtctcagttaatattcgggatactcacccaggcaggtggcctctagagcctgttctcttggctgctggactgcgcggcccgcctgcgtggttggtcaggaatcttgctgtaacccgtctgtctgggctcccatctcagctgtgtccccagcttcgtgtgcaaacttgggccagtgtctgtgcctctggggcctcagtttcttcattaccaacttccagaatatcggtctccacgctgggctaacmgcttgcatttatggaatgctttgttgaatgctggtgctgttgtttccccatttcacagatgaggaaactgagatcttagaggccctgccaggttcgcacgctgtgagttgtgtagctgggatttgaacccagatcagcagatgctgagccttttcttaatctttatgatctgttgactcacaaaatccaactaggggcatttctagctttaaatattttttttttttgtctttcttttttttttttgagacagagtcttactgttagaaatgcttgttcctaggtgccataaagaaatagcacttgaacataagtttaatttcctcagcaaggcctttttttcctttttttactttctgtagaaagggtacactcgtcagcagttttkccacgagagtgcaccgaacaaaggagacagggtcatttataacctgacgtgtccaccttactgctgtgtccagtttccattggctggaaccgggcttcacattctgtatttgtcctgattgttttgtgcaatgttgagaaaggtaaaaaccttcaaatgaggaagaggaacatgctatgacctaatgcttgcttggaccagtataagcatgccagggcaaatatttaggctaaattgtgggagccaagaacataaagtacattgatttctttattacggctagcagatatttaagaatgttagcacaggtctttgaataaattttgcttctgagagaagttactakttattcttaattcgatggggaggaaagcctttgaagaggaaactctactttttgcattgctctatcacccaggcttgagtgcagtggcacaatctcagcccactgcaacctctgtctcccaggttcaagcgattctcctgccccagcctccagagttgctgggactacaggcgtgcaccaccacgcctggctaatttttgtattttcagtagagttggggtttcaccatgttggccaggctggtctcggactcctgacctcaggtgatctgcctgcctcagcctcccaaagtgctgggattacaggcatgagtcaccacgcctggtctctagctttaaataaataggatttctatggggtgggggatgggggggattgtgttagatctattcagtatcttgactgtggtggtaaatacacaaatctatcctgatgaaattgtgtagaatttaatacacagacactaatacaagtaatattgggaaagtatgaataagattggtagattaaatcaatgccaatatcctgattgtgatattatgctatggttttgaaaatgttacatgggtgagcaaagtgcataaggagtctttctgtattatttcttacaacttcacatgaatccacaataatctcaatcaaaacatcaatttaaaaaatagaaatgggttgggcatggtggctcatgcctataatcccagtattttgggaggccaaggcaggcagattgcttgagcccaggagtttgagaccagcctgggcaacatggaaaaatgctgcctctacaaaaaatacaaaaatattagctaggcatggtggtgtatgcctgtggtcccagctacttgggaggctgaggtaggaggatcacttgagcccaggaggcagaggttgcagtgagctgagattatgccacttcactccaacctgggcgacagagccagaccctgtctcaaaaataaatacataaataaataaactaaaaaatatagaggattctctctataaacacactgagtaactttattgtgtgtatgtgaaatgtttggaataaacataagacctggttcttgccctagaggaatgtactgaattaatcataatagtaataatttttaaatgactaccatttattgagtgacatgtgtcagacacagtcctgaagtgctatattaatttcatcagcaatctttttttttttttttttgagatggggtcttgctctgttgcccacgctggagtgcaatgcaacaatcaaggctcactgcagcctcaacctcctgggctcaagcgrtcctcccacctcagcctctcaaatagctgggactaccggcaygcaccaccatgttcagctaatttttgtattttttttttttttttttttttgtagagacagggtctcgccatgttgctcaggctggtcttgaactcttgggctcaaggaatccgcctctttccacctccccaagtgctgggattaaaggtgtgagccaccacgcccagcccattatcacttctttacaagtggaagaaactgagcttcaaagaggttaaaacttgcccaagatcacccagcacataagtagtaatgttggtgggcatgggtccaagcctcactctggatcccactcctcagctgagccagagttccctgagcaccttctatgccagcacattccagtaaaatagtatcattctgccctggcacartttggcgaggcaggcaatatcatccccgttttgcagaggaggagactggggctcagagttggagaagacttgaatccagctgcctctttttcatcctacaaggaagagacagagctgaacacaggtctcacagcactatgaggtcattctggggttcagggtacgcctcaaagaagaaggtgtctgggcaggcctggggtatgtgtaggggtgctggggagtaggcaggacctagataagtgagtttcaggagctaagagcagggtgtgagctgagcctggagctgtttattcagctttagggggaaagatttcatccagggccctggttggtgataaagcagctctgttttcaaaccaaacatggcctttccttcgaggactgggaaatttgggaagaaagatattgcatggctctcctgtggatctttccggccctatcaccaaygaaatatctcactggactcttaggggaaagttgaaatgcactcccaaagagattcaggccactgcgggtaacttcaaaggacggtcctccagaaagctgaaatttaaaaagtccacgacagccctttaaaggtggtctggacacacattgttggtctggcgcccattgtccctgaccctgaccaaaagcctcacagagctgcaaaaatgtcygtgggcaggactggctctaactcgggcctgggaggcaggactgagaagaaaacccacgtagtgagcctgcaccaggtcctaggaactttctacactttctttctctttaagactcataatagttctggaagagaagaagtctcactcccatgttctaaatttacagcctaggggaagagacaagaagggtctcattcacgaccacatggctgggaagtaagagatctgagatttgtctgactccaaagaactgagttgtagtggcctgggggatcacagatcatgacagtgatgatgacaactactatcacttattattatacagataatattttctaaagatggctgtgacaatatctcccattccacatgttcttcttataacgtgactttgacactcctcccactgagtggtgggggtgcctgtattccctccctttgaacctgggcaggcttgcgactatggcagaagtgacactatggaacttccaagaaaagctyattagattataaaatgctatgcatatctaccttactctcttgagtctctcttggaacccagctgccatgctgtcaggaagcccaatctagcccacatggagagagctcgtgttctaaccaagagaccagctgaggtcccagctgaaaggcagcatcaattgccagcatgggaatgaagacacctcagaatggctcccacccctgagtcatccccaacaaattgagtctcctgtgtgccagatgttggggaacaaagacaaactgtctctgcccaaattcctgacccagagaatcatgaatgttataaaatggctgtgcaatgccactacattttagggttcatttgttacttagcaacagtatgtagagcaaatataacaaccattgaataagggctaacattgaccaagtacttgttgtgtgctcagcactgtattaagagcttatacagtcagaggaagaaggagctttgaaactcagcttcttccatttgtaaagaagtgataatgagactgggcacagtggctcaggcctgtaatcctaacactttgggaggctgtgtaatcctaacactttgaggcgggtggatcacttgaggtcaggaattcaagatcaacctggccaatgtagtgaaaccttatctctacgaaaaatacaaaaattagccaggtgtggtggtgtgtgcctgtaatcctagctactcgggaagctgaggcaggagaatctcttgaacccaagaggcagagattgcagtgagccgagatcacgccactgcactggagcctgggcaacacggcgagactgtctcaaaaaaaaaaaaaaaaaaaaagtgataatggactgggcttagtgacttatgcctgtaatcctagcacccaaaacaggtggataacttgagctcaagtgttcaagaccagcctgagcaatgtggcaagaccctgtctctacaaaaaaaaaaaaaaattagctggacatggtggtgcgtgcctgtagttccagctatttgagaggctgaagtaggaggattgcttgagcccaggaggttgaggctacagtgatagacagaagtttttttgtttgtttgtttgtttgttcttggtaggctggaatgcaatggcacgatctcagctcactgtagcctccacctcccgggttcaagcgattctcatgcctcagcctcccaagtagctgggactacaggcatgccccaacatgcctggctaattttgtatttttagtaaagacagggtttcaccatgttggccaggctagtctcgaactcccgaccccaagtgatccccctgccttggcctcccaaagtgctgggattataggcatgagccactgtgcccggcctacacagaagtcttgtgtagtactcctgggaagccttctgaaagagagatttacaatactggagagatgaaaaatgtaggtttccaggccccatcccaaacctgctgagaccacattatgcacagtatcccaatggcgaaggcagggtaagaccaagcccaggagaagggtcaggacaatgtgattccatttaatgcagcaaatattactgacagccctgactacatgccaggtgcctggacttccctcagctactcaggaggctaagtcttgaggatcacttgagcccagaagtttgaggctgcactgaaccatgatcacaccactgcaattcagcctgggtgacagagcaagatcttgtctttaaaataaaataaaataaaaatattattataatgaaagaatttaaataacacagtgttgtagaatatagaatacatggatatagatgacacaatgctgatggggatgacagttcatgaccatcaggcttgtactgggcaccctcctgtgttctctatacacagattctagtcgattaccttctcacaactgctccccccaccccgccttttctattttttagatgcagagattcagagagtctaagcaacttttctaaatcatctagctggaattcagtaactgagccaggatctaccccaggtctgtctgactccaaagcctgtgtcttccagcacacactgctgctgcctggggtaagagctcaacattatgcttggaaaaaggagcttttctatctcattgtggagggctgggatgtctcccgtgtccacgctcccttctttcttagtaatgggcacgttactgcgttccccagcctctcttgcagcaaggtgaccaagtgaacactttctggctaatgagatgtacatagaagtcttgtgtaatacttctgggaagctttctgaaagagagcgaatayactcttctcccattttcctcaaaaaccttctagcaggaatgtggatatgatgtctggagctctagcaaccatatcagaccacaaggatgaatgtacaccccaggaatggaagagaggaaagccagaaaaagactcggtccctgatggctgaagagctaccatacctgcccctagatcttctatttctgatcatcttctatgcaagggtgagtgaactcgtattgtgttaacgtcactgtgatactgggtcttgtttcttgccagttgaatgtgatcctaagtggtacaatgggtcaactgagaggaagagaatgaacttgggttgggatttgaaagatgggtaggactgagacaggaatgggggaagaagttccttataggtgctgggaacagcaagagtgagaagtgtccttgaggtggcatgtggagtataacaaggaagatgtaggagctaagcagggttagagcagtggtttgtaaagagctttggctgccaggcagtgaagatacaatttcaactgttaagcactggggagccatagaaggtgtttgagcggataagtgatgtgtttggtactggattttgccttgatggagatctgtaggcggaactgaagaggaggaagcctgggccagaaatggggccctggggggtgggaattgcttggaaaggaggtttggagaccagctttggcaatggtccatggaatcactattgcattaaacagtggtgtgctaatactgtgggtgatttggaagccactgaaacgatgatgcacaagatagcatgataacatgtcaagttgctcacggtatattgttatatgacaaaaataggtctccaaacagtttgcacaatatgatgagttcctgaaaattcacttcatgcattttatttaaaagccaagaaggttattctccaattgttaataatagttactgctagggggaagttttcagggatgatttttctttcttcttttgctcactattttctaagctgttagtagtagtagtagdaataataataataataataataataataatagctaagcactcctgagggcccacaaagctcggtgccagcctcattctctgtgttaattcatgtatttaaatcctcatagtcctccatgagggagggagtttaattttcttctttttatatttgaggaaactgagattcagaaagcaggagcctatgtctaggggagagcaccagtggaaagagaggtgacaatgaggatccgagagaggggacgtcctakctggatggaggagttagggagtgaggagggaaaggccttctcagaaatcccaggggatgcacgcatcggcctttacagtttataaagtacaccctgtacttccgctcttaaaatgcgcttgttaggaattatgattgctattttatgggaaaggaaacaggctcagagaagttaagcagcttgctcaagataacaagggggagagttgggatttgaacacagcgctctgtgcctgactcaggttctatctctgccacacccagccaaaaaagggggctagtttcagtgtgtattggaaatctgtctgttggaccccttggctcccttaagccaacagactttgtgttagcagctaaaccacttaaaaagagcaacaaagcaagacctggaaattttttaaaaaattagccaggtgtggtggcgcatgtctgtagtcccagctactcgggaggctgaggcgggaggattgcttgagcccaggagtctgaggctgcagtgagccatgatcacaccactacactccagcctgtaccacagagtgagacccagtctctaaaacaaaaaaaaattttaaataaagaaataaaaagaggttattgacccctaccttttggccgaatcttagtcttgaacggcttgcctgaactgtccggaatttcgcrgcccaacytgacactgatttcaaccaattctgttcattccttgtgccccaccgtccatcctgcttccttagctgcctttttgactgagtctgagctgcctttgacctcctggggtagtgcttctgagacargagaatagggtctggaggcaggaaacctaaggtartttcaggccgacttcctagaactaaattgaaagaaaaacccgggccaggcgtggtggctcacgcctgtaatcccagcactttgggaggccgaagagggtgggtcacctgaggtcaggagttccagactagcctggccaacatggcgaaaccccgtctctactaaaaatacaaaaattagctgggcatggtggtgggtgcctgtaatcccagctacttgggaggctgaggcaggagaacagcttgaacccaggagtcggaggtttctgtgagccgaggtcctgccattgcactccagcctgggtgacaagagcaaaactccgtctcaaaagaaaaccctaactttccacgcctaagtaacaaaaggaccagaggctactccttttgcaaatcccttttcctccaggcagatgggaaattggctgtccgcaaccaatcagactgattgagagcggagtcttcctttgcatagaagtggaactttgtaacttcatcttaacctttgattggttgctttttgcagccaatcaggtgtttgcagaggagtgtgacttttgtaacttcacttcagcctctgattggttgttttctgcagtcaatcacactgattgcgggccaccacttcatttacatgagggggccaataggaaacctgtagggggtatttggatctgagaagattctgtatctgggctcttgagccgctggttgggcccctcccacactgtggagggtacttttgttttcaataaatccctgctttggttctttcgttgcttcattctttctttgctttgctgggcttttgtccaattctttgttcaaaacgccaagaacctgggcaacttacagtcaagaccctcaccggcaacacttctaccccgcctggcctgggccctgagctccatcccacagcccaaggcctggcaggtggcttcccaccgcctcttccctatccagtcccagccagctggggatctggttttcccatcctccactctccctgcctttcccagccacattccacgcccaccaaggcccctccaggaaaaggccccagagagctctctgtcctcatgtcagacgtttccctaattcccagtggcttgatcttttgctgtttcggtttatcacaaatgattttccaagccagtggatttaattatattatacacttagggaaattggtgccatttyttaattacttttatagttgaaaagcaattacttagcaatcacatgaagggcttctcatgtttcctggagttctgtagagaaccagacctggtttgaagaagttgggtttgccctggaggtaacccaaggaactggggcaattgggtttggggagacaggtaagctttgtggtatagaattggataaataaagattttttaaaaaatcatgatccacccagttgcttaagccaatgcctgacagacacccttaacatctccatcttcctcaattctgtgtatgtcaacactggtgaagtgcttggattccacctcctggtacctctcaaacctgcccatgactctgcttcctcctgtccagtccaggccaccactgccatgcatctcttaagtgatcctcccctgtccaccctggccccctgaggggggtggaatggtggtctccaaaagatccatttacccccaacctaggaacgtaaccttatgtggaaaaagggcctttgcagatgtaattgagttaaggatcttgagacaagaacttcctggatgacctaggtaggccctcaatccaatgagaagtgtccttctcagaggacaagaggagaagacccacagaggggaagccatgagaagatggatgctgaggtgagtgatgtgcatacaggccaaggagcaccaggaatggctgggaaccaccagaagccaggagagaggatgggcaaatcctccctcagagccccctggaggagtgagcctgcccatcactttgattttatttaatttatttaattaattaatttatttattttgagatggagtctcactctgtcgcccaggctggagtgcaggggtgtgatctcagctcaatgcaacctccgccttccaggttcaagtgatacttgtgcctcagcctcctgagtatttggaattacaggtgctcgccaccatgcccagctaatttttgtattttttggtagagatgggatttcatcatgttggcaaggctggtcttgaactcctgacctcaagtgatctgcctgcctcagcctcccaaagtgctgggattacaggcctgagccactgtgcccagccaatcaccttgattttaaactgctggactctggaacagtgagtagtaaatttcagttgtttgaagccatgcagattgtggttatttgttatagcagctccgggaaactcacacagccccatttagtccatttttcaacacgtctgtcccgtgctaaagcccagtggctctcacctcctttagaataaagaattgcattttcctgatgactaatatacagtaccttcatatgcctattgctatttgaatattctcttttttttttggatctgctcaagtcttttgcccatttaaaaaataggannnnnnnnnnnnnnnnnnnnnnnnnnnnnnnnnnnnnnnnnnnnnnnnnnnnnnnnnnnnnnnnnnnnnnnnnnntgtgggctgctgctacactcttttaatggtgtttttggatatagtacttaattttaatatatcccactttattagtttttaatcttgtagttagcaccctttttgtcctatttaagaaatctaaggycaggcgcagtggctcgcgcctgtaatcccagcactttgggaggtcgaggtgggtggatcacgaggtcaggagatggagaccattctggctaacacggtgaaaccaccgtctctattaaaaatacaaaaaaattagctgggcctgatggcacatgcctgtagtcccagctactcaggagactgaggcaggagaatcgcttgagcccggaacgcggaggttgcagtgagccgagatcgtgccaccacactccagcctgggcgacagagtgagactccatctcaaaaaaaaaaaaaaaaaaaaaaaggaaatctcagtttactctgagatcatgaagatgttattctatgtttcttctaaaacattattgtttacctttcattttatttaattaattaattaatttttgagacagttttcctcttgttgcccaggctgcagtgcaatggcgctcggctcaccgcaacctccacctcccaggttcaagagattctcctgcctcagcctaccgagtagctgagattacaggcatgcaccatcatgcctggctaattttgtatttttagtagagacagggtttctccatattgttcaggctggtctcgaactcctgacctcaggtgatctgcccgcctcggcctcccgaagtgctgggattataggcgtgagccaccacgcccagcctacctttcatttcatatttggatctataagctatctggaattgatttttgtgaatggtgtgagatggaattcagctttgttttttccccacatagacattcaattgactgatcactgcaatgctatctttgacataagcagatgaccgtgtatgtttgggtatggtaactggtttttaagtttatcctgcccctggaatctcagctccaaggcaacagtaagcttttattgacaggaggaggccaatccatagccttgggctgcaggactgatgaggaggaggcaagaagggtggggctctgggtccctggttcttgtcaagcagatcaactcacaaggtgtctgggttcctctttggcttaactcgtgagcctgcttggggaggtggttggtcccaggtttgcaatggcctgtcacttctataatcagaaaagcagttctcaacctatggataattaggagttgatagtaaccacattttgatctgtaagtgcttacattttaggccctttccaggccctctagggtggtggtaggagcaataattcttttatcaggagtataaggaggcatgaaggaaagctacgaacaggggtgccatttgacctaggcattgaaggatgaataggagttttaatatttaaaaaaaaaagaaagaaagaaccaacaggaagggcactgcaggcagcacagggaataagcatgggcaaaggcagggagacatgcatgagcttagtaggggagcagggtaggccggccatggtggctcacacctgtaatcccagcactttgggtggccaaggtgcgtggatcacctgaggttgggagttcgagaccatcctgaccaacatgtagaaaacttgyctctactaaaaatacaaaattagccgggcatggtggcacatgcctataatcctagctgctcgggaggctgaggcaggagaatcgcttgaacctgggaggtggaggttgtggggagccgagattgcaccattgcactgcagcctgggcaagaagagcgaaactccatctcaaaaaaataaaagggggagcaggctgaaccttttagggtagatataatagcagaggatgtagggaagggaaggaaaaatgcaaagcaatgtgagttttaataaaaaccacatggttatctgaccttagaagacgctgtggtctgaatgtgttccccagattcatatgttgaaacttaatggccaatgtaatggtattaagaggtggggcctttaggagatgattaggtcttgagggttccactctcatgcatgggactaatgccttatgttttagtccgttctcccactgctataaggaaatacctgagactggataatttacaaaaaaggttggactggctcatggttccacaggctgtacaggaagcatgatggcttccgaggaggcctcaggaaagtttcaaacatggtggaaggtgaaggggaagcagggacattacatggctggagcaggaggaggagagagacagggaaggtgccacacactgttaaacaaccagatctgagaactctgtcatgagacagctctacggggatggtgttaaactattagaaactgctcacatgatccaatcacttcccagcaggccccaccttcagcattgagggttacaattcggcattagatttgggtggggacacagatccaaaccacatcaccttatgaaagaggcttcattacatacgtccctttgcccttctcttcctcccaccatgtgaggacacagcatttatcccctccagaggatgcagcaagaaggcaccctcttggaaacagagcagccctcaccagaactgaacttgctagtgccttgattttgggttcccagcctccagagctttgaaaaatacaattttgctctttataaattcaccactcttaggtattttgtgatagcatcagaaatgactaacgcagaaggcttagaatggatgcaaccctcccacttgccgttcctcctggccatggaagccatgtgctgtcagtaacaacaataactacaatctgcacattgacagggggccaggcctatcatttcatgcatttgtgtttttaaatctccatttcgcagaattgttcaatgactattaagcttgggtgtttggcaaacttgggtctcacttctattcatgggctgtgtggggcacttactgagcctcagtttctccatctgtgaagtgggccacagtgttacctacttactgagcctcagtttctccatctgtgaagtggggtcacagtgttacctacttactgagcctcagtttctccatctgtgaagtggggtcacagtgttacctacttcatggatgtcgtgaagattacactgagcgggatcatttaatcctcatacgcaggagaccctgatcctaacttatccaaaaactttacaaggaaactgctgagagcccaaccactttagggcctttgcttggcctctctaagattcttctgacctttcccacacagtcacaatgtgtcagcctagctctgagcatcatctcctcacccaacaatagcacagtaggaagggagtgacagggaacgctcctctctccttcctcagtgacgaagaactgtcccagaagcttccctgccctgaaagacatcactgatgtctcacttagcagacctaggacaagaggccactcctagttgtcagggaggctgggagtacgagcatctagctggcggtctcggcttctcttgtggtgctggtctccaatgagaaagcagggaggggatgggttgtgggtgtatttcagtgttggctgttctgaggtaggaactgagcagttgagaaaggtctgtgcatgtgtctcagaggtggagatgacagtgggggtgagagagacagagcagagaactgctgctgtcagacagatatgggggcttagacacaacaatgcctctccagtcattttatagaggaggaccctggggtccggacaagaaaaggatgcccactcagcgcatggtagccaggggattcaggggacaggcctgcctggagtggagcttgcaggatgggaaccagtggaagatgaagttagggtgctagaacagcctcggaggagatgcacagagttggggcagactgctgcccactctacatctcttttccttagtaacaaaacctaatgaattcagggctataatatgcccaactaaaagactgtacttcctggttctcttgaaggcaggtgtggtcatatggctaagttctggccaatgaatgaaagcagaagtgtcagagggacttctaggaagattccttaagggagctgactcatctcgatcgagcattccttccttcctccttccaggtgtctggaatgcagatgtgatgtctggaactctagcagctctcttgtatcctgagaggactttgggtctggaagccacatgctaagctggggggacagcatgatggaaagagtctgggtcctgaactttcacatgtgtcttccatgtggtcttcatgagatagtgggtatcgtcgcctgcactttacagatgaagaaactgaaggagagagagccaagattcctacccccagaaaggccgagattcaaacccattctgtcttatgtcagaactcctgcttgtatcagttggaattctgtttggaaaagtrggtttatttttctcatgtaacaggaaacccgaaggcaggtgattgctggtgttgatttagcagttcaagggagtaggactgacatgtctgtttttctcttcactgttttctcttggttgcaagatggctactgctgctctgaccatgacattcctgttcaaggaagaaagaaaggggaacaggggcagtaccagcaacatgtgaaccctttcactgaaaaagtcaaagctttccagaatctgctaaaggcttctgcttagcccagcatggcagattgtattttccaaagatggtgccagcgatatttcccattacacacgctcttctgcaaggtgcccttgccactccctcatcgagaggtaggggctgggctgagagcggtggctcatgcctgtaatcccagcactttgggaggctgaggcaggtggatcacctgaggtcaggagatggaaaccagcctggccaacatggtgaaaacctgtatatactaaaaatacaaaaattagctgggtgtgatggtaggcacttgtaatctcagttacttgggaggctgaggcaggagaatcgcttgagcccaggaggcagaagttacaatgagcagagatcatgccactgcacttcagcctgggcaacatagtgaaactctgtctcaaaaaaaaaaaaaaaggtaggggttgtttctccactgtcttgaacttgggaagatcctatgactacatagaacacaacggaattgcctgtgcacagctccaggtgtggcccataactggctaggagcttccacctcctccctccgctctgcaagaagtcagataactcagaggctgccatgttaggagaaactctggaggaggaaaaggcacctggagagatgggggagctcaggggttctgaggctccagacatgaggtgaggccatcctggaggtgggtccttcagccccagccaccttaactgggcccatgtagagcagagacagccacccagctggctcttcccgattgcctgacccacaaaaccatcagcaaaatacagaagttgtcctaggctcctaagttaagaggtgtttggttggacagggataggtaactagaacctccatagtggccgaaagataactggcagcagtagatcactggaacctccacttggccatgcctgacctaaaaggaggttaagaaaacaaatgtttagtttttccagccccaagatacatggaggtaaaggagaggctcctcccaccaggcgcccctggttctctttacttttgtgattgaaccaaataaaaacatccaccacgcattgggccctatgtgtcaggcacacgcagcttctttcacaaggcaggcggtatttatggctcccattttgcatatggtaattacccagattgtccagctaggaagagtttgagcctggctttggacccatgaaggtcaacgccttacccacctgctttgtggctatagctatagtggagagtgagtaggttaacagcttggagaacagcgtttttggtagaaggaacagccagccagagcaaggatacacagaatgatgacacagcgaggctggggagggaacaggggttgtgcaggatgtgagtcagagaccaggctgttttgcggcctcaaaatcttggacttgaacctggaggcagcagggagccacttcagggtccgtttctttaattaaaatatttgaatcaacaatagagtcgcatggctcacaaaccaacaaatatacaagggaaatggaaaagtttccttttgacgtccccactcccattttcattagtctcccaggttagttttctgtgtcgcctttcagagtttaagtgaaacaatggtcagtgaagattcttatttttcctgttaacacaaaatattatggtgtcattctgcacctggctttttttgcttagtgatgaaaaatttaccctttaaagtgtatataattcagtggtttttcagtatgtttacagagttgtgtaactgtgaccactatctcattctaaaatactctcatcaccccagaaagaatcctgactttctatttcctttgttttttttttttttttttgagatagagtctcgctctgttgcccaggctggagtgcagtggcacaatcttggctcactgcaacctctgcctcctgggttcaagggattctcctgactcagcctccccagtagccgggattataggcacccaccactactcccaactaatttttgtatttttttttttttgagagagtcttgctctgttgcccaggctagagtagagtggcacgatctcggctcactgcaacctccaccgccgaagttcaagcaattctctgcctcagcctcccaggtagctgggattacaggcacctgccaccatgcctggctaatttttgtatttttagtagagaccatgtttcaccatcttggccaggctggtcttgagctcctgaactcatgatccatgaggatcatggcctcccaaagtgctgggattacaggcatgaaccatcgcacccagcccaatttttgtatttttagtagagacagggttgcaccatgttggctagactggtctagaactcctgatctcaagtgatcttctgccccagcctcccaaagtgctgggattacaggtatgagtcatcatgcccagctctttctatttcctatattgccctggcaaccatgaatctcttttctaatagtttatcttgcagatctttgcatatcagagcacagaacactttttttttttttttttttttttttttttttttttttttggagagagggtcttgctctctcacccagactggagtgcgatggcacaatcacagctccctgcactctccttgaccttcctggctcaagcgatcctcctgcttcagctttccaagaagctgaaactacaggtccatgccaccatgcctggctaagttttaaatttttggtagagacagggatctccttatattgctcaggctggtcttgaactcctaggcttaagggattctcccaccttggcctcccaaagtgctggaattacaggagtgagacactacacctacctagtctttcctttttttatttgagtaataggtagggtctcaatgcacaggtatattgtgatttattcacaatcccataagcatagctattgggttatttctagttgttctctgttatacacagccctgcactgaatagcactggaccacaatggatagcagcattgtgcctgcacataagcagcatagtaggacacgttcctagatatataattgctgggtcaagggctccatgggaatttgcaattttgatatatatttccaaattgcccaccacagggttgtaccacatggactctcagatatggaggatagattggggccagtgtggctgtggtggggtggcagggctggtggggaggggactactgtggcattccagctgagggatgaggacccttggaaggttaaacccaagggacaaggacatggtgactggttagagactgtctgaggagaggatggtgagagttactcacgatgatccctggaggtggcattcccccactgtcccccactgtccattctctcctgcttctacagtaattgagttcttagctggcatgtgggtgcctagctgatgcctactttcccagaccctcttgcagccaggtgtggccatgrgatcaggttccagccaatgagctgtgaaccaaagtgatatgtgcaacttgcagggcatgtccttcctctgccccttttcttctcactggctggagtgcagatgtgagggcaggagccagaggaaccatattgggccatgagtgggagtttcctgttaggcagagcaagaagacagaggaagcttgggtccctggtgagagagaaacaaacctctctctcgagtttaagccacgattattctgggtctctcttagagtcactatacatgaatgacagtttctgtcctcctgccagtgtgtgcctttcactaaaccagaggctgcaaagagacagccaagctgtttttactttctggatattgaatctcactctgtgccaggtgtggtcttgggtgctggagtgtggtgtggccagggcagatgcagtcaccttacctggggaccatcacacaagggcctgcaggaggggctgaactggaatggggctcaaaggtctcctgaggaggtaacatttaagctgagacctgcaggaggcagggccaacgcaggaagggaatgtagtgtcaggcagaggaaacaagagaatggcaaatttgcggcttggcaagaagttgtggatggaagtggagagtgcagtgacacgatcaaggctactgtgtcgctggccactttgtccaggacaaagtttaggataaaaactctcacaccaagagaacacagcctgccctaacttccccttctgggtgggttgtggtcattgggaaatatttagtgattggccgtttaacttttagaaagattcttcctagatttgggaccccgtgagaaattaaacaccaacctgcatctggaacttttcttcccagcgtcaatgttacgaagttatccagtgggtccctcttggtcatcccaagctaaccaccctcagggaattaatcatatcgctgttcctgccaacaacaatattcattcaggagaaagcaaacagtcaaaattgcacactgataagatgggtttggaagctcataaagaagagaattttctacagctagacaaattacaattttctcgccgggcacggtggctcacacctgtaatcccagtactttgggaggccgagacgggcaggtcacctgaggtcaggagttcgagagcagtctgaccaacatggagaaaccctgtctctactgaaaatacaaaattagctgaggcaggagaatcgcttgaactggggaattggggaggcggagattgcgccattgtactccagcctgggcaacaagagcgaaactccgtctcaaaaaaaaaaaaaaaggaaaaatatatataattttcttaattttcttacatgcacacaccaaaaagcaagggctcatgaggcatgtttcatgtccagcttaaagggagcccaacatagagaatttacagggattttcacctttatttatctttgctcttttaggggactgaaggccttgctggtttccttttctcctatttctgttcctatgtggggatatgacctttgaggtgaagttgggattcatatggatgcacatttggggagactgttgagatttactcagttatttatggagcatttattcattttaagcatttattcactcaacacgcatcccatgcgtcattggctggcagagggctgggggcccaggggtgggtggtgcatgacccctgccctcaggtggttgtgagggagtcctgtgaatggacaatgacagtactgtgtgacaggtgctatgcgaggggctgtggggacacagagggaggccctgaagcaggctggatggggcttggggaaggtctgttggagccttgaagcagggtcctttcacttgggtcttgccagttgagtgagagctggccaggtgtagaagcaggatggattcgacagggagggagaacagactagctgagggctgggggctggcagggcatcccagtcccagtccaggaacatgcaaagacccagggtagctgaggctaagcggatggggcctgggggctggtgatgaaatgcaagaggtagccggacactcgtgagcagggctcatatgtccagctgagcgagtgcaggcttcactgctcatactgaagccctactatgtgccagtaaagagagcaggcaaagctgtggacaacctggtccctactccccctgttgctgacagtgtgcaggacatgtcaccccaagacatagcacctcggaaatggagaaaacatcagaagcaggaaggccactgtctgcctttcccaggccttgctgtatgaccactggcrtgaaaggattctctgacccactcccctgaaagtagagaccctcatgtgacaggtgtcctgacctgtacccagaggaaaggaatgaagacacagaactgccaagacgcatctgaacaaacagggccttgctgagcacctccagtttaggaccctgagatcacaccccctctctccaatcacacgactgtccactctccagcaaacctaggcagaaaaatgcatcgttttcctgtgtctttgagtcttgatttctgaaggttcgcatgtcacataaaacttagatggaatcaatgcatcgcacttttctcttgttaatatgtcttttcttataggggtgtctgctatgaagcttgccatgggggaggaaagggwatagttttctccccctgcaatgctcagagtgcacttgggaaaycataagcaggtgattatcattgaggctttaggaggtacgttagtttcctgtggctgctgtacaaagtgccacaaactgggtggcttaaaacaacagaaatgattcctccctagttctggaagctggaagtgaaatccacatgtcctgagtccatgttccctctgaagctcttgggggtgggggatcctttctctcctcttccagcctccgtgattgcttgtaatccttggccttccttggcttatggctgccatctctgcctctttcttcacatgcctccttctttgtctgtttctgtgtccaaatcttcctcttcttaacaggacaccagtcatgggattaggacccatcctaattgatgtgacctcattttaccttgattgcatctgcaaagggcctatttccaagtaaggtgacattcacaggcactacaggctaggatttgaacatatcttttgtggagacacaattcaacctgcagtaagatgctaaccaagcacacccctctcctctgaatctgcctgagctctaaatccactgaagtcaggtggacagcaccaaagtatccactgtgctctgtctagaagctggtgactgtgtsggataagtgctgcaccagtgcacctcctctggccaccccagaatcaggcaggttcacccacgcagtccaagccaccctgcaaggcaggagggatgagaacggccatgaatgtccctttcatggaacctggatcttgcagccaggacaggaggttgccctatcctgaaaattccagatgatgagcatgggctgtgcagtgcgcaatgggaacagaggacagacacagacatccccagacatggtgcttgggtctgtagaggggtccacaaaaagagacgattgtaaatgggacagataggaaggagtcagaaagagtggaaggttgcagcagtcttggcagaaaccctgcagtgagaactccactggatgggggaacagcattccccctgccccccacaacacattcccctcacatccttgcttctgggacgtgttcctttcaaattgtcaaaatgtcaaaaggaggcaagcatgcatggtcggttacgcgtccaaaatgaaatcgaacaacccaaggtcctcctgagaaccagctaggtcccgaccacttgcgcatttgaatcatttctgatctgggtttctggcctgggctctgcaggccctagcacccaaggaggccaactcactgaagtagcctacgcttcaatgtttggctgtttgcatttcttgacaaaggaaatttgttgggcttaagttgccaagggtttgcatctggatcctatgatgtttggctttgggagggctgtgcgcagaactggctctggggcctccaccggcctccatgtaattaacttaagtgcttcgaagatgaaagcttatttgcctgatcctggattatggcatgtgccgtgaaggtaggcagagcagacctcgccagttatctctcgctattgaagtttccaaagaaaccagtggtggacagtggaagtcaggaagtttgggcatgttggaatttattaaatttgcagttaaaaaaaaaaaaaagttctggttgccagcacaaagaggttaagtggaaacaactttacataatgaagtggttaatcatattttgctttagaaacactaatatcataaattggcctcatacttttgtgcttccagtttcaacaatagagcaaagacattaatttcctggtttggtataacttctgggattttccttctgggcctcctcctccttctcctcccttctctcccccctcagctggagtgaggaagatagctttgatcctagatgctctggaggcctgggggaggtgaaaggggggatggtgaggattcctacaggtgatttttaggcctgaattccattgtgacagcaatgatttattttaactactaacccaggaaagcaggcgccaccaggatgaatacctccatcagcttctagcagactaattttactgtttatgaatcactaatatgtttaagaaaaaaaaagggagtactattttagataactaaaagtaagacttcgagaaaagacctcatggtgctcaaacagttccacatgggaaagatgactttggattacaagatagagaacacatggggtccagagagctgcccccaacctccgcagcaggcagaggctactggcagatgaaacactttcatctctcccagggagataaacaggccggtctggatgggcctctttatttacaaaagaaaattaaatccgttttaacacttgcaccattcataggaaacacatgttggctggtaattgttttgaactcattttgagctgggctgcaccacgttgggctgcccttgcgttttcgcastggtttgagatggccgtggaatttgcaaggaattttcttcccaattccagaggctccacgagggggccgttccttggccaagctggcagaagagcactgtttggcttcctgcctcctggagggaagcactttccccttattgggagagggctgcccccagcgccccttggccccgcattcttatcgggagattggaaagaatcaaagggtctcacggccctaattgagcctgaagggcttccttccctcccacctgggagttttctcagaagaagaaataaaaggttgggtgattttcccaagagtttctgttggagttttacagctgcaaggaggcgtcattccgaatttgggtgtcacccagcttttcgaatgctaatatgcatacgatttcctggggatctcgtgaaatgcagattctgattcagtgggtcgggggtggggcctgagattctaacattctcgctgattgggctgatcagagtcccatacatgacgttctcagaccttcccttccagcgcatcagaatcagggctcgttaaaatgcagatcgcggggcccctcctgcagaggctctcattccacaagtctcgggtggaacctgaggatttgtgtctctagtaagctcccaggtcatgctgatgttgctggtttggggagaacactttcaaaccactgtccaaaaccaatgccctgagaagaagcgagcgcgtttttccatggggttccctactgtccaggcaccaggaatggctctgcttgagggcagaagatggggtttgactgagaaggtctaggctgccgttctccattggacgtattttctggagctgttcgcttaccctggaaggccccttttcttcctctctctccaaattgcctcccactcatttccaaagctcagtgccggcgtcacctcctccagggagccttcttttcctccaggcctgagtttgtttctgcagtacattttgcatgtctgtatcatcacttcatttcaccacagtgacctatttgcaggtaatagatagtgcgggaggtcctctctgaaacctcagagaacaggacagagaaagtagcaagcagatatttcttaaatgaatgaacaaatatctttccagtggcatctttgcctgctgtgtgtccttggacaggttatttaacctctctgatgcttgggtttcccatctataaagtgaaaatggtaatgtctaccccacagagttgctgtgactagttctaatgtatgtaaatgggccagtcacagacaagtcatagatgaagcttttgttgtttttgatatttttagtgtgaatttttattattgtcctcaaggtcaatatttttatccttaaagtcactaatttgactaaggttttgccctagttgacataaaacatattttgaggatgttaagccgttggggggagatacgaatatgactcatatgtcttcagcactttacagtttgcctgacaattttgccacaagttaagtcatttaatcctcacaaaagtccagcctaggaagtactatcaagttgaggctcagagaggtgccggcgctaacccacgttcacacgcggccctttttcaacctcgttgcctcaaaggcggggagctgtgctcattgaggacttggtctgcttccccaggcccacagctcgaggacgtgagacctcactgtcttttctagcttagaaaacagctcctgccgaaaatcgcagaaaaccctcctttctgaggttccaatgtgttttctgaggagtgtgtttatcccggatatgtgttccctctcccagaattctggggtcggctaggcttaggagcttggtatcctccgcctcgttcccgaggccctagacacccctcagtgaggaagccattgcgggagggctcagcgttttctggacttcacagctgtggcattcccgttcctcgacgccagtgggcgctctgctcgtccttctcccttcctccgaagcagccttggctccgtcttcaggatgttcttcccaccgcctttgggattttggaaggccgttctcccttccccactatttctagcttcctctaagtctctgagcagaaaggcctttcctgaccagcttatgggcaacggtgaccccgccccttacctgtcaccctcccccattttactttccttcatagaactcatgaccagccagctgacatggttcctgttgtatttttgtggtctggctctgcccagtaggatacaagcttcatgagggctgcgacaattgtactttttctccactgttttcccggtgcccacaacagcacctggctcattgcaggcactcaatgaacatttgttgatgaatgaatgaatgaggctggatttggtcagaggtgttggaaccagagcaactccatcttgaatagaggctgggtaaaataaggctgagacctgctgggccgcattcccaggaggttaggcatttttttttttttttttttttttgagacagagtctcgctgggtcacccaggctggagtgcagtggcgcagtctcggctcactgcaagctccgcctcccaggttcacaccattctcctgcctcagcctcccgagtagctgggattacaggcatgtgccaccacgcctggctaattttttgtatttttagtagagatggggtttcatcatgttaggcaggatggtctcgatctcctgaccttgtgatccgcccgcctcggcctcccaaagtgctgggattaccggcgtgagccaccacacccgggtgatgaggttaggcattctaagtcacgggatgagacaggaagtcagcacaacaaaccgatcataaagaccttgctgataaaacaggtggcagtaaagaagccagccaaatccctccaaaaccaagatggtgatgaaagtgacctttggtcatccttatggctcattatatgctagttataatgcattagcatgctaaaagacactcccccccccagcaccaggacagtttacaaatgccttggcaacgtcaggaagttaccctatatggtcaaaaaagggaaggaatcctcagctctgggaactgcccaccccctggaaaactcatgaataatccaccccttgtttagcatataatcaggaaatgaccataaaagtggacagccagcaaccctaagggctgctgtgcctatggagtatccattctttattcctttgctttcttaataaacttgctttcactttatggattcaactaaaattctttctcgagcaagacccaagaaccctctcttggcttctggatcaggacctgtttccagtaacagactggctccatgagtgtcactcagcatcttcccagttggctctggccatgggcatctggcacccagatcctagtgctggctccttccaggcccaggcctgagccctgccacagaggcagccctggagaggcagaattgcacctcaatgtgatcggttgtgttcaagaggcaggtggcatagaacaatgaaaaaccaagagcgtaacagtcaggcagatctgagttcaaatcctggttcttcctctgcttagcattgtggtcttggtcaacttactttggtgtcctgagcctcaggctgccattgttaaataatgattcccacctggcacggtgactcatgcctgtaatcccaacactttgggaggccaaggccgatggattgcttgagcccaggagttcaacaacagcctgagcaacatggggaaaccctgtctctacaaaagaggaaatgtgttctgtatcctcctgctggctcccaaacctacctctagcttacaaaacccaagcactttgtgctacccyggacatggttaaagctaattcttgaagcagaagttggcggaatgtaaaaaagcctttgctaaggacttgaccargggaaaactccaagcttggaggcctcctaactgctgcattctcagagcagtctcccgcccagggcgagagctcctgccattcaggagggacctttctctctggtgagctttgaggatgggcctgtgaccttttcccagcaccttggctccagaaaaaatgtgcagaagccttttttcctagaagccttgtgattactctgaaaccagtgctcatgggagtggctgcaggaataaatcttgaagatgtttatcctgaaaattccaggtctaatttatgtcctcctccaaacagcatcttggcttgccagccattagggtcatcatacacggaacaacatctctgggtctcagagcataaatacctactgtcaactgggctgggagagggcaggctctttatggatgggggattgggattgaggggtctgctgggcttccagttaccttccagccccctccagaggaggtgatactgcttttatcaactccttgtaagatgagatttaaacctagtcagtccttaggattctattgacagcaatttgtagggctgggtggaacacccacaaacaaacccaattagaagaaacctctgacatgttagataaagatgacaaaaggcctgtctcaggcaccaaagttagtcaccgttgctgcaaacatgtctggattcctgggaagttcttcagggtttagttacttggggcaaagagaaaacttagcagctgagtttattttacagagacacccagggaagggagtggaaggagcagatagacctggatataaaccctggctccctgagtacgggtgtgggccagtgtgcagggcacagagcctttctgtgtcaatgtgtgctcagccttgcacaagcatgcatgtgtgtgtgtgtatgtgggtgtctgtgtgtcttacgtggacagggagtgcctgatacacagtaggtcctcatgctggcaaacccctttttgctggtacacttttctttctagaaccctcatttttctgcccttcaagtgaacgatgtgattgattgagtcacagattgacgcattcattcgtttactgttcagtacattcagtacaagtttactgtgtgcttgccatgtggtggacactgaattcagcaatgggcaacattccaagtattagggtctttctccattattcaagtgctgttgactccagtgaggacactgtgggcaggcgtggagatgtgatgtaccctgagcagacagacacttgagtttccattcccagcaccagggtggtgccaagtacacagtgacgtgccactccctttggacacgtttattacatttactgtcctttgttccccctggaatgcaagctccacgaaggcggggatcttcgtctgttttgttcactgatatccccagagcctagtgccctgctgatatagtaggcacttgataatgtatttgtcggatgaacgggtaatatagtcactcacaggcagctttcaggatgagaatgtttgtctgatcctctcatttataaaaatcctcacaacaactactctccaccctgtccccagtgttgaaagaatctatagagtagaaataatcagcccattggctatttcaataatatatttagttctgaaaagctcttaattgactctgactcctctctgagtcctttccttagacctcccttaaaactctagcctggtttgttcactgtaggacgaaggagtttgkgagactctggctctgaaggctgcctaggagcttggcaaaagcgtctgtccggagtcctgcaataaccacgcccctcacccctttacgaccacacccacttattcccgaccacgcccacgcatccctcctttagtcccagcccctgtccccttcaggaccacgcctaccccctccctgaccactcccatccctataggactagyytctcctcccctcaggaccacgcccctctcccattccaggccacgcccaccccattcaggacctcgcccacctcctcctcggaccacgcccgttctcctcacgcccacgcccagctcatcttccattcaggtcttcyactccgagtggacttttggaagcctctttgatggttgcagcattagtagtatttctctgcacacattatcctgacgccgattcagaccacgttcccttaccccctgactttgctcaaagagacagatctccatacttcttccytccatttgctatcttaactccacccaccatcatcacacrcatattgtaggaaatttagaacataaaggtgtaaaaagctgaaaaacttctatccatttattctactactctgaggactggagataatcttttggcccgtttctaatagtctatttctttttctttatkagtttattagtaggttatgcagacaattttgtgttctgtttttatcatttaaaacgatctcacatattacccatttctttaaaatagtttgtaaatctctytctctctctctyttttttcttttgagacggagttttgctcttgttgcccaggctggagtgcaatggcgcgatctcggctcaccgcaacctccgcctcacgggttcaagcgattctcctgcctcagcctacggagtagctggaattacaggcgcccgccaccacgcccggctaattttttgtacttttagtagagacggggtttctccgtgttgatcaggcttgtctggaactcccgacctcaggtggatccaccygccttggcctctcaaagtgctgggattacaggcgatagcctccgcgtccggccaaatctcatttttaaatggctgcttaataattcatggtgtgaatgaggcatcatttcttagtccctaattttttggacatttatattaattccagttaacaattaggtgacacatgtaattgtgcacacttctttgtctgcattttgacatatttcctaaggattgattgctctaagtagctttacaaggggtcagagagcactgatgtttttctttttctttttcttttttttttctattgtggtaaaatatatataacataaaagtgaccttttaattgtttttaaatgtattgttcagtggcactgagtacattcatattattataccacaatcaaccccatccatctgcagaatttttccatcttgcaaaactgaaactctgtctccattaaatatgaaccctacccctgctcctccaggccctggcagtcatcattctgcttctgtctctatgattttgactactctaggaacttcagacaagtacagtatttgtctttttgtaactgattatttcatttggcataatgtcctcgagctctacccatgttgtggcatgtatcagtattcccttcctttttgaggctgaataatattccattgcatgtgtatgtattacttttttttwaatttttttttgagaccgagtctctgtcgcccaggctggagtgcagtggcgcgatctcatatgtattatgttttatttatccattcatctgtcgtggacatttgggctgttcccaccttttggctatcgtgaataatgcagttatgaacatgtgggtgcaccagccttttaaagattcttaataagctttatcatctggaaaagttgtaccaatttccatatccactagcagtggctgcatgagtgcctattttactatattcagcacttgacagcaattttcaaaatggaagacctgtgaatattgagggggacatgctgtaatgaaattacatgtaataataggaaaaggcttattctctttacccactcacctacccttcttccttccaaacacctacccatccacctatctgtccacctgctcacttacccaccctttcttccacccacctatccatctacctatccatcacccacccacttgctcacccatctacccacccactcacctgtacaggtatccacccacctgtctactggtcttacatatttaatccgcctgcccatccatcagtccatccatccatccatccatccatcatctatccacccatccatccacctatccagccatccatccacccacctatccatctacccatccatccattcacccatccggttatccacccatcatccatctatccacccatccattcatccacccatccacccatcttttctgtcttttccagctccatcttcttgaagctactctcttatttgtttacaacacaacagaataagaagatgagaatatctaagaatcgttctctctctgtcctttattcctgcaggggcatctgaaaggtcacactttattacctttctaagtcattcccctgctccctgccttgggcccccagtctctttgaaattcctctattgaatctttgaatcttttaaataaagatcaaatttctctgcctcctcccacctcctagtttgcaccatgttatactttcaattgttactgtggagttacagtttcaccaaggagcctcccctgcttttgttctttcctaagcaggtgggttggtgaggtggctgcctgtgattctagtggcttttatgggggcctttggcagaggaggagtttctgagctctgaaatatctccttttgtagatagcatcttgggcctggagctaagagaattaagaggtatttacaatgatttacagcaaatgttatactatgttacagtctcactttgtcctgaaatttgtaaggcaagatctggtgtgcgtgtgtgtgttttaatgtaagcataatgataggcatattatatgggggtatttctataaaaagtagaaaacaactataatatttatctctctattaattccctggaaatcactctaggatggatttaagaagagaggttatctcaaataaatggaataaataataagcaaaaaagcattttagaatgaggccgaattggcatccaaaataaagtgagggataagaagaagatcctaaagttggcttaacaaatgctttgatcttttacaaatgggtttctcagctaaaaagaaaatagagagaaaggtgtactgtcatagagttcacattttacaaagcaggtcatttcagactctgctggagggtgtgctgctcccccagctggagtctgcactgacttcagacaggagttctaacggagggcacgtggctcatgcacactgcgtgtttctccatcatcttttatagcggcaaccccacttccccagttgtttactttgagggcaatttccgtatcagtccaataggtacttgagagagagaagcccttttataaaatttagcttaggattaagccaaaaataccaccatgtgggggaagattcctgttccaaacactacctgtgtgtgtatccatgcacaaggctctcggcttccaactgccacggggagttcacggcaaataccgtccattcccaagaagccagcattgatcactgtcgagcactgaggagattggaaacagggcgcagttgttattttagaagcaaactactccctttcctactgcctttcctaaggactctcttgtagttgggctttcctggggctatttcagttcttttgggccctctgaccaaaaaaaagttcatttaaattttcttttttcaaattttcaaatgacatttggagaaaagaggaggggagctgaggtaggacagtgtttgcctcaaagtaaaccactgagagagtgggggtgccactataaaagatgatggagaaatacacccaagtgtgcactaatgagaatccacatcttcccccaaatccatatagaagagttggcttcaggaggacatttccagaactttccagaaaggtcttcacttaccccttcagagaatcttcgcagccatttcttctccaggggagcaaacttatttcccacagcttcccatgagtaccagtgtcacagccatcctcatgtaagtggcactctgcatggcggcctcatgcagaagaaaggctactctttgaataactcgtgtattgtcatagtttttacatccttccccctcctccttaccttctcaatttcactcttctatgtcctattctttagtaatgttttttaaaaaattccctcttttcttgtctgtcttttcctgttcttaaatatgtcgtgttactggcaattatggatttctttacgactagggtcatatctgttgtgagtctttcccagtgccttgccttcctccccaccaaaaaaaaaaaaaaaaaaaaaaaaggctctgacttgataagaaattctttgacattttgagctgggaaacttcattcagcgggatattgccggcaggaggtctgccgcccagcttagggtgcaagcagggctggggtgtgggcgttttcctgggagctcctgatttacatcgacctcaagtatgaagccagtaaaagtgccagcgatgctgtgtctttgaggttaaaaaatctcttgtgttgatatggctaattctgggccacaagtagcaaagtccgcagaaatgtattttcagactcaggaaatctccaggctaaatttaaatgctctacctgagtgcgcttctcagtgaggcttttgaaaaccgagatgtgaaatgaatcgcagatcactttaaaatgcgtttattcatcttggaaaaagtctctccgctgaattctttagcttctcggagccaaaatgtctgtgctgcattaacactccctgcccccacctttagctccagcagctttccaagtgtgtcttctcttttccttaaaaacaaaacattcttccctttttcccattatgcaattcaagctggcagttagcaaaggctgtaattaccgaaaatatctgaatagcttcattaccgtggacaagttattgtcagtaccgtgtatcagtttacagccatcttttctcacttttcccacaccgctaacaatccagcagttaatacacatcttttagccatccgatgttgtttgagatagttgtggttgacaacaaagaagaagtattaggaaacatactttgcaaaacatgtattcccctttgcaagatgtaaaggatgcgtttgagcagcggtgaccgcagtgggcttgtagttctcaggttctacacaagagggcactttggtatccccttgcacaagaccctgagaatgacagggtgctgtgtggtagtaactttcgtaaaagtatttcatatccacggcctgcttacttttggcaaaattacttccagccacaattaagaaaagggaaagttatatttctacagagtccttgttttacttgtgtgctcaacttgcttagatgacttagtttcctaatgacagcgccttctaaggaagtgatgtggattatccaactaaggtcgtgtcacttttgcgatcagagtccactgtgggcaaaaccagggaatgttcaaacgttgtccttcaaaagtcatctcatctcaaactgttacgcaggtgataaaggttctaaatgagcactatccgcttcctgtttttcatccttatctcattaattaaacccatgatccataccagcacctgcaccccagatatagcttctcaggtagagctaagccagattttgagaaaaaatgtatggctgaattattaataatttccactgagacatgaactaatccttccattcctacctaaactcttttcagagttaaaaacaaacaaacaaaaaaacaaaacagttcagggccaggcacagtggctcatgcctgaaatcccagtgctttgggaggctaaggcaggaggatcgcttgaagccaggatttccattctggacaacatatcgagaccctctctctataaaaaactaaaaaattagctcaatgtggtgctatgtgcctgtagctactctggaggctgaggctggaggatcacttgagcccaagagtttgaggctacagtgagctataattgcacctctgcactccagcctggaaaacagagtgatagcctatctctaaacacacacacacacacacacacacacacacacacacaaaattaacagttcaaaagagggtaccatgtttaatcattgttaataaaattcagactaatgaagtaaacactggtatagcaatgtggataaaagtttttatattatatagatgtgggttgaagttcagatcttcccacgaggtgactttggaatagtcacttttcaataatgtactcaacaaattttattgagtgcctactgtgtgcaaagcacaagggatgcaaagatgagctaaaccagatgggccctattcctaggagccatagtctagcggagaggtagatattcatcagagtcacacaaatatgtggacattcaaaactatcatggcagttaccagggatgtcccctcatttccgttttttttttttttttttttttttttttggggggggagtctcactctctcacccaggctggagtgcagtggcatgatcttggctcactgcaacctccgcctcccgggttcaagtgattctcctgcctcagcctcctgagtagctggaactacaggtgtgtcccaccatgcctggctaatttttttttttttttttttggatttttagtagaaacgggttttttcatttttttttttttttgtatttttagtttagtagagacagggtttcaccatgttggccaggctgtctcaaacttctgacctcaagtgagccacctgcctcagcctcccaaagtgctgagattacaggcgtgagccactgcacccagcttgtcccctcatttcttgttggacacatggtatgattgtacttacccaccccatttgaggttaggcatgtccatgacttgtttggcccatgaaatgcaagcataagggccatgtgtctcagtgatgggtagaagctttacaagccagtgcaccgtttgccacattccctttccactgtggcagtgagtgtggaagcgggtgttaaattaagcctcttctaggcttgggtcccagagtggctctgatgaattacactcccaccccctggcatcccacaatgaacacataccatgaggagaaataaacctttgttaaaccactgagattcagagcttgtttgttactgcagcagagcctggcctatcctgagtgctgcagctgcgagacacgcaggtacctggtgttgtgaaaggctatcagagggcggatgggctgctggcagggtagaaaaatatctctgaagatgggaaaacaaagctgaggtctcaagaagataggtaggggccccaaaggaagagcattccagagtttggactaggggtagaaatgaaggtggagagatttgtatggatcagcctcgctgagctcattggtacatggggctcatagatttgttgagaagatgagcaataacaaggcagggtgcccagcctggggcctagaatgaagtaagtgctcaatgcatagcagtaactagcaatatgtgccagatactgtgttaaatgctgcacatataggaactcattcaattcccacacagtcctattctttaggaacgattattatccagcwtactaactgaaagacagggaggttaagtaacttggccaaggtcacttagttactgagtgatgacacttggttttggactccaaatctatgccacctgactttcactgttggttttgtcattactaggattttagtcataaaggcaaaaggcctatcttcctctctcaagctrtaacaggagcaactgattaccaatttaaagctgtgtgtgatgatgtacaactacttttaaatcccattgatagcctgtattagtcaactcttgcctggtaatgcggtgtaacaaacaaccacaatattcggaagcrttcaacaatcaatatttacttcttatgggggtagaagtcgtctggggcagtgcatttgggctggcctcagctgggcggttctccttcaagctgggagtctggtggctgagcttggctgggatggctttgctctctgtatactcatttttcgttatctctgaaggaacatcaactacttggggactctcttctcagggtgatggcagaaatgcatagagaagaagtgcaaacccatgatacatcttcaggccttgcctggaacttgcaagtgatttgctcaaggaggcagagctaggaactaccagggccagattcatacccacgtctgttggactccaacgctgtagaaagctccacatcgtgctgccttgcttaggtggagtatgatccttagacggcatccaggacagaggtggtcacattacatacatttatatattattacattaataaatatataatttatacatatacttattacatacatacacttatgaatgtctatgtttccataaaattgctggatgtgaaagtacccaggattatctgagcagggggcggccatgggaggtactgtggacggagcatggcctttggcatctaaagctctttgcacttaatgtttcatctgggagactgtatggctgttcctggctgagaaatttgactttgacaccacggctgcaaaaagtcctgcagacttcagcatcctatgttaatttttatctaagtgrtgtgttagctgatggggttactctaacagcagaacaaagtacagtgcttatttctttaaagttttacacttttcatttccgtttcattctctttctttgtcttttgttttgtttttgtttttgtttttgtttttgtttttttctctttgtggagaacaggatctcgctatgttgcccagggtggtctcaaacccctgggctcaagctatccttctgcttctgcctccctaaatgctaggatcataggtgtgagcccctgtgtccagcctttccttcgatttctgttgattgtctctcttaatagtttcattggctaagttaactcaagagtgatttcactcagttggcttactcatagaatgggaatagcatatctaccccacgggcttcttgtgaagataaaataagacaatgtttgcccagggcaggatggggatagtagtctgctgggcctcccatgacaaagtactacagactygggggcttaaaccatagaagtgtattttcttacaattctggaagctaaaagtctgagatcaaggtgtccacagggttggtttctaatgaagcctgtctccttgacttgcaaacagcccccttctccctgtgtcctcacatggtcttccctctgtgtgtctgtgtcccaaaatcctctccttataaggacaccaatcagattagattaaggcccatcctaatgatataatttaactttagttacctctgtaaaggctctatttccaaatacacccacattctgaagccctgggggttaggacttcaacatatagattttttggggaacacaagtcatcycctcacagcaggtgatgtgaagtcatgagctccaccctggccccttagtagccacatccttgatcaagtcccttccactactgggtctcagtttcctcatctgggaggtgggattgatcctaggggccgtcagtggaggaggctcaaggaagtcctgtagcttccagcagaacaagggtgtccttcargcagctsctcgtgagcagaggggcagctgtcctttttctgccatgtttcagttggggctgtctcttctgcatkctctggctggaagggacctctgaggtcaggtcaggtggtctaggtgacaagtgagggtggtgatcagttgacctctgtgacagctgccactctccttcccagccagactctcccagctatgcctgtttcaggagcaggaatggagtgcaatggatgggaaggcaggagagctagrggccgaggacccagctgcagacttaactcccagccattcatttccagagacaggrcaaagacctttatattttttatttccttcttttaacttaaatgtcattattattattayttttgttttgttttgctaagagatgagttttcactatgtttgcctaggctggtctcaaactcctggcctcaagcgatcctcccgcctcagcctcccaagtagctgggattaaaggtgtgagttactgagcctggctwaacttaaacatttttgtgaaaatagctaatatagtcacataaagcaaaatcaraaaagtctaagcaaatgtacagtgaaaactttctctgtaactctctccccagcctccgcattcctttcccagaaggcttccagtgttccaagtttctcatgtatcctttgagagatgggttctgtgcacacaagccaatatacggctatagtcttttcttccccttctccccttctgctgtgcactttgattttcctgcctaactctcyatcctggaggtggcgggagaccagctcatgaacttcctttattctggttgtcrctgcgcctttatcagatgccagtgtgggctatactgcaatttagtatcgatgccttattgacagacatggttgtttctaatatttrgggcattaccttaaaactctcctgcctcaatttcctcatctatraagaatgcagaacagagcctggcacaagacattcaataaatattgaagagtaatatataaagagtagctcttttggtcattattctccctcttttttccattttattaattcattcacgcatactctgagcctacgtgcatgctgttccctctttccttccatgctgttcccctttcccctcccttctataccctcttccttgggttgcccagccatatggtgttttagtgccttgtccttcccctaatcaaaagcacaagaagcaaaagcacactgagcagatagcaatgaactaattgacaaaaataaataarcargccaaccagacattcatgttatcakgttattaattcattcattcaaaaaatatttttgggcacctgctgtgtgccaggccctgtggtaggcactgggggtgaaatgtgacccagtggtcacatgtcctagctgaggtgccaagacagagtttattagacagtgatagaatttgcaagataggccaggcrtggtggctcatgcctgcaatcccagcactttgggaggccaaggtgggtgggtcacctgaggtcaggagtttgagaccagcctggtcaacatggcaaaaccccgtctctactaaaactacaaaaattagccrggcgtggtggcrggcacctgtaatcccagctacttgggagcctgaggtaggagaatcacttgaacctaagaggcggaggttgcagtgagccaagatcgcgctactgcactccagcctgggcgacagagcaaggctccatctcaaaaaaaaaaaaaaaaaaaaaattggcaggatcgcccaccacaatgcacatcttgacaggaaatatccaagaatggctactggacccttagtctaaggcaaggacattaagcagatcaagagagtggaaatgggaagatatttttgaagaaagttgttggtgcacagggctggggattgggaaatgctctgtacaaatcccaaacctggttaaaaaaaaggcacccaaaggatcatcggagggcttgctgtgtgccctgtagctgggcacagggcagtggtgcctgcctcttgctgaaggcagctgaaggggcctgtggcagcagcatacggggggtcacctgtaaatatccatcaggtgcagagagcaagaagccatctgacagcagcacccatcacaggaatatttttctggttttcttccctctcctccctctttttttttgagatggagtctcactctgttgcccaggctggagtacagtggctcaatcttggctcattgcaacctctacctcctgagttcaagtgattctcctgcctcagcctcctgagtagctgggattacaggcactcaccaccatgcccagctaatttttgtatttttagtagagatgagatttcgccatgttggtcagcctggtttcgaactcctgaccgcaagtgatctacccgccttggcctcccaaagtgctgagattacaagcgtgaaccactgtgtctggcccctccccctactttaaccctggtggggtcaggaagaacagccagcatgggagaaagggagagggcaaaggaggatggattcctcttcctgggcaggtgccccatctggagccagcctgggctagggagaagaaaattccaagtttaaattgagctctgagttttggttattaccaaattgggattggctatttcatgccgaattgaaaccaggattatggcttagagtgatggcagaactttctgttgcctaagaaggagcaggagagttgtggaactacggagttttcaccgggacaggggatcaagggcaggcaggcagggacttcaagaaacaaaactgcagctgcttttctgattacaccacaggaatcctctgtgttcaaaactctggttacataatttacatgaacgtgctcaggtctttcattaaaatgcgtgtccttcttcaggctccctgctccatgggggcaggggttaagtctgcatcgctccccatttcatccccagggcctggagcatagcagatgctcggcagcgtttgccgagtgaatggatgaaaccaggggcagcctagatgtccagccacgggagagttcatttctcattgtaaattaacacttggtatctcaaccacatgcttcggtcccttgggactgtaaggaatgtgcaggctgctgggaggccggtcagttgtggggtctactgactggctcatgggtctggatgcctctaaggtggaggcctgggtgagtggcaggtgccttctggcaggacctgcctcagtgctcaggtgtgctgcttcccttgggcaaaaatgaaccaaaactttcttccatgaggaagaaagcggagtctcgagaggaaagtccaggcagatctcggctccaccactgaccctctgtctgactcagcttccatagttgtaaaacaaaagggttttatgacatccacctaaggggagcaatgggaagcaggggttgtcccaggttcaggtctgagcttctgttccatgcactggctagagtgtgatggccctgggcaggtcactaaaatagtaaataacccttatttattactaactactgtgttccaggggtgtttagtgctttttatatagagatattaactcatatactctttacaacagcactatgaagtcggccacttcattttacagttgaggaaatggaggcacagagaggttaagcaacttgttcaaggtcacacagctaatagtgataaagctgatataggaacctgtatcaatgtacttgggctgccataacaaaatgtcacagactgggtggcttaaacatcagaaatttattttctcactgttctggaggctggaaagtccaagatcaaggtgtcagcacagttggtgtctcctgaggtctctttccttggcttgcagatggctgccttcttgctgcattctcacatggtccttctcctgtgcatcacactcctggcatcttcctattctcacaaggacaccagttctattgcatcagggccttgcccttatggcttcatttgcttccttccaggctcccaagtttcaattttatcatgtataaaaagataattgtgatgatatctacatcagagagctgtcagaggataaaatgagacaacatacaaaggccttttaaaacaataggacactattgttacatgaagatattaaacaaataaacctcataacccccagagtttgaagacatgagggttgacgctggggaccacatattggctggctcagttggaaagacactctttttaattgtctcctgacagaattcacaagttaaccctccttgagatgtctatcaccccttgtccctccctccccatcatccttgctgtattaggccatctcccactgcttgtttgagactcagttcaagtgttgcctcctacaggaaggcctcctgggttttcctggactgagtggttaccttcgttttcacacagcctcctgttagccttagcacacaccacaggtactagacagcctgctacttttcagcctttcccagactgaagctcctgggtgggcatgattttatcttattctgcttgtgccgcactgggcacgcagcgtgtggtcaagtgaaatgtttggggaaatggattgaatttcttattttccaaaatactttttcctttcacttttccagctttcatcctttatctcgcacccccgccccgccattttttctgtctacatttctaaacatttttctgatttcaaagcatagcatgcccttcccaaaaaaattggcaaatttgaaaaaaaaaaatcacatgtaaaataaaaatctgtgattccactacctggatgtttttcctttacacaaagttccatccaatcattttcccctgtatgtatgtgtgtttatatagctatatctacatctatataatacatatatgtatgtgtgtacataagtgcatgtatgtcagtgtatatattggtgataataatcataactacatgcgcaattttgccgctttttccttttcttcacttcttatcaaacacattctcatgtcattaaaatacctttgtaaacaccaacttccatgacagctgcacattctgttgtttgtgatatcgttgattttcccctctctgtttctgagggctccttcataaaccacctgtgggttcccatcgtgttcctgcgttccctcctccctggctccacgctccttcaacatctctcccttcaagcagatgagtcacttcttccatagcttacaaattggtctgggcactttgttcctggagaatcacagaatttcacgtccacagattctttcatcttgaggaactcaaaggcctttttaaagatggagacagctccccggagacttaccttgtctgggaccctcgtctttattcatccctagtgcttccatcaagtgagcaggtgtataacatagacagccccatttatggatggaaacaccaaggcccagagtgactgtttgcttttcccgagaagtggactgttgctttccagttggctgatgcccgcgtctgctaggctttcattaaggatcacaccaccgtctttgcttttcctttcagtctaaacaaagcctaaaataaagtgcctccgaacactgcattctttctaacgatttcaagagggcagcccaaacaacctctagagaggcagctccctggttcgttgcaatgtgagctctcccactgcctccgatgtctgcttccctgtctccccatttctcatccccactcctgctgttgtccagctgtctcctctccctggagtcgtttctcctttttccctgactaaattcttaacctctgagactcctctcccgggtcgcttcctctggaggccttttatcctctccgagttggagttcagggcctctcccttggttggctctgcccgtactcaatcctcctgtctgtgctcacatctccaccagggtcggcaaagaccgtgaaaacaggaggagaaatgtcctgctcgtgtctatactcccgttgcctagcacggtgcctgggggatgctaagcacacgagtgtgtccgaatgaagcccctcagtcacagctatctaccatgtggatttttgtgacataaaatgaaaaaagagacgaggggagataggaactttaggagaggagaaggcaagattaaatcaaattgcgacaattatccatacacaagacatcgggctgactccaccttctggacccccgtgccagttaccgtcctcattttaaaagggtacttggagccagacgcagtggctcacacctgcagtcccagcactttggaaggctgaggaggtcggatcaattgagcccagagttcaagaccagtctgggcaacatagcaagacctcagctctacaaaaaataaaaataaaataattagccaagcatggtggtgtgcacctgtagtctcaactacttgtgaggctgaggtgggaggatcacttgagccttggagtttgaggctgcagtgagccaagatcacaccactgcactccagccttggcaagagagtgagaccctgtctcaaaacaaacaaacaaaacagaagagaatttgacatgcagtttatctatccatgtcatatgcattgatcccagtgaagcagtcctcctccattctccagcctggccgcctctgggcacccttttccaggtggtgccactgggacaccatgaccatgtgaagctgtgcgcagacagccagaggcctccccctggagcaccagactccattgcctcttgctctcgggctttcctcactcaggtgttcaccaagtattgcagagagcttccraagatgacctcaatgatttcctcctcctggtagtcacaccgttgtgtaagcccctgcccttgactgtgggctggacctagtgaatcatttctaaccatagaatatggcaaaaatgatgggatgtcacttctgtggttaggttcgaaaaaggccatggtttctgtcttgctagcagattctttctattgacttcttggcttgcatcctttgatgaaaccagcaggaggcccatgtggcaagaaactgaaggtgactttcagccaaaaatcagtgaggaaccggagcccccattcagcagccacatgaaactgaacgctgccaacagccactgagtgagtggacccttcccccttagagtcttcccatgacatcacagcccctggactgacacagcttgatggcatcagccagagaccgtgaarcagagcacccagataagctgtgcttggacttctgacccacagaaaccacgagataataactgttgtttcaagccactaagttttggggtaatctcctacaccatgatcaataactcacacagcacccactctcccactctgtgccattgtcctaaatgtcttctttggacaatttgcatctatttgtaccccttcctatgaacttcccaaycctgctatttcataggggatgaaatgtatttcctatgttcctttgctgctagggttctggataaaatttaggctctgccagccaggcgcagtggctcacacctgtaatcccagcactttgggaggccgaggtggtcacatcacgaggtcaggagattgagaccatcctggtcaacatggtgaaaccttgtatctactaaaaatgcaaaaattagctgggcatggtggtgcacacctgtagtcccagctactcgggaggctgaggcaggagaattgcttgaacccaggaggcggaggttgcagtgagccgagatcaagccattaccctccagcctgggtgacagggtgagactctgtctcaaaaaaaaaaaaaaaaattaggctctgccaatgagaagcacatgtgcaacatttggaaagcagaatttgctctggcagtggcagctggtgggcaggctttggcaggagtgagctttgcagtggtcatactctctatttatcagttcatgggtaagggactggtggggcatcagctggaattgcctacagtatcctgagttcagaatcaagcagagtgaccttgaagcctaaagcccagtaacagccttatcactttcactcctccagctcatccaacagttttctagcacctatttatttcctcrtattgaatacctcgctgccaaaaatacctagacacatttctggttccttgactgaactctgctgatagagccattcactatgcaaagccctggggctacaggtgaacctgacataattaattccataacacgacactcacactctagtgatggagacagaaagttagaaagtaatgtcactacaatgtacctgtctgttagaccccactcagaggtgagtatacagtgaagcatgaagcttaagcttcagtgtccctcacttgcctgggtctctacccaggtctgagaaaggccttgcgattttgttttcacaattttctgggttttgtttctctttctttttcttttcttttctttctttctttctttttttttttttttttttttgagagagtctctatctgtcacccaggctgaagtacagagacgcaatctaggctcactgcaacctctgcctcctgggttcaagcgattctcctgcctcagcctcctgagtagctgggattacaggcacctgccaccaagcctggctaatttttttgtatttttagtagagacagggttttaccatgttggccaggttggtcttgaaaactcctgacctcaggtgatctgcccaccttggcctcccaaagtgctgggattacaggtgtgagccaccacacccagtcttgtttcttaataagctcttccccattccccaaattgtataaactctgggcccctcaaaatctggctcaggtttggcctctggggaccctcacccactctgatggctttgcccaccagctgcttgggcaaaaacctctcagatccattcagtcagctaagcctgagctttatagctcaagccaccctgaggcattctcccagcagtgcctcaggacctcccgctcaacactttttccttccctaaaccagctcttcaccctgggtgttccctttgttaaatgatatcactgtccacccagtggcccaaggcagacatgtgctgctctgtggagtaaaatgcccctgagtgttgaagaaaataagtgagaatgaggcacatttggtaatcctgtcgccagaaggctggcccaggggaaggcatgtctgggctcagggtctgagggatagcacctacctaagtgactccaggcagtaaatgtgatgtagggaccttggaactggccccaaagtctgatctcgatggcaaggtgtattagtcagggctctccagagaaacagaattcacaggatgcgcgcacacagacatacatacacgcagacacacacacaaaatttattatgaggaattggctcacatgattatggaggctgcgaaatcccccacactggagacccaagaaagctggcggtagagttcagggcagtccagaggcccaagaaccaggagggctgatggtgcatgtctcagcctgagggcaggaaaagcccaagtcccagctcaacccgtcaggcaaagaaaagggacacattctcccttcttccaccttttgttctatttgagcctgcaacagattggacgaggcccacccgcactgaggaggcccgcctgcctttctcagttcacccatttaaatgctcatctcatccagaaacaccctggcaggcacacaaaaaataatgtttagcagaatatctggacaccccttgatctagttaagctgccacataaaattaaccatcacggccaggcgcagtggctcatgtctgtaatcctagcactttgggaggccgaggcgggtggattatttgaggtcaggagttcaagaccagcctggccaacatagtgaaccttgtctctacaaaaaatacaaaaattagccgggcatggtgacacgcgcctgtccatgtgtcacccacatggacaatcccagctactcgagaggctgagaagcatgagaatcaattgaatccaggaggtggaggttgcagtgagccgagattctactactgcactccttgggtgacagagtggacttggtcttaaaaaataataataataattaaccatcacacaaagtgggaaggaaagtggaaacatgtcaccaggtgagtacccagataattgaaagaggtgcaggccaggcgcagtggctcatgcctgtaatcccagcatttcggaaggtcgaggcaggtggaccacttgaggtcaggagttcaagaccagtctgaccaacaaggggaaatcctatctctactgaaaatacaaaattagcctcgcatggtggcacatgcctgtaatcccagctacttggaaggctgaggcaggagaattgcttgaatccgggaagcagaggtcgcagtgagctgagattgcgccattgaactccaacctgggcaacaagagcaaaactctgtgtcaaaaaaaaaaaaaaaaaagtgcagtccagtggcaggaagaagttgagaatgagtcagaggtgaggctttgagtgcacatgtggcctggagctccctctgcctctttcttttgggggttccccttttgcatggcacctgttgctcacaggatggtatctaaatttaaattccctccaaacagatcctgagacaaggattggttcaagcagtttatttggtgatgatccagaaagcacagggaaggaaaggaaagtgaggcaagaagggagggaaagtcaatcaaggggggagatggtcaggtcttcagtcttcgctgagggcaaccagggctcagccccctgggagcctctgcaggaggatgtggaggtgcagctcagaactgtcccatgcagagtgaggagcatagcgtgtttatcccccaactcttttccctcattggttgagggtcactcctaggatgttcacttcctggcacttccgacttgctctgtgtgccaagccaaacaagcccctgcagccagagagaggggagctcatggcttgtttgagagtgatctgcagtgagctctgggccgtggaatgctgcgggccaggcattgattgctcctaaaggctggccgccttccctttggtgcaaccagtctgtgggaatgcctacctactcaaccttgatggtgggaagtgaggggggcacacctcttctcctcgggtcactaaatggcttctggggtcgtgccatggccaggagcaggaatagtgcaggctgagaggaggactcaccagctttgagttgacagacctagatttaaattctggaatcacctctggaaagcctgttgcaatttccttatttttggagcctcggttttctcctgtgtgaggtggggctaggcccagcatctgctctgcaggcctgttgtgagaatcacaatggatccccatcagcccctgtcccctagtggttgttgatgaatagcaacagggattggaggattctgctgactcagtggcttccccctgccagccctgaccttggcctgagggcttcccccagttcccagctcctgctgccgctcagctctaactctccttccttcgcgtctgtttaaagtgggccttccagggtaaaaagtccattctgtgcaggctgcaggaatcaccacgtctgctggacaaggacatcaatgtctttgaagtgtcctggctggcagaattccctgccgttttgcagcagcatggttctctcttctcagctcatggaatgacaagcttgcaggaggcctcagtggccttggcagctggccagtgtttagacagtttcttgtactgttttaataagaggcatggtggaactgggcctttgcctcattacctctcctgtgactgggcagcctggcagcatggaagcccgtcatctggagctgcgtgcaaagctcccctcagctcctgaagaagctttataggtgaggaaccttccagaaagcaccagggctctctgtgccctccctttttttgtaggcagttttcttttgaattgcctttttgggcttctgagcctccaggatggctttggaaaacatttgccctggaatgttatctctcaccaacatccataaaccataaaccataaaagagacagaatggccctcacatgttattttggagacttagagagattaagtgacttttgcccagttgcacaaccagttagtgacagaatcagagctagaccttaagtttgctgacttcaagtcttccagtatctgggttgtgttagagtccaggtgagggtgagactcacctgaacccaccttcctatcttttgaggattcatgagatgaagactgactgaggcagcaacacatgtagctcaagccagaaacaaaggtgttacctcccttccctaccccagacccccaagcacagggcagggtctgtgggtggtataatctagtttctgtgctacaagtttaggaagcaataaatgacaccagggaacttaaaaagagggaggagcatagtgaaaagggccagaatctctcagtcttgggcctaattaactgtgtgatcttgaacaagtcacttccctacttcaggcttctggtcacttgaagaggaatgggtggattgagctggccacctccttgtagttctggaattctgtccatccattccctcatccatccttccatccatgcatgtatccatccatccatccatccatccatccatccatccatccatccatccatccatccacccttccatgtaggtatcaagccatccatccatatttccatccatctacccatccatccatccatccatccattcatccatccacccacccacccatccatccatccatccatccacccacccatccatgcatgtatacatgcatccatccatctgctcatccatctctccattcactcatctatccttccatccatctatctttctatccattcacctacccatccgttaacccacctatccatcccctgtgccatcccccagtgtttgcatcagaaaacagattaagaagcctatagctaggtctccatagttgaggagcttacagttttgtccaaggtcagtgggccaggattccatcccaaagctgcctgaaccctgaagccactaggcttcaaggtaccttgacctttggacccttcctgcttccatgagctgtcagatcataaaccattcttctgccctactctgtgtcccatgcagggatcccactccacatgcatttccacttcgcatgctcatgccaatcttgtgacatggggctttctctacccacttaaaagaggagaagactgaagctctgagagacagagagcttagtccagggcctcatttgtgacatctgtcctgtgctcccactgtaattctgatgcctggttcagatcttggctctgcatcttgggaaagttacttccttccctaagtctctgtttcctcaactgtgaaatgggataataacagtccccatctcatcagattgttgtgggcattatatggtataaggcatgtgaatggcatattgtaaacacccaaatgttggtcatcacaatcattatacatagtatatgcttccaatcaaggtcagagaggtagtaggcaaatttcaaagggaggactgactgcttcataatatttgatggatggagggtggaaggaatgaggaagactttctctcaaggccacagttaaggccagtgtgttaggagcaggtccacaaatgtgcagccagaggctccatcttgtgctgtgggaggcaggcacgggagccacaattaatttcttttaccaccaagcagcaggcatcaagcctcattaccctgatgagtccatgagccgggggatttgtgtaatcttgttttccctccagccggcctcccggaacgccattgtgctggcactgaagcctcagtgaccccaccgaattgcccgtgcccgacggaagccttgcctcactaagcactgtctgctttcatgagagccccacagatcacccctctgtgctctgtctggtcaggcatttccaacccctctcagcctcctccatcctctactcctgggtcaggcaaagtgggatgaagcctttccacaccctgaaattgccaagatatattcaagcaaattgtgaaactctcaaagttgcacaggactgagaagaaaagggagacttgtgttccatgaatgtttccttatgccagtgacttgatacccacttaatatccagaatgtggaggcccctatcagagtgacttcacagactacaggggatcacttggaatcccagaggatggaactgcaaaggtcatggagaggttttgtgtcatgttggagttgactcctgactccctctcttcttggctgggagaccttagactattttcttgtctctgtgagtctgttttctcatctgaaagctctacctccctgaaggtaaggaggaagaaatgagaccatagcttgtaggaggaactcaaaaaatattggttctcctccttctcatttgttcatgtgacaacttggaacttactaaatgccaggcccggtgacagcagtaaactggacagtcacagatggctcttcctttccctgttatctcatgggagtggtggacaccaaacagtgaattatacaaatcatttacgagccaccagtgtgaaaagtgctacaaggcagcatccacaggcggataagagagccaacccagagggcaccaatctgatggggcctgtcctgtgggaggtcagatctatctatctatctatctatctatctatctatctawmtatctatctatctgtctatctgtctgtctgtctgtctgtctatctgtctgtctgtctgtcatctatctatctaatctatctatcatctacctatctgtctatcctatctatctatctatctatctatctatctatctatctatctatctatctatctatctatctccctgtctatctattgactcactctgttgcccaggcaggagtgcaatggcaggactgcagctcatgacctcctcaggtcaagtgatcctcccacctcagcctcctgattagcagggactacaggcaggtgccaccacactcagctaattaaaaaagaattttgtagaggcagggtcttgctctgttgcctaggctggtcttggactccttgccttaagttaccatcccacctcagcctctcaaagtgctaggattacaggcatgatccactgcacccggccagaggtcagttttaaacagagactgatctactgattttggagaayttgccccagtggggtaggggagcagtccaccaaagagaatgacctgtgtggtgctggaagtgacagagcgtaggtgtgatgcagtgcagtggggcagaggagagaagggtgtgagaaagagctggggaagtgggcagggattctgcagcgctttccccacatggcctgcctccaagcctcaggaagcattctcaggataaagctctgctaacaaatcacatcttcccaataaaatccatcactgtttatttttgatggattgtgtggctggcaatatctccttgggcctttggatgttgatgtttgcaaactgttctttcatttctctgcaagtctgtgttgttaaagccagatatttcatgccaaaagcayaaatgtaatgtgttcctggtggactctggctcagagcagggggatgaactgatgaaggtcttcccatcacaacactgtgagtcctggaatcacgttccctcccaagccaaaggtctgatgatgctcaatgatggaaagcaatttcttctaatgggtgggtccccagtactttatggaactaattccattgagttcccctccacacaggtggagctgggatgatctcacctttccagataagggaaggttaactcactcactgagggacgtctagcttgagagctggagtaaggattcaagcccaggtctccaaccctgagctttaagcatggcgctctggaccaggtcagtcaaacaatgtgggtggttaagagttatgagggtcactggagaggctgagaagtgtgtttgggtttatttcacacacagggaaattgtcaatgaagtgtttaatagagaaagtgaatcagcactttggtctcccaagctcagccrtcaactccttaagcacagcctttagggctgggaaagacataatattactttagtttgagcttctgtctatttgttgatgaggaaacagacccagggcagtcagggaaactgccagctgctatacagctagttgagggtggagctgggctggagggtaggatttctatgtcccattgggtgagcttcccatctcacctcaaccacatcaaaattgaccttccagaggcagccacttcccgcctcccacccttccttagtgaaatatcttcacagataatcctgccattagacacctcattaaatgacatttcatccctgggattggtgtttaagtaacatttgatttgaggtttcgagctctaaatccttcatatgtcaagaggtatttcacactgaaacttgaaactaggggaagggtggtaaatacaaaagtaagagtcagaatgaggaatcttaaagcataggtccaattcagacccaccagttgtatgaagttgggtgagccattaaatcatggaagcattttgtactcatctacaaattagggataaaaatagtttccttcctcttgacctcacatggtagccatggcaattaaatccatacatgtatacagtaggtgagcaataattgcagtcctaatgtgaagagcgatttttctaaagcattagtatgagcaagttctatcttttattcaaattctgcggtggttttcttgtgtcttcattcattcattcacttattcaacatttactgagcatctagtatgtgccaggcactgttttagataccagggacaaaggaacaaaacaaagtatctgttttgaacttacaatataacagagaaaacagacaacaagcaagatgaataaacaaaaatggaataagtaaaacaaatagtagagtcctggagtgaytggggaacacaggatgcccttgagtctagagtgagagaaagagtgggactataaaaaatgaggactgaaagacagtgaggggttgggggatgcaaagtctcatggcttttactctgcattagatggaaaagtcttcggaagattttgagcagaggagagacatgatcagattatattttaacagaatcactctgattgccaaagtgaacacactgcagtgacaacaagggcaaaagcagtcatcccaggtagaggagatggtggctgggaccaggtgttgttaggaaagtggcgagaaacagtaggatatgatagttctgttatttgcacttggttgcgtctgttagcttgctgccactgttttgtgactgtggtgtgtgagcttatcttcagcggacataccttgcagctaaggttgagggatacatctccaaggaaattttgcatatgcttcttctgggcatctcagacactcatcctcatcaacactgggctactaccttaatttcgaaaacagtcaacaaatattgattcatgagatgagcctggccttttaggtaaatttctctgcttcaagtttcatcagctacatggggagtatcaatgctaatagtaaatatgaatgcagacaagctatgggtgtgaaatcttttttctaaattttttttttattttcataggttattggagaacaagtggcatttggttacatgagtaagttctttagtggtgatttgtgggatttgttgcacccatcacccaagcagtatacactgcactcaatttgtagccttttatccctcaccccatttccccctgagttctcaaagtccattatgtcatgcttatgcctttgcattctcatagcctagctcccacttacgagtgagaacatatgatgtttggttttccattcctgagttacttcacttagagtaacagtcaccaatctcatccagtttgctgcaaatgccattaattcatttctttttatgactgagtagtactctgtcatatatgtgtgtnnnnnnnnnnnnnnnnnnnnnnttttctttgtccacttgttcgtcgatgggcacttaggttggttccatatttttgcaattgcgaattgtgctgctacaaacatgcatgtgcaagtatctttttcatataatgacttcttttcctcagggtagatacccagtaatgggattgctggattgagtggtagttctacttttagttctttaaggaatctccacaccgttttccatgagtggttgtgctagtttacattcagtgagtgtgaattcttttttttttttttttttttgaaacttgctcaaatgctggagtgcagtggcatgatctcagctcactgcaagctctgcctcccaggttcacaccattctcctgcctcagcctcccgagtggctgggactacagctgcctgccaccacgcccagctaattttttgtatttttagtagagacagggtttcaccatgttagccaggatggtcttgatctcctgaccttgtgatctgcccgcctcagcctcccaaagtgctgggattacaggtgtgagccactgcgcccagcaaattcttaaaggatgacacagttgagagagaccagcttgttgggcagctgctggggccagtgggagggtttttctaacccactcttctccagggttataatctgttgagggtccctgctttatggtgatgtcctcaattctaactccccatcatgcatgggcctcaggtcttgtctcctgacctcagctggcccatgaacaccccagcctttaagttaccaaagcctaccctctaatccctgccccagagaaaccacaggtaagctcacgtggattgctctggtggtcagttcctgccactcctttgtgccctgcaagtttcctttatttgacttgatgaacttaactctgcatttaactaagttttgcagtttttcttaagcaagtagcaggagggttttcaggttatctggtccatccactatgctgctagaaagccacttgattccctgtgtcatcatcagtgtctcttgacaggattaatttaaggtctatcagcatcagactcaccttgggaatgtgtagttaataaaatacatattctctggtttcaccccaggactctcaaatcacacttttgggaatctggaacttgcattttaacaaatgcccacagtgattctgatgcacacataagtgtgtgagccactgtgcgtctggagattcaagctcctgaattaacccaacacacatttatgaaacaccttctatgcccgcggcaccactcagtcttcatgggatgcagacatgagtaagattatttgtttctttgaagggctttatagcataggtcaggggccggcaaagtttttccgtaaagggacagataacaaatattggaggctttgcaggtcacgtagctttcttcacaaaagctgcaacaggcactatgtaaacaaataggtgtggctgcgtacccaaaattttatttaagaaacaggtggtaggttgggcatggtggttcacacctataatcccagcactttgggaggccaaagtgggcagatcacttgaggtcaggagtttgagaccaggctggccaatgtggcaaaaccccgtctctactaaaaatacaaaaattagccaggtgtggtgtcaagcacctgtagtcccagcttctcgggaggctgcggcaggagaatcacttgaacccaggaggcagaggttgcagtgagtcaagattgtgccactgcactccagcctggtgacagagccagaccctgtctcgaaaggaaggaaggaaggaaggaagaaggaaggaaggaagggaggaagggaggaagggagggagggagggagggagggagggagggaggagtgatggcctggctcacctgtggtttgcccacccctgtgaagctaaaagaaacatgccagagaaaggattctaacgcaagcagttgctagggtggaggtgtgcgagggatttcagaaccagagaagaaggagtctgaacctgctggggctgtcagcaagccttcccacgtgagctcccactggagatgagccccgaggggacatccatcactggacgtttaggtgtttccattccttgctcttataaacagtcagaacaaaccaccttccactttgtaggctggtctgattcttcccttagcctgaaggcacaaaaggctttggtagcgcatttgcagggtgccttctagaaagctcataccaccttcacaccctccaggagcatacactttggccctccgccatcatcaacactaggctactaatttaatttctaaaactaataacaaatatcaattcatggaaagaatcagtgatatgttttgaccatgtccctacacaaatctcatcctgaattgtaactcccacaattcccacatgttgtgggagggacctggtgggaggcaattgaatcacggcagctggtctttcccgtgctattctcatgatagtgaataagtctcatgagatctgatggttttataaaggggagttcccctgcacaagctctcttctctcgtctgccaccatgtgagacgtgactttcaccttctgccatgattgtgaggcctcctcagccatgtggaactgtgagtttattaaacctctttcttttgtaaattgcccaatctcaggtatgtctttatcaagagggttaaaacaactaatacaattagtctgatctttaatcacaaaactaagaacgtagactggacaactttgcttgccttatttccctgagtatattccagcttttatttcttcatattgggcaatgaagactgtacatttttggtagcttgaagggttttcctgggtttgggtgtgactcctcggagtgtgacctagcaggaaggtcaacatccaatctctcctttgctgtgtgagcggtgcagtccgccaaggccactccactcagcaatcagccttttccactgtggctaaacgcgcatccacatcagtagagaggaggccctgaggagcatgtttgatcttagtggaaagctggcccaggctggcattttgacatttggaaacagtgaatacaattacccatctgcagaccaaaagggattttttttccccttgaagggaattgaaggtattttgccctgtggtagtttctctcttaagaggtcccttctgacttgagtagtgtggagaatcttcttccagatttaattcagaagagtgtgctccaggaagagaggacaggctagtgcccgaagctccatcttcctctggagttgaccttttaatgagagaagggtggaaggcagaccagcgagaggcacacaccctttactgctggctctctgctgttgcagacatcgtttcctctgtctctaacctcagcccttgaagaacgtgtggttatttcatcatcagcaaatggggcgaatgaggtcagacttcatgtgattgtccgaggttccacagccagccatgcagggcttggacaggaagtcgagtttcttgccttcaaattcagttcttttcccacttgttgcgtttctcaaaatttatatgctgtagtcctaacctccagtacctcagaatgtgatcttatttggaaataggttcatagcagatgtaattattaataattaagatcaggtcataccagagtagtgtgggctctaaatacaatgactggtgttcttcttcttattattttttagagatagagtcttgctttgttgcccaggctggagtgtggtggcataattacagttcactgcagcctcaaacttctgggctcgagcaatactcctgcctcagcctcctgagattggtgtccttattttttcaaaaagccaagctgggcacaatgatgggtacctgtggtctcagctacttaggaggctgaggtgggaggatcacttcactgaaacccaggagtttgagaccagcttgggtaacacagcaagactctacctaataaaagccacatggagagacagagacacatacagaaagaagacaatgtaaagacacagggagaagatggatggtcatttagaagccaaggaactcctgaagctaccaggagctgaagagaggcgtggagtggatcctccctcacagcctccagaaggaaccaaccctcccaacaccttgcttttcaactcttagcctccagagctatgagacaataaattgccactgtttaagccacctggtctatggttctttgttacagcagcccaagaaatcaatctaccactcgtcatggtaaacacattgtagtttttaagacaatacaatttattgagtgtgtggcaatagaatttatggagacttgtgttgtctctctgtcccaaacattgtagagcagagatggctaactgctctccagtacacatkctccttccttttattaagagaaacagcctccctgattttaatagccagaaaacatgtttcctggcttgccttgcaggaagatatggccatgagactatgttctcaccagtggaatatgagtggaaatgtcgtgtgccaatttcagcgacattttcctaaatgaaaattgtttgccttccaatttatctctctttcccctggttgcagcctggaatgtaatcatggatagccatggatgatcagctttcatcatgtgggcatggaacaagatggaaggaagctggggccctgagtgacctgtggagcagaggcctttgcccaccctgggctgcctgatttcccctggactatcatgagacagaagaaaaagcttctatcttatttgaaccactgtgttttgggaaccttggactagagcagcctagccttcatacactaacaaggtgtatgtgtctgctctttgttgcttttgtagatggttgtgttataagcctgaatgcagaagttgttccccagactactggatttgctgccttttaaaacaggtttattgaactataattgacatacaatgaactgcatataggtaaagtgtacaatttgataagtacactttttgagcaaatccaccctttgttctggaagaagacactctatagtctcaggctgtttctttacyaacatcaacaagctagtcttaaacagaggaacctcagtgcctcactttcaagacaatcaagattatttcccaacattccactagtagagggtcagaaacagagttaaaagttctcagactagaggtagaattgaaaccccagctgagaagtatcaaggtgccctccttccccaaagctacatattcttgtgtcaggatcttaccaggaaatggaaggcacatttacacagggcagcccaagagactgtttcaaaggaaaccagcaagatgtgacaaagcaccccaagactagcgacactgggagaccttctcacttgacttaaaaggctggggcaggagagttacaggacccagtattagctgtagccaaagcctgggcagggccacctaacatgagctgcacccttctgtagagcagcacagaccttgtgcatctgaggcccagcaggatggggccttgctcatccttcccttgcagttcttgctaatgcttcctgttgcctgaacccagctggaagccagagggcaagggaaatcaattgagacagataatggaggtaatcccctgggcacagggcagcatggcagaggtaaggagtctgtctagagccacaaaggaagaggactgagtccagaggtgaaagcagtcacgtatccccaaagacacctgctacacatttgggctttgatttatcaatgagaaggcttgagggacagtgggaaaaatgatgaggagtcattaggtccttgtggaaatggtgcccttgaaggatgagcctgtaatcactaggtacacgtgggtggatgaatgctggtgaaacaggtggagggaatgaaaggacagaggcagcacgagaacactgtaagcagagcagaagtccatgcaaaagccagagatgtgagacagcacgggtacatatagggacccgcaggtggtctggagtggctttgctgtgggttgtgatgagatatccactgtgttggagctctggaacaaaaaggaggtcatctaagctggttgcttctgtttttttcttttcttttttttccggatgcatttcaattaggtgaggggtaccaggcagaaacccctcctgaatataaaccctctgtcttattgtaccagttaaagatgaacgatggctcacttcctattgggtactaagttcattatttgggtgacaggatcaatagaagcccaaacctcagcatcatgcaatatacccatgtgacaaacctgtatcccctaaatctaaaataataataaaaaaagatgtaccatagctcttaattgctcttcaaatcacccacaccattagagaaagctatttccaccccaatctgaattaaagaattctacaatctcctacagtccgaaagagagacttcagctaaagagaaagctggtgctcctcttgctagctgagtgaattctgatcctctttttcatttttattttcttgcttgaactctgctttgttaaatcaaacaccagcccaaaactgagcccatggatcaccatattggcagccttatcctagaatctcagggctggaaagaactccgagtacagcattctccagtgttgggtgtcaacaggagcagagttggtctctttcgagagcttcctggagagtctataaaagcctggcttttgaactcttatatttggaggctgagattcagaaggcctggggtggggcttgagaatataaattctttaaaaaaatttttttcttttccttagataaatcttagaaaccaaagggaattgaattcttaagargacttgaaaatgattctaatatagtcgggttaggggaaatctggtcttgagctttttcttgggagatgtggtgagtccaaggcaagccaggcttcaattctgaatctacactcttcccacacatctatgtggcctctgtgccgagtctgagttttatgttttacaaagaaaactaggagaaaaactgttattcttctgattaacagaaaagttgtccaactggctacacttgaattatatcccctgattattaaactcaggcttctttagttttcatttattttatttcattgcatggagatgttttaaaagaggaaggcaaggggtgtgggggaaggattctgggatagcgaccattctcaccacatgcagaaggccaatactgcttccagaaggagacacaaggaatccttcactgagtgaaagttttttttcttccagagaatatcagtattcctactttataacaagccaggagctttttctgcttcctgatttaaaaattgattcctgactgcatagttctcacacaatagcttccttctcgcaggggcagtgtgattgcctggaatataaattcttagtgggttgaccagggatcacgagcagttattatgttctctgctgctcttaacatgttgtgattctcaataaataatccagagccaaagcatggtgttttgttttgctttgtctcagtgagttttccaaactgtatttactatctcaaagtgagagcatcgcagttttctgagccaactgcagcaattttccagatctggagagtatttttgaagattatttctttggagattttctctcttatttggtttgtttcctctttgataatttttattattcatatgttgaattttttgagcagagctttaattttcttatcttttctcctccttttttccatttttttctttgccacttttctcccccttctgggatattttctcaaattttttcttctaaacttttatcttttctgtgattataattttaaattccaaaatacctttttttggagaggggagtggagggaagtgttctctgactgttccttttatatagtagcctgttcttatttcatggatgtaatatctttcctctttcttttatagtctgttttccccaagttacttttttcccttgtttgtttatttgtgtctctgtatttcatctcggagcattccttaggtgtttggtgatttcctccttctccctctctctgctccctgcattgttataattatctctgagctgacctcccaacttaggtctttctcattttctagtaaacttggcataatcctgtgaaacccatcttttttaagcccccaattcaacatgtgattctgttggtgaaaagccttccatggctccatatttcccacttcatcagaacttaactttgccatttttgacattttcagtctctgaccccactcaggctaggcaccatacctcttgcctcagaatgtggatactcttgtgtgttcagarttggagattaggaaataatactattaaaagtaatagcaatygatgataaagccttcatatgctttattcacagacattactgacttctcctgttagctctgtcgtgcttacatcatgatgcccatttttcaggtaaagaaatagtggctcaaacaaggtgagtggccaaagataacatagctcatatgtagcaaagcagggactttgatctgggtctcagcactttgtccaccatggtgtccactggttgactcaggtgattcacctgggtaacaaggcttcctgaaggccacctgctggtaaatgtcattgccagttcattgaccgggagcccccatgtgtttctaccaagaccccgctcctctcttcgcatacagtaatctgttgtatacactttgtacctcacccacaagcgtgtgaaaagccttagctgttctggtgccaggactaatgggagctgcttacagtctatgaggacaatcagacttggccgcctgccttctttccatataatttttaataagccagtaatatctctccaagcactacagacctctggcttggaccaggaaacctggaactgtttaagagaacattaatttcctttgagctaggattacaggccatctaaaacttcttaatgaatggccacactgcctttttgaagcatttgtgtatttgccaacacagactygaaggttgcattagatattgggagttgtcttttctggaagttagggtcttctagaagctgacrggcgatggaggcctgatgctctgccatttctttggtgagacctctggactgcttcgttcatagtcctctttcccacatatgctcccctgatgtcttactcttttattttatgggtttttggtaactgaaacattttaagactcaattccgccactttgttgaagataaaatcaagttcaaaccctgctttattttatttttcttttttttggayggaactagtgaggaaactgtgtgtgcaaaccccagaaaacccacttgagacctgatgctaattggctggatgatgttcaataggacacggctccactgagcctcaatttcctgatgagggttaaactgatgattcttaaccaggtctgacattctgtaaattaagcatacttgcttctgatttcacagtttccatgggatcagaggattgaaatgtcaaggaacctcccttgatgtccccctaagactctraattgaactgatgaggacccttttgagaatctttcagtgatccccttctctaggaaggaagggtgaagtatgctttgtaagagagattgtctatttgtcttttatctcctgatttcaaacacagtggttccgctaagctgcatcttttttgttctttctgctgtgaaaataattttgtcggaaaatgtaaccagtgcaattatactgaaatttcatatgaaatgttaataaaatggatgtgtgaccaataaaatacttgatgccaaattaaatggaccaaaagggaattctgctttgtagcaaacttcatgggaaacaggataaaaaagaaaataatatctttgagctactatatgaatttccccagaaataaaaatattgtttataataagttgctaatctttggcttgctcagagggaataaaacatagtggccaaagatgtggattctaagggcagatttcttaggttcaaatcccaacattgctagttcttatctgctagccgtgggcaagttacttaacctgtttgtgcttcagatcgcagtctgtaaattggggctaataacagtattttctgcaaagtgttgttgtgaggattgsgtttatacatataaagcagttggtaaygcctggcacataggaagtattcagtttgcattagtgattattattagaaagtcacaaacttgaaatgaaaatggttctcgagtgtgaatatgaatatgtatgtatattcatgaattcatatttcttctctagggaataagatttgcttccatattttaccaagagggcatctgggaccttaacctattgaaagattttcccaaggccacatggctgatctgcagtgggaagaaagaaatattagcgtttagcttgaatgacctacagataccataattagcactcttttgtggagcaacaaattgacaattacccagaatgcttagaaaaaaacattctggttaatttaatcttctggctagccagtgaaatttttctagcatatctgggtgagtaaattacaataatggctgcaaaagcctctgaaagcaagataactagaaagttcacaaattttaggaagctcagcaattatactttagaatatcaaattaataaaatttagaaaatccaaataaaaatgccaatgaatataaaaaactgtgggatgcagctaagggtatgcttcgagagagattcttagtcttaaatattagaaagaaagaaaggttggaaatggaaacatctgtaacagacactgtattgcccaggttatcccattcaggactgaagccctcattgcctcagttgttgggaatgcctgcagccaacagctttcagttgagtcttttttgggaaactgcccttgactaatgaaagccaccttgtccgggccacattctcttctcagggatggtctacatccaatagctagttgatgagagaataaaggtctggccgcattcctcagtcatacctgtggaattttaatttatggaggtgactgggggccagcacagagaggccaatgccctgaaagatttttggtttctctatatttctttattgtttcattagcagcagaagaacgtattgttatatttttaagattttaagttttgttttcaattcaaatgcaatacacaattactgttaaaaatcaagtactacaaaagaaaattaaaaaattttgaatatcatgccttcatttcatttcctagaggaaatgactattaacagtttggtatatggtccccttgacagattttcattgcttacgtttcccaagaggagggggcatgccatgtcacacagggccgtgtggggaagcacctggattagtcaggacatacagcaggagcaaggaccaagtctaggcaagagattgtattagaatttctgcaggaaagggaaggcagaggcaatggcttaggattgtctagcttgaataattctggcagtccttgggccacaggggctgtcctagttgtctggtacctggccctgggttgatttagggcagggaaatattgactggtgtgtgagttagatagagaagtggttcagaatgagctctgaatctcagggcagcaggaaacaactcggccataagtttggtctgtgactaatggatgccacatggacaaataaagaatatcagaagacacagaacaccccttgaaccagatggcatatcccagtaccagtgcttgaccctttgggcttggcagaggcccttgctgggtctgcattgcagttcaacttctccctctgccccatcctggttgtttccctcccttacagggactgatcctacaggcacgtcctgtacccagatcttagagggagcctatcgtgcaatagtatttgcctaagtaagttagtgccttcatccatttgggctgctatcacaatataccatagactagatggcttataaacaacaggaacttatttctcatagttctggaggctgggaggtccaaggtcaaggtgttggcagattcagtgcctggtgaaggccagcttcctggtttgtagacatgcttcttgtgtttgcatgacagaagcaaccaatgagctctttgtggcttcttttatgaggacactaatcccattcaggaggggttctactctcatgacctaatcaccttccaaaggccccacctccaaataccattgccttgggacttaggatttcaacacatgaactttggggaggacacaaacatcagaccacagcagttacacaacagacaaaataaacacaaataatgcaaaagggagggaataatagaggtgggagtcgtaattactacaatagaaaagaaacattcaatagaatcaataaagccaagggtttgagatttgaataggccaataaaattgatagcgttcttataagactgattaagaaaaagaggattacagtgtaataccagtgctttgaaagtctgagatgggaggattgcttgaggccaggagttctgagaccagcctgggcaatgttgccagaccctaacactaaaaaaacaagagagagagacagagaaagacaaggcacaaattatcactcagaaatatctacaaatcctataaacaagaaaaacacaacacaggaacattatgaaaaatcagcagcaaatataccagagtattaatatttgttaaatttaggtagtgcgaacataggtggttattacattaacctgtatatctgattatatatttgaagagtctagtgttataaagtaaataaacacttttttttagaaaaacaaactcagttttccagtacttacccagattttcttctactattaataatataatcattttccttctttttataattattatagatgaataattctattctaattcaattagaagtattttcttctactaataataaagccatttccttcttttataattatattataattattgatgaaaagagcaaagtcrttttttttttttgagatggagtctatttttgycatccaggctggagtacagtggcatgatctcggctcaccgtaacctccgcctcccaggttcaagtgactctcgtgcctcagcctcccgagtagctggaattacaagcatgtgccaatgcacccagctaatttttgtatttctcataaagatggggtttcgccatgttggccaggctggtcttgaactcctggcctccagtaatctgcccacctcagcctcccaaaatttataggcttaagtcacaacccctggctggagcaaagagattttgagcttctrttaagcagtgggccacttcttgaggaactttccctgaacttcactgaagcctcatgacaatgctatgaggtcataactatccccttggaaacagaggagtcagcggagactagtcagagactagtgggccatggttaccaagctrtagtgagtgtaggagctgagatctgaatccatgaattagatacctgaaccccaagtgattagtgataaaggtgtataatgcaattcaataagtactcaccacactctggggatatgggatgcacaaggctgttgtagtccttgtgccatggacagatgattaagtggttccaatgggggaagcatgctgaaccctcaaatctgagaagagcagaatcctctgttctgcttagtggggataaagtgggttcaaattttcatgtgttggggtcagtatcaattttctgtggctgccttaacaaattatcacaaactggtagtttgaaaacagcagaaatttgttctcttggttctggagtctagaagttcaaatcaaggggttggcagggctgcactctcatgaaggctacagggagagctggttccttgtctctcccagtttctgatggcggctggcagtcctrgggtcccttgttttgtagctcaatcactctaatctctcccttcatcttcacaagtccttctccattgtttgtgtgtgtgtgttgtgtgtacattgtgtgtgcatgtgttgtgtgtgtattttatctatagcaacctgttgaagtgttcaaattcagagatggttgagtatgtatcattttcccccaatacaatacaattattacaaaatgaagggcagttccaattttctaaatggagtcacatacttttttcacatactttaatataaaaaacatacacagtgtcaagtcctttcgttcccatgatataagggatgagagtgtatggactttgagtcagacctgaaactgagccctggcttcactcctttcacttgtgtggccttaggcaagtctcccggcatttctgagtcttaagttttctcatctgctaaataggccacttgcctggcagggctatgataagtcctctggcctaatgcctggccacaggaagacttcactcatgctaggctcttcccctggcttcttaggcactcgtggaacaacacagaaagaaaccatcctgatgctcacgaggtggaaggaggatgcaagctgatgtttgacaactgccaatgcccttgcgagggtagaaatatagacagagatttaaaccagtttcttctgattgcaagtaacagagatccgcaggctccctcaagcatcaaagggggatttattgggataatggggaagggaaagatatctcatgcaaacaacaggcagaagcacctgctctcagaataggatgagcaagggttttcggcctaggagctacggatgctcaagggttgtatgtggaattctggggagctcttacacttgaatgaaaagcattgcatctttagttttattaatcttgaattgaaatttagcatttcctccacttatgaatatagacaaaaaccagagcaatattagcaatacctgtgaatttgtcacaaatagaaatcacagatatttcacatcacatggttatgaccatttgtgcccatcactgcctcaaaatgagcaccttagctctgatgctggatggtgtcttctagtgggatgaaaaaagcagcacatatgttactgtttcacaaatgtatttttaaatrttttgataacggtatcttactataattgctttccttgataatcctctttattttattttaattaattaattttttttgagacagaatctcactctgtcgcccaggctggagtgcagtggcatgatctcagctcactgcaacctccacctccctggttcaagccattcttccacctcagcctcccgagtagctgggattgcagrtgcccgccaccgcgcccggctagttttttgtatttttggtaaagacaggatttcaccatgttggccagacttgtctcaaactcctgacctcaggtgatctgcctgccttggcctcccaaagttttrggattacaggcgtgagccaccatgcccagcccattttatkttatatgttacctttccccacccccagaagaatccctaggcttacacaggctgctaaagaactcatgacatccaggaaattaagaacccctgggtcatactctctgtccatggctccacttggtaggtcgaattcatagtctgtttctccttttctttctctggactggcttattttgcttgtcagtttgcacagtaaacataatctcttgagagctgtgctaagcattttctcacatgccattcctgcatcaccgctgcaaggttttactctaagtaggttccactctattccttggagggtctccatcaggactaagcccaggtgccacagtggtgaccttgtattagcacaccctctgttggcttctccatcatccctatttcagatgaggaacagtgacccggaataatacatccaccccggggaggtgggtgggcagctggtgggattcactccacagttgagaccagattgcgtgcatgaactgttaaggcatttgatgagtattctctgtccacagcctgaaaaaggtactggcctcttgcatttctcttctagataaatctccaggattctatccaagagtggagaatccaacatgcacaaaggagtttttactgtgtacctggccttggattcagtgctaggacacagctgtgcaccagcccgggctcttgccacatggaactcctgactaggaaacagcaacacatatcacatgtataagtcatgcagcacagcagacagagtgtggccagatcatttgacttatgggtctgcacacctttgctccagctatttcctccacagaaaacagctgagggaggagaagatgagatagggaaggagaagccaacatggggtacgctaatgctgggtcaccactgtggcccctggtctccacctgctccccctccacaggaaacagcaggtgcatcctttctccagcttctcctcttggtgaacttccactcctccttcaggatccagctggacttctttctttttggaaatcttccctaactcttcrcccctgtccccatgtccccatgtccccatgcaacattaktggcagggacttctcctccgttctgctggcatccgggctcttctctgccataaygtttcrctcacagcattatctcttaatttatctctctcacctggaagaaagaacctctttatrtttctctgttcagaaccaggtctgccacagataaggcattcaggaagtatcagttggttgaatcaaatgactaattaatgttttggccctgtggaatggattcccagtgtgtgcacagtcaccggaatgcagcaggtctagctgacggaatgtgctgactgcacagttcttcctccgtgccccagcatctcctccaccctagctgtgtaccaggcagggatggcttgcatgtgaaggataactcaagggatggctctccttttgtcctcactcagctcatgttccacaaacccaaggcaggcaatcattgatgcccgggtgtcatccctgggctcctctgaactctcctgtggccatggtggacaattccagaagagtccacttctctgcctggggccttttggggtgccctgagacctggcctgtttatttgcaggacagctgggaagtccagggatttaacatcccccagtgaaagacaggagttggtggatgaatatcccaacttcctcatggcttgttggaacaactctaggtggattcctctctattccttggcgggtccccagcaggactgagcccaagtgccacagtggtggcccagcactagtgtaccctctgttgggcttctccttccctatctcatgctctccaccctcagccagcttccctggaccacctcccaaacacagcatctgctggccctatctcactcctgcttccaggggaacccaaccaagccaccctcctgaactgttctgtgtcaatgaatgagtgtctctcaatgagtgtaagctggagggaaacaggactctctggcccctgcacacagggcctcccatccacaggctgccccttgattgcttttgcacacctttaaagatggggtttgtttctctcccatcatgtactcctcagcagagtggagtatgctgtggtctgtctccttctgaaatgcctagaagtccagcaggtctgaaggcctctcacaggtccatgaggacaagaggcaaaagcctgggtggaggttccaatttggggtgagtcccttctcctccctgggtcttagtgccccatttgtgaatgaacgaacagaccagagggtctctctctctccccctcaggtccctcggggtgtaccacagagtgtatctgttacttaattgactggtttgaaccccagtttcctaatcaataaaataggaataataactgttgctttgcagggggattatgcggaaaacgcctggttctggcttcctccacttgtgccctcccctcactcactctgccttkggctctgcgcttctgcaagcatggtcacctgtggctgcacaygcagggcctctgtgctgctggttccctctgctgagagcaccttccctgatagccatggggctcacctcctgatgggggctgcattgtgtcccttcgcaaatgatacattgacgtcctaatccctggtgtctatgaatgcaacctcatctggaaatagggtctttgcagacataaccaagttaaaaggtggtcatactggagtagggtggtgtcttagtccatgttgcrttggcataaaggaatacctgaggctgggtaatttattaagaggtttatttggctgaggattctgcagactgtacaagaaggatggcattggcacttgcttctggtgaggacctcaggaagcatccaatcttggcagaaggtgaagtaggagtgggcgtgccacatggcaagagacggggcaagagagagatgctgggttcctttaaataaccagctttcacatgagctaatagaatgcaaattcactcatcaccaagggaatggcactgagccatwggtgagggatccacccccatgagccagtcacctcccaccaggccccacctccaatactggggatcacatttcagcataaggcttggaggggacacacatgaaaccgtatcgggtggtgcccttataagaaggctatgtggagactcagggacacagagacacaccatgggaaggaggaggctgagattgacagcaaccaccagaactgagggagagcctggagcaggttcccccgcagtctgcagaagaaatccgctctgctgccacccggcctccagaatggggaggaagagaatctgtgatgtctgaaggtgtccggtgtggccctgtgatgcrgcagccccgggaaccgagcacagccccccattgcctcctgaagcaggcccgctggaccatctcttcccactgcaggccacccccactcttctcccaggcctcccaatccccctatgccactgtcatttctctcccctcctggagccaggatagattccataattggcagggccccaggcaaaatgaaaatacagagtcccctgttcaaaaatgatttagaatttcaagatagagacagcagagcattaagccaacctggggtcccttctatgcacggggcctggtgcaactgctcaggttacatgccaggaacactcgatacatcatatgcagcttcttattttttgatgttgtgtgttgggtcttgtctgtttcattccacaagaatataaactcctcacagacagacaccccctaatccttcagatcagctccaggtatagggtaggtgctcaacaaaagtgggttaacggttggcatattgggaagcaggttatagttgggcattgctctcatccttggccagggtccggattagagcccaggtctgcctgtctccaagcctgagccctctcccttctatcagcacagtgcagagcttcaagcaggcacgtcataaacacttgctgatcgtgattaaagcatagcacaacttagcatctccagcttcagcatcctcatctagaaaaatggggtaatcatgacacacacctcttgaaactgtttgataactaaacaatacaatacatggaagcactcaggacagtacctggagaccagctgcctcttctcactggcatctggacagatctgtgcctgtgagtgtccccagggacagaacagggtagggaagggtagcggttgtgggaggggcgtggtagtgaatctcttcccagtgtttggagggtgattaaaagaggaaaaaaagggagaggacagcatgtcacacaagtgaatacaatgtctaggcatgtgtccccgggcagatgtgccagccgtgagcctgtgagtcgcatctgatgacaaccaagaggtggctccactccctggccctgcaggagcctctgttatgacttagaggacatgttttgaagactccaccaaaaagccgaataattgattttgaaatatttgaattctggaacatgaaacctatgaagctttcatgtaccttcctctcctccataaccacatggagcttatttcaaactccagaaataacaaaaagaacccggggggaccaccctcttagaataactccccatgggtgatgaaaggaaggcatatcaaattcactttaggagagaagggattctgagaaatggattttcacgatgtccaaatggagctggcctatagattttcctctggattatactggcctgctttgccttcagatgagcacagatggtcacattcatgaactggggttgctgaaaacacatttttaagggggctcgacatgtgttaaaacaaccagaagttcttgaacaaaattactggtcagccaaactggttttttgtttttgtttgtttgtttgtttgtttttgaagtaacaggctatatgttttagagcagttttaggtttttaggaaaattgaatggaaaatacagagctcccgtggcccctcccctccattcccaaaagttcttattatcagtgtcctgcattcacttgatgcatttgttacaactgacgagagccaatatgcctactttattataacttaaagtccatagtttacattggggtttattctttgtgttgtgcattctataggtgtggacagatgtataatgatactgatcccccgtgagagtgtcatacagaatcatttcactgtcttaagactctccagggcaccatctgctcatccctccctctcctcatccccaactgccgggaaccactgatctttctactgcttccgtagttttgcttgaagttttgccctgcatggcttattgtaccttgggatataagccaataatagtaggacatgtaatgaatttataaagaaaataatcaatatatattaatggcgcaaatttgttttactaaatgaggaccagatccaaaaaaacatggagactactgtcctagagatgaactgataactaaactactttctataagggtctacaagctattttacaatttgaaataaaaagttcatattttaaagatattatgttctaaataagaagttagaatattttaccacagagggatgaatttttgaatttgcaaagtgtctttgcctccgttttctcattttactcctttgtggagtgagaaagcaaggtgttttttatctctttagtggcaatatttaagtgactttcttggcctgtctccctttcttcctctccctctctttctctttctcttgtagtgatatgtgcaataacagaagttttttttccattgacctcagcttatcttatgactctcccagttttttcattggggataaacgtgtttttgccaattccagataactcagtcactcctagtttaaaacacagcctctgtggggcccagtgcatgtggcccaaattctggattctcatcttcctgccaaatccttttcccaccgcttgggggtaatataagttccaaggctgctatattatccatatgagtattgcattgtcaatgaatcttccacgtccagaaccgtatcttgtactcagtaaacactgaacaatgaactcagtaaacattgaacacctttctcttargaattggcctggatagttagastttagaagtcccaaactgaactcacgtcttcctcccatgatccctgggccagtgctccttctccagggctccgcatctgagatgtgacaccatctacccagttgttcaagccagaaactggatcayactggagttagcccctgggtccctgatatatcttggctttcattgcctatgtgcaaaatctatgggctatacaataacaactctcattggtmatcagtccatagaacagtagggacaattggtgcagactaatgtttttcagttttgcaaatctgcctttgtaaacatccatgtttagtatagacttccttgtgggccactggagccctactggctagtgcttaccttggccatgcctgagtagacagggaggaaagaagaggaaactttagatgagtgtcccaactcttttccccaattttaaagatgactatcctatccttcaaacaagttctgtcccctagggcagtgatccccaacttttttggcatcagggactggtttcatgagagagaatttttctacagaccaaggaagactggtttcgggataaaactgttccacctcagatcatcaggcattagattctcaaaaggagcttggaccctaggtccctcamgtgcacagttcacaatggggtttgtgcacctatgagaatctaatactgctactgatctgacagggggcatagctcaggcagtaatgctcactggcccgctgatcactgcctgctctgcagcccagctcctgacaggccagggactggcatcagtctgcagttcagaggatggggacccctactctagggctcagagaagaagctgctatagaggtgggagcacatgttgtgctggttttcttgcttctctgctacagggactgttgtttggaagactggggctatgctgtcctggacacagctgccccrgtactactggccataaggttctccctttccactccatttccctctctctgggagcttgtaagatgtgtggggcatggcattttgaagatatacatttatatggaaaatggatcttagaaatcttccagttttagtccttcctgagtctgtgagaaaagaactccccaagctcctagaaaataaacattctgggtttcaagaaatgtgcgtcagacacaggcgaggggagccgtggtagccagggtagaggctcaagacctcacacaaatgtccctctgtgactcttcctttctcaggctaatcccatgaacccccttttggatctgggatgcagaaactggtgcagctcctcggggggctgaggacccttgacagaggagtcacacttagcagcctggagtcagtgtgtgttgggagggcagtgtttgcatagaaaccctgcaatggttgaggacttggtggccaggcaaacttgtttccaagtgcttcttttggtgaagcgttctgccttgtagctttatggccttttaaaagaatctgtttcatattttttaatggtaggcttcgggccagcattatcatctctaccttaccaatgtggaaaatgcagataaggaaatgccaagatgttaaatgagttgtccaagattttgtagccaatggcggtagagccaggatcagcatctgggccttgtaaacgctctgattgtgaaggtgttacccatattggaccgtgtcagggcctccatctctccagagcagctgtttgcccctggctgaaccctgaggaggtatctgcagaaccagaggcagatggaccatcagacttggaagggactttagagcagcctcttgtttttaatgagacttagaaagatgagtgaccttcctcatgtcctatatctagttcatggcagactgatcccaaagatttggaacacagtcagaacaccatccaactgctttcccataagaaccagatggagtcaactcgagttcctcataaacttcattcaaatacaaaaaaggcagaacagagaaaattattacttttcccatctggaaaaagcatggcaattaggatttctgggcctctatccatttatcataaagagatgaggagggaacaatatgataaataatagatattatcaaactttcattttagtatcatggttgacttctgctggaagttaatagcttggcattgctaagcacactccctagaagccgttttttttcttggctgatcaatccaaaaatggttttaaaagtttggagtgtagtctggtcctaagttagctaagatgggctgaggattaaggcacaaatccaatttttcttttctattaagaaataacacttgtattaaaacattattacagattataaggggcatattaactttgccactaaccggttatgtgaccttggagaagcaactcaccttggtgttctcattgtgcatgtaaaacacccacctcccagggtgagcggagaattcaatcaggtgagaaaatttatgcaaagtgcttttagcaggcccaaagctgatctgtctgtgatggcttctggttactagaagctaatctgggattcttggctcctaagaggtgggcaattcatctcagagcagatcatctttgtccaggaaagaatcctttggcagcctctcttggtttgtcagtgcagtataaggcaaatagaccttcatttttagacaatggtgtggaagttaccatcttgcatacaaagcccagggacccagtctactgtcaggaaagatggaggtcacctgattatgatctgcaggtagagaaagcatcaaaggctgaaggagaacttgtgtgacagtcaggwgagtcagactgaagtctcaatatagggatagagggttcttcagagacacagcaccaataggatgtgtgcgtgtgtgtgtgtgtgtgtgtgtgcgtgtgtgcatgcagagagagagagagagagatttattttgaagaactaactgacacaatcacaattatggaggctggcaaatccaaaatctgctgggtgggcctgcaggctggagacccagggaagagccaatgttgcagtttgaatctgaagaccatctgctgtcactactccctcttgcttagtggggaggttaattttgtgttctattcaggccttcaactgattggacgaggctcactctcattatagatggcaacatgctttactcaaagtccaccaacttagatgtcaacatcatccccaaacaccctcataggaacatccagaaaaacgtttgaccaaatatctgggtactatggcccagccaagctgttgtgtaaaatgaaccatcacagagtgttcacagggaaggagctggtttgggcagaagttgagatctattcagaaaattattttggacccagtcacccttgcaaatggtgtgtttgagggaacaacagctaagcaaaagatatgggaatgtgaactgcaagatttgtattgttgatgcctagagtgagacagcatggtagcctccataagtaggtgcagcccagcagcaggagcaagtgtgttaggcaagctgcacagagtttgtcttcaacagtgacacctgtggccatgcaaggcaatgacagcagtaaatagatcagactccgcttctccaagtgaacctcagaagcaggaatgaccccttctagactgagcaagcctctaagtatttcaaacgattatgatacaggtgcagggtgggttcaggtgtgtggaaaggtgacctcagagggaaaagagcttctgctagttggacacaaaagcctttggtgattgactggcaaagttcagaggtgtccactgtgcccggagttggtaaaacaaagaatacaggttgctacataaaaattaataagggatgacttcctcccctcactttccagcatgcataaaaatagcagaagctttagcagaktcccccatgctgtaggtgacagagcttcagcagtgacttcttcttgtttcccttctggcttttcccaggaggcagcttaggtttgaagcagcatttcactttccatctctaaacaagtaccatatgtttacaactttgggagttctcactcctctttctggagtcaagggtgttccctgggtggtgagggaaagggtgtgtgctttggaaggtcgggaaggtgacatttatcaagtgcctgccatgtgtcaggacagagctggctggatgtttaacctctattatatcttgatgtgtttttgatgtgtgccccacccaaatctcgtgtcgaattgtaatctctagtgttgaaggtgggccctggtgggaggtgactggatcacgggggtggattcttcatgaatgccttagcgccgtccccttggtgctgttctcatgatagtgagtgagttatcacaagatctggttgtttaaaagcatgcagcacatcttccctctcctcctcctgttccagccacatgaagacacctgcttctggtttgccttccaccatgagtacaagttccttgaggcctccccagaagcagaatcaccatgcttcctgtacagcctgcagaaccatgagacagttaaacctcttttctttataaattacccagtctcacgtatttttatagcaatatgagaacagaccaatacatatctacatatcctcaaaccacccgaggaagtgggtcctcatgacctattttacatggggaatttataaattacccagtctcaggtattttttatagcaatatgagaacagactaatacatatatacaaatcctcaaaccacccgaggaagtgggtcctgatgccctattatatatggggaagctgaggcacagagaacttcagtaacacattcatggtcaccaacmccacaagcatccatcagaacctggaaaggagatgattttctgcaccgaagctaacctggaaatgtatgaattctgtggatactttcttaggaaccatgggaatgctctcatcccccagaaagaaccccttggcatgcagacaagagtctttccaccacaacaatttgctttcaggattccttctctgaggccagtggaggaacatgggtaggattatttttcatggctcagttacccagcaatctgcaattgcaagatggtgggaaggactcctcttactctgtggtaacctagagcaaatcctgggcatctctctgaggactgggcttagtgacaggtaatgggcttttcccacctccccctcctgtgctgtagaacctgcaagtgtaccctataacagatttcatcacagagaatcatataaaaatagcaaaaccacttatgagcctgttttggaaaggaaataacttatagtttgggaaaggttccttatattaaaattaccaagctgcttccttcccataattttttcaaatttaaataattttatctccaaataagaaaatcttgcaggcatgaggtaatacttgcctaggatttgaggttagatgttcttgattaaaagtctgatgtactctgtacaagactgggcaagtcagtgaatttctctcagcctcagtttcctcatttctgaaagggactgtaatgtctgtgcctggttgctgtgaaagccaattgcatttggggaggtgaaaagtccataaattgtcaagagctgaactcatgtgaggtattattattattcatagtaacaatatatagatcttaggatatcataagggaagttttgcccttctggggactggctgagtagatcacaaaatacatggcaaaaggccgtacgaattcctcaataaagggttcagaatcagcaccgaagggcactggccagaactgagctccttttccccctgtggctctgagctggcatgggtaggggctggggtggctgaggctcctgcccccaatcacccggggcagctttgcaaattgggtgggatgtcatggcttgccacagaagtgggggtgctggggttaggcgcagggtctctggagtccacctccctggattcaaagcctgaccctgctattttctagcattgaggctttgggcagttgatttttacttcctggctcctcatcagcaaaatgaggatatgagcaaaatgagcaatggtaataatagaatattcctcatagggtcaccatgaggatgaagagcttcaataagcacagtgggcactgcccattgtggcacagaggcagtgtggagagtgctgtatttcacgcagccgtttctctaagtgtccatatccagcatggctcctggctgctgccagtcactctgtagctcctgtccactccccaccctcagtgccaggccctttcctctgtgacaatctgggaagcagcagggtagagtccacccttccctgatycccctgcctgggaagcatcccccagtgtacacaggcttgtgtagagctcttacgtggggcagggcaatcccttggggtcacagaggattacgtcccgttaggggtgacactcaagaccgggttccacttgggttttcccttgcgttgctcagggcttgagccttctgcaaggggacccccgccctacccctgtctcattgccctgtctaagccccatccagttccctctccaagcctctcagtgtgaaactttacccctttttctgggaatggattaatggtgcagcaagggagtcatccatgggtatcctgagctcggcagttgggagatgtgcagcagccccaacctgggtgggcgctggtgctcttttccgctcatgaatcatctgagctcaacattggctaacgtgccctactggaacytgagctcccacctcaatccccaccycacccccagaaccagcggcaggctggcagcccctcttcctgtgatccatctttcagagatgtgtgcggcttggccttgatgaccccatggtctatttccatctcgagaaaagatgattttccctgtcggtaaggctaggaccctgcccttggaaacagtggggcctattatgcccatgaggagcaactgagttagcaattgagttagggacttctctgagcatgttacaaagaccagaatctccctctgctggtgctggcttttggggacgtgcaggcaaatcatgaaatctgactcccattttcatgctcctgccttctcttaggggcttaccttggagaatggcaccaccgtctcatcagttactcaagccatgaacctgctgccatatttgagtctttcccctccctcggagcctacatccgactgctcagtggtgtctcgtgtcgtccttattttgtcacttgacaagcattggctgagtccctgctgtgtgccctgcactgcactggacattcagagtacaacacagtccctagaatcaggctcttgcaatcccgagggatcaagatgcaaagatcgttgagtccatcagccctacaccctgcatctcctgctatgggagcagagtgggaaggacaccaaggcttacagaggctgtgcgcaatcacgtggcgtcagcagcagagccccgtgcccaggcacctggaaattgcatccatccctggactgtggtgggtccatggggctcagggtggggatggggctccttcccggacttcacagggttgggctcagccacccccgtgggctgtttcagctccagcattctctgggccaagattaaacgttaatttgtaatggggtctgctgaaggtatcttcggttgcagcctcgaggcagattactccggaatctcagtggaatgaatcagaggcctgcttttggcagtaagcatctgaagcttaaccagggaaagatgacaatttatgctgcgtcgaagaggacgatagctttcttgttttactgccagaagaacaccatggggtaggggtctgaagatggaaaaccaacgctgtgtcggctggaaaacttttgtttttatttatgagactgatttgtatatgttaaggccaattggtagaaattggcccatttgcaaattggcagacagagaaaaatcttgatttaggactaaaagcaacgaagctaagacaataaaaagagaatcatgttcattaagttaaaaaagcagactcctattcaagctttttttcccttaaattcttaacttctctaattgcaaatgagtttgagatagtttacagagacgcaatataataggataaaaataaatagattaagaaatcaggacgaagggaaaataaagaaaggataatagaataaagccagagaaagataataaacagaactatatatgatactcttgggaacattaaaaataatatttaaaaaacttttaaattgaggtataacgtgcatataagtaagaaagtcttaagtgtttagctagctcaatgaagcttgtggcccaaaattacctgagacaggtctcaaccaacttagaaagtttattttgccaaggttaacagcctcaggaggtcctgacgacatgtgtccatgatggtccgggtacggcttgcttttatacattttagggagacataatacatcaatcaatacatgtaagatttacattggtttgatctggaaggagggtacaatttcaactgggatggggggcacttcytggtcataggtagatttaaaatgtttctacctggcaattggttgaaagagttactatcaatagaaaggaatgtgtgggttatactaaggggttgtgaaggccaaggctttatcatgcagctgaagcctccaagtagcaggcttcagagagaagagtttgtaaatgtttcttgtcagacctaaggtctgtgttgatgataatgctggagggtagatgaggcaggtccgatcctctcttccatcgtgtcctgaactcgtttttcaggttgactctggaatggccttggccaagaggaggggtccccattcacatggttgatgggaggccttagaattttagttttggtttacaggttttacatgtgtggccaacaggtgaccaccaccaataaatatatagaacccttgtagattctgttaggcttccccttctcatcagcacctcagaagaggtggccactactccaacttttctcaccatatattagttctgcctgctcttaagccttcatgtaaattggattacatggtaaatactcctttgtatctatctcccttcactattacatctgtgagtttcactcacgttattgtaggcagctgtaccctcctctccctcactgctgcatagtactctttatatctcatgtgaaggacttatccattctactggtgagggaaatgtgggccatttctactttttggctttatacatgaaggtgctgtgaacattcttaggcatgtggtatggtttggatctacgtccccacccaaatctcatgttcaattgtaatgcccagtgttggagatggggcctggtggaaggtgattagatcatgggggtagagttctcatgaatggtttggcaccatcccccacttggtactgtatagtgagtgagttctcactgggatctggttataaaagtgtgtggcacctccccccacctaatcccccacttttctcctgctctggtaatgtaaagtgctggcttccccttcaccttccacyatgattrtaagtttcctgaggtcttcccagaagcagatgctgccatgttgcctgtacagactgcagaactatgagccaattaaatctcttttatttgtaaattacccagtttcagatatttctttatagcaatgtgagaagaggctaatatagtatgactcttggggggacataaacactcatttctgctgggtatatatacccaggagttgggttgctgggtcatattgtatgtgaatggttagctttagtagaaaatgccaagcatctttcctacatacagtacaggcatacctcactttattgtgctttgtgatacagtagttgtaccattttagacttctatcagcagcacacaagagttcctgttgtttcatattcttgtcaacacttgatgttgtcagtctttaatttcagccattcccatgggggcatggtggttctagaagactttttcccccttttcagcaatcatttccccttctttggatgaaagcattgattttcaatagaatccatcattcgctagccctgagggggatcacatgacccagatctaagactgggcatcactttgccctaacatagtaattggtgtggtttgagccacttaggtagatgcctgagctggtccaataagagtgaatctccagccttttgccagaatttaggtagctattctgtagctctgaggggagaattggtctaagaacagagttaacatgagagagtgagccaagaagacagaagcaaaagcagcttgccaatactgtttgacctccgtggttgtgtctggaactacatctacccctaaaggctatattttctcttttatgcttcagccaggttgaatcaggttttcaattatttgtcatccaaagagtactattcaatgtccatcaagtcctaaaagcccacttcagcattattctgaatacaagaggcttcctcacttgtgaatcttttctccactttcagagcctctgcaggggctatgccctccccagagaatgctcttgctctcgcaagcctggatccttcccrttctttagggaagaaatgtcccctcctccaatattctctagcatagttccctcctcttatttctgcaaggcacttgtgctgttctttcacaatttctcatttgtttattggttattgatggaattttgccatctctctgtgattttcatgaggtcagacacaatctctattttgttctcaccagaaaccttgtgcctagcagagtgcctggcccatcaaggcatacaataaatgtttgttgaatgaatgaayaatgaatgaatataactgtgtcttaaccttggtctgggctcacatcracctggcctggaatgacccagctgtcaggttagttcccctgggcccatcccacacatctgagtttggattctcccagaagcagaacctgggacagacttgagaggaggtgggaagtgagatagggaaggggagccaggcaaccaagaatgtgttagaaagcaggtgtggctcatgcctgcagggagctctgagaacaagtgtagtcaggcaacccagacttatttcacccaagggagagggagctgtggtatttataccccaactaccccacatcagygactaagggctatttactgggaggtatggattcctgacacttctagctttgcctgtggtggccagagaaagctatcaggcaggaaaatacaggggcagccggtgggaaatggggcagcatgctttgcgaggtaagggtgaggggataaaggtgtgacccccgtagcatctgaaccatagccttattgaggttcttgccattacctgctgtcctggggaagctactctgaagggcagagcacctgctctgtacctagtctgaacctaccacctcctttgttgctgtgtggctttacccaattctctttactgggatgggcttcaattccctcacctatgaaatgcagatagcaggccacacctgcagtgttgctggcagtacttcaggcatggatagctgctcagcacctggcaaaggttctggccatagcaattgttcacagctcagtttcctacctctctgcccaagggctgttccttctagcaggcttgcactctacttgtcctcaaggacaaggtgcaaaacagaagctcagtgtgacaagtctgaagtgagggttgtttaaagtgccggtggctcctgagcatcccatctctaggctcttgtaattgtgcttactggaggacatacctttcccactgacgtgcactgggggcccacggccggggatggccactagccaagagaggattagaccatttttgagaagtcttaagcaaacaaataaataactatccccaccactcccctgccatgtgggtggagaatgccttctcagtttaatttccaacagctcctctttgtgggccgaccagccacaggccacattttttggggcacaggaccctgaatagacttccctttggatcccagcagaagacttcgcctgggggacttttcccattgccaggaaggataaaattgccatgamtcgacccagagctcaagcccttgacagttctcaaaaccctttttcgtccagcttctcttttgatttttgaaatcagccctactgtgagcaggccagagtggcctcattatatcaactttgacaaagatcaagggaagcccggagagggagagctacctgtctagcatcacacagcaagagccagagtagggaccttgcctgctggctcctgctggggacactttccccagcatggccctctgcaccccaatatgaaaccccccaagttccggaagggaagcgacgccaggcccttcctgccttttaaagagacttctcttcttctctccacccccttcttctttagtaagtagaaccattagtttttattgacgggactaatgcttttcatttagggccaattacaataggaagggagacgcttaagggtaactgggtgatgaaaggcccccattagggaacaagctcaggagctgctgtttcccatttgtaatgctggttccacatgcgagtcatatttaagccataaacggtggcgcccagggagcactcgtggattgccttgagaaacccgatacttttatcaaatctccagatggctgtgtatttgagaaaccatttatttaatttattttttccccttagagatgcttagattctcagaagctggctccacctaaccccatggaccttccagtaacatctatgctcctgcttgaaataattgccctctgggttttactggcaccccagtggctgcttgtaaactcttgctcattttttttttttcctttgctttttgcaattttgctccgtaggggagaaaataaagatgtgctcggtgctttcctggtgttgggtgctgggttccacccttcacttaccttagatcatttggtctgggtagggccccaccaattgcacccatttcacagatgagaaaagagaggctcccagtagcccctttgcttgcctaaaccaggaagggcagaggagggacgccagcccaggactgtctgcctcctttcagggctgcaaataatttgcaacctaccccgaacatttctaatagcctgatatattgtctatttacaaagtattttccccctttaaaccagaaacttggcagggccccgtgattacgtagtggttccccagatgattacgatgcggtgtctggacttcktggaaagttttggcattagtggctgccttttgttttttcttttcttaaggtttgtgaaagtaaactggcgcttgccctgaggggcctgggcaagtgggggctggagctgctgagggagggttaggcaggctgcaggcccaggaagggagggtgaacataaacagagaaatgagagcgtaaacagcaaatcagcctgggacagacactcaagggatgggtaggaagggaattctgtctggggttggtggaaaatgaagaaggaagttggaacctgctttgaatcctttgaatcctgcaggcggactgacttcaggagggtgggaaagtccagagtgtgtggggaagtctcctgttcctgcttgagatgtcattcccagggttggagagtgcccatgcccagcccgggaactacaaggacaaatgcccttctcctctgacgaactcgaactaggggcaaggtgcagatgaacaatggaatcagtgcattcagtatgttctgcagcagataacagtcccacaattgtgttcccatttcattttacactgctaggctttacagtaccagtactggtctcattttagggacaagaaagttgagttccaggaggctgtcattggctaaaatctcctaaagtgtgagtgggaggctgagattcgaaccccttttcagcttccaaaattggagagtttcagctctcatcattgcacagagccacctctctggtagaaggcagagaatggaggaaaaggcaccaaggagggaggggaccacccagcttgaggtcagggaaggcttccaggaagaggtgatgctggaaccgagcattggcaggtggaaggggcaagtattctagacagacaaaatggactgggcaaaggtctggaggcttcatcctacccagagtgcatggggagctgaccagagtttggagagggtgaggcaatggagactttggtggtggggtgaggaaagttggaaccccaagcagcctgtcacccagcccaggggacatgagctcctgattttacctttgacatgtgttttgtaagcgaagtctgatgggacaatggagcatgcacatgggcagaggagctccatgccatgtgtgtgcccagtgttcctgtggccctttttgcacaaagcatctgtgaggccccagaggtgcggggtgcataggaattcagcaggactcaaatcaagtccaaggaaagcaggttacatgtgtggctatggaggtcgtggggtggggtgcagtaagaagaagctgcactttctgttccaaccaggacgtgcttcaagtgcagaaagaasacaatgacattctaagcaatgggaatgacccattctgtccttgccttttcctgctacttccttggtataagacaaccacctatgctgacaatgatgacaragaaagaaaaagaaggatagggaaatcacaggctttttttcgactcagtacttccttagtcctccataagctgaaggtagaaagtggtggcagaatgcgttcatctcaagacgtaaactaaaaacagctgaattggctttgtkcagtgtttccagttttggaaacaaggacatgcacaatacgccacacgaatgtgtgatttctgcgatttcaccttcaagttaattactcttatatgtgcattaaaactggcatcacatgctatgaagttgaaccatgaaattcatgctaataatatgaaattttaatttaaaaaacttacaatgtcattaaataacaaattaaaatacaccacagcaagtccagagagactacaaaagaatggaaaacactttacatttctgtacatttttgttgctgttgttctgtttttacaaaaaggggccctgagctcagctcctgggggggcttgtttgcttttaggccatggctttgtctgttgggaaaggaatcttcacaagtcctgacrcctctccaggcctcagtctccccactgttaaaatcaaaagagcaggaaaatagtatcagaattgtggacagagactagacttggtcagacagaatggggggtgggaccctggctctaccagctcatagctgtgggtttggacatattgtttaatccctcagaaccttgatttcttcatctgaaaagtaaggccacccatgctcactttgcagtgtggctgtgcgcattgactgggtgtgtgctgactgtgggggctaatcttgagtgagttgcctgacctcagctttaatgtcttcatccagaaaataaggaaaatcatactccatagagttgtcatcagacatttagcgccatagatggcaaaatactaaatatttagtaaatgattgggtgctattattttaaattaattaaaattatttgagacagagtctcactccctcacccaggctggagtgctgtgacgccatgcagctctctgcagcctcgactccctgggctcaagcaatctgcaggcttcagcctcctgagtagctgggactacaggcctgygccaccacactggcttttttttttttttttttttttttaaagtagagagagggttttgtcttgttgcccaggctggtctcaaactcctggggtcaagcagtttgtccagctgggccttccaaagtgatgggattacaggtgtgagccaccacactgggctttagattaatttttaagatacatagtagatgtacacccatggtgaccaccttcagttttatgtgccagatccctgcccacacaatttcttggtgcagcgcctatctgcttctagaatgttcccatcttcccattatgtggtttccagaggcagccatgttcccaggtgattcctcccatctggccactgttgattagtctgtgggtgtcccgtgaccaacttgcagaaacgtgaaaaataaatgtctgttgtttaaaccacccagcctacggtattttgttacagcagcccaaattgagacacctacccctactacccacatatgttcaactgattttcaacaaatgtgtaaagataattcagtttcatcaaatggtgctggaaaaactggacctctagatgcaaaaatatgagccttaatctataccttgtatcatatagaaaatgcaaaatggattatagacataaatgtaaaaccgaaaatgctaaaacatctagaagaaaacatcatggaaaatctttgtggctttgctttatgcaaagatttcttagatacaacaccaaaagcacagtgcataaagaacaaattgatgaattgtactttattaaaattaacaactcctgttcttcaaaagacactgttaagagattgaaaaggcagagattaagagaaattatttgtaatcacatattagtaaaggttttgttttcagaatatgtttaaaaactctttaaaatgagaaaataaacattggggaaaatatttgaacagacactacaccaaggaaaatatgtgtattaaaagatgctccccgctattaatcattaaagaaatgcaaattaaaactacaatacgataccactgcatgccaactggaatggctaaaattaaaaagacagaccatcccaagtgtgggtgaggatgcaaagcaactggtgggttctcaaacactggtggtaggaatgtgaaagggtacaacaactatggaaaacagttgtttaaaaagttaaacgtacacctaccatatcacccactcattctattcctgtgtatccccaagaggaacaatggcatctgtgcacacaaacgcttgtacaggaatgtccatagcagctttttaaataatagtgagaaactagaaacaacctaaatatccaccaatgggagaatgcataaacaaattgtggtacgtctatacaatggaatacttaacaactaaaaagaatgaataactgatgcatacaacaacatgcataacactcaaaagcattattgctaaggtttgaatatttgtcccctccaaaactcatgtcgaagcttaatccccactgcagcagcattgagaggtagggtctttaggaagtgattgggttcattcatggacccaatgggattagtccatttatgaattaatggattaatgcattaatggattaatgggttatcatgggactgggaccagtggcttcataagaagaggaagagagacctgggccagcacactcagcccccttgtcatgaagtgccctgtactgccttgggactctgcagagagtccctgccagcaagaaggccctcaccagatgagctcctggactttggacttctcagccactataactgtaagaaataaattcctcttctttataaattacccagtttcaggtattctgttataagcaacagaaaacagactaagacacttatgctgaatgaaataaaccagactaaagagtacatgtatgatttcattgatgcaaaattctggaaaatgcatattaatctacagtgacaaaaagcaaatcaatatttccctgagtagggggtagggaggacaggaagaaaagagtacagataggcatacggaaagttcgggatcatggatttgtttactctcttgattgtgatagttcacaggtatagaaatatgtcaattgtatacaattgtacacttaaaatatgtgcagtttattatatgtcaattatacctcagtaaagatataaagacaaaattgaagcaatgctaagcacagtaaatgtcaatgattgctaatatttttcctgatagcataactgaagcccagagagagatgtgacttcatctcacatttattctattcattcactcattcatccttttacgcacwtttttgcccctacaaatatttcttgtgcacctactatgtcctcagccctggtttaggagcctgagatgcaaagacgaatggaaaggcatccctttcccctctggacctctcagtggtcacargttaatgatcctaaatgagagacagcccttcagcatttctgggcctcagtggccttgcatgggacacacacagattacattagttgctgagaatcctagagacctatttgtcctcagatccagatctcacacttcccctgatttgctcggtatctacagaggctgactcccgcaggctgcaactcccaggctccatgtcagcttaatggaaggttcaactaatggaaggttctggaaggacactcaagggaagattcagggaggaggagtggtgcaggatctctccccttcttctttgcctcactgcgtctccagaagcaaccacacctcctgcatggctcagctgccatcctgggatacagcacagcccactagtcctggctccactagcaccatctccctttgcctctgcaacgtaggggtgccagtgtctcctgctgtcacaatctctgtacatctgcacacatttcctaccttgtcaagtctgaaagtggcttctactttcctggttaaactctgactggcgaaaatctcttctaaggtttcttctggattaaaaaaaaattcaagaacttcatactagaatttcaagcagggtgtcaggcagggagggagatatttgggggttgggagggcctcctagaggtctctgcaggctcatcacacagacagctgcattacttcatggcaggacccctgagaaatcatgcctggggcctgaatccagccccaaatctgtagttcagggaagcattcggcaggaagcttagatgtgtttccatccagagttcaacacagatcaaagtggtgtggcaacgccatgccctgtcacttcaattaaagtgatcccaaggtgcgttggcgggacatattgggtccaaccagactctgccatccagtatcagctgggaatttcaagtggaacagctgctgtgtcactgtacatgtgtgtctctctacactcacgtgtgcgtcctcaagtctagaaatcctattgatcctgtgtaactcttgagaaacggagatgcccaggactgaatgtatgcaaaatgttttgcttcttttctttcaaagaaagctgttactaaatccatgatgcttctgataattgatggtgccttagaattgaggaaatagaggctcccctccccaagaataccactttggttaatgtgctcccaggaggaatctccttggtttttaatatccaaattttatagactatctatatctcatagtacttcattttgagggatgagtgtttacatttaaaagttatatttatgtctaaataactcaacataacattttccctaaataaaatgatgagtaagaaaagtctccaattacatcccaaataaaatccgmagactctcagaatcatatatacacatgtcaaccaaaggagtgtgtgtttcagctgatgttggcactgaaggaggccttccatattctgcccggtgtgagccatctgtgctgtcgtgtgcttgtccacagtgatgtcaaagtgcgcccttgcttttgcctggtgttgaacaatatgtcccctcaagagttgagtattatggcgaggaaactggttatggtggaaagaaagatgctatccaacaagaagtacatcagccagctattaagtaacaaatcacccccaaagctcagtgacttaaaayaccaatcatgcatcttcagggtggaggttggctgagctaggttgggtgcagctggatattctaggatagaattggcatttactgggaggggaagacactagaaatgacaggtttgtgggtacagggagcttcagtggttgggtcaagggcatgttcagtttgagagagtgagtagacttccagataaaggtgttaagcaggaagttggagaattgagcctgggcctcaggggagagaacaggccttgagattcmagtttggggagcatctgctgatatttaaagccatcagatagggtcaagttagcaagggcatgaatatggacaagaagagaagatacccaagcgtatccaggacaaggaggatctggtgcagtgtggatttgggaattcacagagcatcactccactcctaagagactgagggcaatgataagcagaaatcactgctgcctcgactggcctccgagtggtggcccaagggctataaagtagcccagcccagacatgtgttttctcaaacttcatagtgttttttcaaagaatttgaattagcaactggcattcaaaaatggaacaatttccccaaaagttctagatgttcaacttctattgacagattagaagctctgggcatcatgggcctgtattcctacctggcaacactcagccagagctgagaagtagttgccatggaggcaggccagagcggagacatggttgccatggagacaggcctgggcacctcagtttccccatccccaccactccctattgccttacacccactgcacttggctcatttgtgtttcctgcctaacccctgtgggcccttaagtgtgtaagtccctggcttagtctatggaagttctctgtatatctgcacatcatgtccccaggattcctgacctcagagaagatttggggcttcttgaatctgtgccccccatagccatggagcccatggggtggccaaagcctcctggatacctcacaacatatctttggagcattggagcatgagtttgccattgaggacctaaactgcaaggctgtgtaaaacattttatgtgagaagtgaggagctttccttctcggctgtagttgggctatgtcagagccaagtccagagttcatgtcatggactaaactcacccagaggcctttaggaaatgaaggagcaaagtgagaaggaaggagctgggcacttctttgcatcgtccaggccccttgcatgccctgccagccttcccctgggacacttaccttttgtggtacatcagggtcttgaatgactacagcgtgaaaatggcaaagcagacatttttcccaagctccgtcctcaaggcacagaggaattttaaatggctctgggttggggtacttgrcataatttgcagcactaaatccaaaacagatttgagcagccacagccacagagccacagtgctgggtcccaggtctggaatgtcattggaacaggagttgcccagcttgtgctggaagaatgaggagcactggtgggagaatggagtggaggctacacagcgttctgggcaccagatgcaaggtggccgagtcgcagcgctgcagtcatgggcaaatcacttggcttttctggacctcacttttctcatctctgaaatgggagaggggtttcagttgatgatgccaacgaattacaatggctcaaggaagtggtgttgagaggattcccaccttggccctcagcagccctatgggacactggggagtagtgtttaaggcacttggcaccagactggatgagactgagtcctgcctctaccacttatgggctgtgtggctttgggaaagtaactttacctctctgtgcctcaatttcttcctctgcagaatggggatgatcgtaacccccaccgtataggttagcagtgaagatcggtaataacgctaagatcatggatgcttgccatggtccaggctctgttgtaagtgctctgcagtttgtggagttaaaacttgttgtgagctcagcacagccatgacatgccacctctgttggatgcaagctggccattgtactgggttgaacagtgtccccccagaattcatgttcacctggagcctcagaatgggatcttatttggaagtagggtctttgcagatktaattagttaagacaaagtcatactggattagagtagaccctaaatccaatgactactctgcctagaagaatctgtaggaagacagaggcagagattggtgggatgctgccacaagctaaggaatgctaggaaaccccaggagctggaagtggcaagtaaggatcctcccctggaaccttcagagagagcatggccctgctgacaccttgaggccagttgctggcctctacaattgccagagaataagttttgattgtttaaagccacctggttagtggtgttttgttaccacagccctaggagccgtgtttatcactttatgaataaagacagggataatcagagatggggtggaggtgggctgaggtgaacgcgaatgcagaacttagcaatttgccaggtatttgggagcttaaaaaaaaaaagtagaagggaargaggaaggaaagtgctactttttgagtatctctgaaggattaggcaagatgtgattttattcctattattcataagaaaatcagggctcaggtagatggagcaactcactcctggtcacacatctaagggaaggaggctgagtttcaaaccttgccttggtgactccattgcccttgtactgtctactgcccctcactcccttctgctctgctagaatgcaggcttcactgggaccaagccaggtttgaattccctgtgactggcacagagtgagccagctgtaaatattggctgatgaatgaatgaatgtccagagttccctaatagtactggaattctaggtctctaatttttcctgtttcttagttccgatttttattccaacttcagtcttatgattatgactcctgggaaacaggaaggggattttcttcccaaatataactgtgcccccaaagttgtggtcacrctggctgcggcccctcagatctccctgtgtagagaaccagccatgaggagtgaaattgggtgcagcccctgactgctgcacctttgggatctgctgcagtgtccacactcccccaggtggctcctggacagtgacctctcagaatggggctaggagagctggtcatttctacccaatgcctgcctccctgctcttgctttcaacttttcttttttctgtttagatgtagaaccctttaaaaaatttcaaatagattcttatatagggttctggtaaaataaaaactatatgaatggcattttattagtctacaataacatttacttgtaaaactgtacaatgaggaaaatggagtggttacaaacacaaacgtttaaaataaggagttatgtctgagacggtctctcttagcctccaaagctaatttatttctgatttctgaagtttgtttggattcactgtattgcaagtacaaatgctcattcacaaaaataaatatatgcaaatggtgacatccttcaaacatcttgtctcactgtctcaggtaatgcattaattaaatacagatgaaaggagggggtttttgaggtgtttctttttcttaagtctgaatgaaacctagttaacctggcagtccaagttataacagatttgtggtggcccccagtgtgttaaaatctgtctccatccattggattgtatgttattttttattccatttttagaagggttgacaattctattaaaacattgaaatatgaaacaaacatctgagaaattcttaaagagcaatttaaaatcactggctgagattttatgaggatccttcccagctcagacatgctgtggtaagggggctctgttatttattaccacartaaagctgcataataacacaaccctcagtggcttaaaagaagaaagcatttctttctctcatgagtggctgttgttttaggctgggctcagctgggcggttcttctggtcttggctggagtcactttcatttttggtgactggtggtaggctggctaacctagaagagtccttgctggggcagctggggagatgggctgctccacatgtctccccatccagcaggccagtccaggtatgcttttgcagccaaggctgagaacaagagcagatgggaaacacatcagcactctttcaagtttgtgcttgtgtcacattcactcccatctctttggccaaagcaaggcactaagatgaactcagacctaggggtagggagacaggctcagtttcttcagtgagaggaacttcaaagtcatgtggcaaaggatgtgggaagaggtagatcatcagggtcatcaatgcagccgtataccatactaccttccccaagttcttgccttgactcactggaataaggaagttcaaccaatccctgttgggyatattaggtatattagtttggggatagtgggtataatagtttgcaggggtttacaaaacaaaatatcacmaactgggtggcttaaacaacagaaattaattttctcataattctggaggctagaaatccaagatcaaggtgtcagcagcttaggtttcttctgtggcctccctaggtggcttgtagacagtgtcttttccctgtgtcttcacatggtaatccctctatgtgtgtttgtgtatcagtcttctcttcttataaggacttcagtcatattggattagggcccacctaatgaccttattttcgctkaatcacctcttcaaaggctctatctccaaatatggcaatattctgaggtactgggggttaggacttcgaaatatgaattttggattggacacaagtcagcccataacagttagaagagactttttctcttctcaccaccccttataggcaagattggactaggggctggggtttttacaccatgcaaaaagcaggctctgctgcctctctctgtgtcttctgttctctgagaatgcctgtccttggccagagtgaattcattctgcattcttggctccagaaagggggcctcccatagaaccttcccagcctgtagaagaggaagttttctccagcttcatagcccatacttgctggataagacccaagcgcaagaggagtgagctccattagacccttgaggcaaagctattgttctccaacccagcttaccaggggtaacgcactttgggtcacaaagttcatgccacaagcaggaattagcccagttctttgtgtatcttctacctgggaagtgggaagcgtagctgatagcctactctaatctgtaacatctccaagaccgtcacaatgaagcccctgggcacgtcccaggcgccaccaagtcaatgaggctaacatgcacttttctgagccctggttcctctctcctgtgaagacagctatgtgattaggagccctggctgagcaccacaccatgatccctccagttcttgccactgccagagccagggaagtgcaatgttggcagaaaccatgggaaatactgngatggagccatttttggtagtagatgtgatctttttctcttaatacagctgtaacataatggaatggcaggaggaaaactagatcgtggctggaattcttccagagctcttaaggctaaggtgaaaagtggagaaatccatgagatgaccacaagggctctggatggccatggccatccaatgtggctctttgcactctctgtctccctgaatgcctggcttaatattgactgtgtaaaaacctaatatgtcactttagcaaatttgttggagcaatttttatgaatgggatggatgggaggtgggaagcagaatgttggaacaggaaggtttaattgacttatttacattctattatttctaaacttctacctcacatcaaaaaggatttgaggccaggcatgatggctcatgcctctaatcccagcactttgggaggctgaggcagcaggattgcctgaggytaagggttcaagaccagcctggcaacatagtaagaccccatctctaaaaaattaaaaacataagattagccaggcatggtggcatccacctgtagtcccagctacttgggaggctgaggcaggaggattgcttgagcctaggaactcaaggcttcagtaaactgtgattgcaccatctcattccagcctgggtgatggagcaagacctcaactcttaaaaataaatttgaaacatcatgttaatgtgtatttaataccataagaatggaaacaaaatcaagggcatttagtacaataggaaaacagaagtaagaaaataagagtgagccaaagctaagttcggtcttcggagggaagcataccataggtagtgtgtatttgccacagccatgctgaaaggttggtctctgtggttccttgtggccaaagcagaaggtaaaaatgatcagatacaagattcacagagactctaagacaaaaacatttgctcaaacgtttgaaaacatttgctcaaaggaagctcaactgctcctggtacagagacctatgaagaaatttttcctgtaagtcctcagaaagcaagcctctccagctgagctccacagggctgggaattcaggcctgtcctgcacattgcatgaagccaactgaagcaagaggaacgcatggagcagagaagcagagagaggcaaaggaagaggctgtctctgcatcatcaatcacacagatgcagagtctaccctgtcatgggggtcactgtggcttaagcatggcttccagaccattttttttcaaggttgggcaaatgtttgagtcaaaggcggaggtgggcggccaagcctaccttggccccgctggggaggaaggggcagaccgggggggtctctgggtctctggagccttctaggtkggaaattcccatgaaccccctgacaccaggcaggcagaagcagtgaggtctgggagtttggggttttgtttcttgggggaagaggtgagttcgttctaagtttggggtgaaatgtttgctgaatattcagagtccaaaaaggcaggctgtggagtcacttcctctccttggtgagcacagtacaggagtctctccctgcttatctcggggggatatatcagatgaccccagtggaygcctgaaactgcaggtagtacagaaccctacgtatactatacacaaatttcttttttttcttcctaatttcacagatagaagattcattctttaaaatatcttggcaacctcagcacatatttttttctctttccttataaagtccggaacttcacctttttgcttggaggaaacactttatgtgcacttttgcacatctaaatggccagcatcaccactccgtgctttggagccattgtgaataaagcggctgtagatctgataactgaggcagctactaagtgactaacagcatagtgtagacagcatggatacctgaaggctgcaaatttcatcaaacgagcaatttaaaacttatgaattgaattatttgtttctggaatttttcgtttaatattttcaaacccctgttgaccatgggtaactgaaaccacagaaagggaaaggmagttaagagaggactaatgtactcgaagcccacactttccagtcctcccctcccctgcggctgacccccgtgctcccccaccttgtcccgtggagtcacattactggttctggccaatggattaggagtggaaggaagccacgccccttcccaagccacacccctcctggtcaggtgtgacccacctacggtgctcttttttggaccaggtggcccagtaacctgaatgcctggaggtgaccagacacacaccggctatctaactctccacatcaccttttgaaagggctgcttggagagccaccaggccaaccgactttgtgtctttaagattgaacacttagtttattactgccacagatacagtgggggccaaggcagacaggatagtaaatcttagcacactccattgctgtggggactaaatgagagggctccagcatgctctggagcctgtcggcttgggtttgaatctcagctttgccccctactagcgctgttactttgggcaaggaatagcacctcagttgctccacccataaatggggataatcatagcccctgccaagagggctgctgagagctctcataagacaggagacgtaggcacccagcgcctgccgagaacttaaggtgctgagcacagtgtggcacagctgctagctccctgcccccagtccaacatccccacttctccagccttccccaccttgttatgtcatcctgcatggagtggaagagccaaagatgaacaataaacaaagctagcccaagggggtgttcagtcctaagtgccccaagaggctgcactcatgtgctgtgtaaccttgagtaagtcacacaacatctccgtgtgtcagttttctcagctgtggaatgaaggctgtgcaggagtgtgtgttgtgaatttggctcccttctgcgggatgggaactgcatttcccagaactccctcccctatattgtcctgtagagttgcccaggaaggaagctccgagcgggatgtgggagatggaagggaagctgaggccattgatcccggatgatcacgttggccacacttggtggcagactcagaggtgtgtggtgggcttccgcgtgtccttactgtcctgctctctgcatctagctcatcttcccaagtgacagccctgctggcaaacatcagcccaagcctgccactaggagcttggttgcgggcagcttggaagggggcagctcccagaggagccaggttctccaggcctcmgcccctcaggtgcccttctccagacgcatgccgcttcttggattttcctgcaaaccttcgcctgtctggccctgctggtgccggacctgtgtggcaaggcgctgagtgatgtctctctcaggtcctcagggtgctcctccagacctccccttccaggtggccctcatctgcgtgcaggctaattcctgtaagaaattccctcttcccttaggactcctgcagctctgctgaaccctgagtgcaagggtgacccccggccccagggcrtcatggagacagccaggggagggttgactccctccttrccaaccttgccgctgttcctgctacagggccgggggtgggggtgcccctttggcatggtggcatgcctttctcttgtcaccacaaattctttacgaagataaatattgaatggctgcttagcggtccattgactagatgacccttagtttatttaactagtcccccatggttggacgtttctgttatttccaattctctaatataattaacgccatggtggaagcttttgttcctgatctttattcaaacatcgggttctttccatatgataggtttctagaagtggaattcccaagtcaaaattgtttgagactcgttgtatggacagtcgaattgcccctagaaacgtgcctttattacagggctgcagacatggagcccagggaggggcgagctgcctggactcacaaaacaagtctgggcagtgtagacaggaaggcagccggcgcctgccagcaagagaacccaggagtttgctgggggacttgggtgatgacagagcctggggtggggtgggatgcagccaggggagattgccggagctgacagggccttatgctgtggggactaaagactctcgggcgtcgtctgagccagtcattttcaacattcgctttggctccagaaccaggtgtgtctgtgggtgtgtgcagatcagttcatttcctcgaaagatgggtagacaagcagacttgtgcaaagactcatctcagtgttcatcacagtgtcatccataccagagaaggctgggaaatcaccactaccatagctctggtgactggggtgggacctgaagcccctcccactcccctgccacggccacgaggtccctgcggccccacctggaatggtcatggtgcacccttgcctctgcttccctgagctggctcagaacccattcctggctgggccctccccactgcaaggcttgaaaggcctggagagaggggacagacacccacagacatcccgaccagctcagcacatcctgattcagggtgacttccccctctccattaaaacagccctggcccaaagacaaacaagcatcctgaatttatggtcctgttagcacgacagcagcgcagccaggcgttccttcttggccacgctctgcagagggctccctgtaggtctcccctcctattggagaaatgtcccagccaggcctgctccccctgcccccagttaactctgggggtctcaggccactcctaagggcttgttctgtgtgcaccaactgaacagcagcctctcattcagtatgcgggttagggagaggagaaaaacaaccaaagtcrcttgggcggaaaaaaccaggacacgattgattcccaaaggccatattttttttgcactgtttccttcaagtctgtggcccaggcaggcaaggagtaatatattagctccgttggtttaactggacagcagcatgagcttgtaataaggatgtggtaatacaccacgagaatctgtaggctcataaaacttgaccttataaatctccaagtgtatcaattccatacagcagccactccctgcagtggaagccacagacttataaagtggccgttgataacagaacagtttacccccaacccacctcccttstttaaaactccccaagacagactaatcagggcacattcataattcctcctgaaacaggaatgccacatcaaaacacacaagacccaaactggtctctaggatcagggagtaggagcccaagaggttaagcaagctcattaacaattgggataaaatgttccctagacaacttcctctctcttccccctgcctgtcttcagcctctttgggtgtgagggcagtggtgctactgctatatgctccctagatcaggatttgtgaaacgttttctgtaaagggacagacactagatattttaggcttcttgggccatttggcttctggtgtctgtcataactaccaactctgctgttgtcgggtgagaacagccatagacaatgtgtaaactagtgggtgtggttctgtgccaataaaactttatttacaaaaataagcaggcaggatttggccctcgggttggcgtttgctaacctctgctctaaatggtgcatcctcatccttaacatcctcgtcactggcaactcgccctccgagtgataagggggctagcctgcagaattcaagtcagcacctgggattcccagcaagggctcctgacacccagaggtgtgtcagactgttttccacacctcatctcatttgaactgggagagggaggtgtcattgcctcttcctgttccacagataagaaaactgagatccagagaggttaagtggttttcccaaagtcatagaactagcatgggacatgacacgattcgagccggcagctccggtctcacatgctcaggagaagggcagggaggtagcagtgaccatatgtgaggcactacggtgacatcacttcatttgccccagaataaggtgcttggcatattgtgtctggttttctcaaatccttgcaagctctcgggtctcccgtcatcagccttcctcctggctatcaccacatcccccacacttatgttttatgtgtctgtcataactgctcttttagagttgacgggtcctcgctcctagctgtgtagacttgagcagttactaaacctctcagaccctcatctgcaaaaggacatagaagagccgtactgcaagatcgtcacaaggattaaacaaaacacgcgggaaagttcctgggaaactaaaatgctgagtaaatgttagtttatctaattttcttaaagagtctggccagatgacttgacagacctcttttctgaattaaaaggctctatgttggcatctcctttctgcagtcccccatcttggcatgatgactctgcaggtggagctgaatgtgaatctgattatagtccccagctctaagctgaaagtggatgtgagctttgctcgccccgccggccccaaagggaaggactctgaacccatttcgaacagacaggccggtgcagggggcagctccctgccggccctttagaggaggctcccagcagcatggggttctatttagggaagctgtttccctgtctgggcagatggcctgcaggaacgggggcttggctgatctggtttcaactaattctattaaatgaaaagttctgtagagcagattccttcgcaagcctctgtccacatggtgatttaatcgagtaaaattaaaacattgctgctttctgtccaaattgctgctttctgcggtggccttgtagaggacttggcgggggaggaggggaagtctggatctggggtgggggttggccggaggtgggggtgctggatgctcctggagacagaggcagggctgagacggtggaaagcaggtggcaaggagaggaccctggcgaatttagggttaggatggcagagctcacaggatgcttcagaccatccagttcacccctggtggtgcagatggggaaactgaggtgcagatggggaaactgaggcccagaggggaagtgatgtcatcaagatcacccagggacctgagaatgtgcagcgatttgagcaaatcagacacaaggagcatttctgctcctggagccgttgctgtcttgggascctgaggaggcccatgtggcatcatcactccctggggaaacgggatttgtttcatccttattattcttcaaggagcttggattcttcccctgctaactcctgttcagcagctctgcctggggctgtttaggggatttgtgtccccactaagtccaccagaggcactgtgcattgttgagttgtggcttttaaatttctccatcaagaactagaactctcttgcactgaaacctcacaatttaccaggccaaaaagagcagagttgagttggtgggccctaagctctgccctccttgacctccctttttgccttcccctagaggtgacccttaagggatggccccaggctcctccggctctttggggcactgcgggaaactcactgaatttggaaaaattcggacttgggatttgctcamtccttgctatcatatcaggggagccacgtaaagatatgttgccttaaattctctcattccacagtattcctatgaaatcaggatgcctttgatggacatgccttaaattctctcattccacagtattcctatgaaatcaggatgcctttgatggacatgccttaaattctctcattccacagtattcctatgaaatcaggatgycwttgatggacttgccttaaattctctcattccacagtattcctatgaaatcaggatgtctttgatggacttgccttaaattctctcattccacagtattcctatgaaatcaggatgtcattgatggacatgcacttcacagtttgcacttcacttttacccatcatctaatttcctgcctcccacattcctgtgagatactcaggccagctttagggttgttctcatttcgtggatgaggaagctgaggctcagaagggtgacctgagggcccgcaagctcagattcccacctggttgtgctatcatctgtgcagctatccatagctggggacagagtggcttgtgatggcccccagcargggatgaataagggggtgtggggtcagtagaaggtcagtcctagacaaagctgcaaagagagaagattcgggtttctgtgtcgctcccctattcactgccatgyccctcatctaagccccatttttaccacgttgtcctcagggttagttgatctctaggctgctggtagttaggaagggcttagcaagactccaggtgggactcactgccagcagaagggcagcgactcccacctgccgtggggaagcagctttgtccgtgagggcagaggccagcctggggtcacctcctggcccctttcattctgctggttgctgtgagaatgtggaagagagcaggcagccccaaccctctgcaggtgcctgcacttccgagagccattctgtaatcgccgtctgtgcctccttctgccagggctttcatgagaacctgctgagtcaaatgatccagtggatccacttccaccatcagtgttttgaccttactcattgtcatcagagggtggcctggatggatgtcaatcttctcatcccaccccagatttcactctagcatccagcaaccttctattctttataggagtcagggtctctttctattgctatgtttaacaggagccagggctgtggtgcacatggagaggggatctcagcatgggccgaggtggcgtccacagctcatgggcaaagatttctgggcacacctggctgcttgcagaggaatatacccaggttgaatctgggcagctgagggtctgctgaggaggaacacaatcttagcaaacaggggctgggatgcactatttgcttctgcatgtatggccattggagagaaccacctagtgacgaagcccagtcattagaggacagtaacccagggttcaggtaacaactcagtcaaatccatcccctggacagacccacatgtggctctagaaggaagacagcctctagaaagaaaaatggcagcacttccccctgtgctctcaggtccccctgggacctgagcagcgcaggcagggaccgtataacagtgtaaccgaaggaggggcaaggacgctattccccagctcttacaatggggcatagtctgccttggcacgctgagaacttggtgaatgagctggagccaccatggacacagagatgccaagcaaacgtagggaagtgaatttcagcagcacctggaaggaaagaacttaacctgagatctctcctgcaggctcttgacagcgctggagtctccctttggaggccgagggtggggttgggaatctcaggggatgtcttgaactgggcaggggtgaggagctagtgacatgctagggttggtaagggtgcgagtccctcaccccttaggatcaagacttggggaaatcatgtctctagatcattgagacttgggggaaatcaggtttgcattggggcatgattgttaatccatgcggcaaccctataaaatcacagatgaggatcctgagcttctccatttggggcagaactcactgggacatcttgatacctcgaaatgttagcacgacgtgcaccatgcrggcactgagaagcagcgcaaggcagcagtgcaggtgtttgcaggattgaatctcagcagccgcttgttactctgaggccttgagcgagttccttgacctctctgagcatcagtagcctcctccacaacacaggatgttgatatctaatgtctcaaacacagcccagagataaacaaatgcaaagtgtcaaatggaaccttggaagagtagagtgcagcctgggaggccaggctttttctcgcactcataaggacaggactggatttggcctgtcggagagaatagtgggaatttctgttcttttcttgcataatcttccggccctggttaatgaatctggacaaaatgtcacttaaaaggcacactggtcctttgttgccagaagggttcgattcaaatctctttgctgggccaaagcaagccatatttatgcctttggttcagacatggaagaaacagaaaattgattatgttcctgttggtttcatcaaacmcatcatattcctggtatcctctgacagtctgcaataaagcagtgagatctcaacccttcccaggccatggggatgatggaatctgggaagctggcatcttcaacagctgctcccaaattggctgggctgtgagatgaatcctgtctccataagaagacacacaagatgcttctctcttccggaaccccttcctgcatctgggtcactgagtccctttctagggaaccaagtcacacaatgttaattctctcagctcgtcacttcttccatattcattgaatgctaagcaagtgtaaatggagtcaagatttcgttctgcaaatgccttacatatgcaattgctcatttcagaaccactcacctcgcacacgcccatgatctgaaacaggtttctcagtcgcctgctcctgaaacagccctacaggtgccctggctgatctctgcaacctcggaaggcttaggtgctttccaaggcctccctgagctgccgttgtggtgtgaagaagctggaggaggttggttttagaagaaaacaacccagtggtccagctctgccacttttaagttctgcttcatgctggaaaacctttttcttctgtcaaatttcaagcactaaatttcctcaacatactttcgaaggctcgtgttttatccgtttttaattaactcattttgaagctttcatacttgtccccaaaatattttcttggcatttcatggtcattgttttccttgggaaggccgccggtgctgcggaggagggtcaccgagcaacatggcttggcatttggacacgcttttgttcccttctccccgccaggcctctctggggctcttgcatttactgttaaaatattacagaggcccacacccgaacgtccataatccccggtgctagactgcctctaattgatttaattattcataattgctcagctgggcttatgcatacttgtgcgtgattatagtgaacagatgggtctgtggcggatgatgtgtcccttcctgattagcgggtggatctggagtttctgggagcctgtcatggccttgcggacacttggacagcacctttagaaagttgggatgaaaccccttagcttgttggctttagtgtggtgccaccctcgaacgtttgcttaaaatgtttgggaaattagaattcttggtgccaatggaatttaaaaacaaaagacagacagaaacattggcaaagggtggggaagggcaggggtagttgggttcaaaggaaaggaaagtaggaaagcaagacatggagtaawgcaaacagacacctgtcaactagatagaccctcagctcatctctcacggggctgtctgtctgtccacgtgcctgtagaaccacaaatccagccctaacatatacctgagatactttgggaaaaaatgaacctgctgatatctgggggcatgcagggaggcaaatgggatgcagaagcaaattccatcccaacaagatgagatatcatcagcctgagggtcccctaattgtccccatacgagtcttcttaattaattcaagacaagtaaatgatacgaggcctcataggcttcgcggggcagcttcctggtgactaatatttgaagcaataaaaggagccagrgcattcctgcttcttaatggtctccagtcatccccaccctcgacccagccccacacagccccagcctcctccggcttgggtcagaaaatagcatggaccaactttgggatgcttctggctttctggtcatttacaaagtgcgttggcatcttttcccttgtctgagccttgtgtaaagtcaggtaaaaaacaggagatttgccagggcagggagtatgattcccatgatacacggaagggaactgaggttctgggagaaaagtgagttggtggagccacactgcgggaagagaagtgaggactggattctaggcctggggagacgctttcctttcatctcttccctccctccaagtagaggcttgtgaagagctcaccagaatatctcattctgggttctgtgttcctagggaatgatggtggtcaaagaagccaggtaacccacagatcccrgtacccacagatcccggaaacagcccctccaaaccacggagcggagtgaaggaggcagtgtccagatsgcagagggctttcatgcccactttctcccaacggccttacaaatgaccctggcaaggcatgcattcacccaggtcagagctcaataaatacttgtggtgtgagtaaatgagccccaggttataactggggaaattgaggccaggagaaaccaggtaaagtcataaagaagagccagaaccccacgaccagtcatctgatgctccctccaccccatcacccctcaagggcctctgcaggcagcagtttaatytgaagcaaatcctaaaatagtcctcaagaagatgagcacatcccagctytaattcgccctccaagtgcctcgaaagatcttttytaacaaaaacacagaaatgatttttacaatccaaccaaccatcagctccatgaaccttgagagagacgggaaggcagccgcaacctctgcgaactgaaatgtattgtcagaaggatgtaattacaagtatttatgtacactgattctgaaccagagaatcccgggatggctctggggccaaaaaaaaaaaaaaaaaaaaagagagagaaagagggagagagaaaaaaaaggcttaaaaactcctgacaatgagcaattcttcatggaacaaaactattacaatagccagcctttgatcttgcccgtctcctgttgccaattgtattttgtcaccattggactgtcacccgcgagggagcacttttgaattaagcagtctacagcaatttagtctgcactggctttgaagtgccaacatcagtcaggccaggactaacttttttcattaaaaatttttcagcttctctaagggagctttttgccttttttttttttttttttaagcctgccgggacatttagataagttgagcctccaacccgtggccccaagacatcaaaaggcgcggggtccagtaatgctggaggcagccatcactaagccctaatggagtgcttcattaagatcgcttcaaaggcccccgtttacagactcggagattgactaatttacacattgtgggaaaattgctaccagctctgcccacaccccagcagggggagagacgccctctttctttgaaaggcaagaactgcaaaaggcccctctaattgcagactggcctttacaagggaaaaacccaggccctgccctaaattttgcattcggctgccttagcactctgcgtcctcgcaccgaccctggggtcctgtttgtccggagacagcgtggcaccaacccagctgtgtgtgctttggagctggatactcctaaacacgtttgggtttgaactccagctctgatcctgccagcgaggagccttagarcaagtgacttaaccttctgggcctcagtttccctcatctgaaaatgggcgtgatcaagtcacctcccagggatattttcgaggatgagaggtaaggacggcaggagaagctcaatgtgctggctacttttaccttagcgtaaacayataagagagcgaaaaggcatccctgaaactgaagccatgttttcacaagctgtcttcacggcttattgattatttgagatgtttgcacacagactggggcatgaggtccatagataggtgcgggtcaggcccgtggctgttttgagaactgtgttatgtggcctcaatggcagcaygtaacagcatcaattcatctattaatagttttcctttgtcgtaaaagcaagttgggaagggcgtgatgaggcgagctctctgggatgctgtcatgtggattcacccacgggtctgaaaccagggctggctatggaaggttggtcaccagaggccctgtgggaaaagcaccaagctcagggtgcagtcacccttccagtctggctctgtccccaacgtcctgagcaacaccaaccatgccgcctgtcctctctggtcagcagggttctcctgggactgaaagggcaaggcctaggtatgcccaaagcctcctccccagcctgatgactcggggtcttcaccccgcttgaggcctcagcatctctgggaccttgtgagagatgcatgttcataggctgcccggccctcctgaatgggaatctgcatttggaatgatccctggtgattcgggcacacagtaaagtggaggagctctgccccaatgcttctttggcccaggaaaacacagtgatgcttgtttcctcaggggatccagcccggtgactttggcctgggaagtcatgatttttgggactaacagcctggcaggccccttgcctaccacccaactgggactcattgtgtttacatcagtgtcatgcagctttactctctagggtcatgtggggtcccaagtgaggtaaaggaaactgctgcgtcattcatcgagcacctactgtgttcaggcatcctgctgggtgcagcgcacctggtaagtaactgagattgtgagtcatttggtcttttggttgagtcattgaggaagagattgagtgactggcccagggtcacacagtcagtgagtggcctccttccaagcaccccctgcaccaccccctgcaccaggctgcacagaggaatcccagggtgcccatttctggaggtgcccccccgaagaggctggttagatggggacccaaggggaggcctgaactgccacgtcctccggtattgtccccttcccctctactttctatttgcccatcttcctaattagagggaaaaaatctacactcacttcctstattcaacctttcacttaaaaaaaaaatgcaactcccacccccctggttcccagcctcgaagggaagccaccctggccaggggcaagcatcgcagcaaaccacttagcaaaccgcaaatttcagaggcctcgtcacatctgcattttatcagctttttccggatagtattaccccgagcaattgtctgcagatcggccgacagctgagacgttcaagctctgaattacggagaaagggccggagataaagccgagcacatgtatcccatcaaagtaatgaaagccgcctgccgccaggacgccctgctgcctccttcctagccgccctgccgccccgcaggaaggctgattaacccttgcgaggcaggggaagaagagcagcggtcatccaatactcaggctaatcagggtcccaagaatgggagggaggcagagggggtgggccggaaagaacagccatcgcagagggccactctgacctcaggattagacctgctgcatttcctgtcacaggactttggtgggacggcaaaaaggtagatgaataaaggacttggtgtccacaaggtcccagagacactgcctgggtattaagcattcctagaggagtgagggcaagcagtttcctgtgagtaagccttgccttgctgtgaacggatgccatgtttgcaagagttggtaataatgtttgctgagcacttactgtggactgggcacctttgttccccttgcttcctgtcccaccccatggtgtgctatgcctggagctcactgcattgaactccagtgtctcctagtgagcggtggatgccaggatgtccccagtcctctgctcccatgaccaatgctacttgggtatccatgttctgctcttctaggggcctatgtgacaacttccctggcatccatacctccacagcccagagtggggtctccgggatgtgagctgtacccaggcctaacttacgtccggactgaccagcacgccttcagaaagactctcaggtttacagtacacgagagtgcacagctctccaagacattccaagcaatgttacttcatcgacttatggaaatttgcctttctcatagtaagtctaaagcaacgctgctgctttaaaaactaccagtcctttttgctgaggagttcgaacatctcgttatccttgttaaccgtttagacctctcttctgcctttcacaacctgtggctatttttctatcagatctttgatgtttttcttattgtttggtaagagttccgtgtatattccaagtagtcgccactcaccagtttgactctttgcagcagcatcccgtgagtcctctgtctgctgccgtggccggcggtgccctgggtggacgggaatccttagttttcacgcagtccaattcttcatatttgtctccttctgtcttgtgctcttagggtcttttggagtagaatcattcctttttaggcacaaagatatctccttatgcttttttgattggctttattattttagcattcacatttaggcccgtaatccatctggagcgcaccttttttttttttttttttttttttgagacggagtctcgctctgtcgcccaggctggagtgcagtggcgggatctcggctcacygcaakctccgcctcccgggttcacgccattctcctgcctcagcctcccgagtagctgggactacaggcgcccgccactacgcccggctaattttttgtatttttagtagagacggggtttcaccgtgttagccgggatggtctcgatctcctgacctcgtgatccgcccgcctcggcctcccaaagtgctgggattacgggcgtgagccaccgcgcccggccggagcccaccttttgaaaggcttaaggaagagattatccatttttattgaagtaagacagctctgtctgatgcagcatgctgttggcttaactggacctttgatttcccagcagggacctcagcttgctctggggccttgtcctgcaccccaggttccccatcaatgtcttggggtggggagcatcacttaaagtctcatttccctgccaccttctccacttccataagctgctgcataggtttggacatcttctctctgttttgtattcaaccacaatacacacaaactaaaggaggccaagatgatagaagatggttctgcagttaggacccctcccacccaccttcaacccagcattgcagcctcgtgtgcatccttgccagggatctttgccattgcagatccctctgctgtgagggcttttctttcttcagtccttcccatctgattggccatctctcccctcaagagtcagctcatttgttcaccaatctgtgtgatctgtgcactaaagaataatggatatgctgtatctgccagagttttctggggaaaagcaacacagatggacgccagcaaacctcatgcaacaaaaggcgctatttccaagatttggagtagctcacaaaagtcaagagaagttgaaccatcaggctgcaggaagacaggaattgggtagctctgggtttctacagagcaggaagtaaggggagatcagaaaaccttggtgtcaactcttatcccgcctggtgttgctctctcatgcctgaagttctcagcagggagcacagaattcgttcagcttgggtcatgtgctcaaaaagggtcagacaccatgactgaccctccaccaagaccgcttgcaacaggaaggagctggctcctggaggaaaacaactcgcaaggcttctggcagcccagacacgggtcatccctgatgggctctttatcccagctgtggccttgatgagtgccggacccctacgtgggtcccacagtgcctgctcaaggacctcacagcccagtggaggaggctagttaagtagaaagtgctcgaaacaaggtaaagagtgctgtgacagagggggcacatgggtaggaccccctaactccaggcggagcatcagagaaggcttcctgtaggaagcagtgctgtgctgggcatacacagagctgcaggagctggttgaatagagaagcgggggagggtgttctgagcagagggtgagcaaaacacgcagtgagaaatagacaagcagttgatgtgggaatgcatttcctcctgagtaacagaggggtcctggaatgttccatgtggcctcagggtctctggggccccactcagggttgggttggagaaggctgaatgctgcgtggaaggagatttcctatgtttctgatctggcttgagagctttttgatggctgggagggccgggtactctttcttaagacattgatataacagccccaaagagctgacttgatcatcagggccagacccctcacctcggagtagatgagaaactccagakgaaggggaatctatctgaatgactcatcttttcctcccctgggactccagaaaggatctgcactattccatttcagtggcaagatatctccgtcctcttctctctgccatttccagagagctcatttgagacacactaatcaaaaccaaccgggtcatgttacagaggggaaaactgaggcccagagagaggaaatcctggccacagtctgttccttgagtctccttgttgagcttacagagggtcaacgctgtggggtcaatgcttgtgttacaaaaaagtcacatcctaccttcatttgaaaaccatgttgttatccattcacaaccaccaggctggctaattttaaaaatggaaaataaatgttggtgagaatgtggagagatcagaacccttgggtgttgttggtgggaatgtaaaatggtgcatctgctgtaraaaacagtttggtgatttcttaaaaacttacacataaagctaccatatgacccagcaattccactcctaggtatatgcccaagagaaaggaaaagcgatgtcaacacgaaaacttgcacgtgaatgtccatagcaatgctactctctactgccaagaggtagaaacagatgtccatcactgatgaatggataaataaaatgtagtctattaaggcaatggaatattattcagacataaaaaaatgaggatctacagtgtgggtgaaccttgaagatattgtgctaagggaaagaaggcagacacaaatgggtaaacattgcatgattccattcatatgaaatttccagaatttgtccaagaaaatccatagtggaagacagctgatgagtggtttacagggacttgggagagggaagaaggaaagtgactggcgaataggtatggggtttccctttggggtgatggaaatgtgttggaactaaatagtggtgatggctgcatagcatgtgagtttaatgtactaaatgccattgaattgtacactttagaatggttacttttatgctaggtgagttttacctcaataaaaattaaaaccaggctggttgcttacacccgtaatcccagcaccttggttggctgaggcaggaggatcacttgagcccaggagttcaagaccagcctgggcaacatagggagaccttgtctctaaaaaaaaaaaaaaaaaaaaaaaaaaaaatttgccaggcatggcaggcgtacctgtggtcccagctacttgggaggctgaggtgggaggaccagctgggcccagggggttcaaggctgcagtgattcttgatcgcacctctgcactccagcctgggcatcacagcgaaaccccagcaaccccagtctctaaatagataaataaaaccatgttgtttatgtctgaggaacttttgaatgccattcttacactgtgtcgatagaggatgatgtgaagtcgcagcggaacacttaccagtgtatgcccggttctgagcccttacagctcctctagttctcacggcagccctgtcacaaagctatcctcattattaccattttacagagggggaaactgaggccctgaatgataaagcagatagccccatgtcatcaaggaagggtggagctgggatttgaatccaagcagtttggctccagagcccatgcgctaaagcgtcacagtgagaccctgacttcgagtaagaacccacaccactctgagccctgacactgcagtgtggatcagaggactagggtggcggtgagaatggatacctgggccttaaaggtgctccgccaggcccagagccacccttcctcaaaagtgccttgcttgggcttggtgggccttgaaacaacagtttgaggcttcctatccatccccaggggttccctgggtaatcatgattaatgccagaactaggagccgggtgcactcagggccctgctcagtgattggccctgtgatcacccaccccggccccttgttagcggcccctgctccatagtgggcagcccgtggattccctaatgaattctgtcagcccagcgtgcaggagatggacagatagagaggccaaatcccaaagtggatttataagtggaaatccagggataaatgcggggttggcgtaggtgaggggagttgaccacatccactgctaaatctcagattccaagaggagcttaattcgtaaggctatgtgctagaaaagtctgcattagccactttggcgtgagtatatctctaaaaccactaatgaaattgtgctttggtcaatcaacatttctggggccagtggcatgggtaatcactgggcttgcgttgtgcttttagacagggaagccaatgtggtccctggtacacgcagttttcttcaacaccgaacgtttgtttttccatcttgtgggtagtgagcctttcttgagccaaaatatatgtagctcacccatacaactttattttgtagaaaagggaggataaaagctccattgaccaagcatccgtctcctgccacattctgcctgaggcaggcccatgtggattattgcttgaatctgggaagtggttattcttgcaggtgggaaactgaggctttgggagatggggtaccatgtgcagggtcacagagcaagttggggcaaaacaaaaaacccgattcagtgctgtgagcctgaaaagtgagttctctctgcttcaccaatggttcccagcaagtgccgtggaccctcagggagctggagagctgagactgtctcagaaagccggctttggagtggatggggtgtagggagtgagtggcaggagctaagtacagggcaggatggggcccaaatgccttgctcagtgtctgcagtgtccatcaacctgtttccctctcctggccacctgggagaggactctggagtttcttggattctggaggtcaaaccatcaggcatgcacttccaataaggccttacacctgcacatcagttgaaactccaaaagctgcacagatctttggaggacacatcctggcatggccactcacaagctgtgtgactttggggcaagttgctcagctttcttctcctacaaacttaaaccctgatctcagtctattgtcagcctaggaatagctgcaataacaaaataaggaaaagaaaagaaattactattgggatggatggaaaagaatacatctcagccatgtaccagctgtgtgcccttagtcaagttactcagcctctctgcgctcagtttccttacctgtaaaatgggcatattttacctactttgaaggtattgcctgtcattaaatgagatgatacatttaatggcattaaatgagtgctcattaaagcacttagcaaagctccttgcatatgatgttcaaaaaactggctgttttattgacaccatcatcatcatcagtatcatcgctgtaattaccatcattgtcactgccatgatttccactaccatcacagttagcatcagcattatcattttcattaccatccttatcattgtcatcatcatcaccaccatcaccatcacagccacgatcttcaccaacattcccatcataaccatcaccatcacagccacgatcatcaccaacattaccatcatcaccattaccaccaccatcatcatcataatcattagcatcaccgtcgtcaccaccactatcattaccaacatcactactgtaactatcaccatcaccatcatcaccattaccatcatcatcatcataatcattggcatcaccatcatcatcaccaccaccattaccaacatcactaatgtagctatcaccatcaccgtcatcaccgttaccaccgccatgatcgtcacaatcattaccattactatcatcattatcatcatcatcattatcacgatagttaccatcatcattgccatggtttccattatcatcacaattagcattagcattatcattttcattaccatccttatcattgtcattatcatcaccatcatcaccattaccaacaccatcatcataatcattatcatcaccatcatcatcaccaccaccatcatcaccaacatcaacatcataactgtaaccataaccatcatcgtcacaatcatcaccattaccaccaccattgtcatcaccatcatttctattattgacatcatcgattgccatgatcatcatgacaatcagcatcatcttcatcattatcgattgtcatgatcatgatcatcatgacatcagcatcatcttcatcattatcatccttttcgtcatcaccaccaccatcgtcacgaccaccgttattaccatcagatgggctgttggtgtttccatgggacagatctgtcatagtaagtctgwgtgatggtttaggacttgaagctgattttttctggcttgtggtagttaaaaatactatcctgacgttctctccactgtttattgttttagaaaatctattagaaaattgctttcttcccagtatggttctcaattagccagcatcaggattttccactggcatctcggaatgttctcatcagaaacctcccgaaaggcatgatcgttgaagctgggagatttgcccaaaggctgtctgggcacagagtttctaatgccaatattatttgctcatgcccagctctttccagcaaacagaggcctttcaaactattaatatataaaccaacagcacaagcactttgaaaggagaagggtgtgggggcagggtgcattcatctatccgagctgccatgacaaaataccaaggactaggtggcttaaacaacagaaatctattatctcaccgttctggaggttggaaagtttgagatcaggtggcagcaaatttggtttctggtgagggctctcttcctggcttatagatggctgtcatctcactgtgtcctttcctctgtgctttcgtagtgttgtggggggtgggacagtgggcagggckgggggagagaaagggagagagagagaaacctggtgtctctttctcttctcataaggacaccagttctatcggattaaggtcccacccttgtgacctcacctatcatttattatctccataaaggccccatctccaagtatagtctcattagggttgaggattcaatatgtgaattggccgggggacacaaaaaagtccataagaggaggaaagggcatattaatgaagcatgtgccatgtgccaggcattgaaccaggcactttcgtagataccatttcatttgagtctcaagaggactccatgaggcaggcagcataatctccattttatgaatgaggaagctgagacctagtgagtgtaagcaaattgttcaataccacacagctagtaggacctgggtttttagttcaggtctatctgacttcaaataccacacccttttttaatatcaattattctcagcaaatggcccatggacccctggacattctctgaggtctatgaggtaaaatcttgtgttgatagtaatattaatattgtatcctaatgttagtattaatactaatactactaacactaagttatattttactctgttgactaatcactgatgatacaaatccaacagtggggaaaaccgctaaggcttaactcgaatcaaaatgctggccccaccctatgctatgctatgctatgctatgctatgctatgctatgctatgctatgctatgctatgctatgctatgctatgctatgctatgctatgctatgctatgctatgctatgctatgctatgctatgctatgctatgctatgctatgctatgctatactatgctaatagttacggtattgttcaccatcatgcagtcagtaaaacataaacacataatcttcaatgaagcaataaaattcgttaaggattgtcaaatctcaatctttgagaatgtcttttcagcattctgtgtgacaaaatgggaagcctgcataaagcacttccactgcagatggaagaaacacagtcgtgcagtcatttgagtggtaagcgaaactcactgccttcttcaccgagtaccctttttatttgaaagaatgattgacaggctaaccatggttattcggacttgtgtttttggtagacaatttttttttttgagaaaaggacactaagtttttaataaggggaacaaaaaattgttttcaccagtatagattcacattacagtacaccaatattgacagcattctcttgtctatttttggtacagaagatggtatctctcggtagacattttttgagaatgaacaaagtgagtctgttgcttcaaggtgaacagctaatagtgtttatctgcagagagatctgagccttttttttttgagacagagtctcactctgtcacacaggccagagtaccgtggcacaatctcggctcactgcaacctccgcctcctaggttcaagcgattctcctgcctcagcctcctgagtagctgggactacagacacacaccatcacacccagctaattttggtgtttttactagagacggggtttcattatgttggccaggttggtcttgatcccttgacctcatgatccacccacctcagcctcccaaagtgctgggattacaggcgtgagccaccgtgccaggccgagatttgcacttttaacaaaacttagaattttagaaagcttgtatccatcattgtgagcttgttctccaaatttaaagactttttgatgatagtattagcgaatgtgctttcttttgatgttgtaaaattcagtgtgtgaacatttggcagatcttgtaagtcagtgaaccagcattttccaaggactaatgctgatgtttcagaatctcacataggcaaaagatacctccaaaatgctagacagactaatggattttaatgtgacaaagaacaaaatgttcactgatgtgttttcaggttccacattaaaatactatactactgcttgtcaagttttttgtggtatcaagaaattatctgaaaagcctataaagatacttgtcctgcatccaacaacatatctgtgaggccagattttctttatatacttcaaccaaacaatctatctcacaacagattgcagaaggagataggagaattcaacaatcctctagtaaaccagaagataaaaaatttgcaaaaatataagacaatgccactcttctcaccgattttttttttaataaaaacaagttatttgtgttaacgcatacaagttttgttattatggtttttaagtgaattaatatttaaaaatatttttagttttaatttctagtgctggtagatttagtacataagcaaaagcaatttaggggtcctcaataatttttaagagtacaaacgaggccaggtgcagtggctcacaccggtaatcccagcactttgggaggctgaggtgggcggatcacttgaggtcgggagttcaagaccaacctggccaacatggtgaaaccccatctctactaaaaatacaaaaattagttgggcatagtggtgggcacctgtgatcccagctactcaggaggctgaggtgggagaatcgcttgaacctgggaggtggaggttgcagtgagccaagatcacaccactgcactctagcccggacaacagagcgagacactgtttcagagagaaaaaaaaaaaaaaaaagtacaaaggaatcctgagatcaaaaaagttgagaaccactggttagtccattttgcagttgaggaaacgaaagctgggagaggctggcgatgtggctgaggtcgccatgctggaaaatgacccaacatgatggcaagggctggtgatgcgctgcccagattccccagctgttggaagatggaactcagctgttggccctctttggggatttttttggctgaagaaaactgaacctgtacttgggctggagttatgcaaactcacgcccctttccagggtcagctccatccatggcctgtccagctgggcatcaaggcctggcctctagtcccagctgggatggctctgaagggtcatccctgatacaaaaccctggggaaactgcactgcagttccatgccttcctctgctcagcctgctccctcctcgcccaccccataggtgtggagccctggaacacaccctaagaaccatcctgctcacttcctgggggacccactgtgacagccaatgggaatgcaaactgggcacctcagaccccagtcccaggctcttccactcgaggaaggtctcacatcagcggagggtttggttgacactgaatacatttgtcccatccttgatttgcaagccaccacaaagtcagctcctgatactccattgtttgatcgacggggcgagggaagccacacaatattcaggatccttcatactagtgggtcacttgaagaaaagacagtccagtaaagtgctgcctaaagggaactgattcattacccaacttttctctgtgtacctcctgtgtgctaagcatcttgccagaccccaaggagatctgtcccctttctgagaggagccaggggatgggggagagaaacctacagctacaggaaaccattctctgctttccagttgagtgttcttttcctgagaacccacagtctacagtttgaggtgtagcttcagaagccagcactctggtcctcaaacacccctctgtgactctctgcctcagtttcctcacctataaactgggatagtgatgtacctacctcctaaggttaccttgaggaacaaagaacacgtaacaaaccttttgccgatgtgagctattattagaacttctctatccagcccaagtccagaccctgcatcggggagattttaggtcgtctgtaaaaggatggggaagggtattctgctgtgaggggccagcatgagtgagggcctagggctggaaagtgtgtggctccattagtctaccaatgttcctcgagcgtctgctctgtgccgggtcacacaccaggcaggaggaagcagacttggcgccagcttcacggtgctaacagagttatgctggacgtggcatcaagcaaagcactaaaatagtcactgtgcagccgccaccgtggctattcagagagtgaagaggaggggagggactggctggggctgaacttaggcctctgtggggctttgatgggatgtggagggagaggggtggggagggcccggaccaactacagtcagctctgagttcagttggaggaatgcagacctgatcctctgctggcactaagtagccttcatcaggttcacagctctcctctgcctgggtttgagagacttcagggtcaaggacagagcacctacaactcagaagagcagctttgagcctataattctggcactttctacctcctttcaaagtgcatgagagatgagaattgagctctctaaatgtgcttgtgtataagaggggagtggttatctgatcagaacctcggtctctcagaggtaggagaagcctgtgcagccattcctggatgcatgaatccaccctaggactccccagacacaggtacgtgcagccctgcttgcacatctccagcgacagtgagctcattacgtcgctggaatgtagctgggaagctctctacattctcctgctgaggctaaggccttccctttgctaaaggtcttcttcctctgtctcttgcttttattgtgaccgatttcccttccagacttgcttctggttgactttctccttatgttttgcccttttactcttctgcttccttccttcctgtgttccccaggcctcccgctcccgtgctttccctgcatcaaacccctggagtcccattcactcaccgttacctgagcctctcctgcatgtcacaggaacggaggtgttaactgggtcaatccttgctctcacgaagctcatagtgcactggggccctgcccacgtggtggatgaggtgtgaggggcgaaggagaaaccatttataaataaatctctcctagccagaagactggagaatcacagcatgaaatgaacacggaattcaaacccagatctgcctgagtgtggacagatcccgtttctcctgcccctgtctgtgtacaccagtgactttacttttctgagcctcagtttcctcacctggaaagtagatagattacgatctacctctctggcctgttgtgaggataaaataaagtctggtgtgttagcccctggcacgcagtaggtacacagccccagtaagttggggtcctcctgtccaaaatcagcagggccttggagcagctcccgaattctagcacctggcaagtggctggtgggtcggattagggacatatgttagcaactttctggtcagcagaggtcggccaagcaattggctccaccagactctgggcttccttaaccaatttggacacaagaaacagccacagcacagaccttggcgttcctcatgtaaccccagctcccacatacccagggaggagccgtagcctccaatggtgtggccaggctaatcaaagagggccaatgtgcgctgggcagctgcttctagaggtgagcccatgctaccgcttgaaggccagtgtggctgagcccggtccctcatgcccagctgtctagggcctggggcctctccccaccacctgaaaggctgggcctgkgctctggtgtcagatgcacctcgatttraactccctgctgccattttctagttgtggtcctctgggcaagtcacatcacctctctgacctcagtttccccttctgtaaaatgggagtaaaacgatgcacactccactgaatcactgtgaggatgaaatgggagaaaggatacttagcactgcacaggtggtcatttgggaaatgctatttattaaggtgagttttcccacgaaggccaatgccaggaacagagctgaagagaatctgatcgctcacatctacaggaaatgataaaaaatggagcaggacctaaaaccatgcccagggggtaacagtgaatagctggcaaggcttggcctggcagtgggggggatgctggcaggtgggaggggctcagcacatacctgttgactaaaggaatgagaagtcactcaggaggacttgatctctgccttcaactacatgtgagaaggaaaagccagcttcatctctgaggggctaagaggcagatcaagatgagaaagatgtgaggaggcaaggctcagggtaaggaagtctcctcctgcagccagggcagtccaaagatagagaaagaagcttctgggaaagtgagctccccgtcactggaggtgtgtaaatctggttggaagaattgtaggcagacatgtcataaagggattcctgcactgggtggaaactttatttctgggatgtccaaggtactttccaaccctgagagcctatgatactaggagaaattttttcttccaactccaagattagtgaaggtagcctaatgctgttgccaacaacctcgtcactcattgcttcatgctgtggaagtgtatttcttggccaagtaacagctccatgcaggtacttaccagtggccttcctccaggcagtgactcaggcatcaaggctccttccacctgtggttccaccttcccttgagtctctgagttcttagatggatcctgtgcataaggctacacaatgtgggaaaagaaaaagtggaggatcacacggaagattttcaccgaccaaccttagaaatggtgcacttaatgcctccccatagtccattggccagaactgcaagggaggctggaaaatgcagtctagctgggtgcccaggggaagaggaagtgggcgtggtgagcagctagtcactaccttaggagctggggctctcatttgtgcattcatcatttatccatccagtgagcgctcagtgagcacctactgtgtgccaagcctgtaccctgggatataaacatgaatcggacacagtcccctctctgggagtccacacctaggttcgcagcccaggcacatccaccagctattgcctgcagtttggcagtgacaaccatgatctaaagacaggataactgatgaccttcatcctagcaccaccatgtgatatggaaatgatctctcgggcccatgccctcatctgtaaagcaggaagaatactactgagctcaaaggatgatgcaatacaagcaaagcatgggaagccctctgcaaatgggagtgaatattccctatgtccacgtcctccagtatcagtcctctctgagtgttttgggttggatcaggagatgctgggtaccacagtacaacagtggtggccttccgcacaccccgcagtgtggggagtgaacatgaatttagtcagggatgtaggaggcttttgcccttaaatccttggcaggttggtagtgacccctctgtcctcacaaacagtggcctgaacagaggtgcccagtcccagctccactcacttcaaggactggagagggaagagtctgaagggaaaagtacctggagccaatgtgtgtattcctccatccctcagcgcatcagcctcactggaaagcataatccagggcagtttctcttttatctcagagcctaagctcaaagagttgcattacacagccctgggggagttttcccagaatggaaaagcttaatatcagagaggtttagcaagcttcctgctgtcgcagagctgagtggaagagcagggattgccacccaagttggcctgcttaatgacatatttagggacatgagtgtcaaactcccaggggaaaccctggttctagctcagccatttttgcctcctgtgtgagcactactcactttctttgaaaacagagatgacagcaatgtcttcccatctggagagatcagtgagaaatattttgtgtaaaatcttggccccaggtccagcatgtagcagagaacaaactggaaggtggtacggtaaggtagttaggtgcatggacactgagagtcagcctccgccgcttagtagctgtgacaacttatgcaaatgcatcttctttgcgcttcagtttgctcatctgttaaacggaggtgatgaaatacctagtaagcatcacgtacgcatagttttattctcatctgtacattgatgaggttgattcctattagtttgttaagctacctactctttgcaaatagataagatgaaggtgtcttaagctagagttttgcatttttactttatggtgcctggaaacgagtccagcaatctcagctctgggaaggatgtttgagtagagagaagattgagtctaggaattcaacttcctccactttactgatggggaaccagaggtccagaaaaggaaaggggtttacccaggagcttgcaactcactcagtgctacccttgtacgctttgcccacctctttctgtcttagaaaatgatgccaagccttggttaatgtgtgtgatggaaacctgcagaggctctgatgaagcagtcctgggccatgacggggaagccttgcgtgtccgatgttagcctgggctttgcatttattctcaatgtgagtctcctttcttctttctgtcttatgcctcgcacatcccctctcaggctaaggcaaacaagttggagaattttagaattgtagccacatagaccctcaggcagcaagaggttctagactccacatttcaatcctacaaacatttattatattaggcgccagaccccgaactaaggggatttagtagtaaataaaacagacatggcttctgatctcgcagtcatgctgggagacagacgctaaacaaacacaaacaggtctgggctgggtcatcttcagcaagttgcccctcaagcctcagtttctccatttataaaataaggtgaatgacccctgcttcccagagttgacctgaggataaaatgaagtgggttgagacataggccaccacattagtagacattctaaaaagtggaattatttcctgctctccctgattgcggagggaaagactgcacttgggtttctaaggctcctcgagtagctgaaaaagaagagggtgatacaaataaacagaagggcgtgctctgtgccagtccgggccagggccctcttggcatggcaattccactaggtctgagaagctgaaagcaaaggttattagctgaaaatgcaccactgagcctgttcgttctccagataatccagtttatgtatctgatraaatgggatcaaaatgagaaacacatttccaaaaggagttggaaacagcattgtccttcctccagagcattttacaactgcaaaatcacggtgattcatgactatttcacatgatcgatcctcaagcagcagcgagtgcagcactgcagttacccagaccaggggtggactccagctccaccacatggaagctgggcagccatgtgggcgagtcacagcttctgtgagccctggttttctcaactatgaaaatggaaataatcatatctgatgagcaatgctactggcatgtaattgaaactcaaagggaacttcagaatgtaagcttatgagagagaagatttggtctatttcgttgtgatacctgcaatgttaaaacagtacttagagcatactaggtgctcattaaaatgttcattgaatgaacagtacacaacagtgctcagcaaatacttgttgaatgaataattgaatagayataatcatataagtatgtctttctagcctcacagcatttcctggagatttttgtttgtttgtgggtttttgtttttgtttgttttttattttggtagctgagacatttcgactcagagaggtgaagtaatgcatcctggtccatgcacctaattaggggctgcctcttacctttgaacccagttgtgtttggtcccatatgccttatattttccattgcatctagaagtttcttggaagttgtatcaattaggaatgctttcaacagtatcttaagctataaagcgtaacagtagcttaagcgataaagatggactcctcttccacgaggagaagtggcagatggcagttcaggactggggcaacagctgagcattggcatcatggaaccaggctatttccagctttctcttctgtcatactccaccagatggctttttgtcctaatggttgttgctttatggtcacaaatggctgctacagctccaggcatcacaaccaagttcaaaggcgggaggcaggaaggaaggagggggtggcgagtttcctgaagtgctttcttcttatatcagcaaaggaaaaagggaaccagaggcagctgtctcagaagactttcctttaagccttgcttgttagtttggccacatggccaatcctggctgcaagggcggctggagaagtggacctccagcaaagatggacgggatggccagagtcgcccaggccaatcatgattgttccacaggaacaggctcactgctgctctgaacaaaattggggccagatggtgaggggaagggaaaggggttgctcccttcgagtttcaattacatgccagtaacattgctcagcagatatgattatttccttttcatagatgagaaaaccagggctcacagaagctgtgactcgccccctcggctgcccagcttgcgtgtggtagagccggagtccacccctggcctgggtaactgcagtgctgcactcgctgctgtttgggggtcagtcacatgaaacattcatgaatcacaatgattttgcagccgaaagggaagggaaagggggtatggaagccctgaccacaccgtcatttaacaatccaggagaccaaatccagtgtgactgcccaaggacgggatctggaggagatctagctttgtactgatttttggaagcaatctcagtgggcagggttcctagaaggcgccccacatgagagtgttgatgttctctgcgtgctgacacagcattctgcagccaagcaggaagggagagtcccctcattcagtctgctttcagttcttcagatcacatcttggagaaatgatcagtaagtgcaatgagtgatccttgatgattgctggaatttgcaaagaaaaaggatctaaagagtatgattgggttaactgggaggaaatttgaatgtagattaagaagtacatgatagaattgaatggattttaaattttctgggtgtgagaatcattgctgtggttatgtagaagaatgcccttgtgctaggagatacgtgctgaagtatttaggagacaactcatgtttgtctcatacttgtctacaaatggttcacaaaaaatatgtgtgcgcttttgcacacgtgcccacatgtgcgcgcacacrcacacacaccagtcgccccttatccatggtttcgctctcatggtttctgttagtctcagtcaaacaaggtctgaaaatatgaaatggaaaattccagaaataaacaattgataaattttaaattttgcaatattctgagtggccgtgatgaaatctcatgctgtcccacaccatcctgccaggacatgaatcatccctttgtccagtgggtccacactggagatactacgtactgttagtcacagagatcgtctgctcctgacatccagccatcgacatcatcctgtctttatgatacaggatcacccaaagcaggtgttccttcttccaaagcatcatcagaaggtaacagcagcctaacctcccttcatctcatcacgcaggcgtgttaccaactcacatcatcacaagaagaagggggagagcagtacaagaagacactttgagagagggagaaagcgttcacataacttttattatagtagattgttataactgttctatcttcttattagttgttaaactcttagtgcacctaatttataaattaaactttatcctagatatgtataggaataaaacatagtatatataggattcggtactatctgaggtttcacgtagccactgggggtcttggaacatatcccctatggataagggggcactgctgtaatcaactgtgcacatatctgtatatatacacatacatataaatacatatacacatatatatacacatgcaaagagagagagaagagggtgagacagagaaaaaagcaaatatcagcgttaacatccagtgcatctagactctaaagaaaggccatataaatgttcgctgtgttattcatgcaactctttagtaggcttgaaatttttcaaaataaaaagttggaaaaataataaattaaaaattttaaaagtgagaaagcttaaagaaagtatcaagtaaacacacaatgtgttagtgggcattaaaccgagccctgctgtggggcctccaggtggccagtagatcccacattccagcgtcagtcggccccaggtctgagtccctcctatgccagatggggatgaggtcggtcacggcctcacaggtgtgtggtgagcattgtatgaatggcatgcgtagagtcctcggcaccaagcctgcaccagaagccaggtttcaaagaagggtgactgtggtgtgggtccctgtaagtactactgggcttggcacatgggaagcaggaaattggatgtaacctgtgggagacccgaacctggtgacttcacctgtctgagtccctccagaaggggatagctggggattaaaggcacgaaaagaccccccaccttatccccaccacacacacacacacacacacacacacacacacacacacamactcatatctcctcttcagggagatcctgtccatcagctgaggagttggggctgggtgagacagctggcctctgtgcactggaatggagctagttccattttccagtccctgtgtcccagcactggggtgccccctcctccggggcagtggccagcgcctggcagctcagaggaacasagagctcctcttccctggccctctcgggcagacctgacaatccccactgctgcggggaggctctgccatccttgtgctaatcccattacccacaaatgaagatgtaatcacagccctttcaaagggctcccaaagcagatccctctttggaaagagaaaagcaagtgcaattgtccgagccactgacttctgaagctcctgctgggaggaggggatgcagaagttatttggggccagcagcctctcagctgggaagggactgaaatggcggtcagggcagagacagcccgagtgtgggtgactagttaggaccaggtggtggggtgaggtgtgcaagggrctgaggcctcccagctcccacactgaccttactgcgacctcgctagagctacaagcctatgccctgggatataaacatgaataggatacagtcccctctctgggagtccacgcctaggttcatacgcaggcacatcaaccatacctctgttagcaccatgaagctggggccaagtctccttcctcctacctggtgtgtgacccagcacaaagcagacactcgaggaacattgatagactaatggagccacacgctttccaaccctgggcctttgctaatgctggtccctcactgcagaagatccttccccatccttttacagatgacctaaaatctcccccttgcagggtctggacttgggctgtatggagaagttctaatctttactgtaacctcagctagagctacataatttcagcgcctcccactgtgcatctttcaaatggktgcaaaggtcttatctgatatgttgctgagcagctgtgtgtggaggtgaaatataaatggtgacatgggcacagatgtgagggccccgttgatgtcaacgtcacattatatgaacagtagtaaactttcctcaacactgactacatgcccggcacttttgtgatgctactttcattcccattttacagatgaggaaactgaggcacagagtggccaagtgactttttcaatatcatagggctggagaatggtgactagttttaatggccagcaaaagcaggaacaaaagctaccatctgcttggaagcgtcgttacttttgaacagaaactctggtgtctggcagacagcaatgaattcatctacttttgcataggagtacggttatcttgccctttgactgtgcccttgtaggccagcagaagttctgagattcaaggtggatgaagggattgaaccatgacctggagtggaaaatgcatccttggggctaagtatgtcctstgtgccccgggcctgggctccacgtggccctcactgccttctaacaatcattgctggctatgtgtgaagcgccttgtgctaggtactgtcctgtgtgaaatcagtggcatgctgggaaatgtctgacaaacagcccttggagatagaactcccatccacagtatttctcctccatggtgtaaataatcccacttcccaccatggtggatctcaagctatcaatatgagattattgacagggaattgggaggggttgcacacaactgggtctcctgtgtggctccagtgcactgattcttaagaactcacagcaccctgattgggggacagcacttttattatgccagttttatagattagagcattaactcatggagaggttaagacaagcacttcccaagatcacctgtcaagtaaattctgatgctgaacccttgtctccaggaacccagatgaagatgctgccctctgagcaatggcctgtgtccagctcctctcttcctgatcttctcagggccaagtctaccccgagttaaactctactctccttaagggcaagaatcccagcacaaagcatgagcaccaggcacacactaagcaacaaggaaatatttggagaattgaattgaatgctttaatttcagttggatcaacaaccttgtccaaggtcacacagggaggcaataacagagcccatgactggaacccatgactggaactcatgattgttgactttggatatgaaccttaagtagcaccttcagtgtcaattctgagattactgtcacatccaagcatggacatggagagttctgttattcctgggagggggcagaggggccgtggctttgtactttgcattttcaatgcacctttgtcccctttctttggtcatgaaaagcatgacccagcaccttgtatgtgttggaggctgggcaagaccaagggcacctggagggtggaggtctgagatttatgggatacttgatcattttcaagattttttttcatttgctgtggactgaatgcttgtttcctctcaaaatatgtatatagaagccctaatcccccatggggtggtatttggagatggggcccatgggagctggttaaggttagatgatgtcatggagatggaacccccatgatagattttgctcttgcaaaaggagaaaaagacaggataggtttctctccactgaatgaggatgcaacaagaagatagtctgcaaaccagaagagcactctcagcagacaccaaatctgctagtaccctgatcttggacttcccagtgtccagagctgtgagaaatgttcattgtctaagccacccagtctatggtattttgttatagcgtccaaatagactaagacacatgatgtaagtgtttcctaaagtagcattgcactgggggcaaccagtgtaacatggttggtgatatgtgaatgaaccttttaaaatgttaatacttttgcatttattttaatatgtgttaaaaatatttctrgtgtattatatcagaaatagttttcactgcaaacaacaagacaaaaagtaaagaaaacaacaacaaaaaccagtggcttcaacagaagtttattttgccctctgctgtaagtcaggggctggcatggcatgtsatatggtttggctctgtgtccgcaccaaaatttcatctcaaattgtaatcctcagtgttgcatgaggagcctggtggaaggcgattggatcatggggatggtttcccccatgctgttcttgtgataatgagttcccacaagatctgatggtttaaaagtgacacttcccctttctctctccctcttgctgctatggtaagacatgccttgcttccccttcatcttccgccatgattgtgtttcctgaggcctcccagttatgcttcctgttaagcctgtgaaactgtgagtcagttaaacctcctttcttcataaattacccgttctcaggtagttctttatagcagtgtaaacacagactaatacagagaattggtaccaggaatggggcactgctataaagatacctgaaaatgtggaagtgactttagaactgggtaatgggcagaggttgggacagtttggaaggctcagaagaagacaggaagatgtgggaaagtttggaacttcctagagacttgttaaatggttttgaccaaaatgttgatagtgatagggatagtgaagtccaccctgaggtggtctcagacagagatgagaaacttattgggaactggagtagagatcacttttgctatgctttagcaaagagactggcagcattttgcccctgccctagagaactgtggaacttgagagagatgatttagggcatctggtggaagaaatttctaagcagcacaacattcaagaggtaacctggctttttctaaaagtatatgccatatgtgttcacaaacataatttgaaattggaacttacgtttaaaagggaatcagagcataaaagtttagaaaatttgaggcttgaccacgtgctagaaaagaaaaaccaattttctggggagaaattcaagccactggctgcagaaatttgcataagtaaagagaagcctaatgttaatagccaagacaatggggaaaaatgtctccagagcatttcagagaccttcatggcagcctctcccatcaaaagcctagaggcctaggaggaaaaaatggcttcctgggctaagctcgggccccactgttctgtgcagcctcaggacactgtgccctttgtcccagctgctccagctccagccatggctaaaaagagccaaggtacagctttggccattgtttcagagggtgcaagccctgagccttggtagcttccatatggtgttggccctgtgggtacacagaatgcaaaagttaaggtttgagagcctcttcctagatttcagaagatgtatggaaacaactggatgcccaggcagaagtctgctgcaggggtggagccctcatggagaacttctactagggcagtgcagaggggaaaatgtgggattggagcccccacacagagtccccactggtgcactgccttgtggaactgtgacccctccagaccccagaatggtagatccactgacagcttgcaccttgcatctggaaaaaccacaggcactaaatgccaacctgtgaaagcagcctcagggtctgtactctgcagagccatagaagtggagctgcccaaggccttgtgagcccacctcttgcatcagcatgccctggatgtgagacatggagttaaagcagatcatttcagagctttaagatttaatgactgtcttgctgagtttctgacttgcatggggcctgtagcccctttgttttggccaatttctcccatttggaactggaagatttacctaattcctgtactcccattgcatcttggaagttactaacttgatttttattttacaggctcataggtggaaaggacttgccttgtctcagatgagactttggacttggacttttgggttaatgctgaaatgagttaacactttgggggactgttgggaaggtatgattgtgttttgaaaagtgaaaaggacatgagatttgggaggggacaggggacaggaatggaatgatatgatttggggctgtgtttctacccaaatctcatctcaaattgtaatccccatgtgttgagggaggggcctggtgggaggtgattgaattatgggggtggttcccccatgctgttctcacaatagtgagtgagttctcatgggatctggtggtttaaaagtgacacttcctccttcactgtctctctctcctgccgcatggtaagatatgccttacttcccctttgccttccactatgattataagtttcctgaagcctcctagtcatgtttcctgtttagcctgtggaactatgagtccattaaacctcttttcttcataactttcccagtctcaggtagttctttatagccaagtgaaaacagactaatacagtatgccacaagatcaaggtccatctctttctattttgttactctgctatgcagggcttccattctcaaggtcacctcatggtctaatctggctgctgctgctctggctatcatgcccatattccagacagcaggaaggagaacaggaaaggagaaagacacattcctctcttttaactcacacttacatcccactggtgagtacaagttataaaaccacacttaatgagatgkgtatggtggctcatgactgtaatcccaacactttgggaggccaaggctggaggatcacttgaggccaggagtttgagaccagcctgggcaacatagcaagaccacatctctaaaaacatttacaaaaacaaaaaacccacacttttccttctaagagaagccaggactgggaatctttattccaagctactctgtggccagcaaagaaataagaggttcttccacagggaggaaggggagagcgattattgtggaaaagacactagtcttttccacacacatccaaagtgtgatttcattgatattattgcttgggatgagattagagtatttaaaagttgaggccattgaaaaaaatgattaaggacattaagtccaggtgacaggtgggtrtggtaaccatcatgaaggcagtaagaaatggtgagcctctgcattactccaggatctggagttggtaycattagcatagcttccttcctcttgcaaaggaggcaagcctaggctcagagaggctgggcggccggccctgctgcctccaaggccrgggctcacaccctcgcctcttcccaggatcgtggcagccactcacccagggctctcccaacagcacagcttctttctggcccaacatccatcacagaggctgcaaagatggaatcctccctttccagcctccctggcagctcggggtgtgccagggacctgatgtaagcattaaagcataaaacaaggtagggaatttgggactgtcattgatgttgattttgactctgggttctcatggatttcagaaccacatatgtcctcaggaactagccacaggttgcccggccacctgaaaagaaactcatccagcaagttcaaccttgaatgataaaaaggaaaaagtgccaagtgcagtgcttgacacgcagtaggcacttaccatcagtttacgcttatcagtattccacaccagggcattccaagtgtattcattctttcctcaaatgcatttaatgcatggaaagacttaagactagtgccaggcatggaaaatactccctaagcgttagccactattcttatgattatcatggcattgttgtgattgtcatcattcattcattcaacaaacatctattgcacccccatgtgtgccaggcacagccttggcactgtggagtcggcaataaaaaaggcagagtctctgccctgctgggagcccagcccctaaatgattcatcccacacttaatgagcttgagttgtgattcatgccgggggtcctgaaagcatgaagcagggccactgagcttacccggggcttccctggggagcagctgtcatgagttgagtcctcaggaaccagctggagtcagcccagctaagagtggagaagagctcacggggctccagaggctcatccagggctgctcagcaaaccaggcatgaaggccaaggcccctccgtgctggctgcattaaccagcttgtcgggcctcagctcccaggcccagagtttgggaccgggccaggcaggctcagagcaggccaggcattggcagatgcctgtgtgctgaaggcagggtagcgctgcctggctgcctccctgacctcccagggcatctcctttgtgtggcagcactgtcccccatgccgagccccttgggatccagtttctgtggaggccgacttgcaaaacccggggtattgtcttgtaacagcaggctctggggtgggttcaatgaaaatccagccctgcatgtctctgtattctaacctgaaaagaattatgttacatcaataratgatacccattatgtgccagcatccagggctcttaattgactcgggcttagttaatgattgggagaacatccacggagagcctgaggctccaaagggaggggctggggatagattaataacataaaggactggatggagacactccgttcaactgctgctgggccctgtgtggagctggctttggcgtgtgacagtacaaagtgggatgggaagatatttgatgacaaaatccctcatcttatgctgagaggacctgctccttccctgctgctcaaatcagaagttacagcttgagacacatctgctgcctgccttctcaccacatttagtgaagacacccactctaagaatccttggacaaagtgaccccaaggactggacccgtcttatcctcgatagtttggagactcattagtttttgctcccaaggaattctgcaagttttcttggagtcctttctgtggtttctaagaaaatttaatgcaagctcggtgaacatgtttttggaattttattaacatgccatgagggttagttaagaattccatggaagctgggggtctattccaagtaagaattccacactgtttctgtgagaattcattaaggatcacmtggcaaytctgagagattttcacgaaaattcattgagaactccataggtcttctatgaacattccatcagacttgtggaaaaattctatgagaaggagacacagctgacatgaacattctaggagcagccgaagaaagtgcagcaggacttatgggagggtttataaaagattccatgaggctgccttgcaaaaattccatccaaatgtttcaagatttccgtaggagttctttggaagcctgtcagaaccttaagcacatccacagcagaattttctgtaggagtcaccactgccttagcactacgtccacatgtgtcagagccccagctccaaatcaccaatcagggaggctcccttgaaagagattcctactttctttttctttcttagtttcattttttaaatttcttttactaaaacgaaaatcagtttgttagaaacatactcgctctggatacctgctgagggtctaaacacagtggataactgactatggaaacataccacaaggaaatggaagagttaggaccactctgaagaggaaagaatcttcaaatctttcactccctatgaatcctgtgaagaatgtgtgctgattgacaatatttctcacatggtctggtatcaggggcaagaacatgggagtggcagccaggagtacctggttctagttccaggtctgccattaactcattgtataagcttaggccagtctctgggtctcaatttccccttttgtaaaatgagaatttttagactaggaaatccccatggactcttcctaccctgacagtctgtggttctgcaaagtaataatgatggtgctggtaacgatgataatggtggtgatggtgatgttggtattgattttgttggtggtgatggtggcgataatagtggttgtaatggtggtgatggtaatgatggtgacggtgatggtagtgatgatgacggtggtgatgttggtggtaatgatggtggtgatggtggtggtggtggtaatggtggtagtaacagtgggctgtggtgatgactgatgttgctggtggtggtaatagtgatggtggtgatggtggtaatgatgggggtgatggtgttgatggtggtgacggtgctgttggtggggggaatgatggtggtgatagtaacggaaatcatactgatgcaggtggtggtgattgtagtcatgttgatgatggtagtggacgctgtcgtagtaatggtggtgagcgtgggggtgatggtggtggtaatggagatggtggtggtaatggtgccggtgatgatggtgatggtggtggtgatgatggtgagggtcatgttggtggtgatggtggtggtggtggtgataatggtgataatgtttgaggtgatggtggtggtagtaatgatgatgatgatgatgatggaggtggtggtggtaacaacggtgattaccatccctgagcatttatactatacggtctactgctgtgctaagcacctcccattctcttcttaaactcacatattcaaccatttgagataagaactatatttatctctcctaatttatagaagaggagattaaagcccccagaaatttgatgaaagtcacatggctgataaccagcagatttagcatctaatccatgattgtcctacttcccagccttctcttaggcaccactccacactgtttcttctaccacttgcagctctaatcttttgactttcaaggaagttctccaatgtatcatgcaaaggacctgtgatagcaaaagcctcaggctgcctgatttgttcacgttttgtaaacacctactttcatccctcatccctgctacatcatgatctgcccttttgtttgcttatccctgatccaagattctaatcatgtacctcttctcccatgtggtctatcctgcacataccaggtgaatttcttgcaaacgatatgtaccatcacaaaatccttatgctcagaaatttttagtggattctcctagtgtgaaggactaaatagactaagctaaacttttgaaagtcccttaggacatccttctaggacctctaatatcacagtctctgtgatagctccttaatgccctgggctgaattccatctctgtgactttgtttatgcacatactgcctggaatgccttcctcctccctctccatcctgcttcttctgaaaatgagacttactagactattttaatctgcaatctagaacattcacacattcttcatcatggagtagcaygatctaaggttgggctgcaatgaatattgtttggacagctcttctcacactgaatggacagggcaagtcactaaaagcaaggaccacactgtgtcagagccatgcagatctgaccctgctgctgaccagctacatgatcttgggcaagtggctttacctctcctagccaatttccttatctattacaaaatggaatggaaataataaaatcttagtgggcagaggtatggtgaaaaatgaaatgagagaagagaaagatcttcctgataagctttagaagttgtaaagacaatcaggaatgtcaggcacagagcacactgcctggattggaaaaggtgtttgggaatgtgacttgattgccctctcctacacatcytcaagcacactgcagggcacatggtgctgtaataatcatttagagcccctgtgctccaggcattgtgccaaatcttggcatcaagagtgcttttaatcctttttctctcctttaattgttcttattcttttctgccaatatccctgtgttacagcatatattgaggcttacagacaggattcaaagctgggttggctcatctgtttcttagccccttggctttgctgcccttcagcagcacacactaaatagctatgtgcttcttttctttcctttttttttgacaaggtctcactctgtcacccagattggagtgaagtggcaagatcatggcttactgcagcctcgacctcccaggctcatgtgatcttcccacctcagcctcctgaatagctgggactacaggcatgtgtcactacatgaataattttcttttattttttgtagtgataggattttgctatgttgcccatgctggtctcaaactcctggactcaagtgatccacctgccttggcctcccaaagtgctgggattacaagcatgagccactgcacctggccgccatgtgcttctcgaccaagcaaacttcctagttcctcaggcctggagtgcctccatgcacacaaatggaccacatcccgctcctcagggagagcttgtggtttgtgcttgtgcgggaaatggtttctaatcaacaacagtagaggaggctgacctacaggtcaaatttaaatgccccttgttatggaggggaaggaaatttccacgtagttttacagggagsgggtaagtcaacagcaaggcctttggaatcatcattgcaaagctaaggagaaagtcaaggttgataaagagcctagacctttgattctgatggaaaaatgggttcagagagaaggagtgatttgctgaagctagtggcagggcttggggggaatctggagcctgattccctgttcactgcaccacatctcgaccacctctcctgtgtcccattccctagaggcctggctctctgccaggactaacctggccatctcctccatgttctaatggcgatgggtgagtgtgtgacattttacacttcccagctatcattttctgtcatttttatttataacatcttcaccatgtttctggccttacgcttgtctctatgaaaattattgagcagtgaaggagttgaaccacgattaagacaaagtcattgctctccctaagggttgtagtgacacatggccaacttaaagaagtataaaaatcaaacaagtaggactcatttttctctgacataagaattctggaaataactggtccagaatccagggctccttaggacccaagactcctcaactcactggtgccaccatccatagcctgcagttcctgtactcttggtcacagggcggaccgtcctccacccccaccatcataatgtctttctgagcaggaagaaggggtaaatgtgaggggcaaaaaagcatatgccaattggttcatccctgtttaaggtctttactagaaagatcttccccatacatcccattggctactgcaaactgcaagagaggctgagaattaagtttgtatttgagttggtatactgaaggctcccagtaaaactaacgtgcttttagaaagaaagaagggaagtggatattgaatagactaccagctgtctctgccacagtggagttaaagacttcctaaaattgtatgcaaaatgaagaatatatacatgtgattttcagggaagagagtctacaacatttcttaaattttcaatgggatcccttgggttgagtacctctagtccaaacaaagatctgtgcagcaacaattctaatagcttaacattggttcttcatgcctacacccagtcaatttcctcagcattaagagcatgggaggcattaggaaaaaaatgcaaggctcccaggcagggattctgctttaccagcccagagcttccacatcacaactgcgtgaccatgggaaatcccataacccttttgaacctcagtttcttagtctattaaaagggagggaaaacctacctcaaaaacttgtaagaggatatttctacttcttgcatagaaataggaacaggaaccagatttattctccctcctgaaacaaataaaaaccaagacaaaacatgttaaaactggttttcagatattggccatcaggcagcacaagaccaaaatccttgagaaagagaaaacaaacaaggctacaattgcccagcctattgcttggacaccatttcctgagatcagtgcagggaggctatcttagtaagttttatcctgctacaacagaatacctgagactgagtagtttataaacaacagagatttatttcttacagttctgggggctgggaagtccaagatcaggtggcctccatctggcaagggtctttgtgctgggtcatcccatggtggatggcaggagggcaagggagggtgaaagagagcaagaaatcaaactctcagcctcaagctcttttataatcagcactaatccattcttaagaatgtagccctcatagcccaaacacctcccattaggccccatctcccaacactgttgcattggggatttgatttccagcacatgtgttctgagcaacacattccaactacaggagaggtcgaacctaggcagcacttgaccatctccacgagctgaagtgctggaagtgagagtacagggagtacaagatggctaaaattcacgcagagtaccagaggtggaaataacacagaaagggctgcacagggtccctcctgagtcttcatctgatcctgtaagtacttatcrgcacttgcatgagaggaagctaccctcctccaaagaattagrgaaaacatccctagcgtgcaaacagaccaggaatatagcgttttcaccagccacagtggataagcctcagagttagaaggatgtcagagtactacagaaggtatttatagtcttaaaagtgggcaaaattggccctagactaaaggctgcctcgatagcatctaacaaagattaaaaacaaagcttgaaaggaacaaatggctcccaagttatttaaccgtgttgcaggaaaaaaatctcaagaatacttacagaatataaaaatgtctagcacacaagaaaataagtatcatcatatgtggtataaaagaagcaatggcatgcagagaaactgtaaaataaaatgcatgatgagagcatcagtcaacagaaacagaacaaaaaataacacaggtgatagcattaagagacaaggaccctaaaacagttattacaactacataactatgtctaagaaagtagagaaaaaattgagcacgttgagacatagaaggtataaaagaatcgaacttctagaaatgaaaattacaatgcctgagatttttaaaaaataaaacaaaacactttatgagattaacagcagattagaaactgcagagagaaaagatatgtgaacttgaagacctagtaatataaactattcaaaaatgaactacaaaggagaaaaaaactgaaaaaaaatcaaacagagcatcattgacttgcggtacagattctagtttgctaacatatgtgtattataatccacaaaggagaagagagaaagggaaaatagaaacaatattggaagaattaagagctaaaaaatttccaaatttgatgaaatctttaacacacagagccagtgaacccactgcaaaaaaaaaaaagaagaaraagaaaacattatcaaggtwcatcataattaaattgctttaaaacagtgataaggagaaaatctcaaaaggaccctgtaacaaaaaagacattacatatagaaaaacartgataataatagctgcagatctctcattggaatcaatgtaagccagaaagaagtggagcaaaatatttaaagaactgaaagaaaaaaaaaaaggttggataaaaatcttatgaccagcaaaaagttctttataaagaaaggggaaataaaaagagaggattgaaaaggacatacaaaaattaaaagcagcagagcaatattacaagaagtattaaaggaaattattcaggcaaagtaacatgagatgggatgaaaacctggatctacacaaagaaaaaatgaacagcagaaatagtaaatgtgttggtaatgtaaagggtttcttttctaaatttctgaccactttgaaacataattggcagtttatattttaaaataacaaccgtgtggtttataacctgtagaggctgagtatgtaacaacagcagcacaaaggctaggaggtggttcattcttatactacaatgtgaagcggtgcaatactacttgaaggtaaaccgtgataggttaaaaatgtatactatcaacactaacgcatcactagagaaagaaaacattcaacttttgccaaggtgccaaggcaattcaataaggaaaagataatctttcaacaaatgatgctgtaacaattggatagccatatgcaagaaaatgaaccctgacatttacgctaaagcatgtgcaaaaactaacctaaactatatcataaatctaaaatgtaagagctaaaactataaaacttcaagaggatagcatagaagaaaatcgtagtgatctttgatttgttaagatttcttaagtaggacacagaaatttccaactataaaagaaaagtatctaattgtatttaatcaaaatataaagtttttgctttttgaaagacactcaaatgaaaaggtaagccacaaattcggcagagttttttgtgaaacatatatccagaaaaggactcatatctagactatataaagaattatcagaactctgtaagaaaaataaactaatttttaaatggacaaaagacttaaataagatatgtggatagcaaatactgacattaaaagatgcccaacatcattaatcattggggaattaaaactacaaggaggtagggcgaggtggctcatacctgtaatccttgtgcttcgggatgctggagccggaggatcacttgaggccaggagtttgagaccagcatgggcagcatagtgagactgtgtctttaatttttttttwaattagttggacatgatgatcagcgcctgtagtctgagctacttcagaggctgaggtgggagattcacttaagctcaggagttagaggctgcagtgcactaagatggagccactgtactccagcgtggttgacagagtgagactctgtctcaaataaaataaaaaataaaaccacaaggggataccaccacacacacatgctaacattaaaaagactgattaaccaagtatcagagaaaatgtcaaacaactagggctgtcatatgctgctaggagcatgaaaaggtacagtctctttggaaagcagtttgggagtttctcaaaaagttacactcatacccccaaatgacccaccatcctactcctaggtatttagccaacagagatgaaagcatacagaactgcacacaaatgttgggaacacgttgagcagctttatttgcaatagccccaaactagaaactatccgaatgtccatcagcaggtgaatagtaaactgactgggtatatctatgcagtggaatactacccagcaaaaaagtaatgaatggtagtacatgcacaccatggacaggtatcaaattaattatgtggagtggaagaagccagaccaaaaatgcacatattgtaatggttccatttacataaaattctagaaaatctgtcataacaaatagattagtggctctctggagtatccagtggggaaagcaggaagggattataacgatgccccagaaaactttgggagatgatgacttttacgttaactaacttcattgtgatgattgattgatttgtgttcatatgcatctgctaacattttatcaaattttatgcttaaaatayatgcagtatgtcaattatatctcaacaaagctgggatttttttaaagctcgaaagagaaactgaaatactagacaagaaggaggtaactgcatgagttatgcattccagacataacattcttccaaggaagatgaaaatggttcaaaagaaagtgagtttctaagaagagagccaataagattaracatgtaaatgcttttcctatggcaagctttgctcttagtagtattcctgagctcactcattgcaagttctcaacaatctcctgggggagggactgtactgtcctcattttatcgatgaggacacaggcacagagaagtgaaggaacttgctcaaggttacacagctagaaagaggttgagtccggaagatgaacccaagcaatttggctcagtggcctggtctcctgttcctgccactctcttctgtcccttgtgccttgtccagagagctgaaaacagctgcagttctattcacagccctaacgccacagccggggtctctcggaagctctgtggttttggccccctatgagagctgtagtacacgttccttcgttctcttccccagcctcctcccwttaccactgtaccccttaggaacatcttaagagttccagaacttcccaggaccttcaaagcggttttatgccaccatgcctgcttatgaccytcctccaatacgcatgccctgttttgccagccaagccagcacctcacctcaggctcagctcatccatgaagtcttgactgactcaagtccccatccccaagaagaattggccctgtcctcctctgctcccattccatgcctcgtagagactctgaacctggccgcagttcaagggcaggagagcctggctgtggaggatgcagggttctggaaaggcaccaaaaagtcatagcaaatratgtgggacaggggaggctgatcagggcttagcttgcaaataaaatttaaaattgtgaaacagattgggcatggtggcttacacctgtaatccccacaatttgggaggccgagtcggggggatcatttgaggtcagcagtttgagagcagcttgaccaacatggtgaaaccccatctctactaaaactgccaaaaaaaaaaaaaaaaaaaaaactagccaagcgtagtggcgggcgcctgtagtcccagctactcaggaggctgaggcagaattgcttgaacttgagaggcagaggttgcagtgagttgagatcacgccactgggtgacagagtgagactccgtctcaataaataaatagataaataaataaatgaaataacattgtgaaactgtttattttacatttcacaacatttagtcctatgataccaatggactggctcctgggaccggtcaagatgagataagagttgatccttctggagatcctgacaaattgtaggacaccaggatgcgtcaagccaagagcatcattttttacagcattcgaggagctcatcaatgctcccaggagcctctctcaagtttggatatgcacatccctcctctgsaagtgcctgtgctgtcctgattgagtggatctgctcttcgtcaaatgttctcggagttaatcccaccagatcctcctgtgtctccagttttgcttgtggcagaagaaattcttgaaaaacaytgtggcaggtagaataatggtctcaaagatgtcgacgtcctaatccctggagtctatgaatatgccaccttacaggataaaggggactttgaatatgatgaagttaaagacctcgagatgggggaactctcctggacagtctgggtgggcccaaagtcatctcaagggtcctcgtaagagggaagcaagagggtcagagtcacaaaaagtagwtgtgatgaaggaaccacaagttggagtgatgtactttgaggatggcagaaagggccatgacccatggaacacaggaggcccctagaagaaggaaaggggaggaaatgaattctcccctaggaggaacaccatcttgcccatactttgattttagccttagggagacccagttctgatttctgaccttcagaactgtaaggtaataactttgtgttcttcaagtcactaagtttgtggtcatttgacacagcagcagtaggaaacgaatgccatttttatccacttcgaggaaatcgtgcatctttgaaaactttgaaatttgctttgcagtcacagtgggagctggacgcatggttgatgttctgtgtctgcccctccagtcatcccacccaggccctcattctcctatgaatgtcacacagccaagtcctccctgggaactgccctctgcagaagatagcagcctcacccaaggttatgacccctctccactggggcagcctgcattgaatgaacagtcaatcccaggggacagagtctggccttgatttggatagtttcaggctcatcccagcttcagagctccaygtggtgctcagtgrtggctgcatcacgttttagcttctcccctgtctaaggtgctcctctctctccctcctgggcattgctgcccagagcactctccaggaattttctgcatgcaaatcagctctcagacatgtttcttggtatactccatgtaagacagcaaacatttagattgtgttgcttgcagtcaagggagtcagatggcctcrggctggtctgcctggagcagagacaaggtttgtrgttttaacaagatgattgatggaggtgagcagagaaggccgtttgctggggatgacagtatatgtagtccattcacttgtgaggctcttcctcttacaaagacctatgtttgtttcctttgctgcacagtacctgccagggcttggataatgaacccatatgtacagggactgcgtaaacttgtctttctgtgtctgcacatcccctccagacaagcccagctcagcagcctgctggataccactaagtaaccctcatcaatgccaaataaaccagagaatcatcctgatgaaccctgacccctcacccccaaatcatgacatagaataaaatgttttgtgtcactaagtttggggctgtttgttacgcagcagtggaaacatggaacagtcatttggactgacytttggacagtcatttggagaggtgacatcatattaaatgagtagcaagtaccactgcaggaattagtgggggtggagggagcacctccagatcggaagggcaaaaaggaaagttttgagactgtactaagtgccaagcctcaggcaagggcttccacctctgctatctcgaagagtcttacagtccttgggtgaggtgggaaagcctctccccattctacagaggggcagatgaaggcctggagaaaggtaaggtgacttgttcaaagtcacaccactagttccttgcattcaattatttaccaattaattaattaattcaacaagtatttcatgagtgtctgctatacggcaagctccatgcgagttcctggggaagcatcatgaaaaaaagaaagggtagagttggtaacagggattgggagtgcatttgggagagagggctgcagatgcaagtcaggtggtcagagtgggcttctccaggagggaacacttaagccagtatggaaggggagaagggtgggaacttgcggtctaggaaagcttcctccacagctctggggctcaggtctacagcctgcggggcatagatactcctgagttttccggtatagaaacctgcaccgccttcagctgtgctgggcactgcctgggccctccattggaggcagggcagggcaggcaacgtggcaccagataatgatgcctctgtgtcgcccacactggccgcaccagctgcaagagccatccggtggctccaagttaattgctccagagcacaaggggctgtataatttggatcaaagggcccctctcttgaagtcttaattgtggcacttcacgctgccctggggcgagctgagccacagcagcactgcctctggggtggtgcctctggtctcagctttgccacttgccactgtgtgttgtctacctttcctggcctcagtttctttgcctataaaatggaagtgaaaagatcctccttcccactaccccctaccgtaggcgaggatgaagtcaggaagttggtatgcaaataatgtcataaatacgtcttgaatcctaagtcctacctaccctggacaaattactgttctttgaactcaccctggttattgatccatccatccattcattcmgcattgcctgtgtgcccattttgtgctaggcatgggttctggggttgcagaggtgaccaagacaccgtcactggcctctatgagctgactgtctggagaggggcaagggttgagtagagaaccacagtcctgctgggaacagggtctttgggctgggctttgaagctcacacaggagtctgcccctttatgggaggacatcccagcggaggaaactgcacatgcagaggcaaggcatgatgcggtgtgtcagtggggaatgctcactggacaatggaggcaagggctttacaggccagcaggggagtctggacttgagagccatagaagggttttaagcaagggagagatatgatcggctttatctggggggagggatctcttgtagcaatgtgcaggccaaagagtgagaggctgggggcaaagmgatcaggaaggaggcagttgcaatggcttaaatgggacttcattcctacactccgtgaatactttttgaacacctactgtaagccaagcactgcgcaggctctgggaaagtgtgagacaacgtttgcactctaatggggaagaagacaataaacataaatatgtcaggaagtgtcagatgctgacaagagctccagagaaaactcaagcagacgtgaaagggtccctggggtaggcaggcccttagcatccctgctccgtgccttctgcttcctcttcctggacttcaggggctggaaagctaaaaactacatttcccagacttccttgcagttctggatccaagacaaattaggttccatcaaatagatgcatctggagccctggaagaacaagcagggcgaggccttctttccagcgcttcacgctcctttttgttggcagccagggcacgtttctgccgcagtcagcgttccagtggagtgtggttcctgcaggttcctagagggacagttttagcagtggttgcaaccttctgatttcctctccctgatccctgattatagccatagctgtggtcctttactgttgagatctaacctcctatataaagtgtgcaaaagtgaattcttgattagtttgttacatgtacacatacatccatgtaaccaccccatcgtctagctataaagcatttccatctgcccagtgccgtgggccccctaagctccrcagtcgaagcggtgaccttctggtttcccatcttaccatggtggaaaccttagtagccaccctggccagtcactccgaggcggttcagcctccagctcctctttagccttcccaagaggtttgcaagcacctcatcccctgttaagtctctgagaaaacagaaggggccttgggagttggtgttgccagatgcagcrcacagaggtttgggatgatgcctcctaatatgctgtgcggttctgggtaggcaggaggtagagagaggggatggcggcatttggtggtacacagaacagaggaggtagaaccaaggctgctccctgtgcagtttccttggccagaaatgccctccccactactgcattgtgagtaggagagtgggtgccaccttcaaagctcagacgccacagcttccagaggtctgctctgacccactaggtagatagatcagcacctctgcacctgtgaatctgggccaagcagtgctttgttatatataattgtaattgtgccttgtacacaattccatctttaggacagtgtgtcctggcagggacaaagggcagggatgctgttcttcctttkttccattgttcaccaccgtacctggagtatcagtcatctcakcttgaccgtgagttacaggttctcagggayttcgtatcttagttatctgggtccctgcggaccagcacrggtctcatccttctccattgctagagagaatatcaggagccatgtggcccaggcagggggcagcctctgttacccagagccataggcactgcagggaagcagaatgaggagcaggacctcagggggtccatgtggccrgtgctgctgcccagggctgtattctacatgctccaggctttcctgtgcgtggyccaggtatggggtttcaggagggccagggctgggctggcatcggcttggccactcagtgggtgctcactgacagtgagtgtttagctttatgttcctggggaatcagatggcctcagttcaaatcccagctctgctacctgccagcttcagggccttgtgtgagtctctcaaccttctgtgtctccattttctcatttctgaaagagggacagctattcatagggtttgccacaggtctggttccttgggaaacagattctgtgattcacgtgcccaagattttagtggtgcatctgaaggaacaagtgmagcagggctcaacagcatggcagaggtgacaagaatcaggagaggccgctctgcaaatggagcagatccagccccttggggtggatttggggccactcctccttcctgtcttggccaacaggactctttagttaaaggcaaatatggcggaggactcaggaataagcctccgccaccaacacgtactgcaacacagagctgtgtccctcctgaaccatgtcatctgccatagccttgctgtgagaatacaacaattactgtttttctgtgttggtgaggccagcagtcacagctcttctggtgagaaatgttattatatttgtggggagcggcattcaggacagctcatgcaaacccargctaaccaggcctacaggtgagggaggggcaggaggcagagatcacgggcgaaaacaatctgtgcccaaattctggatggggccttaactgcaaacgaagagcccatcggtttggtgtgtcccaggaggcaatgccagggagagaacmggtggctggagttgtcttgggtctgtccatgtttcccaaataaaaaagttgtgcaccaagcaattccccatttaaaaaaaaaaaaaaaaacttgatttccctgtggaacataaactgtagcttagcatttcttggcagccagtggtttccagaatttcatgcaggttaaaaataaaaatgcaaagcattgtgataatcccttctgttctcgcggctctttccactttgccaagtattttcccagccatctcgccccacagatccccaccacaatctttccaggctgggagttttattcctaatgatagatgagaaaactgaggcactcaaggccacagaaagggaagcaagatcccccagactcaggccaggcccgtttggttccacatggagcaaccttctactcggccacttgtcttcttaatgtakcaggtgagatcgggaaaaatactaaatatcacatcactaacgtgttcaaagccaactggtattcccaatagggttggaattgatgtcctcgtccttccagcttaaacctgggggacattttcctgtctatgtcttacttggtgttaccagtcagggtccaatgggaaagagtattttcaagtatttaataatgagactgtttataagggctgggtagtatttgcaaggggatgagtgtggagctcatcctcagctacagccccatttgggggtcagggtccaagaactcaggggactgggccaccatcctggaggagggagagaagggggcctgtgagctcagtgagggagactggatcctcttcccactgaccaagactgtgtggcctgcaagattggacccaaggtcacaggctcatggcagctgggctcagggcagctgggtgttgaacaaatgaagggcttgccaggattcaggtctccagaaatggcagctcagaaaaaggtctctcctccaggtggaatccagcrgagaatgttacctggggcctggggccatcacccccaggcattcgtggaggcccccgtctgaccacctccttgcagagctgttagcccatctcacagtctgctccaccacttgctagctgtagcggtgtcaccatgcacytgttactcaatgactttgagccccaggctctaatayacagcaatagactgggtgcttgaggttgttaatttgtgaatgcaagatatacctagagtgtgctcataaagtaatcttctgagaaagaaatgccatgaagggaaatggtggcatggtatcatggagctgagccacacacagatacaatatcatatagttcctcttgcttcttccaggaagtctccccagactggtgctaccctccgtctggaatgagaatctcctttgggctcccacattcttcgtgcctctatcatagcatgtatgagtccacatctctgggtcccttattggccattcctcaaaactgtgagctctttgagaacaggaaccttgtccttttctcccctataacctcagatctagcatatttcctggcacataggaggtgttatagacaatgtttgtatgtcctcaacattcatctgttgaaatcttgtctccattgtgatggcattaggagatggggcctttgggattgggacttaagggtggaacccttatgaatgggattagtgcccttataaaggagaacccagagagctccttcccttttctgccatgtgagtttacagtaagaagaaaggccatctatgagccaggaagtgggccctcaccagacaacaaacctgcaggcaccttgatcttggacttcccagcccccagaacagtaaaaaataaatttttattgcataagctgctcatgttatggtattttgttatagcagcccaaattgaccaagacagaaggcctatccctcatcaaatagttgttaaatgaagaatgaataaatgaatgaatcaatgtatccttcagcaatgctgtgaggcaggtggaatagacagtattgatccatcttatagaaagggaaacagattctgagagtagaagtcactcacccaaggacacagcagcaagtctgtagttgaccttgcattagaaagtttcaagggttttgtaggatgataaatcctggtcttgtcttttgtctagctgtcttctaagagcacagccctgaccctagagaattcctcctgttctgcaaaaagccagtggaggcccaggggcctgaaataggccaggggagcaaggaagtgctgtttctcactcagaaaataatggcacccaaatccctgttcaccttatttaatgctccaaattttctgagaggtctaattgaacattcctccgtggaaccctctgggtggaacaattaaccggcctcttagcagcgagtagctccctgggcaggccccagatttatgtctcctggggaggcagcctattagctgtggccataaatctcggggccctggctggcaaggtggattttaataaaatcataggggacggagccaggctggggcagcagatttccggggggagagccaacatttgcctgtaattaatcgggacgactttgagctctggggaaatgcccaggattttaatgaaaattcaggagctggaagcagtgaccagttggcatccacatcagtgtcccagctgggattggggatgcaaggaacctgggggagctggggccacccctgccaagaggtcttgacatggggtgttattcagtggacactagtacaattatcctgcttaactgttagaatacttacatactagttggtaaattgtttcctcagccccctatgggcctcccactttctaggcacccttgcacaggaatccctgggcttcctcataatcccaaaacaaaagggtagatgcctggcccagcaaggggcttcctgatccttcagtcttcttggtcagtgctcagggcctgaacttggctgtcctgttagccaggtctgcacatgttaaggtgccctaggggcccacccaggtgaccmtcttttcatctctcttctctctacattctcctgcccatctatatctccagttcatccccctctcttgagctgcagattcatatcctcaaccacttccttgacatttcctctggaaatcacggacatcacctctccaacacatccaaaaccaaacagctcctccccaaacttgttcctccctcctgcctgggccctccatcctgatcttaataaacgccactacttttgcttcatttactctttcaggccaaaatctcaggggtattcttggatgcctccctccatttcctcatccctcaacaagtcttgccagctcttcccccaaaggtcatgtcacccagttccttcctggtcctagctgccattggatgctgcctggatggctgccatcaactcctactttgtgtccttgcttccattcttgcctccctgtcttctcatccacacagtggcccaggagagytcaaatgccactcccgagagagacttccccaaccatgccagcatcgcgataatgggcgctgaggcttcctgagcaacagaccctgtcccaggtgcttcacatgctccttgttcaaccctctggacaaccctgtgacagcatgtgctattgtcatccccatttttcaaatgagatacagagatgttaaataatttgcttgaggccacacaaatggttggtttcaaagtctgtgcctcctgttccaaggagacctccccgccccagcctcctcctgccccagctcttgtcccaagtgtcccccgtctgctgtttatttccctttaatcacacctgtttgccatctgacccccaaagcctgcgatctcctggaagtgggaccttcactcttgttcaccagctcctggcacacagtgggtgaaccataaagatgtgttaacttgaacccattttgttgtcagcggatagaaggtgggaaactattttggaaaccacgtagtccccacgtgtgtcccagattggccaaaaggtttttcctctttgggaagggatcagctgtcatgctgtatggagcaagtccccggaatcccaccctggggctagacatattctcytgttactttttattatgggaggcaggggagaaagatgcacgctgtcaaggataagactggggatttgctgaaagggtagatcctgtgttaagtgttcacatcactcaaggaaaaggacagaggaagggagggagggaaagagaaaaaaggaaggaagggagggaggtaaggaagaaaggaagaatggaaagaaggaaggaaggaaaagagagagaaagaagggaaagaagagagagtgaagagaggaagtcagaaaagtttgtaagagtgggaagggaccttagaaatcatctaatcattacttcatctatattgtaaatatcagtgaacctgagaccctggcgagtaagtgacttgcccagggtcatgtaagttcctggttaaactaaaactacttaggagccagctctcctgtctcaaagtccagggtaccctgtatgtagcaaagagttcttcttatactcagacaacactaaaactcaacgtctggcttttttctctatccctggagagctagttaagtgtatctggataaaccaggccatgttctggggaaggtgtttcagagagaggaagatgaaaactgtaatcaagactagtctaaaatccatataacataggccactgcctggatggtggaacttcaggatcatagcagagctttttcctctgactgaaaacatctccatgatgttgtatcctcacaattctttatccaggacaaggctttttagtccacaaaatttgatgtttacttgtaaatgcccttggtaggcaaaatatacctgaaaagttgcactgggcttaaatgcctgttacaaggtgtcttcttgagaacagctcatgatagaaatagtagagagtcagttagtcagttgagagatgggggtcacagggaagtaagcaaagagttcaggatgaaaaattagaggatgtaaggcaaatgccacaattttacaattaagaagcccttgctctaatgtacacacctaaaaatcagtcacaaagagacagcagaaggtggttactcaacagaaaagcctgaggttgaatgtacatgaagtttgaagtgaacaatgaagcaatgatctaaacaatgccaggaagacaaaaaaatgatttttataaaaactttaattatctagacattttagacaaataaaattgctcattgttatttaaaagcaaaaacaagacaaaagaatcacaaccaataaatgactcctatttgtttaatagctttgtttatggagtatatgaagcagacctaaatccagtatgcagtgtacagattccagacttaaatctccagagggcagaggagacacctcaagcatctggggtcttctgtgcctgggaattgggggcaccaggcaagtgatcatggcaagcaaatcattccmtgcagagaagagcttttactacagtctaacagaaaattatcctaagatttcttttgttggtctctcaccactcctagtcaaccaagtattggaagttctagccagggtagtcagggaagagaaagaaataaagggtattcaaataggaaaagaggaagtcaaattgtctctgtttgcagacaacgtgattttatacttagaaaaccccatcatctcagcccaaaaacttcttgaactgataagcaatttcagcaacgtctcaggatacaaaatcaatgtgcaaaaatcacaagcattcctttacaccaacaataagcacacagagagccaaatcatgagtgaactcccattcacaatcactacaaatagaacagaatacctagggatggagctaacaagggatgtgaaggacctcttcaaggagaactacaaaccactactcaaagatataaaagagaacacacaaacaaatggaaaaacattccatcctcatggataggaagaatcactactgtgaaaatggccatactgcccaaagtaatttatagattcaatgttattcccatcaaactaccattgacgttcttcacagaattagaaaaaactattttaaatttcatatggaatcaaagaagacctcatacagccaagacaatcctaagcaaaaaggagaaagctggaggcatcacactacctgacttcaaactatatttgataccagcatagtactggtatcaaaacagacatatagaccaatggagcagaacagaaacctcagaaataactccacacatctacaaccatctgatcttcgacaaatttgacaaaagcaagcaatggggaaaggatttcctgttcagtaaatggtgctgggaaaagtggtaagccaggtgcagaaaactgaaactggaccccttccttaccccttatacaaaaattaactcaagatgaattaaagacttaaatgttaaaccccaaaccattaaaaccctagaagaaaacctaggcaacactattcagtattgaataggcatgggcaaaggcttcatggtgaaaatgacaaaagcaattgcaacaaaagccaaaattgacaaatgggatttaactaaactaaaaaccttctgcacagcaaaggaaactatcatcagagtgaacaggcaacctacagaatgggagaaaatttttgcaatctacccatctgataaaggtctaatatccagaatttacaagaaacttagagaaatttacaggaaaaaaacaaccacatcaaaagtgggcaaagggtatggacagacacttctcaaaagaagacatttacatggccaaaaaacatgaaaaaaagctcaacatcattgattattagagaaatgcaagtcaaaaccacaatgagataccatctcatgccagtcagaatgacgattattaaaaagtcaggaaacaatagatgctggtgaggctgtggagaaatagaaatgcttttacactgttactgggaatgtaaactagttcaaccattgtggaagacagtgtggcaattcctcaaggacctagaaccagaaataccatttgaactagcaatgtaattactgggtatatacccaaaggaatttaaatcattctactataaagacacatgcacatgtatatttattgcagcactatttacaatagtaaagtcatggaaccaactcaaatccccatcaatgatagactggataaagaaaatgttgtacatatacaccatggaatactatgcagccataaaaagaatgagatcatgtcctttgcagggtcatggatgaagctggaagccatcatcctcagcaaactaacacaggaacagaaaaccaaacaccacaagttctcactcataagtgggagttggacattgagaacacgtggacacagggaaacaacacctaccagagcctatggaggggtgggggtgaggagaaggaacttagaagatgggtcaataggtgcagcaaaccaccatggcacacatatacctatgtaaaaaacctgcacgttctgcacatgtatcctgtttttgttttttagaagaaataaaggggaaaaatatctcttgttgggcccctgagttgcaagactgacagtccctagagatgagctggaaggatttgcctttccatccgtgctaaccctctgacctcggtttctttatctataaaatgggagcaaagttccctacctccaggcttaattgtaaagataaaatgtttgaggagtagatgtttcatctgtctgtccagggggtacagaggtggagcacactgatgttggtccatcttgcttggaaacagagggtctgacaggtaacagttctttcaacttggagacagagaaatatgccttttatgtccgtgtatggagtctaaaaaaggcaattaaacctgagcagttgggaacgttcagatatctctaagccaaagaacagcagggatttgggtagggtggctggtatgagtggacaatcattttcaaagcaattctgaattcctctgggttccgaaagaccctgcccatgctcagggacctgacagatcatctaaagtagtcagatactctcagctctgcctatgaagaaactgaagcccaaatagggtgagcagttttcctgaggccatctgggcaagccaaagtatatttgtgcaattgtgttgctataaagaaatacctgagactgggcaatttataaagaaaagagatttatttggttcacagttctgcatgctgtaaatgaagcatagtgcctcagcatctgcttctggtgaggggctcaataagcttccaaccatggcacaagatgaaggggagccagtgtgtcacatggcaagagagtgagcaagagagagatgccaggctcttttaaacaaccatctctcacatgaactaatagagtgagaactcattaccatggtcatatggtttgactctgtgtccccacccaaatctcatcttgaattgtagttcccataattgccatgtgttgtgagagggatctggtgggaggtaattgaatcatagggtcagttaccctcatgctgctctcatgatagtgattgagttctcatgagacctgatggttttataaggggttttcccccttttgcttgacacttcttcttgctactgccatgcaaagaaggacatgtttgcttcctcttctgccatgattgtaagtttcctgaggcctccctagccatgcaaaactgtgagtcaattaaacctctttcctttataaattacccagtctcasgtatgtctttcttagcagtatgagaatggactaatacacacagggaaggcatttcatgagagatccacctccatgactggaacacctcccaccaggccctgcctccaacactgggtattacacttcaacatgagatttggagggaacaaatatccaaaccgtatcaccaagtatcctggaattgccaggggcataaccctgccgtggggtgtggttataaatcaactcttactttggatttatctttgaggcttcctctgatccctagtgttgaagtttaaatgtcacttctcaaagaaacatcactgrcctctcccaagggaaccctttctactgtcctctagtgatgccttgcacactttctggaggctcctccattaaaatctactttgcccatgaaacatcagcctcctctctcttggtgctcacctctggtcatggggaccttycagagtgttgctgagcaaacgaatgcatgaatgtcattgttacacaccatataaccagaagtagaattggaccaagtaggttctttaatgctatgtttagcccaccctggatgtgacactcttgtctcttggtgttccttctcttgaattcctgtggacatgcctggctcctgcrcatcattctgagagctggaccttgtctgactcaccagtttctcctgaaacccctggcatagtttcctgcatatagtaggtgctcatggaacagtgggtgcaaaatggtggggtttgaagaagacctagttttaaatcttgacctctataagtctcttataaagacttracctcccccacaggtggatctggatattcccttattcacaccccactgacctgtgcctccatttgtttgtgtgtctgtgtcccatgtctgcttaatcattgtgtctctaggtctcagcacaggctggacatatgagtgggccttgggtagtctttcraagatctaaaggacagagagaaaagcccaggagttggtgttccattcgatacacccctaggtcaaacagtttcattaaaaagtagtgacacctcaccgactccgaagtttgccaacttagctccctgctggagtctttttcctccgcaaacccaacagaagcccccaccccatcagcaatgaagaatcaggcctttaccagctgcgggggccgcataacagtaaagcagcataattatatcttaataattattttgcagcataggatttataattactaaatgtgtgataactgctccttaaatgcccatgctctttaaaaaacctaatttataatttaaaaagctgacacttcttggagcgctttattttatcttgtcgggagtaatggaagagtaagttattgaaaacctttatttttcattagccttaaattcaatgacaattaatgtgcccaatttgattataaactgcacaaattaaacaataaagagctgtctaatgagaaattaattatgaggaagggaaggggagcggggcgggataaaagcaatcacttatggcccgtggcagcatgtgtcaggttttaaaggagatgaagggccctctcctcaatgtgtgtctttgctgataggacccatcacagatcagttgatccagaaaccataacagcctagtaattgaaactgccaaaatcaatagtgctgacagccttaattaaattaaatatggctgtgatgggctcccagagcccggcgtctgcgggccacttgaccctccggctgagcgtgcctgatggagtgcagccaccgcgtgatggatctcaccccaggggacagttggggaccaggctcctgcagacagaggctccaaaaggagtgaggcgctgcccgccccctgctgcctggccagcccggtggctgaggaagactcggacatggagccaggatgcctttcccctcaaagtgttggctctgttttgtcgggartcaggaagtctgtgtcctgtggcacctaatttaggagtgcagaggagccccatgcattagagaagggggagcatgaaaggaaaagacaacgcaccagtgaatcactccttgacaaatgtgactgtytaccacacccttggatgagaggcattcgtttttcacgacagccctggcaggagaaactagtcagataggccagcctcattttcctcttctgtagaatgggtacatgtgctgagagagttgcaggagttggatacataaaatgcacagcctgggatgcagagccctgcatggggtaaacagctgatgaatggataaaggagcgaatgaacatgtcgctgccattgccactgccatagactgtcatcccattttgcaacaaacaagcaggggcccagagagggaatgtgagtccttcagactacacactcaggacctctgacccagaccctgggtcctttcctcatcaacatggtgccgcccaagcacgaagcatgtttagttttggcagatactttttccccatacagatcctgccctgcgagaaaaggtatggggattttcaactccatttaacagatgagcaaactaagcagctaggcaacttgaccaaggtcactctcttggtgagtgccagagccagggctacaacccagcaacccrttagaatgacgcccaaaactgaagccaaggactgacagagggacccagacccttggctgggaggcccagggaacaacttggcactatagagctgctagaatctgggacctaatctctccccmagaagcctgattttttaaaaaggtctatttgctaagaagacaaagtacaaacccattagcagctcttgaagttttgtttttgtggttgttcctgtcattcttttttctcgctgccaaaaaatcatcaggttaatttttttaaaacacatggaaagatctaggacacacccgtcccctcctgccattcctgtgaatttggggattaatacatggggttgcttagataccttggagcaagtaaccccagcacaaggtagtggaaagaactctggagttttcacagaaagccttcgttggattcaaatcctgactccattgtttattagctgtgtgaccctgggtgtgtcactcaacctctctgctttctttccctacawctgcccatgggtacaagacctcccttcctctcggaactgatgtgttattgaagcagtgatgcccaagaaagggctttgcaaatgagagaatgtgatgtaaatggcatctcctctgttcatgatcaggcactgttattccacttgctttagccacaggttgagtgaaggaaagaaaattgcacatgatcatgttctgagatattgttctttccttacaaaaaaaagaaatcaatgactacaaaaaaactggcctcataaacattggttttcaccataggaagctcaacaaataaatatcttcacagtttgctcggctgtcggcaggcttgagctgacttcttaaatgacatgaaataggcggctcgagttccccaatgtttatgtcagcactaacaaactgtcccttcattacaggcctgccggagatcagaggcccagattattgaaggagacgcctatgagatgcccaagcggttgctgtgacaactctgctggagggcgggaggcggcgagggcgggcagctgactgttggctgtggacaggctccaggcgtgccaggccagagtggggataattccaccccaggttgyttagctgagggttctctgcgcattaagcaccttaactcgctgtcctgctgcaccccagccacagaggccttggtgaaggtgaaatcttagagaatagctgggaagccaaaaggccaagcagtttgatgactatttccttaaagctgatgaaaaagcaacgtggataatatttcctaacaataatggccagcagttagtgttcactgccaggcccctgcccagtaccaagagctcaggttttacatcagcatgacgtgacctatgtggaatccctggctagctctgtgaccttgagcaaagtcactcaacctctctgaatctcaggcactagtgttgaccatggacacaataacaccttccacctcgtaggtttgctatgcagccctggggcactcctgtgcaaagccccatgcagagctcaagcatggggtctctgggaccacactatcagggttcaaactccagctctgtcactctctggctatatgaccttgggccagtcacctaatctcttgagcctggttttctcatctgcaaaatagagataccagcacctgatacgatttggctctgtgtccctaccccaatctcatgtggaattgtaatcctcaatgttggaggaagggcccggtgggaggtgactgaatcataggggcagacttcccccttgctgttcttgtcataataagtgagttctcatgagatctgcctgtttaagtgtgtagcacttcccacttttctctctctctcctgctccaccatgtgaagatgcacctgtgtcctcttcaccttccatcatgattgtaagtttcctgaggcttccccagccatgcttcctgcacagcatgtagagttgtgagtcaattaaacctcttttcttcataaattacccagactcaggtagttccttatagcaatatgagaatggactgatacagaaaattggtgctgggattgtataaagatacctgaaaatgtggaaacagctttgaaactgggtaatgggcagaggttggaacagtgtggagggctcagaagaagaaggaaggtgagggaaagtttggaacttcctagagacttgttgaattgttgtgacaagaatgctgacagtaatatggagagtgaagtccaggctgagatggtctcagatagagatgaggaactggagcaaaggtcacttttgttatgtgttagcaaagaggaaggcattgtgcccctgccctagagatctgtggaactttgaacttcagagagatgacttggggaatatggcagaaaaaatttctaagcagcaaagtgttcaagatatggcctggttgcttctaacagtgtatgatcatatgtgtgagcaaagagatcatctgaaactggaaactatatttaaaaggaacacagagcataaaagtttagaaaatttgcagcctgaccatgtggtagaaaagaaaaacccattttctggggggttttcaagttggctacagaaattttcataactaaagaggagctgaatgttactagccaagacaatggggaaaatgcctcaaaggcatttcagagaccttcatggcagcctctgccatcacaggactggaggcctaggagggaagaatggtttttgtgggcccagtccacaaaaacctgtgcaacctcctcaggacactgcttcctgtgtccagccactccagctccagctgcggctaaaaggaccccagttatatctcaggtggctgctccagggggtgcaaactgtaagaagccctggtgttaagcctgcaggtacacagagggcaagagttgaggcttgagagcctccacctagatttcagagaatgaaaacaccccgacgtccaggcagacgtctgcttcagggcagagccctcgtggagaacctgtactagggcagtgcagcgggagaaatgcagggttggagcccccacacaaagtccccactggggcactgcctagtgcagctgtgagaagagggccactgtcctccagaccccagaatgataggtccactgacagcttgcaccgtgtgcctggaaaagccacaggcactcaacaccagcccatgaaagcagccttgggggctgtaccctgtggagccacaggggtggaggtcccctaggccctgggagcccacctcttgcatcagtgtggcctggatgtgaaagaattgagtcaaaaaatattattttggaggtttaatatttaattactgccctgctgggaagtatttaacatatattttttatttactatttatttaatattcaactactcccctgtatggggcctaaaatctctttgttttggcggatttctcccttttggaatgagtggatttacccaatgcctgtaccccattatacaaatatcttggaggtaactaacttgtttttgactttacagacttataggcagaagagacttgctttgtcccagatgagacttgggacttggacttttgagttaatgctggaatgagttaagactttgggggactgttgggaaggcatgattgtgttttgaaatggagaagaacgttagatttgggaggggcaaggatcagaatgatatagtttggctttgtgtcctcacccaaatctcatgtcgaattataatcctcagcattggaggaggggcctggtggaggtgattgggtcatggaggtagacttcccccttgctgttcttgtgatcatgggtttttgtgacatctcgttgtttaaaagtgtagagcacctgcccctttgctctgtctctcctgctccaccatgggaagatgtgcctgcttcccctttgccttcttccataattttaagttcctgaggtctcctcagccatgcttcatgtacaaccttcagaactatgagtcaattagacctcttttctttataaattacccagtctcaggtagttctttatagcaatgcgagaatggactaatacggaaaatacactcaactcaaatgaatatgtaaagtactggtgtagttaataaatatttactatgatttgatattctcagaactattagacaaggagggttctgatgctcacaatctatgcatgaagactctgaggctccaggaggttgggtgccccctccagggcccacacctcctgactgaaatctcatcactggaatttacatcccagccagcctgagaccaaaacctgtgtgctttccactgtgagccacagtgactgcgatggggagtaatacatcacacacatgtgtacatgcacatacacactctgccatatatcatgaattgctggtgaaattatgagtccactgggcacaaattacaacagggatagataaaacaccttcttcaaaacagagccttccactggagaactgagctggctgaccctgtcagagctggttccaggctgctctggccctgtggcttttccagatttgcaggatgataggggaagatgtagttcactcccctagtccagtgctgtgtgaattgcagtaagggaatgcagaggggcaggttaactcaatcaggtggagggctattaactgaggtgggcttactgaggtcatctgaaaatatctcgactcattcactcattcattcattcattctcacattgttactgggttcctgctccttgtagtgttgcaccaggactggggagacaggcatgtaaaacatggttccttccctccagatcaaaaccacaatgaaatatcaagtcacacccattaggatggccactatcaagacaacagaaaataactgatggggttggtgaggatgtggataaattggagcccttatgtaccttgtgcactgctgctaggaatgtaaaatggtgcagtcactgtggaaaacagtgtggcagttcctcaaaaagttaaacattaaaaaaagtcaaacagaaatccagaaatcccacgtctggatatacccaaagaatttaaagcagggattcaaacagatatctatacactcgtgttcatagtaacattattcacaatagccaaagggtgaaaacaacctaagtgatcactgacagatgaataaatacaatatagtacacacacacacacacgtgaatattatgcagccctagaaaggaaattctgacacacattacaacatgggtgagccttgaggacattatgttaagtgaaataaaccagacacaaaagcacaaatttgtgtaattccacttatatgaggtccctagagtactcaaattcatagacagagaatgtgtaagggcagttgccaggtgctggggtgcaggcagagaagaggagttattgtttaatggggacagtttcagttggcaaagatgagaaagtcctagagatggatggtaatgactgttgtacaataatatgaatgtacttagtgccactgaatcatacacataacaatggttaaaatggtaaattttatgtatgtatatttcaccacaataaaaaatgtctggacaggaaataaaatatacagtgaatagaagggccaattctaaatatcagggacaggacagagatcaactaagcaacccattggaatttatttcatgcctcttatgtgggaaagcaagcaggctagctgggaccatgagtgaggtgatgtattagtctgttctcacactgctaataaagacatatccaagacagggtaatttataaaggaaggaggtttaattgactcacagttccacatggctaggaaggtctcacaatcatggcagaaggtgaatgaggagcaaagtcacatcttacatggtggcaggcaagagacagtgtgtgcaggggaactcccctttataaaaccatcagatcctatgagatttattcattatcatgagaacggcacaggaaacacctgcccccatgattcaatcacctcccactaggtccctcccacaacacgtgggaattacgggagctacaattcaagatgagatttgggtggggacacagccaaaccatatcaagtgggatactacctaggaataggaaaggagctccatgcccgcactgcttgggacttgatgaaatgcggttgctgattcagtaaggggccctgggtctctgcatgtcagccggttccaggtgatgctgcaatgctgctgcagcatggggcacactgggcatggccagtgcaactcactcagaggggccatgtgagggaggcagcaggacagcagcttggtgtgagacgcccaacatttgaatccctgccttgttgtttgtgctgttagttagagttctgcagagaagcagaaccaatgggagatgatgtctctctgtctgtcttgtctgtctctctctctcttctctctctctttctgtctctatccatccactcatctactcacccacctatccatttgtccaccaacccacccatctatcaatccactcactcacccttcatctatgtatgtatgtatgtatttatctatctaccaattcatctatttatccatccatccatccatctttacctgtctttgtatctatctattcatccatcatacctatatttatcactctctcatcttttaatctacccatccgtctatccaaccatatctatatttatatgcctctctcatctatctatctatctatccatctatccatctatccatctatctacttatcaaaacatttatctgcaagctggaaagacgagagtttttttttttttttttgagacggagtctcgctctatcgcccaggctggagtgcagtagcgctatctcggctcactgcaaactctgcctcctaggttcatgccattctcctgcctcagcctcctgagtagctgggactacaggcgcccaccactgcgcctggataattttttgtgtttttagtagagaagaggtttcaccatgttagccaggatggtctcgatctcctgacctcgtaatctgcctgcctcggcctcccaaagtgctgtgattacaggcgtgagccaccacgcctgggcaagacagagagattttaaggaattggctcatgcaatggtaggagctggtaaatctgaaatctttaagacaagctggcaagctgaaaactgaggaaagagttgatgtcatatggtcttcagtaaaaatctgcaggctggaaattcaggcaggctttctaggttgcagtcttgaggagagttctttccttgggaaaccacagtctcgagtctcaaggccttcaactgattggatgaggctcacccccgttatgggaggtcctctgctttgctcaaagtctgctaattatcaaggtcattctcatctacaaaataccttcatagcaacatctggaccagtgtctgtccaaataagtgggcaccgtagcctagaaaagttgactcctaaaattaaccattgcctggcttactggctgtatgagcttggccagccactgagcttctctgggcctcagcacctgcctctataaaatggggataaccaagccaatggcatgcaagggttagcaggtttcaaaccaaaagtgaatttgcagtgctgagcacagtacttggcacacaggaggtaagaaagacacattcaggctcccagccaggtgttatgaagggccatgtgtcacaagt

SEQ ID NO: 10810 - DNA, 52896 bp, Homo sapiens
atgagttctaatcaaatggctttattcaaaagcctaattttcaagaaagaacatgctatgagtaaaaagtagggtcctggaactagccataatgcataatcgtactatgaaataataaagacaactttgggataaatttaagaaaaaacaatgttttatcaaaagtaactaataatattgatctttatatttgaaaaaataaaatcaccaaatgatcaaaaaagaatttctgccttggacagctgatatatacaaaagtgtgtttaatatgcaaaacagaatcatagtaatttatcaccatttaagaagtggggactactgtagttgatataatatttgtgcatacaaatttgtgattttatcttcttaaactgtgtcattttcattacttccactgagtagtcaccccttattcaagttttgctttctgtggtttcagttacccatggtcaaccgcagttcaaaaacaggcgattgtagaacaataagatattttaatagagagcgagaccacattcacataaccttataataattataattataattgctctattttattattattgttaatctcttactgtgcctaatttataatttaaactttatcatagatatgtgtaggagaatacatagtatatatccggtttgatactatcctcggttgcaggcatccactggcgatcttagaagatatcccccccgtcgataagggggattactatatagtatctttattagccagaatttccctaagcttaggttgtttgaatcagcgtggaaggatgttctttttccacccaaccccccccaatcctacctgttaaaaattgatcctctttaggactaggaaggattgctgtttttcaggacccagatcaaattcattgcatccacaaaatttccattattctttcttactctacactcaagaatctatagctccttgtattatggaaaccttggcactatatttttactttaccttatattatttcatgtatttatcttatttttttctcatctccactgtatgtctattctataagtttttaggacagggatttttgtgccttgtttacttgtatatcatgtaacacaaggccataataggtgtttactaatatggcaactcaaattgagtaagaaagttgaaccatcagcagtgtaagactgattaaatttttgaagctagagcaaatgaaaacaggtcattctttttatttcagtttctgtgattgtaataattagagatttttattgttaccctgctttcattttaaaacaaggtttttcaaacaatctcacttgtttatacctttcacattaggattcttggtccaaatttgtaacatgagcttagttttttttttttttttttttaacctcttgtgactatgtgctactgatctctacattttgaataatagtgcttacttatctgccagcaaagcaccctggaatattctgctacagaattgtaacatacacctacaatcataacattcaatttgaataaaaatataaaatatccaatttaaaatcacacacagctaaatttctctgtgggccaaaaatgtatttagtacctccacttctgtgagatttcacaacttaatatttttgtgttttatttctttaatcattgtcgcatgtacaatatgtattagaactttgaggtataaaaaaaatgcttaactaaattaaaaacttttcctctcaagttctacatcaaacagttcgttaactgcagacgtaaattctggatttgccaaacgtgttcgacaagataattcaagtgagaagcacttacaagaaaacaaaccaacaatgggtatgtctcagcttttaatttgatatttaatggtatgactctgtaacacacatatagtactttacgttttttattgtgttttcataagaatctccctttattcatcacctttactatgtggtagaacaagtatgattatccacatattatagataaggaaactttaaaacacaaaagcatttacccaagatcacacagatattatattggtagagccaaaactcaagaaccagatcttaaaactctactttctacacccttttagttatccctactgtctcataataattgaaataattggctaaatgtattacttaatgttactaattaagtgtattttgcagataaactatacccactttaaatttttctcttagcgtaatattttgaataatttggcctctaactcaatgtgtaactactacacagattccagtctgtatctagttacaatcatattgtaactcccattggcaagttggaaaagatactgatggatctttcccatcagtatgaaagatactacattccatcaaccgcatatgggagtgacatgagtttatggtaacaaaaccacttcagttaaactagtggtgtatcatgccagccagttttcaggccccaacatctagacctctgtctctgatactacagttcctaagacttcattcagaaactatttattcactaggcatttaccatgtcctgtgatgaatacagagagcagtaagacacagtttgattgttctctataggaactgataattatagcaaatgcaatttaaaggtgtctcatgatataatttttctaaggataacatgaaagctattgttagtttttttctgtcgatgccctttgattagagtaatataaaattcctcagtaactttgtcaaactatattggtaaatgcctgcttcctgtagtagccagtgtttaccttaagttcaatggaaattgaagcatcagacagcaaattgaaacatcagacagtaaggtagtaaagtacaaaatttaccttgatcatttggtttgacatgttgtatttaataatgcttaaaaatgtgtatctgtagttagtttaggtgtgtactgccccactgatcttcttaaaaagttcttcaagaatcataattctacagccaaataataaatttataaaaactctcaaattggccgggcgccgtggctcacgcctgtaatcccagcactttgggaggctgaggcgggtggatcacgaggtcaggagatcgagaccatcctggctaacatggtgaaaccccgtctctaccaaaaaaattttaaaaaattagccgggcatggtggcaggcggctgtagtcccagctactcgggaagctgaggcaggagaatggcgtgaacctgggaggcggagcttgcagtgagccgagatcgcaccactgcactccagcctgggcgactgagcaaaactccgtctcaaaaaaaaaaaaaactcaaatcatagaacttggctttttctaatatgcttattatctgaagatacaaattcatcaaatatttcatgtataaagagatgtgagtaaaaatatctactatggggaaaaaaaagtgggagatgataataaaccacaatgcttgccaaagaggtattagtttgtaaggaaagatattttatatacattataatgttcaagtgaaaaatgtattaaaccagttttctaactaacaatgtacaaataaagaaacataggaccatcagtagggaaaaaggcaactcctgttaacttagcagttagagaaataacagagagtgttaagggaatatgtccctctaaaactaaaacctaatatggccaacaaagtggataagcaattaaactaatcctgaaaaaagtcaatggcaccctgttgtaacaacactttgttgagtagaaaatgacggtgaaagctaatgaagaaccagaagaatgggcataaatagaacatacttgagaggtggcagtaaaagaaaaaagagctataggattaagatcagccctttaggaagtactagatgcaaatgataattttaaaattggaaaaatatggaagtttaaatccctggggaaatataatccaaggaatgagaaaaaatggtgatacaacaaagaaaatgaagaaatgcttgtagaaatggtcttttattagtcagaaagaaagaaaatgaacatagtatttaattcagcgacttcacccgatgtctgtgtatgtgcacgcactcactgaaactttagtttgcaatatgaatttgaacagcttttaaaccaaaggtattaatgtctctttgttgttgttatattttaaattatgttaactaacaactatgaatttcaagagtaaatttttctttctatggtcataatttttataagttgaacgatgaaaactttttgaatgatatttatgccatatttatgcatctttttatttcttctctagaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagtgtttcattttcttgtctcattactacccctttcatactctaaaccagtggtccccaacctttttggcaccagggactggttttgtgaaagacaaaacctcagactgagagtagggggtggtttcaggatgattcaaacacattacatttattgtgcattttatttctattattattacattatatattacatatataattaaataattatataactcaccataatgtagaatcattgggagccctgagcttgttttcttgcagctagacggtcccatcttggggtaataggagacagtcacagatcatcaggcattacgttctcatagggagtgtacaacttagatccctcacatgcacagttcacaataggggtcacactcctatgagaatctaatgccactgctgatctgatacgtggcagagctcaggtggtaatgccagcaatgggagcggccacctaccactcgcttcctgctctgcagcctggttcctaacagaccacggttgggaacccctgttctaaactattattttatagaaaatgtgaattttgtagatttgtatttcaggtaagatcaagatatgtggcgccagagccaagtctgaaaataatccacaggcctcgtaatgataatgggaaaagatgtttcaatcattcttgctgctataggaagtacatggagctgcaacttaattatacactgtttacttgccttgcctgtcctgtttgtttgctgaatgtaacatatttggccaaatgcacttttaattttatgcagcacaggacccttcacaccaaagcaagcaagctgaaatattttaagcctttcagctaatcaagtttatccacttaaaatctggctgggagagtgtgagaataatctttgaggtccctttcagctctgacactggtgattccatatttatagagcatattcaggatgtgtcatacagaaaaccaccataaacacatttttttttggtcccttcgacatttggtttttggttgtgttgcctgtttaacaatcactttcacctctctattcctttcaattttaggtaaaagaaacctttttaccagatagtgacgagtggctaccatgattaataagtgactagacctcatggtcctcctcatactaaaaggtatgagcacgattttcttatataccatttttatcaggtagagatttggmcttctataaaaattaataaaagggacttttgtcatataactatattaaggggaagttggggtaataaaccataatgaatgggaaaagacagctattaactatgtgaatttaaactaaaacaagaatgctatttgataagtcactgtgaaaacatttttaagtgagccttatgtaaaaagtagatcactcataagtgaatatktaacagtgaattttcaaagtgaacatgcccacataaccagcactcaaatgatgaaatagaaaattatctgtacctcggaagactctcttacaccttctcccagtcatcacctccctcagtggtaacagctatcctaacttctaacaccacagtttaatttttaattctttcttaaaaaattaatatatgtacttttaattggcacataataattgtacatatatggggtacaatgtgatatgttgatatatgtatacaatgtgtaatgatcaagtcaggattttagcatatccatcacctcaaacctttatctttgtgttggtaacatcatagatctattttaactaaaataactaatttttatttttaaaaaaagtgttgttctaaaaaatgatacagaacagtacgaagtaaatgtgcttcctcctcactgcctactaatatcattcccacgtgtaaccactgttaatattaggttggtgcaaaagtaattgcggtttttgccattactttcaatggcaaaaaccgcaattgcttttgcaccaacctaatagtttaggtaccatgactagacatttacttttgttttttatatatatatataaaacaaataatatacttattatatatatttatataaaacaaataatatatttattatatatttatataaaacaaataatatatatatttatatataacaaatatatatatttatatataaaacaatatatttattatatatatttcaatatacctatattcttggatttttttatgaaaataggatcatacttgttatattgttttgcacttttcatttttattcacatttaaaaccatcatggacatatttgtaaaatttttaagtgtgaatttcataatactgctatgataatttttatatagtaaatatatcgagagaaacgtagataatggtctcttttgagctacactgttcagcatttctgagaatactttggagtagtcactgttatttctacattatgatgtgttaagcatgttccacagaacacaccaagtgtcataaacgacagcactgctataacatggcatatgtgttcataaaacacaaaatgctgtgcaaagttgtgcaatgaaaccacaaggtttatgggaaaaatggggttagtagcacaacactcaaaaggttagtcactgacacattaaaagaaagataggaacctaataaaaacagtggcctaattttacacgttaactggttaagaaatgtatgagtactatgacaaatatggcactttgccttgagaaggaaagtttgcttggaagttgatgtggaaggattgtagcttgtgagttactaggaaatgatggaaggagggtgatctgaattcagacaggaatttataatgccagatgtggatggctgtggcccactgtcatgaggtatattcattttgaatattctgatgtagcttgataccactgagtggagctttctgttcacctaatgtttcatccagatgaaagcttgtgtatccaggtacaaaactcacattaggcccaaatggttccctaatgtaccaatgccataggagcaaatctgtactttcaaaatagttacagcagaactgacwatatatatatatatatagtatatatatttatacacacacatatatacagcaaaactgtacatttatatgtgtacatgtatacatatacaaaactacatttatatgtatacgtgtatacatatacaagcatctactacagaaaacatgctatatacatatacatgctgtatatatatatatagcagaactgactatacatatatacacgtgcatatgtatatataattgttaaaccgaagagggattcatatttataacaactgcattttgttttatattatgctttgactcatatttaaataacttggaaatatctacagtaactgctcaacaagagctttgatgttaatgaagttgcaaattctggaatcagataggataatctgaccttactctgagaacaacttccaaccacaagccttataaagtgtccctttatttgtaaaggggccctcagtccacatttgttaatgaacacgtaataatagtcatacttttttgagctcttatcatatgataaatgttttaaatgcatttttcacttattcctcaaacaagcttttaaagtagatgttacatttcatgttgaacatgataaatatgtataagttttatttatcaattaagtacattttttaaaaaagtaaatgttacagatctacaacttcttattcaattccaaaactccacagattttgaaaatcaggttttgtataatttttgtctgtaaaacctgacttctgctaatatgagtctattaattgtatttaccctacttagtataaacattcagaggctttgctgcagaaatgttaacattcagttatagagtattagcccagaccccaccagggtgagggtgttatgtataaatacagtatatgcactgtattgcatttctaaaacaaaaagaaaatactgaattataaaacaactacccatgaggatttcagatgatgatgtctagataacatatttagttttctaattgaaaaaggagaagatgcttggaaaattaagtaatttgccaaaaattccacagctgtacagtagcagaattgggatttttgaactaaagttgatataaaatacctctatctacagtgtggctaacactgcatatggatggctatacaaaaagcatctctcctacacaaaacaaatttgagtcacctgttcacttgtgactggtaattagctttaatttgtgggtgaagttcagtaaattatatccagatttgggattgattcagtgcattttataattataaacaaattatatctaactcaccttgtttatattaaaaacaaaaatgggctgggcacaatggctcacacctgtaatcccagcactttgggaggccaaagcagatggatcactttaggtcaggagttcaagaccagcctggccaacatggtgaaacctcgtctctactaaaaatataaaaattagccaggcatggtggcaggcacctgtaatcccagctacttgggaggctaaggcaggagaatcgcttgtacctaggaggcggaggttgcagtgagcggagattgagccactgtactccagcctgggcaacagagcgagattccatctcagaaaataaaaaaaaattaaacaaaaataaagtattgtgatttgtacatgtggaaaagtcattagtatcactgaaggcattcacaaatcctatggactgatttttcaaggatgttgtttctttacaatcaaaatttcacacatatattgctttttgcgtattcacaacttactcataagttgttaaccactcaaggtaagatatgttacaaaatcactcgtttacatcctcaatttttttgtgttaagactccatattcaaagtctaaaggcacaactgggacattaagacaaaatrtaaacatacgtttcaggaattagtacagggcaattgtttttgaaatgtatatgcagagcactaagcttgtcgcctcctatgacttcccccaaagagtagtaattgatagatagtccatacttatctgaatgaacatcatcttgacaaatcactcaatccttgcaaatggcaaattctacataacagccactatggggattagtccctcaagttaagaccttttggggaagtttagttctgaagtatttctgtcatttatatgtacatacagatgctcctcaggttatgtcctgataaacacataataagctgaaaatcttgtgagtcaaaaatgcatttaatgtatctaacttaccaaacatagcttaacccagcctaccttaaatatgctcagaatacttatattagcctacagttgagcaaaatcatctgacacaaaggctattttataagaaagtactgaatatctcatgtaatgtatttaacactgtactaaaagtgaaaaacagaatagttgtacggtttctctcacaatgctgggcagcagcagcaagccgtagctcccagtcagccacacagttcaacttaatgagactttgaatttacgatgggtttatcaggacataaccccattaaaagtagaggaatatctgtatgtgtgtgcccaagtgagatataagacaatttttttcagaagtcataatttaaatatatatatatgcattcttatacttttaactagatggaaggtgaaaggtacctgtataattaagaagagtagagacatgagaggaaaatagttctatgatcaggaccttggacacaaatactgtgtcttcagccttatttctcatccctgcrgaataatcttcccctctgcaagccacttctcaaatatgaaatgctgaaaatcctttctaatatcaacacccttggcacacatccctttcccattatctccttcagtgtggttatttcagaatcattgtaagtctttttaaaaatttttaacccctcctgttcttcccaataacaattgttaatgtagattcttaacttctaccacagttcttaatcaatacaaaatgctacttcaaaatgttttttcccaagtgctctgttcccctgaattcttcatatcaagttaaaaatattaatctacccaaattaagtctgaaagatcaaactattttattagtcttcagttagctctgctcctacactttgaagagaatcttctcactcaatgtacatccctggcaaccaacaacctctttaccatcttgtgctacagagtattacctaaaatgaccccaactcagtaaaatgtccccatctaccactgagcttaataatcaccacagtgggctttgggcctatataaaggtattttctaagtttgaatgcatacgtgggtatttttaattattagatcaatgttagagagcctgtactttttttctaaaactttaacctgtttcaactactaattattttacatataaaaccttagttttctatataatttaaagagtatggtgaatttctgattttttgttaacatcttcacttacaatgcaatgttgagattcattttgccactcatcctggaactatgtttcttttaggcttttggttaattactaaattttgttcagtctttctagccttttctttccaaaagtaagtaacatttaaacctgtaaacattatttgttatagtaatatttaaatgttttacaagttaaagtatcaagtatttgttcatatctacactttgatatttgagtggtatagtagacatctgctattttgccaggtccacttaacctgaatttgattaaaacatctcacttctttgggaaaccactcctttcctcagtgaggtcccagtggagctatctctgtgtgcgcacacacatgtagacacacactccactcacgcacatgtaaacacacctgtttttccccagcacattaaggcccatcagtgtaataatcatcaaaggtcttcctgacaacagtgattggttccaagaggactgatccactaagattgtaagagactttttgtcccaggttacaaggtataagaatcatgtaagccttaatctctggcgtcttccgcagcttcatggagaaagctgtctacagaattaagtcaacacagaaaagtgagcagaacctagaaaaggaaaaagagaaaaagctccagatgacattgtgtgagctcctgaatccaggtttgcgtgaggctacctagattcaacccctgcactgccaaattccataaaccaagtaattccctttttcacttgagccaaatttttaactctatgctaagataattatagattcaaacaaagttgcaaaaatagtacagagatgtcctgtgcacgctttacctastttttcccaattgttcttaagtaactgtagtataatatcaaatccaggaaattgacattagtgcaatacgtgtgaatcattctatgccatttcatyatgtgtgtatattcatgtaaccaccaccaaaagtgagacgcagaattattccatcaccacaaacttctccttcctatccattcttgcctttggcaatcactaatctgttctccatctctataatgttgtcattttgagaatgttatataaatggaataatatagtatatgaccctttgagattggctttatttttcaatcaccttaatgtcctttagattcatccaagttgatgcatatatcagtagttcattccattttattgcttaacaatattctatggtgcgaatgtaccacaatttgcttaaccatttacctactctaggacattttgattgtttccattttggggctattacaaattaaattrctataaacattcatgtacaagtcttgtgttttgagccacttttattttctgtccattgcaaccaaaagttttaaataattcaagcagaaaaatgacaaagcagtgtaaggaataaaaattttcttcatctttatatattctttcatttacccatgaaatagaaagtaacatttcctctctttctctgagaagaaatagagaatcttctttctttactttcttattcactcttcccaaaaagaaatgatttgtataatctgggattgtaaaataccatcatccatcgttccacattcctctattgggttgagttaaagtatagagcattactactctatttcatgtgtagccaaccctcttgctccattttctcaaatctctttttgccttctygtggcctttgttctcccagtttttacttccatacagtaaatagccacggtaggtacacaagccaagagccccactgtccttctcttagcatttccatttttgctcatttgtgttcaaagcacattggttaggtcatgtttcttcatggggctggcttgataagaaccaagatctaaacttggggaagaagtagcagaaarccctttattttgttagtacgcccatcccagatcttatttatgtctatttctcagttggttttgaatccagaaaagagatgtgagagattcgtttttcccaaaactcccaacataaaacrcttatatatactatatgacctttcaaagatatgccacatttaaatttttttatttgtataaatttaaggggcacaactatagttttgttacataaacatattgtgcaatagtaatgtctgggcttttagcgtaaccatcacccaaataatgtacactgtgcccattaagtaatttttcacccctcattcctctyccccattccaccctctgagtcttcattatttatcctttctcactctatacccatgtgtacacgttatttagctcccacttataaggaagaacttgcagtatttgacttcctgtttctgagttgtttcacttaagataatggcctacagttttatccatgttgctacaaaagacataatttcattattttttatggcttttgtaagaattttattattttatggctttttgtatttcattgtttatggaatgtgtaaaggacaaggacttacaatatatatgtatacacaatagagtacaaaaagtaaatatatatatataaatgtgatatacatatatcacattatttatatattatatatcagggtgatgatggcttgaagtctaatctgttcatattcactccctcgcctgcccctcctccttgatagatatagatatagataggtatatctcaaaattagaacattattttctgagtttctcaattaaattatttcctatgcamrgatgatccataactacattattcaattccactgactccttcaactaagtacctgtcctcaagttttcatcctagcccaaactatctttattatagcaattaatgctaccatatttttacatttttacactactataacatacattttttacattactgttttttactcatgtatcttataaaaatctaccaattttcccttataaccaatcttccctcctttcctaataagctttttttttatttaattgaaaaaaaagccaaaaattggtatcagtaaggcttgcatttccctgcctggccatcattggcacatgagcagcaaagccaggaggaaagggaaggtatcaaaaagagatatacatggtaggaaaagataggccatctattggtaattacagcaacacaagcctatgtatcttggccatccttcacatggactttttaaatatcagtgtttaactccactaaatacatgtattggccattaatttgataaaggcccccttatacttgccctctggagaataaatcattcaagcaatttggtgcttacactgctaaaggctaaaagtccatgatcctaaatattgctttcaaagcctataatgagagagtcttcccttttggttatcttgtctgttttaaagcagtgaacaatcctaattggctctttgtagtacccagccagccaaacatactcccttaaatgcttcaagtactttgatgatcttgaagaaatgttccattgctgtctttcctttcatgtgaagatttaaaggacaagccttgagaactaattgaactaaataaactgtacaggtgaactttagcacttcttggtaactaacacaataygttttgactcctataataattatttttctgtagaggctgcttcctcatgcttataagtttaatttggcaggcaatattatataaagaaatttgattttatttagtaatcttcatatctcccttcagatcgactcattctgcctcccaaaaaaaagaaattgtggataaaaattcatgatatttaacatcttttgtagatattgggtaggtttcatcatctttttcccactattggaagttaatttttaaccaaggagggtgggaagtgatggctgtcagaattagttggaactcttttcaaaattctccatctgtctgtaatttagcatcattgctcatagacccaagatgatatagtcgattgcaaagaaatgacatttccagatgaaatccatttataaaagtaaactaatcccctgtcatgaccttaatgaccattagagagtcccttagcaaccaaaaataagctgtgaggaagagatgaatgcatttattcattcatttcacatgtgccagatattaaaattttctagtttcttccttcaattcatttaatgctcattttttgcacacccaaaaggacttgatatttaattcttttataaactgtaaacatatcacagtggtatttggatatcttacagactttgtctgtaaacagaacttgcttcatggcatattccagatactagcgggtacaaaattttatatacttaacaagttcttcaattgaatgccaataatttgtaacattcggataggaaaagcacatttaatacaatgaatgttatttatgtttagtcttagtggccataataagggctatctgtaaaagacatttgcaagataaattctgaattataggaagcatcttgaaacatatctacacctaaaacacatatttaaatgaaaattaaatattctacatcctatcatattaactaatgccagatggaatgtaacataatattgcacaacttagcatgactcagcaatgttagtggcttggatttaaaatatttttcaattgtaagtggcattagaaagaaaagtgttaggttggggaaagagagaaaacctgttcctgaataattaagtcttcagactattacaatgctgaagccagttgctgctttagttacccatctgtagcaaaatggaccttttatatgaaaacatgtctatttttgaaagggtcaattagcctctccacagttgtacattaagaaatattcataatggtaaaaatttcaaatgaartcattgatgcaaagatgaaactacctgtaccttagaagaaaacaaaaagctgagtaggaaaacacccattgtaaatattcatgagacaatcacagactttgaaaacttatattttgtattataaaattaactcacatacaaagagtttggaaatgtcatctatgtttattttacttaactaaaatcagaaccaatagtccaataggtttatataaccataaatgttgggcagaaaccattgacttatttataggtaagcttgcatttcttgagagtgaacctatctctacttaggatgtgaaaaaccataaagaaagtatttcccttataaagaataaacaagcaatgtcatattccattgcatttttgttgtgtgatgttcatggcaacaagactaatagggtctatgaaatccaggatcacgttgcatttgtttacccttatacgccagcacctaacacagtacctggtcctatatttgcctgtgttcaagaaatgcaatgggagaccctaatatggttcacatggcatttgccagagagaagcaaattgcttaatctaggggaaaacaactcgaatgctgtacaaatagcatggtgaatttatcttgtttccacagtaattttaaaagtgacttatttcttataattatcttttaaaatatgttctaactcctccagattggcctaggtcatatgttctatatctctcaggtagggagtgagtcatataatttgagaggtatatgctatttccccttcgtgtgggtagagggatatgcgtttctaccattcttggcaaggctgtcattgtaggcctaaacattgagttgttttgttttgttttaaattataacttttgtcaaaatttttaaaaatcacatcttaacatattggactttaatgtaatgtcaacattatgaaataatcacctggagttataactgtaattgtttagatagtatttttagctaaaagtaaagaatttctttcctttgctaaattaaaactcacgtaacacatccagtagacagcttttattagtcctgtgtaaatttaccctgtcaatatatttaaaagtttaggttttgtagtaagcccataaaagaaagaaaaaataatcatactttatatgtaaattaaaggttttattaatatttttatgaatgagaattgcatggaattactattagctctaattggcctgaataatctcaattagaatagaggaattgggtgttctggtcattttaattgggatttaacagttttaaagaagtttttttatttaaagcctttttgattttggccctttaaaggaaactctattttctcctctccaaggagaactccttgtttatctctattctaaatactcaacacttcactacattctcaaaacttcactctgacaccatatgtgtggatgttttgctcttactaaccaattctccaactctctgggcaccaactgagtatcctgcaattcagttatcacattgactacctgaggttagtgcacatcccacgggttaagggcttagtcccacaagactacttcccacttcatataccaattgcaagtaaaggtccccaggttacccatacatctgtccaacgtggctacaaattgaggttcccaagacccctctttgggtttggtactttgctatcaagacttataggactcagagaaacactttaattatgtttacatcttcaatctaaataactaacaaaagatctctaaaggaaaattatacacattcagaaacagcattgcaatgggagtatgtgtgctataataaactatgtatatattcaaggaggtagatgaagacaaagtttaaaaacaattgaagagaattgtatgattgttttgagataattatccttgactacaaggagcaataagaagggtgatgctagtcagaaatyagatatgcagttgttgggcaaatgtcctcactgaagtattaaaaaatagattttgatggcctttgtgcaagtttgcagttttggcagtatttggtgatagtttggttatcaagcatttatgcataaaaacccttactttataaccttcctggctctatttgtcaggattttttttttaacacaagtgattccattttgatctgacaatgttcacatttccgtcttttgatcagtatcgttcttcaaaagcatcactgatcaatcatctgtagttaggtttttattgtcccctggggccaggatggacctatcgcagtttgttagtctagtcccacatcggagggagtgattgatagcttggatttagtttcaaaacccttttagccacatttgagcaatatgaaagttttgaagggagtagtcctgaggctaagtctacctagagtccattaataagttcaattttatctgtttcattgtcttttgctatcaatttcaaagtgctggcccagcattattttgttaagggttgtacttctgcagaaatttaactagtaacaaatataaagtctaaaaagggaaaatacaaagtaaaattaacagtaatatgtcaatctcagtttgcataatgtttttgagccaaaaacctctgcttaaaggcaaccaattgaacaaatcaaacgcctgttaccctgccaagtagaaaaggtagacattgagaagggtaagagttttattacaatatatagtcttgttttagtgtcttggaaaaagttgtctacagcatgaaaacatcaatttctcatcctgacttgtagtttaaatatctatggtatgacatcagacagtttggtgaactttttatgtggcccatacatcagacacaacacttgttccttaaaattcatctagtattagcttgcagggctttacgaacagagcagtttccattttgagtaacttcatgaaaaaagtgttattggaggaatatagaaggattaaggatctagtctcgtttatatgcagataaaaacacttgaaaacaatatatagagttgcaatctaataacaggtgtattatagcttttctttaaaaacataactttttctctatatatagatcacataggaatctcagattttaaaactttttgaggttaggaagccaaactaaggcagattttaaattttagctacattcttaaagttcctgagcctacacagaagtgacaatttttttttactcactgtaaggctgggaacccttgaagccaggtattctatacacatactcaaatataatattttatgcaaagccttggtaatataaccagttgtatcctaccataaagagagagcagattattattagacatacaaataaccatattgacctaggaatacacaggagtagttttcaaattttagagtaatcaagtaggcatataaatcaaatgtttctatctttattttaaaaagtatacttttcataatatgagaaacaaagtgtttaagtaaagaccaataatgtttcaattaaatgacataaaacattatcagttattcactctcatgtaattattttttattctgcttgagcatgattagaagttttatgaacccatcagtttcttcattagagttttgaaaaaacttaatttagtccactgatcttaaagttagtagaaaactgtattttagaatacttttcagagtctcttccgggaatttgattgtgaatgcctttagagaagaatttaaagcaataactatagatgacaaaaatttaggatagccatggttgaaaatctgatgtaaattcattataatcagtaattgaccaaaaaaattatttttttgtggcataaaacatcatatccagaataagactgatgacatagttgattactgaaagttttatataattttaggacatacccataaatgtaactgaaaaaagattcagcatcacttaccatttgacaatgcttcccatacaatttaccaaataagcctaataatttaatatgtctacaagatgagagatatattatttgatgctctacaggagcccaagtggataatctcaaagttaatccttggtcaaaaatacttaatttagaatgtttatcctggggaaggctgtcaaagacatcaaaacattcaaaatgtttgactaaagtgagagtacatgtcactatgaaataatagtcattaatttaaccagaataataattgaaagacttcaaaagcagtacagaaaggtacatggatgtagaaaccttgagcctttcaaagttcactatttctaagtaatcaaaaacctaatagatataactcaggaaattatcctgataaaacgtaagttattttttagtccagttaccaagaaaagttaaaaagaaaaaaaaaacttttatgtgattgctccttcttttgggaagcctatttagataaaccagaagtcaaaactgatgaaaaagatacttgaatttaatcagacacaggaagagtgtgtccaaggttacgagtgctaattatagtcaacttggtcccacacaaaatccattttatccacagtatccttcatgaaccttattatgacttgctcaaacctttgacaacatgtttagactctgtttgtcctgtcttcctctttcttaaataatcagtcatttacttaaggacaaaaatttatcacacaagattctttctcattcaaaattatttctttttttaaccttccttaccaaaaatacattttcatgcctataactttcttcacatatttttctcctattttttcctttcaacctttatttatttccttcataaatctatatttttaaacaacctttagataacctctgaattagatgaaattattttttctcaatgaagactacatttttatgcctttcttataatttttctgtcagtaaaaatatctcatttttggtgctctttatatacagaattatatatataataattagttataactctcagtaaccttaatttttagcaagcaattttgaactgtcacatatcagtatctgatagatgaaaaccattttacacsttttagaaatctgtttcctcataacataattgttatatgtataaatacaccaaataatrtgatatatttagtttttttataaaattttaagaagtaaagaacaaacatgttattatcagtaatatattttagtttttatcttatttggaaattacccagatatttaatctatcacttaataaaacataacataatttaagattttaaactacatgaaaagtttatttataaatatttactgcatttacatttacctactttatttttaagtattataactagattacttatgaaacctaagatattagacaaagtcaacatttcaagttattttcctcttaaccatttttataccctgtgaatatcaggtgttcacctaagtaaaaaatatatggatattttctggtaactcagaagatatacctgttcttgttaaaaaccaacaatattacattagccttagtcatcaaataattatacaatcaaagatcatttagtgttagactaaatttatagttttataacctttgtatcaaaccttgacacctaaaaagagacaaatatataattgtctgatgagtaaacccaggcaaaaatgtatgctattttgaagacatttatttttattttaccaacaatataaaaaccagctttttaaagatttactcaagtcatgtgaacaaaaagccatttgggttgatgactgtatagtttatataagcactaatgcatgtaagccaatctgaatagaatttcttaagggatttctggttgactataacagttttcaccatgcagtcatgacatacagcttaatacatgtacatgtgcataaatatacctaaacacatgtacacacccaaaaatagtattgcttttatttagaatattagtcttgacacagtaaaacatactaactcacctgtttgtaaaagacatttagatacaaattatatttctgttaacattcaattttcaagctgctgataaagacatacacaagactgggaagaaaaagaggtttaatggactctcagttccacttggctgaaaaggaaggcaaggaggagcaagtcatgtcttacatggatggtggcaggcaaaaggagagcttgtgcaggaaaactccccctatataaccatcagatctcatgagacttattcactatcatgagaacagcatggaaaggacacacccccaagattcaattaccttacaccaggtccttcccacaacatgtgggaattatgagagctacaattcaagatgagatttgggtggggacacagccaaaccatatcattccaccccggcacctcccaaatctcatgtccttatatttcaaaaccaatcacgccttcccaacagtcccccaaagtcttaactcatttaagcattaactcaaaagtccacagtacaatgtctcatctgagacaaggcaagttccttctgcctatgagcctataaaattaaaagcaagttagttgcttcctagatacaatggggtataggcattgggtaaatacagccattccaaatggagaaattggcccaagaaaggggctgcaggccccatgcaagtccaaaatgaagcaggatagtcaaatcttaaagctccaaagtgatctcctttgactgcatgtctcacatccaggtcacactgatgcaagcagttggttccaatggtctcaggcggctctgcccttgtggcttttcagggtacagcctccccacctggctgctttcatgagctggcattgaatgtctgttgcttttccaggtgaacagtgcaagctgtcggtggatctaccattctggggtcttggggacagtggccctcttctcacagctcccggtaaggactctgtgtgggggctccaactccacaattcccttttgtactgccctagcagaggttctccatgagggccccacccctgcagagaacttctgcctgggcatccaggcttttccatatatcctctgaaatctaggtggaggttcccaaactgaattcttgacttccatgcacccacaggctcaataccacgtggaagctacccaggcttggggcatgcaccctctgaagcaacaatccaagctgtttcttggccccttttagccatggctggagcagctgggatgcagggcacccagtccctaggctgcacagagcagaggggtactgggcctggcccgcgaaaccatttttttcttttaggcctctgggactatgatgggaggggctgttgcaaatttctccgacatgccctggagacattttccccattgtcttggtgattaacacttgactctttgttatttatgcagatttctgcagccgggttgaatttctcctcagaagatgggtttttcttttctgtctcattgtcaggttgcaaattttctgaaattttatgctgtttcccttttaaaactgcatgcttttaacagcacccaagtcacattttgaatgtcttgctgcttagaaatttcttccaccagataccctaaatcatctccctccagttcaaagttccacaaatctctagggctggggcaaaatcccaccagtctctttgctaaacatagcaagagtcacctttactccagttcccaacaagttcctcatctccatttgaggccacctcagcctggatttcattgtccttattattagcattttggtcaaaaccattcaacaagtctctaggaagttccaaactttcccacattttcttatcttcttctgagccctccaaactgttccaacccctgcgtgttacccagctccaaagttgcttccacattttcgggtatctatagcagcaccataccctaggtaccaattgactgcattagtctattttcacattgctgataaggacatacccaagactgggaagaaaaagagaagtttaatggacttacagttccaatggccagggagacctcacaatcatggcagaaggcaaggaggagcaagtcatgtcttacatggatggcggcaggcaaagggagagcttgtgtagggaaattcccccttataaaaccatcaaatcttgtgagagttattcactatcacgagaacagcactcacagtaaagacccactcccaagattcaattatctcccaccaggtccctcccacatgtgggaattgtgggagctacaattcaagatgagatttgggtggggacacagcaaaaccatatcacatggctaacctttatttaccccaataggtaatctaatgaaggatatggaccaaaattgggtaaagcagtttccattgtggtttggttttgaaagacctttttttttcagtttcaaatgagtggaagattcagttttcaatctttacattttagctagaactggctgaattgtataaggaaaataaaatctctaaagagccrtaacttttagtaacaaatctattttttgttggctagttggatttgattgactaatcagtgcagatggagaagtattttagcakggtcgtttttttgtttggttggttttcttttgggctcctgtgtggcagacaaagcaatttttatgatagatagagataacttatattattgctgtgagctcaaggttttgacctgtttgatcatctgtgatcttaacttctataagcacttatctagttattttcttttatagtatcaatccttcaattagctgttctgtcatcctaagcaattgttaggcaaacctgactaacaggtttacttaaatttacattttaaaaaggtgtctagattgttgtttataatagagctgttttaatttgtaagacattaatttgaaagccctttaagactgtttaaaagcttgactgaaaagccataagcagagagttttatttcaacaccagtagaaaagttagaaaattaggcagagaaatgaaatagagggatagagagagctaggaaggctctacacattaattctgtaattacaggggatttttagagagtctgaataatgatcaatcaagccttgagtctttcttaatgtaatttgcccatcagtttaaaaatgtgcatgagaacaggccataatacgtagtcagctagagtcccacaaacccttggcatgccttaatgtttgagaattccattctatttctcattaatctcttgaaagcaaagataattttataaatccttttggaccagtgttttagatggtagtggctgtggcagtgacttttaattagccatcctgaacccatcatttaaaatatttatttttgctttcagaaattttgaaataagtaagggaaaaaaccaaattatttacagatacacataaccaacccaaaataaaagcaaaatactaaattaggcacacagaaagaactaaaagtaaattcactaggaaagacactcctcaaagatagaatgtaaattatgtgaatccagagtgctcaaaccagaataacgcttgtccttataccctaaaggacttgccaagaaagataaaaagtattttattatcccagaaagaatgcaaggttcttcatttcagttggcttataacaacaataacaacaacaaaaaaaaaaagtcaggcacttctaacaaaaagagggaagcttggcctgacagaagactcacaatggcagaataggtgagttgtggaagcagggagctgaaagggctcagaagagtactgcataccagttccaaatattaacaattccttttgataatagtctttcttcagatcccacttctgacaccatttacgtcaacctaaaaaaccagagaggggctctctaaaagaaaatgatatttatttgggaatacggcattgtgatgagaatacatgtgccatagtaaaccatgtgcatattcagggaggtaaaaaagacaacggattttaaagaaaaaatgagcaagaytacacagtggttttgaggtaattaagataattatccttggctctaaagatcaataaaaagagtaataccagtctgaagttagacagccagttgcaagaaacatgtccttgcagaagtagtttttgtgtaaggttgtgatggcctttatgcaaggttgtggtttttgcaatcatttgtgatagtttttatcatcaggcatttatgtatacgaaccctcttttcatagccttccctggctctaattttcagattttttttttaataaacatgaatccattttgaatctgataagtttcacaatgtgtttgtcttaaagaatacaactcagaaacacccaaacaagaggaggtatggggaaggcaagtggagctccgaggtactcttcaggtataccactctcccagcacaaccaacctgttcaccaacatggaagctctccaaacttctttctcttgagtttttatggaagcttcattatgtaggcatgattaattaaatcattggccattggtgcttaagtcaatctctaggctctctaccttcccttcaattacatggttgggtctcttggcaaccagccttcatcctatgattatctaggggctttccagaattacctcactaacataacccaggtgtggttgaaaatagcttgttatgaataacaaatgatgctccattcacccttctgttatcacttaggaaattccaagggctttaggagctctgtgacaaaaataggtacagacaccaaatatatatttcttatcacagtatcacagaccctaattgttgaaaattgatattagaaccttacagttaaagaaacactatgagtttctttccatcccacttaaccttccgtgcagtgctggaatctcttctatggtattcctacctctttctgaaaattttaatggataggaaactaatgtctttggaaggtaacacactccattactgaaatattatcattgttagagagttctgatttctattaaatccaaatctggctcactgagactttggtccgttgtttatagttttattcttgaaagcaataaaaattacatatcttgcccccaatttaacacttatacctaacataaaatctgccatgaagtactatcaatgatttgttatataaaaattacaggaggtcattgttttggactcggctcctgtactaggccccaaaaaaccagattaaaaataaaaatggactcagctatgctgaagtaccatttcaccaaacctgaactaacttgatatgtgacttagtaattagaagagagaaataacaatttcccaaacagaccagtttaaaatctttaatcagcataataatgaagtttcctctgctttaatccttattcacaaaaaaggtagtgtaaagtaacctgatgttatttaatgagttatttttctattcttctgtctaaaagtaactaatatactctttgttctttgtttctgcttacttcagcccttctctgtctataatgctaaactcctctgctcagcccgttggaacacttattctattttatgaactgaaatgttatccaattctagaatcacaaataaagccaatagaagtatttaaattaaatttgttgtaattttgtcttttgacactttcttacaagggcttgataatgtcattgggaatgacccagttccctaatgtttgcatttcttgtattggtcagaaatgccttcagctgcaaggaaaagcatactcaaatataatagcttaagaagtgaagacatgctcacataactagaaatctagagataggcaattgctaacgtttgcgcaacagttcagggatgctcagggatattttctctgcagttctctaggtctttatggtcatttcctttgtctaaggcaggaagaaaaaggaagtgctatatcttttattttctcatgaaagcaaatgctttcccaaaagtcctgcaaccagactgcatgacttatttaccattaggtttccagcccttaatagaatatggcacctattatgtgagcactaaatgttataaaattaataaatgaatgaatgtcttatatcaacacaaccatatgagtaaaactctggccttaaaggtattctgactagaggagagataaacataaaattaaaatacaaagcaatcaaaaagctctcacttttctttaaagggaaaggaaaacaatcataaggaagcaaagtagacttatttaagtgttatttcttgcttgctagtaatttaaaattgacaaagggagctccagtggcacatgtttaatgattattattttcaaataaaataataatagaaaacataaaataagtgatcaataagttggtgttgtggagtcttccctggtaaaatctcaaaacaccaagactaaaagtaaartaacaaaagttttaaggaaggaaaaaaacctgaaagcttgtgagatatccaaaaatctcagacttcattccagatctcctgaatcaaatctgtatgttagcaagattcccaggtgacttagaatgtgcacatcctttcatttttttcctcacttcaccatccatttctcttaattacattattatgtaataagtgttctattcttttacataattgtactgaagactcccaatattattattatattttgtacaagtcattgatatagaactaagtaatatggtttggtctgagatgaaggacatgtgtactttacatcagagtttcacgaccttgacactattaacattttgggccccactgttctttgctatggagggctgtcctatgcactgtaggacgtttagcagcattccaggcctctactcactatatgtcagtagcaatctccactccagttgtaaaaaccaaaggtattatcagacattatcaaatttttccaggaaacaatatagtccctgattgagaaacaatgctctacattaaaactttgccatttgataggaatcttccaagccatgtttctaaatttctttttatatctttttttaactcttcagtttataaccagctgccactgtttactgtatgttatgttattctattacaggcatatgtccaagatattttgggttcggttccagaccactgcaataaagcaaatatcgcattaaagccatcatatggacttttttgtttcccagtgcatataaaagttgtgtttatactatcctattagtctattaagtgtgcagtagcattatatctacaaatcagtgggcatgccttaattttaaaatgccctattgctaaaaatgctaacaattatctgaaacttcagcgagttatagtctttttgctggtgaagggtcttgcctcaatattgatggctgctgactgattagggtgrtagttgctgaaggctggagtggctgtggcaatttcttaaaataagacagcaatgaaatttgtcacatcagttgactcttcctttcatggaagatttctctgcagcatgtgatgctatttgattgcattttacctactgtagatgtttcaaaatttgaggcaatcatctcaaactctgctgctgctctatcagctatgtttatatcatattctaaattccttgttatcatttcaacaatgttaacaacatctttacaaggaatagatggtgaactttctcaagaaaccactttttttgttcatccataagaagcaacccttaatttgtccaagtttaatcatgagattgcaacaattcgtcrcgtcttcaggcttcatttctaattttaattctcttgcatgtccaccrtatctgcagttactttcttcactgaagtcttgaacccttcatggtcacccatgaaggttggaagcaacttccttcaaactcctattaatgttgatatttttacctcctctccaaaattaccagtgttctcagtggcatctagaacggtaaatcctttccaaaagttttttcaatttactttgcccagatccatcagatgaatcaccatttatggcagcaatagccttacaaaatgtatttcttgcataagaagacttcatagttgaaattactccgtgattcatggcctgcagactgaatgttgtgtaaacagacgtgaaaacaacattaatccctttgtacatctccattagcaatcttgggtgatgaggtgcattgtcaatgagcagtagtattttgaaagaaatctttctgagcagtaggtcacaacagtgggcttaaaatgctcagtaaactatgctataaacaggtacactctcatctaggctttgttatttcrtctatagagcacaggcagagtagacttagcgtaattcttaagagcccacagatttttggaatggtgaatgagcattagcttcaacttaaaactcaccagctgcattagcccctgaggggagagtcagcctgtcctttgaaactttggaaccaggcattgatttctctctagctgtgaaagctggcatcttcttccagtagaaggctgttttgtcaccactgaaaatctgttgtttggtatagcctcttttattaatgatcttaactgtatcttctgcataacttgctgtagcttctccatcagcacttgctgcttcacctggcacttacatgttctggagaagtcttctgttaaaccttgtgaatcaatctctgctaccttcaaacttttcttctgcagcttgctcacttatctcccagccttcacagaattgaagaaatctagggacttgctctggattaggcttttgcttaagggaatgttgtagctggtttgatcttctatccaaaccactaaaactttctctatgtcagcagtaaggctgttttgctttttttatgattcatgtgttcactgcagtagcatttttaattttcttcaataacttttctttgcattcacaacatggctaactacttggcacatgaagcctatctcagctttcaacatgtcttccttggtaaacttcatcatttctaggttttgattttaagtgagagatgtgcaactcttcctttcacttgaacacttaaaaattaggcaattggagggttattaattgacctaatttcaatattgttgtgtctcagggaatagagaggcctgaggagaaggagagagatcaggaaacaactggtcagtagagcagttaggacacaaacatttatgaattaagttccccatcttatatgggtgaggttcattgtgccccaaaacaattccaatagtaacatgaaagatcactgatcacagatcattataacaaatataataatgatgaaaaattttaaaatattgtgagaattaccaacatgtgacacagagatgcgaagtgggcacatgctgttggaaaaatggacttgctcaacgtaggcttgccacaggtcttcaatttgtaaaaaacacacaatctgtgaagctcaataaagcaaagtgtcataaagcaagtctatacctggatttgctttttatttggtactatatctccttgggtaatttttcaatagagggtgtgtagacatagacttcttaagttcttatttgtccaaaaataagacaattttggacaattaagttcttctttgtccaaaaatatctcaacttggctcttagtagcttgggtgattaaataattccaaatttagcattctttccacccagaactctgaagatattgcttcactggctcatgcagtgttgcctatgtgaagtctgatacctgtattattattcctcatagatttagggatatatctacttactacaggttgagttagataaaactggcaatgtgtgaccatttttttcttataaagcaacaagttcaggtagtttaatctaatatttgctatttgtctttttattatatttatattattatatttcctttcctcccttgatcaaattcttttgaattttttggttacatttttctttattagtttgaatgcatactttcttttactgtgagtaattacactagaaattataacatgcgccattgacttaccaaaatctaatggtacttggcaatgttacctcctcccagacaatacaaagacctttacacactttcacttcatttaccttctcttgacttacatgtttttgtgtatatataagtttgctgtacattttaacattaaaaaagttgctatctttatacaatgttgatttagctttattcccatcactttgcattttggttgctttccattcctcctgtgtcttctggatgccactaagtactcttttcttttggcctgaaaaatcccctttagagcagtttgtcttgtggattttatgagtacttatttactggagactatcttatcccagctttattttattttatttattttattattttattattttatttttttgagacakggtctcactctgtagcccaggctggggtgcagtggcacaatcacggctcactgcagccttgacctcttgggctcaagcaatccttccccttcagcctccctagtagctgggactacccacatccacctaatttttaaaaaattttttgtagagatgagggctcactatgttgtccgggctggtctcaaactcctaggctcaggtgaatctcccaccttggcctcccaaaatgttgggattatatgcctgagccaccgtgctggcaccatatttatacttgatgaatatttgattggctataaaattctaggttggcaggtgttttcttttagtgccttaatgacatccattccaccgattttaattaggaggagtcagggtcagtattactgttactcctttaaagacaatgtctttaatattttttccctttgtttttggctttctatttctacactttcactatatttggatgtggatttctttcttttctttcccctttctttttaaatcatgcttgaaactcaatgaacatctgaaatctgtagattgagatcttttatcagggaacttttcaatcattatctctttaaataccttatttcatcatgttcataatactgtcgattataacttgcatgattaattcacatatccaagaaaaaaaaagaagagactcatggctgattaaataaactctaacatacaccactgtcgcttaagaatttggatcttattcttcttgcagaagctctttttctaagataaaattgtgttatatgtcattgtttagatctatatacattggggttctgcagagaaacagagccaatatggatgtgtatacagaaataaatatatttattttgaggaattgactcatgtgattgtgaaagcttagtcagtccaaaatctgataggagaggctagcaggctggacactctggaaagagttttagttcgagtccaaaggcagtctattgggaaatcaagaagaaccaatattgcacatgaagtctaaagtcagtctgctggataattcccaccagcttagatgaggtcagccttttgttccattcaggccttcaatggattggatgaggcccacccacattatgaagcacacttgctttactcagagtctactgatataaataaatgtaagactcatccaaaaatacacccatggaaacatacagaataatgcttgacctgatatgtgggcactggggcccagccaggttgatacataaaattcatcatcacaatacccatcaaggaaaatatatgcaaaacaattaccaacatagatattcctaaaactttttcccactaagaatccaaattttcctaatcacattttgactactgtccgtgtatagcattttctcaaagattccataaaggaacaaaaagccatagtgataggctctcaatctggctttgaaattatgtaaagctagcctactactgacctccttgagaacattgttaaacagttctgattgagctccttcattccctccccacaaacatttgtttcctaggaaagtgaagagagtgctccattattgtccttgagattttattccaaataactgacctcccattctggaagttttcatggttatccttttgatattcaaacatgcacaagaatgatcattgataactgatgcccagcttcagtaaaagtgatatgctatcaactgtaagatacatctttatttagaaaaggtaaagtatgaaaaataaatatgcaactcaacatcaattaaagaatttataacctctgccctttcccttttctccttctgggactccaattaaatgcatgctaaatcttctatatatttaagtgtctttctccccaaatttttttttatcattttactgctgcgaaattcatcatataagtccttattttctattattgcattttcagttctagaatatctagttgattctttcacaaataagcaatgttccaatttgtatatattccaggtacttcttgaaatttttatgtttgtcttttatctccaggagtatttcaggtattattttacagttatattttatgaaagaaaaaaaattaaataaatgaataaatgcatgctagggaataaaaacattatatgcaacttgcaactacaagctgtgtacacaccacagatcataaagcgtcaatgatgaatttttctattagtttccagttcctccctgataaaacagtagttgaatatagaggtcacaagcaaactcagttagagaattacctttgaattctagccagataatcttgggcagttacttttttgagtctatttgtttttggttttttttttttagtctatttgtttttaatttgaataaatttacagggtacaagtgcaattgtgttacatgtacagattgcatagtggtcaagtcagggtttcttgggtatccatcatctgagtaacataccttgtacccatcaagcaatttctcatcatccactaccttcctctaccctgtgttttctcattatccactgcctttccctgccctcttctgagtctctgctgttgataattccattctctatgtccatgtgtacacatttttagcactcaattatgagtgagaacgtgtgatatttgacttttctctatctggcttatttcatttaagatagtgatctccagtttcatccatgtggctgcaaaagacatgattttattctttttaaagactgaattgtgtgtgtgtgtgtgtgtgtgtgtgtgtgtgtgtgtgtgtatacatatctcacaatttctttatccagtcatccactgatggacacaggttgtttctatatcttcgctatagggagtttcattgtctttattcatataattaagatagtaactgtagtgattttaaagtgttttcttggatcaagttagagtaagtatggattgagtacataatgcactaacatagcgcctgatatatagtcaacattgaataaatgtactctattatcattagggaagtgatgataaccaaccccttatctgagacagtctgtgtcttccttaagaatgtcttactctagtcacatgtgtggcacggattctggagtgtctgctgtttcttttaggacctttctactgagtctaaagctttgctgatgcgtttgcccaaaagtttgtacatatggtacatccttaatttctagggctttatccactgatgtatagcctacaaaaccttgatttcttctatgttgctctgcaaagtgctggccatgcatcatgctgctgttttctctctcatgaaagcattcttgtcttcatgagctttggcaattgtggggtaggagagaagaaaggaagaagggtgcagttgtgggaaaagttgaaaagaacatctaaattacctgtggcaatacaaaccacttcctgcacagagtccaaattagaaacagatcttccaatgcacaaaaataaaggtgctgagaaaacttgtggaccagtctgcacacctggcccccttagacttgctcagaagtggtttacaggtgtttctattgtgctttttacttatataacattttaaatctccatgaaggggagcatatgcccaccagtgcagcctgggaaggttacatgggagcactggataatcacaaaagtggaaaatgttagctaggtatatgaaagattgggctcaatcttgattagccccaggagatgccttgctactgtaaaaaaaaaaaaaaaaaaaaaaaaaaaacacaaagcagaatcctcaagtttaccttaccatcttttatttgactccttcctccttaaacctgatatagctggaaacagctatagaatagctggatgtgagttaagaaaaagtgtaatttttatgagggtagagtcatgcctcaattatctctgtatccccagggacaaccctgtgtcaggaacattattgctgctgcttaattcagaaacaatggtattgctgaacttggtttactacaaatgatttgattcatgattaatccatgtttacagaagagtaacaatacatgctttgttccccccaacacacctaatggtaaagaaaaaaatgaaatatttctaaaaacattactagacagtgtcaagatatttattacaatttttattcatgtaacttgggagcttatgaaacttctgtcgcttctctgttgaagctattccactctcacaatactgtatgatgtagtgaagattaatattaaagacatatcacgattatctctttaaaaagtcattttcagtttagtctgtaatattaacatgaattcactggccccagcccctgagaaggaaagttcactgtgatattttttctgttacaaatgtttttagcaagscttgctgtagtcatagtcactgggaaatatttagtgcctggctgtgtgcatagctctaaaacaaatgtgatgatggtcatttgggggcagagattggatcccacttattattaaccttcctcctttctgaggctaatctctccacctggcctctggtcacctctccttctgcctgcccctgaaacttagtccattagttatgctttttccagcacttaactcwttattcttctccttctcaggctcttttctcacaagttaattctttagttcaagaaacttcaatgaaatacctgccatatgctttacacaatgctggacactgggacaaatgcaaagaacattaagacatggtcttaccttctagattctagaagctcacaggaggttgacagctaaacaaaatatcaaaatacatatgcatggtaacagaggcatctaaaagttgccatgggagtaaatatggtcagatgtctcacctaaagcaattacggtcctccattcttcctttcattgtaaagtttcttaatgtagtattagaccatatgtactaatgtcttcctatgtgttgggtactatgcttggtgcttttacctacattattttttaatctccacaacaaatccagagctaagttgtattattatcctcrctctacaaatgagggaacagaagtagagagaggttcaatgacttgctttagatcacacagttactaaatagtatctacctgggttggttaagatgctttcagttgcaagtaacaacaacaaaatccttcaagctggattaaataatcaagggaatttattggtttttataagtgaaagaagtaggacgagcttcaggcaaggcttggtgcagcagctcagtgatgtaaccataggcccaagttatttctctgtcttttgccttctttgaaatcttgttaatttcacccttacgttgatccagcttgtggtagtgaaatggctgctggagtatcctgtatcacatgctttctgcttcttatccagaagagagaagtctctcctccagccatcaaacaaagattctgggcttccctttgatgctgtcacttctacccctgaaccaatatagaaacactgcctcaaggagaatgaaatgctgagagataatccttattgcctcctttactgcagagttattgggataattggatgggatgatgtatgtcagtacttagtatagtgctagcatacaggacggctcatagaggttacctattactattattattattaactatagttatgtgctgcataacaactttttggtcaacaacagaccgcatataggacagtagtctcataagattataaaactgtaattttactgtcccttttctatgtttgctatgtttaggtacacaaatactcaccaatatgttgcaactgtccatagtattcagtacagtaacatgctgttgagatttgtagcctaggagcagtaagctatatcrtatagcctaggtgtgtagtaggctgtaccaattaggtttgtgtaagtacacgctatgatgttcgcacaatgacaaaattgcctaatgaagcatttttcagcatgtatctccattgttaagtaacacataactatacttcattatatgtgcatgtattcaacattcattcattcaaccagcatttactgtgtacccttaatgttgtaggcactcttccaagaataccacagtgaacaaaacaaagttcatgctttttggagctgatattccaatagaagatcaatgagtaaataaaccacatatgaaaaaataaaaagtgaatatgtacaatgaagaataggaaagggtgtgggggatcaagtgaaatgaaagagtgcacttttataaagagtgatcagaaagtgatatttgagcagaagcatgaatgaaaggaatctgtgaaccatgtgtgtgtctgaatgcagaacattcccagaagaaggaacaacacatgcctttaacccctgtgttgcctctagtgttcagggtcccaggataatgcaaggatcataggaaayttctracagcgttttcaacaccaaggtgaacacttacagcaaaatgcctggaagccacacaacatttcatgagtcttaaaacccactgactctactatctgccagtgccagctaaacaataatataccttccactattttcccctccttttaactttgcaaactagtgctttggtataatctgctagcaagtcctctgctagcaagttttctgacaaatgtagttttcagtcttgcaacctcttcattaaatgggatagactcgaggaaggaaaatgaagctgagttgtcaaagacatttataggcacatttatgaatactatttttgtcattttatatatggatcctagagggataaatggagactatgtcccttatacttcttgcatgaataccatttttctcagctaagtttttggcggggactagattgcagtcaatttaatgttaaactctggtatgtgcctgggacctggaattttggctgactgtttgaaggctcatccatttttagttctatctgtgagaatgataaaggccagggtctcttataaaaattaaaatgcctagctagtgacctcaggtgttgggccattccactgccataccttatgcatgccagagaattggagaaacattgaatctgtgtaaacagttgccaaatgtcaggagttagtcttacaggattacaggattatgagggactgtacacagtcttcaggtgtgtggaggtagtaaagcctgtgagataagcttgtaggtgatgataacagatagatcagggtttatgtgtgcacttgactcttagtatgtattcaaaagacagaatatggtaccctctgaaattgtgataatgtaaggatgatctctatagaagttcattttacttattttgcctggctatagcttcctgttgttccctgacttaaaatatctgatctttcatttaacctcactcaaataagattgattgttcttaaataggattagttgttctgcgctagacttttgagcagctttacttagtctatgccattaaaattaaggtcctgacgttaaaatatgtttggcatttatgattttattatataaatctttaaatgatcagtggaaatttctttgcaggtgttttgatcattgcttccatatttaacagccattgcttccaaaagcaggagactgggttctaactaaccatattaaaaaaaaaatctggagaaagcaacacttgacccccaacttgtcatttgccaccaagaaaagcaaatcatacaatatgctgtcaactacctgacaaaactcaaggcccagttcaaacgtgtgtttctgctgaagacgtttccatctgttcaggccaatactaactctctacccatgcaactgatgatgcttatgattacaataataatggcaatagttgacataaattgcagaccttggcacagatggtcaggttctattattgcatctataggtgcaaatatcttttgatttactttttcccactaaaagagaactcagttaatacaggattaaagccctattcctttttaaatgccctgtgccaaaatggtttctagcactaagtagacattcaatacatgataactgcatgatgaataaatgaatgaatgaagtctgagtcccagtgataaacacgaggtttcttccacttagactggagacttgaatgtgtttaaaattcctttataggggtaatggtatctgctgatctctgctcattgacccagatgtggcctctggacttctcatcaatcttgttacctgatatcctttagtcaatgggctcttgaggagggagaaatgggcaaagagcctggagtaaatgagtaaaaagtggagtgggataatattatgggactaaatcctaaagaactggcaggtgtcagttgcttaagagaagaaaaacatcatagcttcaaatgtggggagtatcagtgcaaaagagatggtaatgtttgggattcccttcactggtcccaaggccctttcctatctattttcttatttgtactaagacagaaatgatctgccctgtgaaagagagaagaggtgattttacaaagagctataataaggaagataactgagctggagaaaagaaaaagcaaaggcagcagccctagagttggaagacaggagttctaattctggctccacccatttgtagctggtgatcccagataatttttatatgctgtataagcctcagttttctcatctataatataaggctagattcctatcatactaagttatcattaggactaaatgagacagtaaacacacacacacacaattgaaatgatacagttctaygtaaatgtaaggatttttttttcactaaacaggtgttacaattaagatggacaaaatttttataatgaacatatgtctctatacaaatcagaaaaaaaaatttaaacctacctaattgtatgtactttgtataaatttcagtccacaggctcaggagcacaaaagctcaccttcactatagctgaacttaatgtgtatgtagggctcttcattcccctttgtgacaggaaacttaattttgatcaatttagggtaaatcagccagttcagtggttgtgtctgtgtttctgaaggagcttatagggtattagcatcagaggtggttcctggtcctcagccatcacctctcccttatggcacctacagagccatttgccacccatcttcatgcctctacctggcttcactgcagtggttcccgtctgaaatgtctttacgagaaaagacctgctaacaagaatcctcattgctctggatgatggagcctgcatgggagcattccccactggctggtcaaataggggctggtcataagatttattttatctagaagagaaccggagcaacatttaaaacaagccaccactgaaatatttgctcctccaagcaccttagagaagatttggtgaagaatcaccctagttgtgtcaaagtagacctgaagaactttgacttgctcaaagttcctgatctgggtcccctgattccaggccatgagtccttcttttaaaccatcatatagtgtgtgagctgtcatctgagagaagcccagtaagtataccagtcctcagagtgcaaggaggcagttatttcataaattacatgctagtgttttattctggtcttttatttaagcaacaacaacttgagtttcttgagaataatatttatatttttggtgtgagtagtcttaatcctttgtagcatgtggtagggatataaacataccaacaaacaaatgcgtaaatgaatttgtgctctgagtacaatctgaattcttacagtggaatgcagcataataaatcaattaaatttaataaacttttacttagtgtgttcatgatgatgtcttgtactagcttccagatctaaacaaaataaaacacactgatttggccccaaaaggctcatagcatagtatgtaagtatagcatccgtaataccttttctggccaggaatggggcatagagcacagtgtgcagaaataagaaagagaatcaaagctaccatggaatgaggactaatggagtaccaggcactgatcatttaatcctcacaacatgtccatatggaaggtacaagcacattgttcccaggttcccccccaaaagagatcaaagcaaaccctccacttaagaaagctaaatataaacttttattacatcccaatgcaagatgtttccaatacaatctatttccttcaaaggtggggtggagaatgaggggtggggtttgggccacatatttttatgtttacattttatttcagattggaaaatttgtatttcactgtcaaatcaagtaagaacacatttattacttagtgttgcttgaaataatatctacaatgtttaaagtttcatttaaaagcataaacttcttttaagctcaaagttaaaaacacaaatataaactgcatttcatgttctgttaatatttagctgtgtggcaatggatgagtattttttctctgtgaggctttgttttctcatctggcaaatgaggaaattgatgcagatcatcttcaagttcccttcatgatatttaatataactatttatgtcatgcttgtaaatagtaggtgatgatgaaggttactgttccccacaggtgaatgctgcaatgatcattggtaggactgttaggctttgtttctcaagaggataatctgattgggaaaagaataagagtgcagctgcagcccatccttgtgaagaaggtaccagtgcgctctcaaagccaagtcttgaaaataatagcgaatgctgtattggataacagccatgccaggtgattcatagatttatcttatttaatcatggtaagaagcttccaaaagagttttctttgatgctgaaataaaacaaatatttagaaaagtcaaatgacttgcccaaggtgatatagctagtaattcacaaacattcacactagaaattcacactcagaagatgttcaaaaggggttgctttgataggtcaggctagggctgactgggccctgggctactgtaactaatcctgaaattctctaggaggcaagggttatcaataccctcacctgtagccctctaacaacaagcttgtatgttggtgttatgccacccccgcccccacttttcctaccacaaaagactcacatagtgtcagtacagagctgatggcatggattcactggcccgtgcagggggtttcaacatttgagccaacatttaaaaattaggagatcacacatgaagatgcatatttccagtttcttttcaaaaatccaaacatctagaaatacatagcctacactctagactgcgaacaatgaactggagccagggctgccctctgcctacattgcacttttgcacaaattataaaaaaggtgccccactgggctgagggaggccagtggggtcacagcttggtgagaagagagcaagctgaatttcacttgcttttttgattccatagccaaagcccttgtgcacagttgcttgggaaatagggtaattgcaatcatgcaccgttacccatggcagttctagccaagtggctctttctgcagatggtgcatatactctttagtttgatacaatctctaacactcccttaatcctctctaggagtgaggcccagtaccaattaattactaaaaatctatggactttcagaattctatacccagcccacttcactcatttctcttatttcctggctcctgtaggtcttttcatttgcaacycttgctctaatgagtcatggaagaagggtagcatggcgaccttcatatatatttgcaggaattctcaaaagataatggcaaacaggcaggcataggctagagttatcaatcttgagggcagctgatcccaaccatttaaatatttccacagatgaacttaagttcctccattccatgggcctacttggtcttccagcaaccaactctcctcttgaggtgtgtctgagcctcaggaactactgctggggtggctcacctgctccaaccattagctttgcccagactcacagctcagccactatggatttatccttaccttctcttaaatgccctgagcattccctttactgccctttccttatatctcatggagcactgactcacaaatcaatgtcaaaagtgccacatttgatcattccaactggacacaaccctcttctcaattaaggaagcaagcccattgctcacttaagcccattgctccctgttatgggctgaattttgtcccccaagaaaatgtgttgaagtcctaaccttcaggacctcaggaggtgaccttgttgggaaatagggtaattgcaaatataagtattaatatgaggtgatactggggtagggtgggaccttaatccaatatgaatgatgtccttataacaagaagagggctgggtgcggcggctcatgcctgtaatcctagcactttgggaggccaaggcaggcagattacctgaggtcaggagttcaagacaagcctagccaacatggtgaaacactgtctctactaaaaatacaaaaaattagccgggtgcagtggtgtgtgcctgtaatcccagctactcggggggctgaggtaggagaattgcttgaaccaggaggcggaggttgcggtgagcagagatggtgctactgcactccagcctgggcgacagagtgagactttgtctcaaaacaaaacaaaacaaaaagaagaggagagacagacagacagatgtgaggagaaccatgtgatgacagagacagaggttggcatgatccatctacaagccaaagaataccaaggattgctggcaacagccagaagctgggagaggggcatggaacaggttctttctcagtgccctcaaaagaaatcaaccctcctcaaacctggattttggactcctaaccatcaaaactgtgagagaataaatttccattgtcttaagccatccagttcatggtaatttgttatagcaactgtaggaaaccaacaagcttcagttaataaaaatcagtgtaagtctggcagcccaggcctggactgttaaaacaatgcagctgggatttatttcaaaaggacaaagcccaatgggcgaccccttggctttggcctgctcttgatagcctgggtgaactgagcagattggagactgcaaatttttctttctgtgtcttaaatatgaaaagtctcttgagttctcctaacttgctatccgacactctactactccctttctccccatcccctgacatctccgctggtagtgtgttaagagcagtgtttccctgcatggatggtgctcacttcttttcaataacactctcttccctgaataaacaatatcctgacctaagtgatggtgtatttaggtcattaagcaaggtagctatggcagtagaaatgagatgcagctttgtttccaaggtatttttgcttttggtcctatttatctggataatgtagtacaaacacagcttctgaaaactgactaacgagaaaactgagaatacagagttgttgccattgagcaaggaagccaggaaaaggtggagaaggagctctcataggaagaggtggatcattttgggtaaatcacatcccctctctgaacttcaggtgtcttaagaggtgtagagtagaacagatattatcttttctgcatccctgtgctagagttatttgactctattgtcttaaaaatgacaatatctaaaaagtcagaatatgcaatagcctcaggcttcaggtttgctccttttcaggggaatgttcattaagaacataactgcttttcgatgatggcttttgtaatccttgaggcacgctatggacattgacttaccatgcctttctactacagatacagagaagccacagatggcattgtcaccagaaaatggaagcrcaaagcgctttgggtaacagcaattcaagaatgactgcagagaaaatctattaagaaattcaaatgcagatttcaatatttactccttttcattctcttcctctctctctcgctcacttgctctttttctctctcccaccttgtttttctcgctctccttttttttgcatacagtttctcagtaaaatacatttgattaaattttataacaaacaagcttatgaaatgcagatatacaaaaaggaaaacataagaagcatgcataattctaccactgaaaaatactactaaaatttggtatttaaacttttgaatgtttgtcactgcacttgcatgtgtgtgtaaatataatctccaactctgcagagaaatacaagaattgttatgaaccttaataaactcccaaaagatttcaagagcaacttctctgtcattagaatatactcagaaagtcaataacatattttaatccattccaagagccccatatttattgggtctatgagaaagcaatttatagcgttggtttttttataagaagagtagatggccatttgggggcaagtcatgtgtcatttggaataaccacaataggtggaaaaaatgcctcagattctgctgcaagactaagagccacaaggagcttttcgttccatcactagttggacatttattggacatcaatttcatatacaatctcatggtctgcactggggaatgacaaaaaagtataagaaattatctctcacctgaagaaatgtatagtgtaggtttgttaaaaattaagttttagaactcatttttcaaactaaaatctcatgctaaaaataatatatagaatagatcaaagcagactattatgaaagatgcaaagatagatgggcctggggacccatccatctgttttcctcaagtaccacttaaggcccccacaaactatagagtggaaaccaatagctacaggagataaatgaaaacattgacaggtcaaggtttgtgaatataagtgtggttggtcatggtaaagaaaccacagttaatacgctccctctgcgtgctggatgctcatcctggagctttgcctctatcaattaacttaatcctcacaacagtctcgatctgtaggtataataaatctaggtttgaaaatacaaaaatgacttgttcaatatatctcatagctatatttagcagatctgagtttcaaatgcaagtctagatgactctgacatccatgacaactcttacacctaaatagaatgcaagatttgaataactatacacacacacaagcacgtgcatgcacacatgcacacatgcacacacaggatatacatgattaattgtgaaatgagaggttaacagtcaggtttgatgtgtcctgattagtgaggggaagaatttacctaaaaattctgggtgtagtcattcaagtatgacgtaaaagggaatggattgccaggtagatcatgatgaatgaacaaagatagagatttgtggatatattacacaaactgtgtgtgagaaaatcagaggatggaaatctttattgttagaatatctgcctggaggaagaaggacttgatttagagttaaaataatgcttggtagcctcaaaggatctcctccccaatatttattaattactgtgttgttttaacatatgtccacaaatcctttgatactcctccctccaggtggtagaaattaatgttccatcccttgagtataagctagacttagtgtcatgcttctctgaacacagtattgggaagaaaaaacacagtaacaaactgacagacaccgtcttaaccaagagatcaaggttaacgtcaccagcaaggagtcatattggtatcatgctgaatgacgctatgagaaaggcatttgcctaggtggcattccttcccctcaatccataacttcattctaaacatgagaccatcagtcatggtacttctagattgaagtaggttgtacaaaatacctgaccactacttttcaaaagggtcaaagttatgagagacaagaaaagaccaagacactgtccagactggggagactggggacacatggtgattgatacaatctaatattctggaacaggacattagtagaaaaactggagaaatattaagaaagtggtttagttgttggtattgatctgttgttattttctaagttttttaaaaaaattatagatggatttgtatttcaaagataaaacaaaggtgcttcttagaattactgacatagggcataacaaatttccctataactagggatctaattttgggttctctattctattttcttagttttgattaatgtaagatgttatgtaagatattaatattagagggaagctgagcacaggatatataagaataatctttgtaaatgttctataaatctaaaattattttacaataagaagcttagctctttttttttcttttttttttttcaaaaaaatggtgcttgatatattaatgagtgcagaggagttaaagaatgtttccagttgggggaagagcgtgcataaaggcacagaggctgaaaagtgtgagacgagtttcaagaatgagttcatttagctggtttaaaagcagccctggaaccaagtatgaataaggatttagccaacctaaaccccaaaagacgctctgggggcagattgcaaaacatcctgcgattaagattgagaattttgccaaaaaatattatctaaaccccatgcacttttaaaagtttgtgaggccagtaaattaataacaaaaaggagacagaacccacaaatgaagcagaagaatgaatgttacaagatataggtagtaagttcaataccatcatagggcactgaattaagtgtttctgacacttaaagcataaaataaatagattgtattgttgccatcccctgatttaaaaaaaaatgctaaattgttcctttgcagaagaaaaaaaatactatttttttaaggtaggaaaaatcatgtaggctattttataattcattggtgaccagacaaagaagttttaaatgttgtgaaagacacaaagttttaaatgttgtgaaagacatcagatagatgatccttataaaggtctttgcaaaaatgcttcatgtttacaatcaaactgtaattcattgaagtcattcctgcaacatctgagataatgtaaaccaactggtttgttttatgactacctaaattgattctgagaaaattgccctgaagaattgaaaagaataaatagttaaagcatcactttttatcacacctctctcttactaaagagcttacaatgattctccattacctgcaggcttataactaaatattccatagtaaaagagctgtacttctgagacttgtagagcattccctcataaactatttgtagcattagccataggtttacatattactaactttggttggcaagcatcttcatccatttctgctgctacaacaaaatatcttagactgggtcatttatatataatacaaatttatatctctcagttctggaggctgagaagtctaagatcaaggcactgctagacttgcttgctctctgcttccaagatagcgtcttgtttttgtgtcctgcagagaggatgaatgttgtgtcctcacatggcagaagtggcaaaaaagccactttcatgccttttgtaaggcactaatcccattcatgagggcagaactctcatgacttaatcatctcctaaaggccccacctcttattcccattgcactggaaactcagtttcagcatgaattttgaagagacaaaaacattcaaaccatagcagcaagtatctagaggatttgtgaaaggaggcatagaaagaggcttggttgaatgagactgagaaaggtgtgcatgccgtagagataatgtgtgatgctactggggtgttcctagtaccaggtgatacatgtttgcctgggaaagtaatgacaggactaaaaatgatgatagacattacagaacttctttcatttattcaaaaataggccaggcatcgtggcttacacctgtaatcccagcaatttgggaggctgagatgggaggatcacttgaggtcaggagttcaagaccagcctgactaacatggtgaaacctcgtctctactaaaaatacaaaaattagccaggcatggtggcacatgcctgtaatcccagctacttggcaggctgaggcaggagaatcacttgaatcccggaggcagaggttgcagtgagccaagatttcaccattgcactccagcctggacaacaagagtgagactccatctcaaaaaaaaaaaaaaaaaaaaaaaaaaatttgttgagaacctcccactgctctggattcttagaatatgtcaataaacaaaatgcataataacagactgcccttgtgacacttatattctagtgaagggaaatagcaaacaattagatgaataagtaagttttatagtgtatcacttataggtgacgagtgctatggaaaaagaaaaaaaaaatgaaaaaacagaggaaggtaaaggagattggaagtgcagtggggtcaggttgcaattttaaataggtgttcagggaggccttgctaagaaagtgaaatttaaacaaagtttaaaggaaatgaagcagttagccatgtagatatatgagagaaggttctcatcagagggaaaagccagggctgaggtgcagccaggagttaagagccacaggagaggagtaggacaaaaggtcagggaggtgacgtggggtctgtgggctggtgtaggagctttggcctttactctgaggctaacaggtagccgcaggaagggtctgagtagaggacttgatctgggttaggtgttaaaggcttctgactggggaatgggtagacacagaaagagcagtttatgaaggaagacctacagagccatggaattaaacaaggtctagtgccaaggactgcttatgaatgacctcatctgagctggcccaagagacttgtcgtaacataaagatgtccagaggaaggctctttcctagttttcccagttgcatgtttcttaggctgggtaacttggaccagagatcaattcctggatgtcctggtgatcacagagctggctgacttcctcgctcactcagattttagtcttgtagtcatatgtggctgccatattttctttttctttgatgatatgaagagcctttaatagctcatgtatggctttttttttttttcaaggcagtgacattcacagaggactctttccctggaaaagggtctattcctttctccctcggagccttggagttcattcccaatctagggaacaagaacagtcaagacttcatttggacaaggcccgtctatttcctagatccttttaaagtgattctaacaccatcgtgctggggagaatcatgtctttttaacaattaaagaggagttaaggaggctagaactagctcacttccagacagttctttagagaagtgccgctcaatagcaatattatatatgcaagccacatatgtaactttaagttgtctggttgtcacatttcaaaatgtaaaaagaaacagtaaaattagccttatttatttattttgaaacagggtctcactctgtgacccaggctagaatgcattggcgtgatgatagctcactgcagccttgaactcctgggctcaagctatcctcctgcctcagcctcctaagtagctaggaccatagatgcacatcatcacactcaactaattttttagctgtttgtagagacagggtctaactatgttacccatgctggtcttgtccacctagcctcaagcaatcttcccacctcagcctcccaaagcattgggattacaggcatgaaccaccacacttggttaattttaataatatattttattcaattcaatatgtctaaactattttttcaatatgaaaaataatcaatataaaactattaaggatatattatttaaatttttttcatgctaaatcttcaaaatctggtatgcattttatacgtccaagcacctctcaattcaccctggccccatttcaagtgctcagcaggcacagatggctagtggctattgcactggatagcacggccctggagttacagatcgtaagatgcttgggtttctctaagttgactagctttgcacaactgttttgtgcagcaagtgactaatgatctaaaactttgtgaaagtggaatttggtatcacatggtggatgagaagcagagacaccttgatcacatcctgtcctcaactgcaagttatttcctactccccacagtgagaacatgataaatgagaaagaactttgtaaacagaaaagtgttttgctcaagcttattactattattaaagtgcttgctc

SEQ ID NO: 10811 - DNA, 12442 bp, Homo sapiens
atctacatattaataaattctgtacagtggtttggcttaatgttttatatgttataagaaataagcaaaacatagggatgatatttttagtaaaggtatttcagggtatatgagaatcagattcctagggccctgggtacctcatcttgctgtttaaagtcctcatggaggatcagtggagtgcagagcccagaaatcatcctgaaggctgaagctccctggtgaaaaggaccctctcctgcaccctggggctcagagggaacaacaaagctccctcccagggtctccagcctctggcctatactgtcagcctgcactttcttggccttcctggctgctaatattccagttcccagcagcctcctctctcacccttcacctcttctgactgggtgcgaatggtaactagaccaggcagtgccctccttgtcagtctgcctgtctgcctggttccctctcagagtttgtgtcttcactcggttcatcatccccagccccagcaggaacagggagaagtgacttggcaaatgccccactcaaaatgggatccctcaaccagagaccacttgtgaaagtcagttttccctgactaaagaaacaggacatttaccctgttagaagttgatgtctgccagagacctccacctgggaaatgctggttcatggcagggtctctcttttagtaaagggaaaaattcctggctaattgatagctaataagtcatttagaatccagttcatgtaaaaggattacctacttaaaggattaactccattataataaggacacacatcccacaccgcacatccaatgtcatttgtgagattgctttgattcgctcatgtagaatgttactctgctgctttgcagagaggcttgccacacatttcaaatctctgctcctcatttcacaccatctggctcatgaggtgaaggtgatgagaagtgtcttcagacaatactccgaggtttgtctatcagagtcatagtcatatattacatatagagattattttcttagaagttgtaatttattgatatgtattttactcatggcatagatagatactatccaacaattcgtttttattacctctacattacactgcttaggtagccactactggtacctctgcattttctttcttgtatgtgacattaacgtataagattgtatgtacatggtggcttggtttccaggaattgctgattaggtaatttagaccattccttccactgagtacaatgggaaaaggaggaaaacatacatatttgaaaaatctggttgagcaaatggatgggctaacaaagcagtgaagatttgcctggccaggaaccaggagaggggagaaatccagaagagcaacttgagctgtggggctgcttttgtggatcagaggcagtaacacctgctccctggccagaagccaacttccaggattcaggactcagaattcagaacttagacggtcccttggtctctctagaattcagtgctcatttagaccgggctaagaccctcacactcaatggctggaggatccaagcttatggcatgactgcctctggagcatttcatgctagagagatcccaacaggtgtaggtaaatggtctagagggtactagccaggcttccatggaactctgtgtaaggcacttccctgtgttgttactcatgttggccatgtcctcgggaatttagtggaacggccatgtcgtcttgagtggaagtgaggacggtgagggggtccctgggcagtcagagattttgtgtccctgcgtcctttccttccatctcaaccagagaccacttgtgaaagcccaagaacaaatgtcattaaatgtccgaggcgaatccaagaccaccgatccattgcgcccaggagccttgggccatgtagcccagcagtagtgaggtctgtgaggccttggtcacccccaaagtgttgccccaagaggagctgccgctcgttgccatcaggcacctcaggagctggacatggtattcattataatttctgatgaggaactagagaggtctcatagcatatagaccttgatcaaattgggtcatggtggagtcaggcaaaactctgcaatgactcacaggtacctaagtataaaacaaagtctcaactcagagcatccatcagagcttcaggctcagtagtcattcctttatgctgttgctgtgtttgtactgtgataactggtgcttgaagggaggacatatagttacatgttgcgggaaaacacatgtcattagaaaacttggcatgatttagggaccattgccttttccatggtagatgtgggactctctgtcatcttcaccctgttgttccaagtgcagaagagaaagcttcttcctgctttcagctgcgtgactgacaacggaagctggaattcagagaatcagtggcagcctctgtctctccaggccccaaccctgcaggtttaaggaatggacttaggtctctggcactttgttctcaacacacattttccttcactcattcagaaaaaaaaaaataataatagaaaatgaaccaaaggctgcaattctcatggcacctagagaactggagtacggaccaaggttgccacatgcctgtcattgctccaccacactcggttgccgtgtgacctcgggagaagctctctaccactagggacttttaaactcatctgtgaatcctggataaacacagacattccggtaaccttactgaaatgaagtgaggaccaatgagttgacaggtggagaaaaatttttttttttttttttttgagacggagtcttgctctgtcacccaggctggagtgcagtggagcgatttcggctcactgaaagctccacctcctgggttcatgccattctcctgcctcagcctaccgagtagctgggactacaggcgctcaccaccacactcggctaattttttgtatttttagtggagacggggtttcaccatgttagccaggatggtctcgatctcctgacctcgtgatccgcccgccttggcctcccaaagtgctgggattacaagcgtgagcctccgcgcccggccgcagaaacagaaaaatttaagtgatggcctttactcctagacagggcttttttaggaacatgcaccttaaaagtaggaggaaaacataatgccagcaacaccctgcctaaaagcccctttagtgatgataattatcattcatctttctataaaagtacagcaagactttctacctcaatatctcaaatcagttaaatatatcttctgatcatataccagtgtggacccacatgttttgctccaagtgaaaatgaaaaggaatgagaacatctccacctttgtgtggtgaccatgggaccacggaggcttggaagccagcctacatctgcccaaactctacatcacctgccattgtcaattttcaatctatccgttctatgctttggaatcctacataattcatactcttgaaaaatctcattttcatatgtagggcagggtagaaaaggtgatatctctgttttaatttgctaagacttccataataaagtggcacagactgggtaagttaaacagtagaaatgtattatctcccagttctggaggctacaggtccacgatggaatgtattgcagggctgattgctcctgaggcctgtctctggcttacagatggccatcttctccctctatcttgtcaacattggcctcaaaatatgtgtacagggacacagtttagcccataagagtctgcgccatccttggcggtgcatattataagaaataaaagagaatacaaccctttggctggactctgttgatattttgaaatgttggtcttgcaataagaacaccaccaaaggccaggcgcagtggctcacgcctgtaatcccagcactttaggaggccgaggcgggcggatcacgaggtcaggagatcgagactaccctggctaacacggtgaaaccccttctctactaaaaatacaaaaagaaaaattagccgggcgtggtggtgggtgcctgtagtcccagctgctcgggaggctgaggcgggagaatggtgtgaacccaggaggcagagcttgcagtgagccaagatctcgccactgcactccagcctgggcgacagaccaagactccatctcaaaaaaaaaaaaaaaaaaaagaacactaccaaaacaagggagccgaagtttagttttccctggaaggtgagcactccctgagcctggccgccccagggcagcaagacccagtgctatgtagttctccaaagtcctatttactttagtgattctgattctgtatttttaactgggaaaaggattctctttcaggaaagcaaccacttctgatgctatttaggtattattctccttatacttataggagaaaaaattgatgttaatgaacaggaaatatttgccaaattatcacacaaataatttttgtatcattttaaaatactccttattgtactgagcttgttggtattttaataaaaattattggcacataatatttatacatactttggggtacacataatattttcatgcatgtgtagaatgtgaaatgatcgagtcaggatatttaggatactcatcacctcaagcatttatcagttatttgtgttgggtgaatttcaaatccactcttatagctattgtgaaatacacaatacattgttgttaactacagccagcctgctgtgctatcgaatattagaatttattcctcctatttaactgtatctttgtacccattaagctacctcgttttatctcccagatcccccacacacccttcccagcttctggtaactattattctactctccacctccataagatcaactttttttcagttctcacatgtgagtgagaacatgtgatatttgtctttctttgcctggtctatttcacttaacatactgacctccagttccatccatgttgctgctagttattatgaggtagttctagctggaagaatagagaattaaaagaaatctttgtgaagcccctacccaggtttgtcaatttgtaacattttaatattattggctatatgtagtatacatagaaaataatagaaatatatgcagatagccctgattctccacagttctgttatgtatgtgtttccgctgaaacacatacagtacagtactctatgtactgtacagtactactgtactgagtactggactgccagtggggagtggcggatgtcttgaatttggtgaatgcctttatattgctacaaagtgtttttttttttttggttgtttgttttgagacggagtctcgctctgtcgtccaggctggagtgcagtggcgcgatctcggctcgctgcaagctccgcctcccgggttcacgccattctcctgcctcagcctcccaagtagctgggactacaggagcccaccaccacgaccggctaatttttttgtatttttagtagagacggggtttcactgtgttagccagggtggtctcggtctcctgacctcgtgatccgcccgcctcagcctcccaatgtgctggcgtgagccaccgcgcccggcctacaaagttttttaaatcctttcgtttgacatgattttagactttgtaaaaattgttttttgttgaatgtatcattctgtggcttgctttatcgtttaatatggtctatgaggtgaacccacacacccatagaaacagttcatttgttttcagtgctggatagtatttatgagacgaatatcccacaatttatctcttctcctgtccgcgacctttagcttgtttctgttacagacactgccacaatgaacatcctgggtcatctctctctggtcccctgtgtgagttccccaagatacggatgtaggaatgggattactgtgcttttaccatgtgatgttataggatgtcaaattgttctctgaagaggttgtatcaactcccccctttaaaatcttctttgacattttacaggtcaagttatcttcctccccaactagctgctcmgcctcagtcccccttcattggctccttttgctgtagatgctggagcactgtggggttttactgcctcccaatcactctagtgtcctccactcccaggattttaaatatcgtctagacacagatggctcccaaatrtatatctctacatatttctataatcaaaaaactaatggtaccaaaacaggtactctgatatattgcagatgggcctgcaaactggaaatgttttcaggaaaggcagtatggcaatttctgtctaaattaaaaatgcatacacccagtagtcccacttctagaaatgtgtccaaaaatagacctgcattcctgaaaaatgactgtattcagaattatatgttgcaaccctgtttgtaaaatcaaaaaggaaagaagaaagaaamtgaaagataaaagaaaaaataatccaaatgtctgtcactagcggactagttaaaaaagcattgcaagctgggcacagtagcattcacctgtgaatacactctactccactctgggtaacatgaggaggcctccctaccttcctaagaaaacccaaacaagcactgcatatctacacggcggagtctacaaacatttaacacaaaagaagaaagacataggaaactcttgatattccctcatgggatggtctccatgatacattgttaagaagaaataaagcaaggtgtagaataacatatagagtctgctaaaatttgtgtgaaaagggacaaagagatatatatacacatttatatttgcttgcatatgcataaaatatatttggaagaataagcaagaagatatccctggttgcctgttggggatgagacagggtaagaaagagacattttaccttttgaatattttgaattttgaattttgaactatatcaagaaataaaagataattcctagggcaaccaaacaaaccccaaaaaaattcaaaatgaaaaaccttttaaaaactaatagaatttttttacctttattaaaataaattttaaaaattttctaaatattatattattcctttaacaaggaggtttaccgccattttaattcagtacgttgttttctttttaattgcatgatctttctttacatctatcttttttccattacaaggtaaaataacagcatgattaattaaatgcaatttgtttggtgaatgaaattttgttcaaatcttggtctaagtgggaaagggattctaggggatccagtgcagcagttatgggtttcagtatgctcacgacgccctccagtgtttgtgtgggctcatggatgccatatctagaaaacactggaattctcaagcacacgtgactgaagccatttgccaaatgttcaaggtcctattaatggcccatctgagtacttgtcatacgcggtcaccctatctttggatcagaaggtacactcagagctcctagtgtcacatcccaggcccaacctgctgagattagtcgaggaaggtctggaggtcagtgtcgtgaggggtgggaagactgagggtgtgggggccagttgtggagtggcgggagccccaggtgctgtatgaagccgagcctctggatcaccctgtgaccccacatttggtcccttcctgggtgtcttccattcccaggactcccaggaaataaaatgctgcaagattggggtggggagctgtccagggtgggtcaggtgtggtctcactgatcctacacctctgcctcccagcccactcccagccctcttctgatattagaaaccaacacagattgccttagggtggtggttctcaaagtgtggtcctgggggaagcagcattggcatcacctgggaacttagatatgcaatcttcagggcctggcctggacctactgtatcagaaactctgcatttaacaagcccccagcagaattctgcttttcaaatcagatctctctctctctctctctctctctgtgtgtgtgtgtctctctctctctctctctctctctctctgtgtgtctctctctctctctctctctctctgtttcaagtctcaatattgagtagctgtgacttctggatagtcaggtgtcagacaccctttcttgccaggaggcaccaggctcctcaatcagcttagtctcattcttggcctggcccagggaaagatgttcacttcctggattctgagcaaagctctcctatcctgggtgcctgtggggctcccacttacaccacaaaacaaagctcaaataatattattttcttttatgagatttttggtattccttcattagtcagagctgaagatctacatatatgtctaccaagcaagtgtgcatgtcccactagccagtttgttagtcttgccaatgcaccacaacgtagcagcctctcagtctctccttgtgaggtgttacctggagttctttgtctcaccaccaagagaattaaggagcgtggatacaaagggtgaggttggagcaaaagtttaataagcaaaagaagaaagctctcccccacggagagggggcttggaagatggttgccatttttacagctgaatgcaaaggcttttacaagaaactgatgagggctgggtgtctcatttgcataaggcacgaatttccggtagctccaccccatcctcctagtgcccatgcaggcccttagcttgagttactccatattgctttgtttccctgactgcccatgtatcgggggacagaattttccattgcgggcatgtctggacaagtctcctgtgcagcctttcttatttgtgcagctgtgggcatgtcttaggcaagcccccctgtgcaagttcccttctctgtgcctgcaggccgttcttttgtttgaaataattcaactgaggacccaccataactgcccgcctgaccagtttcttccttttttctctctcaatttgtgttatgatttccttactgatctctgcctgagcaagactgggcacgccttgagggcaaggagggtttatttcctcttacctcagttccagctcctcttaaaacaatgccccacgcacagtaggtatttgataaatgtttaccaaatgaagggattgcctggaatggcttggcagacaggaaagcagaatgaaaacccacaggccaaaagtggctgggaaaagattttccaaatcctagtgctgggcacagggcccactgaaattcactttcggaaccttcccatctgtcttgttctcctctcatcagggacttccatgcccctcaaagcccacctagtcacacactacctttcaggaccaccttccagatcagccaggtgcaaatcccacagacttcctgcctgtggctccaaatgctcagctgaaattctgaggctaatttcagtggagttagaggcttatcccttaggagtggcaatggctggctttaagattcgagaagtagtgtttacatctcaaaagagaagaccgctccaccagaaatgcagagtttttgtatgtgcgggtccggggtcttcaggagataaagaatgatagctccaggagcgctgggacccccgtgcagccaccagtcaccacagcctaggcaggggttgggctctcacctcggcccctcccctgcacgccctggatgtggatggtccccgagtgtgaactcgcctgggctctgaccctgggtgctcttcccgccgttgtggagcctctgcgggtgtggtgcatgcacagggggcttcacaggagacccggggccctttagagtctcaaggccaacattcttggagaatccatgtcaggcattcaggctctcagagactcagatgcccaaactatgaaaatgagagaatctatcccactctctcaggtgtggtgagattcctattatatgactatcggtcatctatacatggattgtactctcagagttgcctttatcagtcggccaatgcctaaaacccaaagatgggtcaggcatggtggaggaagagttcctttcttaccttctgaaggtgccatcaacaggaatttctaccctgtggagtctagaggagactttccttgaagctgagttgggaatggacatttggacttttttttttaagagttagtaactccgtggagaaccacacatttatttgcttactttaattctacagcaacattcgaggtggcttactgcaacaaacccagtgtaataaatacatacgaattactttaaaataacaccaaggaaaatatacattttaaaagattaaggctggggtaaagctggaacattactaggcgggaaggaacatctgaaacatttgctgaaatggagttgaccctttacctagccatagatttgttgcctcacgatttcattacatctgagcaccagggaggggggtggcagttcaggtcaccagtcccttgtttcctgcttcaggaacagtgtcctgttctatacttacagtcaaagcaaattacatcgttgtaagatgtttaatgatgaagtcaaagtccacagagtcagcaagtaagtgtaaaaacctcaggagtccaaggacagtctacgtttctccccagaaatggcctcactatgcactgttgaagggagagggtcctttcaaggggccccaagatgcaggagcaattgggctgcagctctaaataaagatgtcctttctacctgcagattccacaaaacctcacaggcaaatttggtgatctcacctgagctaggaattcggttttttgatgttggttctctttgagccattgtgtgagctttaaaatgtgacgtggagattttgctatactggtatttccttgctggaatttgacatccacagtggctctggcttccctgtctggtcccaggaggaaatggagtgtcctgcactttttttcagcatcgctttgtgtaagaaggatcaggagacctggagtcaggggctcctccaatctcactctccttcataaaacagtgtcccttaagctttctgggggtgagggccttaacaccgtgctgttctgatgaatataattgtcccagctcccgaaacaaaagcacaggtgcacaaaataccgactgttgcaagcaatgccaaggtggggatgtttcctaggtgccaggtttagcactttgactttgtatgtacacacacaggggccaggcgttgtggtttatgcccgtaatctcagcactttgggaggctgaggcatgagaattgcttgaagccagaagttcaagaccagcatgggtaacaaagcaagacccagtctctacaaaaaaaaaaaaaagaaaagaaaagaaaaaaatacacacacacacacacacacacacacacacacacatactgggtgtggtggctccagtctgtagtcccagctactcgagaagctgaggtaggaggattgcctgaatccaggagttggagcctgcaatgagctgtgatcaggacactgctctagcttgaccatcagagtgagaccctgtctcaaaaacaaacaaacaaaacaaaacaaaatacatacacacacacagccagagccagcactgagggagaggctggcctcaggggtggggtcacaggcatttctcaggtccctctcagtggtctttgtctctttttcctggaggtggaggagtctgtacttcatgaggagaagtcctctgaagaaggcgggagatactcaggagcggggtccggagagggaaaaggatgaggaagtggagacaaagtggagggggcagggcaagaagggcacatgtgaggaatggggagggggaggaccttccagctgtcagaaaggtcccacgcagaatttggctcttggtttttctgctttatcaggatggatttgggaaaccagccggagcgggagataaggagtctactttgcaaaggacacgtgtgagtctcctcctaatttgaactcatgagtagcagctgacagccaggacccttgtgtggggcgcgtgacgcccctttgcaaccagggcgttttctgcaccccaccagccatccctcctgggaccacgctggtcctctccaaccctaacagggagagaaggaaggagaggtctggaggctttgggtcctccctcgtgctccttcttcctctgccatttattccctgagtgtccttgactttcctccgctacccggaccccactacagcaaagcacatcctgcacactggcctggactccctttgtaaccacccagtgtgttcaccttgctgactgcctagacaaagccgatttatcaaggcaggggaattacaatagagaaagagtaattcatgcagagccggccgtgcgggagaccagagttttattactcaaatcagtctccccgaaaactctgatcagtttttaaggataatttggtggatagggggggccagtgaatcaggagtgctgattggttggctccggtatgaaatcatagtgagtg

SEQ ID NO: 10812 - DNA, 36989 bp, Homo sapiens
tcttgcaaacctattctgagttgttacaggtctcctgtcaaaataagcatgaaagcaccaatggccactacacacgacaggtatgctactttacaatcaccctgcccctagaaaagcttaagaaactttatgtattttaactagagaggtggtctcataactaaagatgagattcagcagagaaaagcaaagatatttcaaatgactgtcaggaacttcctggctccttgggccttggtcttccctcctgttaaccgattccagccatcagcaaaaggagcctctaggaagcttctgaagtttgattcataatcaaggtgagtttcaacgttcagtctttcgccccaagcccttctcgcctcatctctcctgtttccaggctcaatcactggttttattcttgggtcctagtctctgtggcctacattttttcttttgtttttggccacatcctccgtttctggtccttgatcttcactgttcatttcctgagcctccacttccacttatctgccttgcctgcccgtcttacctggctagttttacctgtgtcctaccacctgcatcctactttgctactctaaattcctagatgttgcatttgcctgaaacctagaacctatttcttgtcctgtaaacttagaacctatttcttgtacaacctggtcctgactggattctgaacacagtgcttattctatctagctgaattttaagtctttatatttttctccagtctgtttacccatccagtttctactggacatgcctcttctcaaggcagaaactcaactgctttcagtatcgccagcctgccctagtgtaaccctcaactcttgggggagagaaaaagagagggataaaccaccactactgaccactgaagcaagaagtaatgttttcaggacaattttttttttttgagacagggtctcattcccgtcgcccaggctgcagtgaagtggcacatactcggctcactgcagccctgattttccgggatcaggtgatctcccactttagcctctcaaatagctgggactacaggtgcgccaccacacccagctaattttttgtatccttagtagagatggggtttcaccatgttgcccaggctggtcttaactcctgaattcaagtgatccacctgccttggcctcagcctcccaaagtgcttagattacaggtgtgagccactacacccagcctctttcaggacaactttatatgcagtctactggcatgcctaggtgaaaataaactaaatgactgaaaatgttagtattttgacccttataaattcaaaaggcagagagagcattttggatgggacagatggcaattgaaaataagcttgtttaccttgtgagagtctttccccctggggactgataagttgtggcttctgggtcattgcattccaacactgaggcttccctggcaacacccctagtccaaggtaaccaggatagagctctggaaaccactccagccccatgcagctgcgaagagtcttcctgccagcagctgcagcatgattggtgaaggggctctgaggagtgtgacgctgggctgaacataaagggctctggcacccagtgtgtgatgcttggaactgactatcagatttgggctccagagataactgtccctcgggactctccattaatgcctttacatcagggacacaattatgattctgggcttctgctttcttttcttgaagaaatgttgtagctagagaggcaagactttgactacttgactgcgatacagaatgaaactggtaagtcgtctccctcggaatgaacaaacttaaatgtggtctttccccttgagactcctttcctgtgactgaatccctggtgttgaagttctcacagccatggctcatgacagtccgttcctgcttttctgttgcagacatacttttctctgcatttcctttgctcccacacgtctctactcccagggtaagtcctttctcttgtttctccatgacttggattttacctaatgagctcattttaaggcttaaaatgagggattctgtgttcttttctggagtctcagtaactgtaacatcagtagggactcctgagaggtgatccctgcctttggaatctctctcattgcttaataatgttcttacccttttaaccccatcactgacattctttggagaaatatgacaatcaccagtaggcacatctagtaattttactagaagttcctgtctttggggatcaattttgtccaatttgagatcaccagaggtagtttgtacatcattaggtagagttgaggaatattttctatcttgatttgacaaagaaggttctattgagccaaccagtaaagacgctccagcttctgaaggattacatcgactttctcctgatttaggcaaatctttggcaagttctcttttaggagaggttttctctgatgcgtaaaactgagccttggtttcttcttggaaagtagtcattggtttagtattttttaacattttgaaggatggttggattggattcttgatgtctttatctgcctttgtagtagctgctctttccaaaccaacagctggcagtggaaaggtcttcactgtctgttctggtttgtccaccaccaacttagaatttctttcttcattctctgtctctaactctttccctttagctttaattaaatctttgattggtcctttcatctttttagcacgtgggagtgtagctggcttggactgataaactttttgatcagtaggtatggttggtcctatcatcttacagtatggcaagtgggattttaatcgtttaaatggcttcttacagtaaggacacacttccattctgggtggattatcactcatcctattcctgaaaaaggtaaatgtgagattatgagaagcacatagtttgtacataccaatattttacttatgtgttgtatcttttaaattcatttggaacaagctagatgtttgctacttacggttacagcaagtcaactagtcattatatgagtataaaaaattgtttaaaaacccttaaacacgttattcaaggacagaatggtaaagaataaaaaacttaggccaggaaccaaaggttatttatttatttatttattttggaaacagagtctcactctgtcacccaggctggagtgcagtggcacaatatctgctcactgcaaactccgcctcccaggttcaagcaattctcgtctcagcctcccaagtagttgggactacaggggcatgccaccacgcctgactaattttttgtattttagtaaagacggggtttcaccgtgtccgtgttacccagactggtctcgaactcctgagctctggcaatccacccacctcagccccctaaagtgctgagattacaggcgcgagctaccacgcccacgcccagccaaaggttactgattacagcagaggtttccaaagtgataaatagaatatgcactagggtgtaagaagaaaatattagaattaccacaatcaaagaatgagaaatgaagctctactaacatttagtaatatgcatatacacacacacacacacacagatatacataaaatgtatgcataatgcacaaatatatacatggccaaggacacagtcctgtttttcacttatacttttttttttttttttttgagacagagtctcactctgtcaccaggccggagtgcagtgtcggctcactgaaacctccatttcccaggttcaagctattgtcctgcctcagcatcccgaggagctgggactacaggcatgcgccaccacgccaggctaatttttgtatttttagtagagacggggtttcaccatgttggccaggatggtctcaatctcctgacttcgtgatctgcccgccttcggccttccagtgtgctgggattacaggcgtgagacaccacgcctggcctacttatagtttctagtacaacagattactggcaaattagtttgacatctttgttaaacatatacgatgtaaaaaattaaaaaaaaaacatttataccatgtatatttgtacctgttattctttagagtccagaaaagaaaatgtttaattccaatgtttagttgaaagttatttcctttctacatctcttattctttctataaagttccagagggcaggaaacatatctatcctgcacacagctgtatgtaaaaacctagcactgagcctggcatacaatatttgttcacttaattctttagatataaacgtttaaatattattcagtactacaactgataatatcttctgactaccaaagagattaaaaagggtgactgaaaccacttacaaaatagacacaatcttcaccaatccattcaataaagcaaccaacccaccttatcctgtacgaagtccttcaaaacaaaactgttttctgccaacagattacagtaatcatttttactttgttgttgtttggtctttttttttttgagatggagtcttgctctatcactcaggctggagtgcagtggcgcgatctcggctcacagcaacctcagcctcccaggttcaaacggttctcctgcctcagcctcccgcgtggctgggattactgggattaagggcgtgcgccaccacgcccagctaattttagtatttttagtagagacggggtttcaccatgttggccaggctggtcttgaactcctgacctcaggtgatccacccgcctcggcctcccaaagtgctgggactacaggcgtgagccaccgcgcccagcctgctgggattacaggcgtgagccatcattctttctttctttggaggtacacactaacaggatgaaagccacagactgtttgtttacaataatacacacaaatgaagccagtccatggaccttcggctaacaacgttaggaagggcttgacacctgctagacgtttctgcctccactccacctcacactcaaccctacttgaaagatcccggtacattcccacgataacgtctatacgtgggtgtctgttttcttacccgagctcctccaggaggatgctagttttgtgggtgcttctcccggatccccatgcttccccgatcaccgttcccgagtgtggcagaatgaaacgtgaatgtcagcctgtgtaggacacgatcagacaggtgacttggcagcatgcacagtgagtaaacgcggcacgatactgaaccaaatagaaacacaggttccggaaagcagagagttaagacctccccagcctccgggctcaaggaggacctcaatagttccactaatcctcaccctcacctccggcgctctccagccgcctttccctcctcccgctgcgttaccagcctgcccacctccccgcacccttcctttccctgaaagctgttctgattctgccagctgttctgattctgcggagtggatggggtcggcccggcagctcctgggtcagggacagccgttcccgcagccccaccgaggatttcctcctgcggttccaggaagaccctccgccggccccggcacccgattccctaccctctccgctcaggagagtctcccccagacttagaacgtgggccgcggaaaacaaacccgcccttgcaagctccccacagagcaccgtcctcacctcggaagacctgaaagcccaggcggccccggcgacaagccccccagggaagccccccaggcccctgcccaacccccggccaaggaacctcgtcaggccgtctgcaccactgccggataggtccgcctgttttaaaatatgttacacggattcaactcaaatacttgtatgatattattatgacataattgaatttatttgaaacctggcttgacttttataccgtaccctccgttggctgtgaacaggcgagcgcttctgccaccccaggggaggtcctttctcccagaagctcctagtcgctcctcccgctccgagcccgcctcttcccgtgggcggggttaccagtcggtgcggttgggatggtgccactgcgcagccgcragagggcggtaccacggcggcagcgacatgggggggcgcggagcagacgccggaagtagtggtggtacgggtccgactgaggggtactcgccaccggctgcgtccacccgagsggctgcgagagccaaggcccgagggggtgggcgtggcggccgccgaaacacaaccccctctgttccctctcttcgcggagcggcgccgcgtagcttccatccgccagctgccatgagcgagcgcctccgtcccaggtgagagggaagggaccccctttccattcgtcgcctgaggatctggragatagagccgagggggcgcgcgaaatgggggtcggagcaagagtggacccggcggggctccctgtggggtgcactgcgggccgggggaggaggggagagggatgcgcgagygatcggatgcttggttcctgtgggtagctggaaggtgactctccggggtccaggtctcccgcccctccatcttttttcccccctgtcttttcctatttggaacgaagtgtgatcggtcccggaagagagacggtggccctaaagctttcctgtcctaaatttagkagggtggggggatgggataaacgtctcatcttggagagggagcccccaaaggcttttgtgagggcaccgggcggggagctgccggctccccaaggtcagaaagaaaggttgggcttaaccccgcagcagggaaagattcggttagaccgaagaacttgtgccctgaacggttgtgaacacagaagggcagatgaccaaggcgggttatggatcttctcttsactgtggcrttaagaacaagctggattctaaactgtttggattgcggggccgtttgactccgaaggcgggaggaaagattttatcgcgatgcactcgctaccttcccgagggagcctggcctcgggacscgggtcttaaattaggggttctgtgcttgacatgtactactagagtccggactaagttgggatttcttaatttttttctctctcttaatttcctctgcaagaatgtgtggaggagaaagttgggaaaggttacctcagaatgctcttcctgttacggtctttccacaaggatccttctctgaaataattatttcatgtgattgaagttctcaaaagtattctgagtttatttggtcccatagtgaaaacctagggttccccaagctgctgcattggattattgatttgggtcatgtagcaggtggagcataaagcctctccttgtatagaaaagaagagtggactaaatttgaaattgggggcccaattacagacatgccatcggaattaggagcaagatctttagatacagtgaatctgacccgactgccatattattctttcccaaacccagtttatacttacgatattctcttggggtgtctcacatatctgaaaaaaaatctaaatatttcctacaaataaaaattctactgtacataactaatctgaatgcatttatactggcagtagattccttttatcttgtacacaaataatctcaacatgttttaaagaagttatttgatttggacaggcttttcctgccagtgtttaatggagtatgatgggccagctctgccagctctaggatggtctaagacggtggtttttcggctgggtgcggtggctcacgcctgtaatcccagcactttgggaagtcaaggcgggcggatcacctgaggtcaggagttggagatcactctggccaacatggtgaaactctgtctctactaaaaatacaaaaaaattagttgggcctggtggtgggcaccttcatcccagctacttgggaggctaaggcaggagaatcgcttgaacctggaaggcggaggttgcagtgagcggagatcactgcactcaagcctgagcaacaagagcgaaacttccatctaaaaaaaaaaaagggttttcaggctctcccacagtagattggatagccgcagagaggtgagtgtgtagtgagggagtccctgcttattgattgattgattggttgattgattgactgattgaytgacagagtctcactctgtcgaccaggctgsagtgcagtggccccatcatgcctcactgcagcctcaacctcccaggctcaggtgatcctcccacrtcagcctcctgagtagctggagcacaggtgtgagctaccacacccagctaatctgtgtatttttggtagaggtggggtttcactatattgcccaggctggtcttgaactcctgggctcaagggatccacccgcctcggcatcccaaagtgctgggattacagatgtgagccacctcaccagactgggagtccctactttaacagatcctttatctcttatatagagagaatttttttacagtaagaaagaaagagttctgttactttttaaaataaagtttgaaaaccactagtttccatactctttttttttttttttttttttttttttgagatggagtctcactgtgtcggccaggctggagtgcagtggygcgatctcrgcacactgcaacctctacctcctgggttcaagcagttcccctgcctcagcctcccaagtagctgggattacaggcacacgccaccacgccctgctaactcttttgtatttttagtagagacagggtttcaccatgtgggccaggctggtttcgaactcctgacctcaagtgatctgcctgcctcagcctcccaaagtgctgggattacaggtgtgagtcaccgtgcccagcccatactcttaagattatttctatgccgagtctctaggagatgacaggaaggttggagagaaatgaaataatgcaacgtgatggaatcaaccatctgtagaagtaacagatgctaactggtaatctgcacctagatggttagggaagaatataatcagttataggggtgcctgctaaaatcataacctggtctgtggcattaatgccaaaaattgtaatctgattgattgaactgatagggatgagcatgaagctgtaatcttgccagttgttaacaccattgttgaaagaagaatgtttcaaggatgagatctgctaagagcctagaaaaaggcaaatgaagagcaggtaggactctttcttaatctggtaccatccagaggagaaggctaccaacaggccaaagagattattctggtgccttgagagatcaagtaatttatgaggcagggatatttcatgtgactctcccagagattagttgaaatccacaaaatcatctcatctttttttgttcttacagtccctctgccatgcaacctccttgacattcatagtcttgtccctggaaagatctatcccccattataaatgaggagatagcaaattttgatcaggctcctaagtttggttagagtgactcagcagcccaaagcccagtcagctgttggcacgctgataaaatgggtgtgtgaggaccagcagctgctacttactcaatgactttctctttgggtgtcgactggcctcccagcagacattgctttgcctctgcagaacactcccactcaaattccctgatcatattaggatgaaattagcagtttcttggttcaaatttatgataaaagcacacccatttaatgattattaaaacctgatattcatctatttttttttaacctccaactacttcaaagtaatgtgcagctaagatctgatctcctaagagaaaggtggggagcagaaatgtcttagaatgaagtaaattacatagcccagtgcaggatggttgaagctttatcagaaccacacactctttattattccaaacttaagctgggatccatactcattattaaagttagacctattcagaatgttgcagagtacagagaagtgagcttagggtgatcatttattttctctaatattcaaacctcaactcaaaacctttaggattaaaggcctgccactgtaagccaccctactctcatagaaagtgtataattatttagaagacactatatcctccaaatgtacatgctttccaagagctgtgtgtccacactagccttttgtctcttaactatagaaagctgaaacttcaagggttttgtaataggtgctgctgccatgtacatacagacctctagcctgtgctgctccggagaacgttctgcagtgacggaaatgtcctttatctgtgctggtcagtgcagtagccactagctacacgtggccactgagcactagaaacagggcagctgtgacctaggaactggatggttaattttagttaatttaaatgtaaataaccatatgtggctagtggctaccrtattggacagtacagttccgggcaatttgactgaaaattatacctcctttaatttatttctgttttctaacaggttcagaaatcgttttgacagcacataattcttaaatagagtacatacaaatttggtctttcttgcatgtcygagaacacttgcctaagaaagatgtgtgatttttctttaaacctggaaatwttaagcagcttatgctatcatctcatagtaacaatctagtgaagtaattgttatatcataataccggctagtgttgccagaataagcaggtgaatgtgaccaagaggtayttttataagggttttcaggrcaaataggcaaaggcagccactcttatatcaaatgttgtcatatggaagggagtacaattaggtaactcggaatcctaatttcagggagtgtaaaaagaagaaaaccttaattaggttagaggttgaaagcttagtcattaacctcttcctgttcttgtttcagtcccaacagacatttaaaattgttaagcttctttttagaaatgagttttactaacttaagcttgacctcgctgctgctgtcttgtatttttgctcttagtgtccagtgatgctgtacttccaactgataacctattgggatatcatatgctgaattatgttttctcaggccagagggcaaatttatatgttgttatggtttgcaattcaagtgtccaaaacatcggttgtttgggtttttttttttttctccttgtgatttaatttcaggaaaaggagaaggaatggcaacgaagaagacaaccatcttcccccccagaccaaaagaagtagcagaaaccctgtctttcaggattcctgggacacagaggtaggaagtgtggtcacatagtctgttgttttcactgcttgagttaaataacctagtatctgctgtgtaattaaatttacttaaacagtaatttaaaatgaccttagttgattatactggtttaacctttctgtttccaaatcagggtccctttgaggaagctgtgtaccctgtccccagcaaaacagtacatatstgcacatagtcatatatgtacacactcatttgtatttgttagaaatttcgtggctytttgaaagcctatgtttgaactcactgttttgtatttcagcagcgaacttcttttctggtagtttataaaccatgaattgtccttaagataaacatattttgttgcttcaattcaaatgccttttaagagaaactttaagcatgtaaaatatgtaaggtatgtgtatgcagaatcccatttctcagtgtttttacttttcattatcttgttgtgaaaagagctcctgtggtgagagggaaggggagttgggtgttctggaacttttttacaatttttgatttcatgaaagagtgcttcagtacgcagactgaggatacattttctgtgcaattggaaggctgctctgtgctggggaaaggaaaccaatataaagtaatgctgctattaagttatgcacctagagattttgacccttaacagttgtcacactaagagaaaagcctcaacaacaaagagccctagcctcataactcacagtagaattctcccacacccaaataatttgtactttaattagttcctgataataggatttgacctatatccagtctgtctttgccagcaattcaaagtaactcccccaagggggaaaaatcaggaactttcatgtaggtaacagtcattcagagacagtgaacaagtgcagagtagaatccttctgtgtggagacctgagtttctatagctgtttttcctcttcaaatattttcctggccgagcgcagtggctcatccctataatcccagccctttggtaggccaaggtgggcagatcacgaggtcaggagttcgagaccagcctggccaacatggtgaaaccccatctctactaaaaatacaaaaaattagctgggtgtggtggtgcacgcctgtaatcccagctacttgggaggctgaggtgggagaatggcttgaacccaggaggcagaggttgcagtgagctgagatcgtgccgttttactccagcctgggcaacagagcaagactccgtttcagaaaaaaaaaaaaaaaaaatatatatatatatatattatatatatatatatttttttcctatttgcttttttcttttctttttaaaaaatgattatcagaaaggtaattgagctttgtttaatgtaatagttgggaatctcagggatgaaagaaaacaagattagaggctaccatgaatatctaatgataaaaccctgtaatagtaattgagtttccattcttttgaattgtaagactattcattaaaagagtatgcaaagattacttctatggtgttggccatcagtatttccttacttgtgtctgtatgtaagtcctgctatatgatgttcatttcagtcaagggtatggtaggtctaactctctgtattaacgtttttttcccgtatctgccagttttgaagcctgagaacagcaatagaaattgccatctttttcttgcttttgtctcttggttaaaaaaaaagaaagaaattgtcatccttttttaaaaaaattaacatttctgatctcttaagtaaggcagatattgtagatttttaaattttatttatttatttatttagtttttggtacaaaatgacctttactctctttctaaaatccgtgcattggtctcacagaagaaaacaacgtcttgttactcaacctcctgggttctctagctgagcttgtccttacttgtccaaagaaattcagttgttgagccactccgtaatcattatctgaaggaaggactagattgtcttccttatcgtttaaggtcattactggtagtttctgtctgaactcactggtagatcacctaatggggtgttacaaccattagtttcagccttgcttactgaacattgaccagaatagcctgctgtgccgtcctgtgctgtcctgtcctgtcctatcctatgctgtcctgtcctgtcctgtgctgtgctgtgctgtgctgtgctgtgctgtcctgtcctgtgctgtgctgtgctgtgctgtcctgtcctgtcctgtcctgtcctgtcctgtcctgtcctgtcctgtgctgtgctgtcctgtcctgtgctgtcctgtcctgtcctgtcctgtgctgtgctgtgctgtgctgcgctgtgcttcctggcagtggtattaacaagtaacaaggacaagtgaatgatgagagagccagagaagcaaaaggcagagggaatatcttttaaaatggaaagttaagccccaaataatgaagttttcactactggaataaatgattatgtttgtagcagcaaaaaatcaagtttagggacatttggctggtttttgatgattgtgtataaaagggaaaataaaacaattcatttttaattatattaacaatttagacaaaatattttattaataacattactaatgaaaatgttttcttttaattctgaggtagggccatgaggtcagtttccttgaaacttaagttatgtaagagaaaccatttcctatgttttccctgaatgaataagctttgtcacccagactggagtgcagtggtgtgatctcagctcactgcaacctctacctcccaggctcaagcaatactcctacatcagcctcccaagtagctggaactacaggcacatgctaccatgctgggttaattttttaaggttttttttttttttttttttttgtagagacgacgtctcactatatggcccaggctggtcgtgaactcttgggctcaagcgatcctcccacctcagcctccccaaaatgctgggattacagacttgagccaccatgcctggctagaattcccttccttccttccctctgttctcccctccccttctctcccctcccttctcctcccctcccctccactttcttctcttcccctccttcctctcttcctttctccctccctcccttcttccctccctcctttccttcctccctttctttcttttctttctggcagggtctccctctgttgcccaagctgagtgcagtggaatgatcatggttcactgtagcctcaacctcctgggctcaaatgatccttcctcctcagcctcctgaggtgctgggactacagggatgtgccaccaaacctggctaatttttttaattttttgtagagacagggtcttgctrtgttgcccaggctggtcttgaactcctggcctctgaccctcctccactgggcctggccaaattctttttcttattttcttttttttgttaacctggctgtttaagaattctttttcttataacttgaacttcatgaggaattttttttttaattctaagagagatttaaaagttacttacaattcatttctaaaagttaacctttttgcttaagtacaataataatggcgagtactaggaaatatgtgaggtgttttatttatgttaaaccattaaattgtgccacaagtaaatcacaactatctgtacagtggagataatagtatctgcctcttctttcctagatactataaagctaaataatgtgaactgatttgccggattagttatatagagagaaacttcatgtgtgcataaattaatgtgtgcataaatggcttctttcccccattttatttttttattgtttattgttttttgagagggagtttcactcttgttgcccagactggagtgcaatggcgcaatctcggcttgccataacctctgcctcctggattcaagcgattatcctgcctcagcctcccgagtagctgggattacaggcatgtgccaccacaccctgctaattttgtatttttagtaaaggcaaggtttctccatgttggtcaggctggtcttgaattcctgacctcaggtgatctacctgccttggcctcccaaagtgctgggattccaggcgtgagctaccgtgcccagcctgttttagtaggtattattatctccacttctcagatggaaaacttggcacacagaaaaatagtcacttgtccaaagaacacagctagtaagaggcagaggaggaacggagccccagggtgtggttgttgggctgcacgctcctgaccatggtgtgtgctctcccagaagatagaacagaggttctgcgagactttgctaaatatatccaggagcagctagagcctagtcttctctttttttttctttttttttttttttgagacagagtttcgctctgtcacctaggctggagtgcagtggcatgatctcagctcactgcaacctccacctcccaggttcaagtgattctcctgcctcagcctcctgagtagctgggattacaggcacccgccagctcgcccagcaaatttttgtatttttagtagaaatgggtttcacgatgttggccaggctggtctcaaactcctgaccttaggtgatccatccgccttggccttccaaagtgctgggattataggcgtgagccaccgcgcccagccctagttttgttttgagtcaggaacagagaagaacaattttccttctctttttatctagaagctgttttttycaagtacatggcatgatatgatcttagctataaagcaattttagatttctagcaagaaaaaaaacaaaaatgtggtcttgtgttttttttttccaaatctctgattagtgcttgaattgaagactttgaattttaactccagtaacttggacttaatgacttatgagccttagaatactatttttttaagttgaagtatttactaatttaattttttttttttttttgagacagggtcttgctcagttgcctaggcaggagtgccgtggtgctgtcatggcttactgcagctgtgaactcatgggcttaagcactcctccctgctcagcctcccaaactacaggtgtgcgccactacacctggctagttttttttttttttttttttttgagacagagtctcgctctttccccaggctggaatgcagtggcgcatctcagctcactgcagcctccgcctctggggagggttcaagcaattctcctgcctcagcctcmcgagtagctgggactacaggggaccgccaccacgcccagctaatttttgtacttttagtagagacggggtttcaccatgttggccagaatggtctcgatctcttgatctcatgatccgcccgcctcggcctcccaaagtgctgggattacaggcgtgagccaccgcgcccrgcccacctggctagttttaaaattttttttgtggagatgggggtctcctcatgttgtccaggctgatcttgaactcctgggctcaagcaatccttccaccttggccttccaaagtattaggattacaggtgtgagccaccatgcccagcctaattttttgtttcgtgtaaagccattctagatgaatcacattagttaacatctatctcaggctcagttttctcttcactgagcaagaagtgaaatgattttatcaatttttttctatcaaatcctgatcttgggcaactatttggatgggtaaaaactacttagatttaacttaaattttttttttagggtctagtctttttaggttgaattctattatttacatgtagaaggagtaatgttctttactttcagttttaatatctttatctacaaattacactagaagtttctgtgtaaatctagcttctgttacctaggtatatgccttgtaaaaagtgcttctacttgagtaaataaaagcagtatcttctyatccttaggagggaagaaattaaaatctaaatttggctgggcccggtggctcatgcctgcaatcccagcactttgggaggccaaggcgggcagatcacgaggtcaggagttcgagaccagcctgaccaacatggtgaaaccccgtctctactaaaaatacaaaaattaaccgggcgtggtggcgcgtacctgtaatcccagctactcaggaggctgaggcaggagaactgcttggacccgggaggcggaggttgcagtgagctgagattgcaccactgcactccagactgggcgamagagcgagactccatctcaaaaaaaaaaaaaaaaaaaaaatctaaattaaaaaaaaagcaataccttttaaaagtacaaagacctcaattttttttaatacctttaacttagcttaacaagaccattttgattttttagaccagtgtgaagtaatatcagatagagagtgaaaaaatgtggagataaaacagaagtggctgccgggccatgtctataatcccagcactttgggagacagaggcaggtggatcacctgaggtcaggagtttgacaccagtttggtcaacatggtgaaaccccgtctctactaacaatacaaaaattggctgggcgtggtggtgcatgcctggagtcccagttactcaggaggcctaggcaggagaatcacatgaacctaggaggcggaggttgcagtgagatgagatcgcaccaccgcactccagcctgggtgacagagcgagtctccatctcaaaataaaaaacaaaaaaaagaagtggcttacctaggacagcttcagcccctttgtctctactagaaggcaaaatttttgatgttaatattaaaatcctaagggaattcttagtgggaatgcggaagtgtgagaaattaaaaaagaatagaaccaggggatccatttatcataaagttaggagtctataaattcatttgttttaactgataagaattagctgagtgttgggtgattttttaaaaaataatgtgaattcatatgacaataggagtatttagaataatttttttaaatgttattttaagctcttcattcttgcccattctcatctttaatccgtcttagagttgtagtattaatacattctaagagacagactgatttggccgactcttttcagtgaaactgttaggattgtgtgtttagaaccctgtagcaaattaactctgaaattaagttttgttttttttttttttctttttttggagacagggtctcactctgtctcccaggctagagtgtggtggtatgatcatggcttactgcagccttgacctccccaggctcaggtgatcctcccacctcagcctcctgagtaactgggactacaggcgcgcactgccatgcccagcttatttttatattctttttgtrgagacaggttttcaccatgttgcccaggctgatctcgaactcctggactcacgygatccacctgcctcggccttccaaagtgctaggattataggcatgagccaccatgcctggcctgagattaatttcatttttttttcttttttctttttttttggagacagagtctcgctctgttgcccaggctggagtgcagtggtgtgatctccgctcactgcaagctctgccccccaggttcacaccattctcctgcctcagcctcccgagtagctggaactacaggcgcctgccaccacacccggctaatttttttgtatttttagtagagacggggttccacagtgttcgccaggatggtctcaatctcctgacctcgtgatccacccacctcggcctccagaggactgggattacaggcatgagccaccgcgcccagccgagattaatttcttaaaagatccattcaaaagggaggaacagtgctgttagtctaatttatagaatacatttactttgcttacagtttaagtccttgatatgtttgtaaatacctcaattcacagcatactaagctaccccaagcagtttcgtcgttttttttttttttttttttttgagacggagtttttctcttgttgcccaggctggagtgctatggcacaatcttggctcactgcaacctctgcctcccgggttcaagcgattcgcctgcctcagccttccgagtagctgggattacaggcaatgcacaaccacacctggctaattttttgtattttttttttttgagacggagtctcgctctgccatccaggccatagtgcagtggcatgacctcggctcactgcaagctccgcctcccaggttcatgccattctcctgcctcagcctcccaagtagctgggactacaggcgcacgccaccacgcctggctaatttttttgtatttttagtagagacggggtttcaccgtgttagccaggatggtctctatctcctgacctcgtgatccgcccgcctcggcctcccaaagtggtgkgattacaggygtgagccactgcgcctggccattttttgtatttttagtagagacggggtttctccatgttggtcagggtggtctcgaactcccgagcccaggtgatctgcccacctcagcctcccaaagtgctcggattacaggcgtgagccaccgygcccggcagcagtttcttattgaaacagaatgttaaaatctgttattaagtactgaagatatacacatacacatctttttctactgctgggccttattttttggcctgttgaaatggaaacaaagtgaagtgatactaataatacagtatttccattcagarggaactttaaacacattgtgtggtccagtttcaccttataagggtaacaaaggtatagaaaggatgttatttattcatggagacagaaaagttrtcacctgcattttctttccttgcttatttataaagtggttttaattaacccactgagttcatttggaatcttgtgtcaccaatattggtagatctgaagttttctgaaattattggacactttggaagcacaaaattttacattagatgctctgatagacttggctgggatcatctcttgcatttaatccagattctgtggcagccttagaatgaaaatgagcttcatcatgactccagagatggagtatatactatgggtaagattcctcttttaaggttcacattaattgaaagcaccattgaaagaggggatggaggtaaggggaagctggggcttgacagaaaataaaatactacattgatcttttattttctttttggaggtagagtctcgctctgtcgcccaggctggagtgcagtggcgtgatctcagctcactgcaacctctgcctcctgggttcaagcaattctcctgcctcagcctctcaaatagctgggactccaggcgcacgcctccacgcccggctaactttttgtattttagtagagacaggttttcaccatgttgcccaggctggtctcaaactcctgagctcaggcaatccacctgcctcaggcaatccacctgcctcggcctcccaaagtgctaggattacagacatgagccactgcgcctggcctttattttttattttttatttttgaggcagagtctcactctgtcgccaggctggagtgcaatggcacgatctcagctcactgcaacctccgcctcccagattcaagtgattctcctgccttagcctcccgagtagctgggactgcaggtgcacgccaccacgcccagctaatttttgtattgttagtagagacagggtttcaccatgttggccaggatggtctcgatctcttgacctcgtgatccacctgtctgggcctccaaagtcctgggattacaggcatgagccaccacacctggccttttttttttttttaattgagatacagtctcactctgtcccccaggctagagtgcagtggcacattctcagctcactgcaacatctatctcctgggttcaagcgattctcctgcctcagcctcccaaatagctgtgattacaggtgcttgccattatggctggctaatttttgttttgttttgttttggttttttgtatttttagtagagatgaggtttcaccatgttggccaggctggtctcgaactcctggcctcaactgatccacccgccttggcctcccaaagtgttgagattacaggcatgagccactgggcccagccctgcttttcaaattaagaagagaaagcatttggttctagataatatacacatagctctctttttatgaagtggaatggcttagtgattaatatttctgtctgaggtgggggtgctttcttaaggttattagtagaaatggtgtttggagttgtttagtttctgccatgggtataagtgagttgtctcttaaactgactttgcacactggaaaaataaaatgaaaggcaggcctggctgagagaccagagcttctgtgccctttgatgtatcatttgagccctttggactaagaaaatgaacttcaacttccccgtcctctgcttcacaatttagttatatctagcccttctgccaaagagagtagtgtgtccttctgcctttttgctctatattctctcaagactcctgaaagctttttctagtatttctcccttcttttcggctcttcagattccttttacccactgtttctttccctggcctgctagtgggctcttttccccactcacctcctctctgccttgttttcccctcagcttcctgtgtgccttctccctctccctcccgccagtcaccttcagttgcctgcagccactgctgggactttctcatcggccttccctcccttactctctggatcctggcttcctccttgactctattcaaactttttgccaggctcaccaatggtctttccattcagcaaacagttcccaaacacctgctgtctgcccagcactgtcctgatgctcgagtaccctatgtcttcttcctctccttccggagttctttctgtcctcctcgggggtggtgcgtgttctccttccttgtcatttccacagtcctcctgggcctgccttcctgcttgttgtattaggaaagctcccagtaggkctctgctttcagatccttaacctcattcatctcccacagattcytaggatccccactcgtaagtatagacctgagccagtcttccatgctcaggacccacctgttcctgcagccctcatggctcttgataatctagccatcacctcttgtgcagtttccctctcactcactcctgtcaagggcccacccacaccacaccttgcttttctgagtttgctcttgttcccattggtcataccctgcctgtgaaaattcttccttatcctcctgggcccagctgagacaccattcatgttaaggatcctctcctagtactcagtcagcatccattgctggattcccatcaccayagtagctgtgaactgttgttaccaatgggtatggtgccaccattttcttgattcagctcagtaaatatttactgaatgcttcagcagccctagtggaacgccttgtacatagtaagcacacaaacatttctttgcccagtggttggatgtgagaacaagctgcaccttccttttgccagcatggtgctgaggtggggccctggcatttacactttaaaaagcccctagtggccaggtgcagtggcttacacttgtaatcctagcactttgtggggctgaggcaggaggatatcttgagcccaggagttcaagaccagcctgggcaacatagtgagacctcgtctctacaaaaaatagctgggcatggtggcatgcgcctgtagtcccagctgctcaagaggctgaggcaggaggatcgtttgagcatgggaggtcaaggcttcagtgagttgtaatcatgccactgctccagcctgagtgacagagcaagaccttgtttcaaaaaatgaaataaaaagcccataggtaattccaaaatagattgtatcatggcagttctcttctgggtcttacccagatgtctgcggttataaggatacagtggtaggttttattattaccgaaactaacctagaatcctttttcacacagatcttcaagacaggactctttgtatattgttgagagagattcttggccagagccttcataaatttatcttgcttgtgttcacagacctgcaaggggtttttatttcacagatcacacrcagctttattctcttttgattgtgtcatgaaaatagcctggtcagatgtcatgtcagcactaagcctaaatggacaattcagagaaaagaaaatgagctttgtaaccgttgatttggttaaactgtttgatgagtctgtaaggaatcaggatcataagagtgggattcctatttgatggtccttctcagtcccaaagtctttggacccttgtttctcttttggtaaaagaatttggtgtcttttcgakaacaaatgtgacaaggtaaacacttctctactaagatagcagtttccatttccaaagccgtgcatcatcaagtattggcttttgccctcaagcaatctgatattaaaaagcttcaactaagtgagggaaataggattttttcctgtttcaagatktttactttaggagacaaaaatgttttacttctgtatatatcttaaggcactaatacagacttcaaatttagttttatgccttttgggttaaaagtgaagaatggtctttcctttatcccataaagcagatgactttggtggctgacagtgttaagatcaactacagtaacttcaaaaaattttttgaccctgttccatagaaatgctttattttgtaacccagtacataccaaatatatttgtgaataattgaaagaaagcttcacagaacaatatccttatgttgcactctgttgtcctttttttttttttttaatgctggttgtaacccaccaatttgatgctggtttcactctcaatttgaaaaatcctggtccatctatagattgtgtgacactccctaagcctccacagtagtgagaaaactggtctgaattgtcagaaaatagaaaccaaagcctcagtagtttaacactatcattggtctgctcaatgcaagttaatacaactgaagcagctttagaagttctgaggtagttaaggtgaaacaatcttctcaaaatcatattggcagtatcaatacttttcagtctccattttgaagttaaatgtaattgaagaccttacttggtttcctagtrgcattctttttttttcttttgaaacagagtctcactttgtcacccaggctggagtgcagtggtgccatctcggctcagtacaacctctgcctcccaggttcaagcgattctgctgtctcagcctcctgagaagctgggactacagggatgcgccaccacgcccggctactttttgtatttttagtagagacgcggtttcgccatgttggccaggctggtctcgaactcctggcctcaagtgatctgcctgcctcagcctcccaaagtgctgggattacaggtgtgagccaccatgcctggcccatggtagcattctttagttcacttactcattatcagtttcttcctcaaaagaaatgttttttgatagacacttgagaaaataaattttaaaataaaatagaagatccaaatcgtaaatattttgtcatatatatccttccagattgtttttggtgtatataaatrtatgtatgaatacacttgagaaaaacattttaagaatcaactgatatactatatatactgcttagtatgaactgaaatgatgtaaaaaatgatgccaaagacttcgatgttagtatatgtatgtctctatgatcattgctaatggctgaatagaatttcatcatatatgtatattaatggatgtaatataattaaaccaattctctattagacatttaggttgtttccaatttttagccattataaacaaggcccagtaaacacttttttttttttcttttgagacagtcttgctttgttgccaggctggagtgcagtggcgtgatctcagctcactgcaacctccgcctcctgggttcaagtgattctcctgcctcagcctcccaagcagctgggactacaggcacacaccaccacgcccagctaatttttgtatttttagtagagacggggtttcaccatgttggccaggaaggtctcgatctcttgacctcatgatctgcccatctcagcctcccaaaatgctggcattacaggcgtgaaccaccgcgcccagccaagattttttaaatgaactggaaattgcaaatctacctaaccctaaaaaaaataaaaaataaaaaaaaattatgtacagaaatcttccctaatctgtttaaagaacttttgccttttcttagagtagcatcacccttgtgctrttatagtacgaaatagatataatttgagatgaaaacttgacttactagaaactgattgtagttcttgccttgattttcagacagtacctgtaatgagaaacagtaaagaaaacagactaagaggaaacaaagcgttctgcgcggtgggtttctaattgagtgtagtgacctgtttgttaaatattcatgattcgcaaggtgcaagtggccattctacattgttatactaggttaggagacgcctttgtagaatacaatttttgtttttgactttgacttcttaagcctctaagtaaatacagttgcagctggctgcaaatcctgctatctgacttcatcagcccggcccattatcatcctttcatgaggtttttatttttttatttttttattctagaaagaggggttgtcccctgctacctgtaggtattggggtatgtgaccatagctccaatggcctcggcaccatcacaagtcttggtttgagtcttgttaatgatggcagctttgtgaacattgcttgttttcattgtttcagataagttatctatatgcatattattggatgtaatttttggtcaaaaaagggatagaactaggattttaagaatcactttaaaatatatatctgtaaacagcattttgtttaatttatacatttttataataaaaatacataataaccacattgcaaaaaagttgaagtgtagaaaaagtcaagcagctataatctttccatcctaatataactactgtgatttcgttctttctttccagtctttattttttttgagacagtctcattcygattgcgtaggctggagtgcggtggtgcaatcttggctcactgccacctcgacctccgaggttcaagtgattcccccacctcagcttcctgagtagctgggactataggcgcgagccaccacgcccagataatttttttgttttgttttgtttttgagatggagtcttactctgtcactaggctggagggcagtggcgtgatctcggctcactgcaaccttcacctcccgggttcaagcgattctcttgcctcagcctccctagtagctgggaccacaggcacacaccaccatgcccagctaatttttgtgtttttagtggagatggggtttcaccttgttggccaggatggtctcgacctcttgacctcgtgatccacctgcctcgggctcccaaagtgctgggattacaggcatgagccaccgcgcctggccttttttttttttgagatgaagtcttgctcttgttgcccaggctgggtgcaatggcgcgatctcggctcactgcaacctccgccccccaggttcaagcgatctcctgcctcggcctccctagtagctgggattacagccgcctgccaccatgcccggctaatttttgtatttttaattgatacggggtttcactatgttggctaggctggtctcaaaactcctgaggcatgagccactgcacccggccaatttttttgtatttttaatrgagatgggggttttgccatgttggccaggctggggttttgccatgttggccaggtctcgaactcctgcactcaagcagtccacctgcctcagccaaccaaagtgctgggattacaagtgtgaggcactgcacccggcctccagtcttttttttcttatgtgtagactttacctagttgtaagcagacatttcagaaccaatgtctttgcctaagggaacataaatgtggatgtattaaacggctaagttttaaaaaacaattatatgctagatattaattactagaattctttctcaygtgctgaatacaatattgtattgcactgtaaacacagaaaggtactgccaattcagttrtcagggttgtcatttattagaaatgcaatagtaaaattgtaaaataaggctgggcatggtggctcatgcctgtaatctttcctgcctggcactttcagaggccaaggcaggaggattgcttgagctcaggagttggagaccagcctgagcaacatagcgagatcttgtctctactaaaaaaaaaaaaaaaaaaaaawtaacgaggcatggtggcgtacgcttgtagtaccagctgcttaggaagctgaggtggaacaattgcttgagcccaggagattgaggctgcagtgagcttgatccactgcactcgagcctgcgtaacagagtgagaccttgtctccaaaaaaaattgtaaaataccataattctgaaatgggtccttcgtgtcaccctcccctttgagagtcctagtggtggaaggcgggaatttctgaaagtgacttttttttttttttttttaaaacatgaactgcagaatgaaagtgactcttatcagggatctccgagtagcctctccaagatgactaaaacaccaagtcatgttagttacattaaagaaaaagttaggcacgctcatgtacacacatgtacatatgaactgcaataatgccaacataagataacttgaccagaagtctattaaagtcctttcagggtctgtgtcctgcagttacagaataccattttgtgtctatgatgatcacaaaattggcataggcttttagtttttatcttcgcttatacccagaagccatcttatttgtcaccttttttatactctgtcccaatgactcatacattcccttggaggctgagaactgccttctttggttggaaattattgaaatgaatgggaaaagcaggtatagaatatgtgcaaaagaattaggatatagttgaaaggatttggagttaggcagcccgtgcttgaacctggactggacccatcctcctagagctgtgtattaaggacaataaaccctgctcagcctgacagggtggctgtgaggagaggatgaaacgttttaggagagcgtactttatcaattccaaagcccagtatrtgtcttcatcctcaagctgaactggaaaggtactcttaatagagcgctgtacatgaaaccacagtaaagctcttaaacaaaacagccttattgtgaccctgtttctttcttcttccttccagtcttcaggcagtgacagtggtgggagcagcagcagcagcagcagcagcatcaayagcccggacagggccagcgggcyggaaggcagyttgagccagaccatggccggatccagccctaacacgcctcagcccgtgcccgagcagtccgcgctgtgccaaggcctctacttccacatcaaccagaccctgagggaggcccacttccacagcctacagcaccgagggcggcctctgacatgatgtgccggcagtttcttgccttctgtgaagggacagcgctgtgcagatttgatatttcaacttacaacttgttttaaaagaaaaattgcacacgaaaaatgcctgttggcttttcagtctatatttgaaataacaggttaacaggcagttgtttacttgtggttttgctgcactattgcaatttcaaaggggctttgaagcaattttttataggattcttttgagggagggtatcaaatctatgtcaaggtagtggtttgaggaaaactcattctgtgtgttgaatccatagtatgtcccattcagactgatttccaaatctgtcaactagaaactctactttatgtaaagggccttttaaaaatgcgggatcttcaattttttttwttcaataaactagtaaagagtatctagtttccatgaaaaaacataagtttttttccaaaatataggaagcttgattcagtcttgcactgaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagggagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaagaggctgcaacatagcccatgcttagggactggatggtttttgcaagagctttttttttttttaaactaccatctcccaacttwtaaagccagatacttgacaaggattttagatcttaatgggttcgatggtagggaatacggaamggatacactgctaatattgtgtctaacaataaagcaaacaactcgatgctgtaagaagmcaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcatcttttacaccttctagtagctcaagctagtaaaaccttgtacttctctattgcgccgccattaaaagcagcattagtgcattttgtcattcagttcttaatcagttatttaaaagggagctgatcatgggtggctcggtgggaggtggggacccatccacggatgagcctcttgctcttggcaccaacctgagcttttgtttcgatgtttctggttgatttagcctttcgagtgcttgtcatgctcagtgggagaagtccaaacctccaaaacaagaggaaagaatttagtagcacaaacaggcagctctggggcccagcagaagcctcatttttttttttttttttttttttgagacagagtctcgttctgtcgcccaggctggagtgcagtggcgcaatctcggctcactgcaagctccgcctcctgggttcacgccattctcctgcctcagcctcctgaatagctgggactataggcacctgccaccaggccagctaattttttgtattttttttagtagagacagggtttcaccatgttagccaggatggtctcgatctcctgacgtgatccgtccaccttggcctcccgaagtgccccgcagaagcctcttggcagcctttacctgatctgactggatgccagtggcaggatgttatggggttcttgggagttgaacgtactgctccggggggcgagctgattctctgtaccagtcaccaatccaaacagaacctggcagacaagaggtggagcagaggtttcattgtgcaggtaaaagaaaggcaaaaaaaaaaaaaaaaaggttagtcacccatcgctaccgtatttctaactgtcattttggggaatgttctgagtgcgtttatgcttcacgattactttttatcactgcccacaggtcagaatctgagaggcagggagtttttattcctctttctgaggcctggataaaactgtaataatccttatttacaacttaaggggccaaatcttggttgcctcagtgtgtgagattttatctaatcctctttcagtccttataactacactcggctatttgtgtcttattcccctccctatgctgcatcctggagtattacgtgcttgagcaggttaattttgttatttgagcctgtatcgcttcgttcgcactaagcatgtttttgatttgactcacagaagttcgctgcaccaggcgatgaaggttgctgttgaggtgtggcgtgaaaacgtccaggtcaaatggatcaatgagggcttccaggtggtcagtcactttctcaattctgagaaaaggattaggatcattactgtccacattttttaggatcaaaaacaatcttatgatatcctactgctgtagaaatcttggagttgggttttattctacttagttgctggcttagtacgtttgtcactgatgatagtgcttaagtcaccctcaagcatgatgtctaagtgaagtccaccctttcccccgttctgtctataaggagggcactaagggctcaaatgatactcagcagctgctaggctgactcagaagagaggggaataagagtccacctatttcacttgaccattgcatttatccagcaggcggccattatttaacttgctggtaatatgagcacttactgttcaaaacaaacacaatgaatgtgcagtataacaggctgactctggtggcttcccagcaaagggactatttgcttttggaagagaccgccttgacatagctccctagaggatacgacacctggagtctggcttgctccggccactcttcacctcgtcacccttggctgtcagaacaatgttgaggtaacgcagatcataaagcagctgcagcgcccggttctgggtgactggaaatgcaccttctttctgcaaatgaattcccggtccccacccatgaagagagaggacttggtatgtgagcgtaataaacagcttcaagttttggttgagtttcagcttgctatttcagaagcagatggttttaatgctcatatggccagtttaatctcacaacaacaaaacaaattttgttagaaacttgaccttaaaattaaaaacctaacagcagggaagagacctggcccttaaaaaaggcctcagatgctgtaaatggttgttctaaaggggaaaaaaaggctccttgcctgaaggagaagtgttttgaggaggctcattagagaagacttactgaattctttccaaaatcaggatttgttccttcttgggtttttgtttgtttgtttgtttgtttgttttgagatagagtctcgccttgttgcccaggctggagtgcagtgacacaatctgggctcactgcaacctccacctcccaggttcaagcaattctcctgcctcaccctcctgagtagctgggactacagatgtacgccaccacacccggctaatttttgtatttttagtagagatggggtttcaccatgttggtcaggctggtctcgaactcctggcctcaagtgatccacccgccttggcctcccaaagtactgggattacaggtgtcagccatcgcacctgaccatgttccttctaaaaaatgttactggccaggcgtgatggctcctgcccatagtcccagcactttgggaggccgaaacaagcgatttgcttgaacccaggagtttgagaccagcctgggcaaaatcgcaaaacctgtctctacaaaaaataacaaaaattaggtgtgctggcgcatgccttgtggtcccaactattcgggaggctgaggtgggagaatctcctgagcctgggaggttgaggttgcagtgagccgagatggtgccactgcactccagcctgggtgacagagtgagactctgtctcaaaaaaaaaaaaaaaaaaaaaaagttactaatgaaatgggattatacaccaagggcagaacgcttcctagacagtgaaagcagtgtgaagggttgggagacaagaactccccgtaagtaagcacctctgtgtgtcacactttgtggcaggcaactgttctctctaactccccacagtcacccctgaggtaggtgtgctgtggctggggccgggggctgtctgccttttacaagtgaggaaaccactgagcggtttatctacaggatcacatttggccctaaggaaacggaggttaatgatttgcccggagcccccagtgaaccagtggcagcactgaggttggaagccaggtcttttattttgaagctctgatccttttcattgttttttgatttttttgttttgtctttttaagagacagggtcttgctttgtcgcccaggctggagtgcagtggtgagatgatagctgctcattgcagccgtgaactcccaagctgaagccatcctcccacctcagcctcccaaagttctgggtcttggtgtttccatctgtgctgagctgccttcttagcgaagatctgctgaccctttagaatgagtgtaagtaaactcacagcgctgggtgctactcctaagatagagcatttttacaggacccgatgcctgggctgggtgatccttaacagtttgagtctttgatgtgaactgctcaaacccaagacaatgctaaggttttcttttgtttaatttgtgtttttaatgggcaaacattcagacacctaccttaatctgtttttcttcggagagtttctcataggcagctactacttgaaccatacagcttttcagcatctcctgtaatgtcacctttggcaaggcatggcctccaacccgattaatttcctggcataaactaaacaggaaggactgtacataccaggacggctaaaagaacaaagaaatgtcacattgccaacttgcaccaattaaatgacacacagtgaaagtgaatccacttaatcttacaaggcctatgtgccaggactttgacccctctcagcaacgcttcttacaggcagactgttcagcagacacaaggcccctggttaagtgcaatttgctgttactgcctccacggtctgaggctgatctcgaagaggtgcctgtgttttatgctgctgatttcacggcaagtaagtggttccctaattagcacagagcctatgctacaaaaggaaagaatggttaactgacttcttgaacagtctgccatttacttagccctacatctactatgcccccacagtagaaaattacagatgttactttcagctattcctcagaagttgtatgttgaatgattttctaaaatctttcttcttttccacggagcagtttattccctttttcagcccatggtccctgctcacctgtgcagggagtcggatcttggatgtgacactgctgccagactctgcctcctcctgaatttctagctcatcccagctggtggctgtggccagaactgagccagcatcatctagaagtaatgactgggtgaatccatgaatcaaaacctggtaataaaaggcagatatccatacaagccactcagatcctctgtagagtttctttaaaacaatctgtgtaatcctgagaacagctcaagctgctgaagttgtaggtacagtgatggtatcagtcctcttttggctaattatcaatgatatcagccatgggaattttgttgctaactaccctataaatgtcaaataccacttctttttttttgagacagggtcttgcccttctcccaggctgattgcagtggcacaatcacagctcactgcagcctcgacctcctaggctcaggcaatgctcctgcctcagcttcccaagtaactgggactacaggcgtgcaccatcacatccgaataatttctgtactttttgtagatagggggtttcatcatgttgcccaggctggtcttgaattcctgggttcacacaatccaaccatctcagcctcccaaagtgctaggattacaggcatgagccgccatgcctggcccaaataccacctcttaaggtacaagtggaggctactgggaatatgatatttaggttaaagagaggaaatccaggcagaaagtctttcattctcatctgatgcaaggaaaaaatgcagcttttctgtctactgaatctaagctaaaaatgaatgaaaaagttttttttgagacggagtctcgccctgttgcccaggctagagtgcagtggtgcgatctcggctcactgcaagctctgcctcccgggttcacaccattctcctgcctcagccttccgagtagctgggactacaggcgcccaccaccatgcccggctaattttttgtatttttttagtagagacggggtttcaccatgttagccaggatggtctcgatctcctgacctcgcgatctgcccatcttggcctcccaaagtgctgggattacaggcatgagccaccgcgcccggccaaaaaagtttttactgaactttctggcagagataaagttaaccgtatgaaatcagaattgttttgcctttactactgaaggaactgattgaggttggcaagactggaatatgacagaagtgagacaagacagggataagaaattacatcactcactttcacaactgcactgctccagacctggtagcccatcacgctctgctggaggagtacttctttaacctcttgccacttggcctgtgtaggaatgatttcctgagttttcacctttccctgttttctcagagccctaaactcccttgctggtttctctgagctctctgattttcccaggatgcactgcttcagatgggggcacagctctcccagggactggcagagtctggccatgaaaagaactgagtgcagcttggcactgttgagggcatcctgttgcccttgcacaccctcttcaatgctctgtagctctgcccggatgcagtccacgatgtgcttgatgcatgccacggactgagtccgcagcatctcctgcacggtccccgcatctgcgtatctgtcaaaggcagaactcttggcctgtgtgggagaaacgtccttgggcagtgatgagtcatcagaggggaggtaagccaggaggtcatctagtttaaccttcagcttagaatccagggcagaacagaagttctgta

SEQ ID NO: 10813 - DNA, 53282 bp, Homo sapiens
ggcacagtggctcacacctgtaatcccggcactttgggaggccaaggcaggaggatcacttgagcccaggagttcaagaccagcctgggcaacaaagggagaccttgtctctacaaaaataaaatgaaataattaagtatggtggtacatttccgtagccccagctgaggcaggagaattgcttgagcccaggaactggaggctgcagagtgctgtggtcgcaccactgcactgaaacctgagcgatcgagcgagaccctgtctcttaaaaaagaagaagaatgtaataaacacctgtgaaaccactacccaaacaaaagctaggatcttgacagtgatttacatcttaccatatggccccccaacctgtggcgccacgttgccctcttaatcctcatcctaaatcctgtatttattcttcccttgtttcccttcatacagtttattatcgcatatgtgtgcccataattttagttgcctttgactttataaaaagggaatcatgtttatgtaacaggacatttttcattgaatattctatttcaaagatccatccatattacggcgtgtggctgtatagttccttcgtattgagtgctgcgtaatatttcatcgtgggaattaaaccataatttattcatttgttctctccagatgggcatttgggttatttcccagctttgaccactgtgaacagagctgctataaacatccttctatgggactcctgctgtgaatgggcaagaattcctccaaggtccatactccagagtagaattgctggaccatggggtgtatatgtgcttaactatcagagataaagccgggctgttttccaacatggttgcaccaagtcacgtccccaccagtaatgtctaagagggcttaatttttctccactgcacttacattacaagatgcactctatatttgtgcatttatttactttttctctcctgccacctagaaggtcagcttctaggagagcaagcgttttatgtcttttattcatcattgtatcttcagtgcctagaatggtatctggcacatagcaggtgctcagtaaacatcatctgattagatgaataaatggatggctctaaatgggccctaaaagctcgcaatatcacatatgattagcccaactacctagagacaggttgacaaccatctctcagttttaatcccttaaatccagggaaagaaccattggccaaagcctacaaatacctggaccccccagccaactacatcagtttctgagggtggggcttggacatgggtaatttgtatgcactctgcaggagattctcacatgaatccagggtgggacccagtgctctggggtggggagggcgttcatctcaccatctcgcccatagatgctcaagctgctttcaactccggctgtatgtgaatttcagagcaagaccctgggatgaatctgtgctcacctggaaccagcctctgcctggtgatggggagacactgctcccaggagccatgacctgcacacatggccacaagagcagtgcccaccttaaccttgggcctgcagaccctcctcgctaagcaaagccggctgtggatgtcacccttctgaggcttctccaattctactgcccattctcagcaggcagcaaaagacctttcaccactcgcaccccaccagtgtcctacaggcccaaggaacactctgacttccaggggccccatttcagtccccagagacacccaaacagtccttctcactctgtttcctgttttccacttaaactttttctcaactgctgaaggggaggtcacagctggtctgcacagaagaatgtagagggctggagagaagggctcaaaaaagcctaactcactcggctccacaggctggggacaggggtggcatgtgtctcccagggctcataccctaatgcacatgcccctaatacggtcttcagtgttactcatcttgttttgtgtccccttccagactctcctgtacctagaccagggctggacatacagtaggtactcaataaagtctagttaattccaggctctttccaacacaaatcaaatcacatcaaatttttagtaattcccatgactcttagaataaaattgcaaacccacactgggtcttataaggccctgcatggtagctctgcctcttctggccccaggctcacccctcttctttctcagtggttacttggtctcctttctgttgctttaacacaccaagcgctttcccacctctgggcctttgcacatccctgtttcctctgatttaatcattccccctcctaccccactcagccacattaagacctatgaatccttcagggagtggctgaaacatcaactcctctgaaaagccctccctgattccttagacctgataagacccctgttagatgtcctcacgatatcctgtacttttccctcatagtctttgcaaaagtttggaattagactttgtgtgattcttgattcatgtccgacttcctcactagactctgagacccaggagggcagggaccatgctgctggtgtcagctctctatctcagcacgtagcccagtgcctggcacataggagggcatctggtattttttggatgaatggatggatggatggatggatgaataagtggataagaggaaggaaggggccgggtgcggtgactcatgcctgtaatcccagcacttcgggaggccaaggcaggtggatcatgaggtcaggagatcaagaccatcctggccaacatggtgaaaccccatctctactaaaaatataaaaattagctgggcgtggtggcacgtgcctctaattgcagctacttgggaggctgaggcaggagaatcacttgaaccagggagtcagaggtttcagtgagctgagattgcgccactgtgctccagcctggtgacagagcaagattccatcttaaaaaaataaaaataaaaagaggaaggaaggaaggaagggagagatggaggaagggaagcaaggaaggtgggaaatttcatacatgaatgtatagatgaatggatgaataaatggatagatggattgatggatggatgatgggtgggtgggtgtatggatgaatggatgatggatgagtgggtggatgggtgaatgactggatggatgggtgggtgggtgggtgggtgggtggatggatgggtggaatggatggatggaggatgggtggatagatgaatggatagacgggtggatggataagtggatggtggatggcagaacaaaaaaaatgagttggtctctttctgccatctttctgagctgctataatggtgcatgtgaacgtcctggccagtgttctcaatagcatcaacatgctgagaagagaagcaaataccaggttgttttaggttgtgttccaaaatcatcatctagtttctaagtgtgatgatgaagtttagtttacatcagtgaatttgcaatcatcaataatcacagagctagaaaaatcactgtggacctcacaggcaggttaaacaagtgtacagtgacaagccccagtttgatgtgcaactcaaagatctagaaaaatggtacccctatcccctttggtttcattgtcctgacaacctcagctggtatcagggattgcaaggaagcaagacaaaaatacacaggagggaaaatcctgggattgtttttctagggatgtaataaattcatatgaataaaatgcctcaatggaccaaaaaaaaaaaaaacagttcatgattgattgcttttgcttttgtcctattgacttccccattggtatctgagccatccctcccatgaattgtgggctccttggtggccaaattccttccctctccttggaattcttttctccccaagttccctgggagcagagtgttgcattcccagatgttccaaacccagttgagaggggccattaagggccactctgcaccagatcctcagctgggtgccatccagtagtcactcaacaaacacagaggcagcatggtgctatgggaggtgcaaaagcatttgggactcagaccctagctctgccacttactccttgtgggaacttgggtaagctacttagcctttctgagcttcaggaggttttttgtttccttgtgtaaaatgaggacaacattaccttccttgtggggcagttatgaagagtagtaagtattatttaagtgcctggcacataataggcactcagtaaatgacacccttatgtaatggggcaccagccacaccacaccaagatgaatatgatggctatctcactctagcagggacagatttcatttaagaggctaattgtgatacagggtgtcatgtcaaggtatgggcaaaggaacacagaggaagatggggtgaattcaggaaaggcttcctggaggaggtgacatttaatcagaccttaaatagcattcgacaggaagtccagagacacgagttcttctttccaatttgctgctaaatcaccatgcgaccttgagccaatctcttctccactgtgggatccccagatccttctacaacataagctggttgagcacctgctctgaatccgttcagtcacagtctcctgtgagaagaatctgctgacagccagagcccttcttcccagacatacaagacacacaatgcctagacacacaagtttgcctgtaatgggagagggggacttcatggaccccagaaggccatccagggaccctaggctaaaatcccagaactcagtgatcctgtgggagtatcgtcagacttggccctgccctatgcaaagcctctctctttagtctacagcaggtgaaagcaagcagaatcattgacccaatctgaaaaagcccatccaacactgggctgcaggtcagagcaggggcctggggaggggaggtccctccagctggccggagagccagagctggattctgggaaagcacccctgagcagcctgcccctgaccctgcctagtgtatccccatctgccccggggaggcaggcgtgggctgctctgggcaggcgcccaaacaggccactgacccccgtcagccacccaggctggagttcccggacgcatccttcatcttccccaatctaaacacccccaggccccaggtggtccacccccctcccagccaatgtgtgtctcagccgcatccagcttgctggaggacagggggactggccatcccgttaacacttgagccgctgccatttccagccttcccttccatccaaccaatgctcacccaccatttattgagcaccagttgtttgcaggtggctgtgaatgacatggcagagggcctgcccttctcttcctccaggatctcacctcctggccagggtcccctcccctggtcccacccctctcacctggagcaggtgggtgctttgggggaagtgggctcagggctgggaactgggtactggcaggagattcagatcggggttggtgtctgggcatcgctctaagcttttgtgatcctgggcctggctcttactctctctggcttcagtctcctcatctgtactcttcagattccacggttccaactgagtctgaatcaggccttgtcagcaccctcccacccccaggaatagttagaggaggaaaggaggctagctctgaatgcttcaagatctttctttagacagtctctggatcttattcattcattcaagcatttattgagcacctattcagtgccaggccctggactgggagactggaaataaagatgacaaagattcaagccggtgactcctaaacatcccactccctgcctcacgctctgcttggggtcagaaggccccttggggtctcgggagggcctggccgaggatttggggcgccccgagactcgcgtgtcagcgccggtggcgctcagggccgagatctgtctcctccccttcctcctcctccgccccctcccctctccctcccggagcacggccgaggcctcctcccacccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtgagaacgcgggtgcttagggaccccacccccggctcccgctgggggcccgcgagcggctcggggacgtctgggctggggaagcggggctgttacccccagggcgggaggcagagacgatccagctcctggcttcgccccctccgcgacgcgacccccgaggggccctgggccgcgcctgcagcgccgcgcatccccgtgcttcccggcgcaccccagcgcacccggcatccccccggcagggcgagggccccgggggaagggaaggctccgggagccaaggagggcgccccccaggcggagagtctcggaaaaccgcgcccccggcccctgccttccctccaggcctgccccaagggaaagcgggcggggcgaccccgtacgccccccttgctgtcccccttcggttccccattgttctcagccgaatgctctcctgggaaggggggagggggtgctgcgctctcctcttaaagggccctctcccctcttgtctcctggcaggtcgcgagcacgagtggggtggggcgtgccacgggcccccgcccccctcgtccccctcgtcccccagcccagctccggagccgcagtccaggcgcgccgcccgagggtccacgccgcacccctcccccgtgcgttctgcggccacccaggccttccaggacaccgtggagagggaacaagggggcagggacgcccccttcggcaggagccgtcggagaagggggcccagaccggagggaggcgagaagccccactgaagccgggcgcagggtctgggacgcagttgggagtgcaaagggctggctgagagccgcaggagcagcaggctgtggcccaggcctcctgggtgacaggccctgtctggcggggaacagggaccaagagacaacacagaagaggctggacctcgaacaggggcggctgcctcactccctacmtgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcctgcaatagtgggggacctggcccctgaggcagtggcggccatgtcacggccaggccacggtgggctgatgcctgtgaatggtctgggcttcccaccgcagaacgtggcccgggtggtggtgtgggagtggctgaatgagcacagccgctggcggccctacacggccaccgtgtgccaccacattgagaacgtgctgaaggaggacgctcgcggttccgtggtcctggggcaggtggacgcccagcttgtgccctacatcatcgacctgcagtccatgcaccagtttcgccaggacacaggtgagcagacacccaccccatgccacccgccccgccgagccatcactaccttgcagcgtaggatgctgaaaatcccagtaaatctgctgatgccaaatcccttccccatctccctgcctcacctccagaaaaacagggcagtctaaccttgtccagtttaagacttggattccaatgcagcctctgagcaagctgtagggccttgagcaagttgcatcatctctctgagcctcagtttcctcatctgcaaaatgggtagatcaatatctctcacagctgagtgaggattaaataaaattgtgctcactgagcacagaacctagaacagcagtagcatgggattgtagaataagggctttacatgcacttcctcatttgatttttcccaagaatcacaggcagtaagtctgtgtattgttgtattattatgagtcccattttatagatgaagaaaccgagtctcccagaagctgagtgatttaaactcagagctgggatttaaacccaggcggttgagttccagaaccaaagttcttaactggtatcctatactggctccaagtgttggtttgtggggtggagtcgtgctggtggtaattaattggggatggggggcgttggtggtgttgatggtggggtgaggtggcaatgatggaggagacagtgttagcggttgtgttggtggtgactcagtgatagtattgatggtggtggggtcttggtgacaatggagggatggatgatggtgacgtggcagtgttggtggtgatgtcagtgatagcgttaaccatgggattcagtggtgttggtgacattgatagttgtgttggtggtggtgctggaagtggtgtgatggggtggtgatgatggagaaaatgagagaatgatgttggtggcagtcttcgtggccatgtggtgtggctggtagccctgtgtgtggctgttacttagtggtattggtgatcctgttgtggttgtaatgatggtgatgttgatggttgcgttggtggtaatgtgatggctgatgatggagataaaatcgatgaggtcccactctcaggcctactctcttttgttctggagatttgtcatcgttggggagatctccctgagtcattgcccggtggtatctgtgacaagctccatgggcagtggggactggtggggtcctgccgtgcagaagcagcctagaaatccttggcatgtttgaccccccaaggaccagctgatggggtttggggaagttcctatgaatccctggatgacagaaccacacgtaataaccccaggctggtaggatgctcgctttccctctagagctgtgccaaccaatatgttagccaccaaccacatgtggctactwaaatttacattaattaaaactaagtaaaatgtaaaatccagttcttcagtctcactagccacacttcaagtgctcatagccacatgtgtcttgtggtaccttgtgggccagtgtagatccagaacattgcattgttgcagaaagttctattacaccatgctagttagaaaggaggccagcctttctaactagcacagtccaatataagtttctgcaatgattgaactttccaatagtccggaacattgctaggtacccacagagtgcttaccatgtctggaaacacaggcgaattcataacaaatggcttattgatggtacagattagtacatctatgtttccgtaactccaggcattgaccaccatcactgatggtgccaattgttcatgcattccatcatatgattatttattgatctctgctgtgtgtcaatttctgtgctaagcactggagtacagcagggagcaagacaaagtcatcagtcgaggtcttgtgctggaggacctacactgaaggtcctggtgtggtcagggagcaagcaaacatatcaccacagagacaatcagtggcagatccgagagcatgaactaaacctggcccagaggtactcagggaaggctagcctgagaaagtgatgtttgaacagagatctgaagaatgagtgagggtgccagtgtcccaggcagarggcacagccagtgcaaaggccctggggtaggaaggrgcagaggacatttaagtccgttctgtttgggatgcatctcccaccaaggggaagatggtgcaagatggcagctgagcaaggaccggatgtacaggcctggacagccacgcaaagaactttgaatttgatccagagagtagaagtcatcattagctccatgtgcccattcttccagagaggcaccaaggacctgatggaagaaggggaagtgttgcacattacccgccccattctgttttctcctaggggtagagggcagggctgtgagagcagaagtgggtaggtgtcactccttgctaggaggtctggtgttctgcaggttcagagctaatgctgggtgtagagatcttccgggacctagctgggttgggtatgggcggcagggtccttagaagcagggacagactccccacaaggctgccaagttggcaactttacctttgatcctcttatctttggggggacccccatttctattcccagcatccccttatgttcccgagtccccagacttgcacactcccctttcatcaggccccattctctcaatagtaccccttttatggttcagcctcactggatcccccagaagttcagctctggtcacttcccctctccctctctccagagctgttcactccacacctgccccctgtttgccggaaaagggaaaaaaaacactcattcctaaatggactcctgggagcctgccaggaaccccctcccaccccaaccagagagggaggaaggcctggaaacctattgcgattggcaggagacctcagctgcctgggaacctgctggagagtggggcaagaggcctcctcaccagatatgtgagggtttttccctcgctttacccaggagcaaaacaatgtcaagaaaggacgtcttgtcctcattggtaacgcactggaaaagagcctcaaccggcagggagcagacctgagtgccaacggtgtgacctcaggcctctccaggtctcagtttccacatccgtgaaatgggtgagaggatcacctctccagcagggttgtcgggttgaacagagagaatctggctgattttatcccacaaacatcaactaattatctactgtgcatctagcacgtgctcaccactgtgggtacaagagagacaagcaaaagatcttaaatcttttttttttcttctttttttgagacagtgtctcactctgtctcccaggctagagtacagtggtgtgatgtcggctcactgcagcctctttccccgggttcaagtgattctcgtgcctcaacctcccaagtagctggcattacaggcaagctaccacataccacacccggctaatttttgtatttttagtagagatggggttttaccctgttggccaagctggtcttgaactcctggcctcaagtgagccgcccgcctcggcctcccaaagtgctgggattacaagcgtgagccactgtgcctggctgtgaatcttgaaaatattatatttcatacacacacacacacacacacacacacacacacacacactccaacataatgctgtaaaacccaaaactcatgtgtatgtgctgaaatcaacacaagcttctgtctagattttctaattgtaaaattcttgatatgttcattgaagctgaacttgaactttgaggggagactgccctagctttgctagtttcccaatgcaggagctggctgatttttttctaatagcatcagataataaatcttttaactttgtgggacctgcagtctctgttgtaactattcaactctatcrgagcagaaaagcagcatagacaatatgtaagtgaatgcgtgtggctgtgttctaatcaaactagttgtggacacagaaatttgaatttcatatctttttcacgggtcatgaaatattcttttttttcccccaaccatttaaaaatgtaaaagccattcttacttcctgagctgcacgatagcagatggtgggtggatttggcctgtgtgctgcaggttcactgacccctgccccacatgttctgaacctgagcatggggtaagaccgtgctggtgccacaggacacccagcatggcttatccaccccttgtggtgtgtaccaaggtacacgtgcgtgtgcgtacacacacacagcaccagtctgctcgcacaatgccgacacacacatgccctgtgtatgtgcctcccgtgcagtgcagccagcggaagaaagccccggtgtcaggctggggccacaggggagaagccaggctctggccccacaggggctgcggtttgttcagccgtgccccctcacctttcccctgctgggctgttttcactgctccctgcagggggtgaggttccctttgaagccctccaggtccagagcccagagtctggactggaaactggagcccctccacggggaggcctaatgctgtgaccctgagctggatgatgttagatcaatcacggtggtgtcccaggcagagggttggagggagagtcagagctgggcgagggatgggtcgcttgctcgcttcgcagtactgagccaagtgcccggtttccctcaaagctttctttcttcatttccctctgtctccaaccgtccctcccacagacaaagattgccacatatgggaagcccaaggccgaagggtatgctcagctggtggctgggctgggcccaggagccatcagggtcttggggtgagggggttggctgccactggcagtcggggaaaggtttgagaatggctttctgctcccagagaagaagccacatcttccctgsggggtcatttacatcccctgccactgggacagccgcctccgagggcctcacccagaccctgaatttcccacccagttcacacagctggacagaggtgtaactcagccacttccgcagaagctcccagctcgctccctggcctcatatgactggagctggggaggggcacctatctgcctggtatctcccatgtcgctctccatgtgctgctggaggggtgcatggcagcctcctgcccmttctgctgatgggatagctgaggccgagggakgccagctggggaccatccaaagatgccatacccraggctgcaagcctggccttttctggtgcccccaagctggccaacaggctggagtggcaggtggtggctggttctgggatcttccagcctgcctccttccctggaaaccttrggcttcactcagccctggtccctgccatgagaggaagcactatctgaggacacttaggctggagacccttaggctgttaccacccagatgggaggagcttttcccatcaccggggaaaacacctccagaattagacaccaactggggacagtgaggcccagagagggtgagtgacttccccaaggtcacacagcctaccagtcctaagctagagcccaggccccccagacaggccttagggatagaaaacaaggtgacatttaatgccagggctgagagaaccccttcccccttcccccttctcccttgagagcgctcttggggcttgttgtcagggtctagcccaaggcagggacagcctgcacyaccctggaggcctccagggctcagctcctggttacaggaccctttgggaccctctctccagcctcctcactggagactagggctgggcctgatgccaggggcaagaaagactatgtgtaggggcagggagcggcccatctctggtagcagcaggtccagctaatccatatgtgggtgctccccaaccaccagtcacgctgtctgtatttctactattgcagacccatggtctctggctgcttggctaactccagaagcctgttttgaaactaaattcatcgctcgtatttggtagtcattggtggcttctcagtaccaggtcctgggctgggtcttggggactcagagagaagggcaaaatccatttcagagtctaatctatccatttcagatcagtttcagagtctagtgaaggtgaaggcaaatgcatatcatggaaatagcctttgaaccctctgactcataaggacaacagatacagacctaaaacccagcttggccccttgctggctgtgtgaccatgggcaaattccttaacgtctctgagtttatttcctcctctgtaaaatggggataagaatagtccctagctgggagggttgtcatgaggacataatgagatacataaatgagatatgtagataaaagcttggaggatactactttgcacgtagtaagcactcatgctcgaggaagaaaaagatttaaatgcctcactaggcagatgcacggtgccttcagccatgggatgtgcatggtgtatgcctggagcctctgagaggaggacttcctggaggaggagtcctttgagagtgtgtgatttgggtaaatagaatgataggaggaacacttacaggtggaggaaacagcaggggtccttcagcagggtcctggaggagggtctcaggcctgggtggcagagggaggctgtgatgggagataggggatgggtagaggaggcctcgtggggcccactggggcctggcaggctgggctgccagctgctgccctttagcagccaggccccgggggactcacagccacgctgcaggaccagcctcattaatcacgggcccttggagctggagcaggtggggcaggggcagcctcaggcacttcctacagtctgtctgggttcccttcacccagccagcgggtgtcaccccattttacacatagtaaagctgaagctcagagggtggggagccgcctgccgacgctgagaagagacgggtctgagatcagatccaggtctgcagcygggtgcgcacggcccttcccaggctcgcccgggccaccgagtaccttggacagcaccatcaacgacccgcccgcgccttccgggctgggggtggggatgcccgggacagaccccctcgcagccctctccctctccttctcctcccctcacccctttctcctccttcttccctccctcctcctctccagcttcctcccatcccccgcctcattcttccaaaggagctgcggagtctgacctggagaggaaggaggagatggaagctgtgatgggaagcgtgggggctggagtaggggaggtgatgcggaagtgacaggtagcggggctgtggaggggatggtgaagaaggtggtaaggagtgaagcgtgaggggttgggaggggagatgatggagggtgtgatgagagggtgacgaggaggggccaggacggggaggccacggggaggccaaggggttggggcaggactggtcacagtggctccaagtgcccattcaggcagtaggcaatggggttgaggtccctaactctctctccagtgtgatgttcttggtgcatgggggtgcctggggtgctcccaggcctccgcccgccacctctgtctctccctgggcctccatccttccacctggctctggaatcacaaccggtggtagccagtccccaggacagctccagtcccttagatagtcacccccatgagcccacccagcctctgggttgacayagacacccccagcagcccctagctgcctctggctgacatcaactgaggacatggggcctggaacctggaaacagctacctcggggaatgctgttggtgagggccaggctctgggttcccatcccagctgcttactaagaatcatggggtgtgtaggccgggtgtggtggctcacatctataatcccagcactttgggaggctaaggtgagtggatcacctgaggtcaggagttcgagaccagcctggccaacatggtaaaaccccctctctactaaaaatacaaaaattagtgggcatggtggtgggcgcctgtaatcccagctactcgggaggccaaggcaggagaatcacttgaacccgggaggtggaggtagcagtgagctgagattgagccattgcactccagcctgagtaacagagtgagactccgtctcaaaaaaaaaaaaaagaatcgtagtgggtggggagatttgtgaccttaagtaaaccacactccctccctgagcctctgagcctctgtttcctcacctgtaatatggacctgatgatagtactgaacttgtgtgattgtggtcactattcattcattcatcaggaatttcatgagcacctactgtgtgccaggcactgtccgggcactaggaatgtcacaatcaacaggacagacacagaagccctcaaggtgcttctgttctgggggtgaggggtggagtgatgatgggtgtgatgcaggaggccaggcgccaaggaagtcccagcatataggactgtcccctaccttggagcccaggagctgccgggctaggagctgagtctcctctaggtcycgcatagttgtgtccttgctcggccaccctggccaagcgcctctccctctctgggctccttccatcatccctctggagctgctccaggctgctactgctgcctgcacagacagcagtggcaggccggtgacggggtgcatgagggagtctggcgctgggccctggagctgagcaccctgagatgcagaacaaaggacgaggcaatcaaaggaggctgccaggacagtcctgccagcagctgcagcacagccacctcttgtcccgatgaccgactgggcctttgtcccctccccctccaactgcaagcagagcacggtaagaggaagcacagagtttacctggaataccaccttcccagggccctccccctggctggggtaagcattgccctccccagcttcctctgttctagggggcgaaggttcacttgttccaaggtgttactcacytggccctgtggaaatgacagtcagggagcctgggtccaaggcctgtctctaatttgccaggtgatcttgcccaagtttctctctgcagctcagcttacccatctacacaaaggctgcaaattcagatgcttacagggcctgggcaactaatagaagtgtgtgcagtgtctgggaaggcagaggttttttaactgtcttgctctccagtgcctggtatgcagcaggtgctcaataaatacttgaaggcatgaatggggccagcataactcagctcctgctcactgttgccaaggaggccaattgttgtggccccacccttggatatctggggatttctgaaatctggactggtgtgaatctgccccaatttttaaatgtgaggccatttgaggtggctcatgcctggaatcccagcactttgggaggctgagacaggaggatcacttgagcacaggagtttaagaccagcctgagcaatgtagtgaaaccccatctccaccaaataaaaacaaaaaaaaaaatagctagacatgatggcacacacctgtgatcccagctactcaggaggctgaggctggaggattgcttgagaccaggaggtgcaggctgcagtgagttatcatggcaccactgcaatccaccctgggcaacagagtgagatcctgtctcaaaaaataaataaataaataaatacaggtcactattttttaaatgtaaatagcatgtgaaccagaacaaaaccatatccgcccagcttgcagtctccagcctagtcatgagcagcattcagttaggttcattcagatgtatttggttattcattcatttattcattcatccaacattttgcaaggacctacctccctgcaytcctgaccacagagggatgccaaggtgactgtaaaccagcccagccttggaggggctgccaggcccgaaggaacacagacacctccgcacctagtgagctatgtgctttgatgggagcattgcaggcgcaaggtgctatggagtccccaaggagcgagtggtttgccctaaggatggcagagaagattccaagaagacagagtgcttgtgctgagccagaagattgagaaagaactcagcagggaggccagtggggtggggtgggtaggacactctagacagatggaacagcatatgcaaatacagaggcataaccgcacacacggtatgttcaaaaaatagctggaattttggtgtggttagagtgtgaggctgtgcagacagcttgtgatgggcttcagaggctactctaaggagtttagactgattcctaagggcactagggagctattgatagctgtggagcagaggagtgacacagtccagccttgagtctgtgaaaaatccccccggcgccatgtgagaatgcactgaacattgcaaagggtggacactgggacatggggaggaggcccctgcaacagtccaggctagcactctggtggcatgggccagagggctgacagtggaagtcggggaagttcaaatcctgactagattcaatcttcacttagtagcccagtggctatgtgactctggacttcaggcaaattgcttcacctctctgtgcttcactcagtgtttgtacaagacagtgatcgtaatagttatcattatcatatgtttattatcattattatcataacaacctgccccagtcattttgtggctgaagagttgacttacacgaagcatttagaacagcgcctggcacatagtaggccctctgggagtgtttattatcattattattttattattattacaattatgccatttcacagatgagaaaggagcagtttggagggctcaggctgtggaggactgtccagccctctgtcccctccccctccacttcctgctttgctagggatctgaatcccctgctgggtgtgtgrgaagccaggtgaccagaaagccccccatacagcccatggcgtatgagtgcccgcctccgcctgccagcagcctccaaggtggtagcctctccgagtgccacgcagcccttcagccttccttaggcagcactgcagaccccctctcctccccttgtctccccaccaccctggcctggcttccagcagaccctggagaacctgggccagcttcaaccacaaggaaaccactaatgggccacagcttagcctgatgaatcccagaggagagtttggagggaaacagaacactgcgggattattgatcatggggcaggagctggtgaggcagcctggatccacaggctgcagctcgaatcccagcccagccggtgcccccagccagacttccacgtcttcttagggagcctcagtctccccatctgtccgatggggctaatattagcacacacacccctggggctgctgtgaggactgggagatgatgtgtgtgagcccctagcacagttgctggcactgcggagcattcggtaaggtgttgggtgccgctgttgtccttgttgtaggagacaggtgagcagccatgcagatgccagctaaggggctattccagaaggtcacatagcaatccagggttggaacctcagccatgtcacttacttaccatgcaaccgctgtgcctcagtttcctcccccagaacatgggctcatgagactaagtcagagggaacagcaaatgaagcaaggtggccttgtgtaggctccagctggaccactcacagatggcatccggtgtgctcctaactgctccgtgcctctgttttctcgcctctaaaatggggcaataacacccccacctcctaggggtgctaaacacactcttkcgcttgaatgagctaaacacagcctggggcagaaaagtgtgctctctgagtgtggatggctgttagtattatgacttctgggttggtgaaggattcagtgaagtctctgactggggcccagccactgcccaacccccggtcacaggcctcagcctgtggtgggactcccccagcctgacaggatgtcccatgaccgcctcccacgtgcccccttcccgtcagggtctgggtgcccccaaactgagatcacttccctccgggaagccacccccaaagggaggggttccctgctgggccttgaagctggcccagcccagagaggaaccgtttagasgctgagggaccagcaggaggaaggctcgggggctcagaaccctcccccttctccatggagtcagctgcttcttaaggccaagaggtgggggctgaggcacccacatacccacctctaggcagtgggttcagatcgggaccatgctctagggcagaaacctcacacggctaaacaacggaaagtaaagctgaagtagtgagctctccatcgctggaagtatcctaggctgtgctaccacttggtgaggttgaaccccatggaaccagtccaacctgggcctgcctttactccacgagtgtggcatcattcccagccctctgctctcaccctcccaagagttcacctctccgggcctcagtttcctcatctgtaaaatggaaatagtcctggtccctccctggaagcaatggtgtgaggatggaatgagtgagtgcaaggagagtgctgagtgcagcatgtgccatacagtaggtgctcaataaatgctagccttggtttccctgattctccatgatggtctcagcctccaggtttccagcttccctttcttttcatctctcaagctcgttctatctctgactccagctctcttggtatctgcctcagtttcccatgttggccttggcctgtctctgacagtctctttgatcatgtatgtctctctctgtctctctccatcctgctgtcaccctgtctctgccccaggcatgaagcagtcactggcagctgtggctgtggccgcccccacacccggtctcaggggcccagcttgtgcagtcctccagctgacactgaccaaagcccctttctccagttcagctggaagaagcctggaatttttctgccaaacatttttaagcaactagggaggagagagaaggggaagacaacaaaggcagagacacaaaaacaggccgaggcagaggcacggagcccatgtttgtcacaggcccctaactgcctgggggacgcagaccctgtggccagcacagcagggtgccctgaaggccagagtggggtgtggtctgctctgggccaccagcctgaggcccagcctctttcccaggctgaagaaactccagccccttcttagacccattgttctggctgaaaatctaggccatggccactgcggaggagaaggagcatttccaccactgctcccttagaaatcttgagatcgaagtccaggcaggtcaccaaggaaccagctgcccaccccctcggcctggtccatggccagcctgggccggagaggcggacggatgggcaggcgggcagcggcgggcgctgcggggtgcagggcccagyggggaggacagcagctgccctaattactcctgctctccaggttccaatcttgtttcaaaaggactccagggacacagcctttaataactaccagtaaacaggcaggaaaatcgatacctggtaaatagagccctggagagagggaggcctgggctagctggccctgacgggctcccagagtcctttgctgcagagctggccaacgctgatgttgagaatcctcctcctggcctgagggtcctccccagggacccctcgaagcttggcctccaccctgggggctgcttgctctccaatctccactccctctccatcaagcccagattttcctctttcccactcctccaagtgccaagtaggttgcccgtctcgcttgcagatgtcttctttgcaccaggctttgtgcctsgtgctccaaacatagttgcatatctgacctagtagtctttgtcctcccaaaagtgatctaccaatgaggatgactaagaacaaaaacaaataatgacagtgtgaggacagacatgcaataaaagactgctgcgtttgccaactatagcaacagaacagagaagcccatgttggaggagatgagcacatggagggctttgctggatgaataggagtttgccaagtgaacaagggctgggggaggatgaatgtgggtaacatatgtaatatcagccattgtagctgtattcattgagtgcttactaaatgctaagtgttctgctaagcacctttgcctatacgttatctcattttgtttccccagtaattctttggggtagatattaatacccccattttatagataagggcactgaggctatgtgtggtaccagccaggatttgcacaagacctgagagattttctttttttttttttttttttttttttgagacagagtcttgctttgtcgcccaggctggagtgcaatggtgtgatctcagctcactgcaacctctgcctcctgggttcaagcgattctcatgccttagcctcctgagtaactgggattacagkcacgtaccaccacgcctggctaatgtttgtattttttagtagagatcgggggtttcaccaygtgggccaggctggtcccgaattcctgacctcagatgatccacccgcctcagcttcccaaagtgttgggattacaggcatgagccactgcacctggctcgacccgagagacttctgagttgcttgaatcacttcactctgcacctcctatcccggcccctcccctgccgagctcaggatttggcacacaggggaagttaaataaggcgggttcccattgcttcccttcctatcctgcacatttttcaggtaatacactgccttcacctcaccaggagctgaatggtggtacttcaggcacatcagccttgaagatcagtcatcacaacccctcattttgcaggtggggaaactgaggccctgagaggggaagaccagcacacaagagcaggtgggagcaggatccagggttttctctctaactcacctcctcccgggcctactgtggaggaagccccatcaccagggaagaaatcaatctgcacacactcaattaaaatgataaatcaggcakcagrgtgaggctgccccagagatgcaggggaagtttttgtctgattggctggaacatggtaggtgcccagggaccttatttcctggggctgggctgccagtccaacctctccacctcttcaaccccgcccctttcatatcaatagccatagctccgtgcctcgatttctccagctattggggcctgtccagttggcagggcacaaggctagtctgtagcccttgtgattctaacagaggagagggcagaggacaagctctttcagccctgagtagggacacaccagtgtggaacagtctgagttcccctatctggttgcagatccctgggccaggcacccgaggaagatgccaattaacaatggaaatgccttccaggttttgaggtcctactgtgtgcaggtactgtgccaggtgctgggagtacagcagtgagcaaagcagacaagatccctgactttgcagctgacagcctagagtgaggatacgcagcataaagaatgcatgcagattaatacatcatgtcacagcctggcgcagtggctcacacctgtaatcccagcactttgggaggctgaggcaggtggatcacctgaggtcaggagttcgagaccagcctggccaacatggtgaaatcccgtctctackaaaaatacaaaaaaaatyagctgggtgacacatacctgtaatgccagctacttgggagtctgaggcaggagaatcgtttgaacctgggaggcagaggttgcagtgagccgagatcacgccactgcactccaggctgggtgacagagaaagactctctctcatatatatatatagtcagtcaggtaatgccaagtgccagggaggaaaataaagcaagctcagaggacagcaataggagggctgcacttttagatgtttgaacacacacctgtaagaaagaagggaggaaatgatgagaacatctgggaatggtgaggtcatattccaggcagagggaacagccagtgagaaggccctgaggctggacagtgcctggtgtatttgaggaacagcaaggaggccagggtggctggaatggagtgagtgataagggggaggtagacaatgccagaggaggacagggccccacaatgtgtgatttcgttgtaggtcatggcaaggactttggcttttactccaagtgagcggaagccaggaaggattttgagcagaggaaagatgtgatctgacttgcattgagcaggatccctctggctgcggtatgggaaatggattacagaggccagtcatgagtctactgcaatggtccaggcaggagagataacatggcggggactgggtggtgtgagtgcagtggggagcagtggtcagmtgtggatgtgtttgaaggtggagatgactggatttactgacagattggaggtgggatatgaggtagaagtcaaggatgagaccaagatttgggggtccaaggaagagcatccggaagcgcaggagctgccaggaattgctatgtgaagacttcaggaggagcaggtttggggcaggggagagcagagctgagttcaaggtgcctgttaaacctctccagggaagggtcatgaacctggctcccaggggagaagacggggccaaagatggcagattttggaatcatcagagtagacacggtatttatctcaattgatcctctcagcaaccccacaagcaactgttgctacagctggcaaacgcagcagtcttctattgcatgtctgcttatgcccattttcaacatgagaaaactggggcccagagatgctgagttgcctacgcacagtcacagagctggaaagtcagaaagtcaggacttgaagtgagggctgtctgcctcccagccctggggtcccacccagaccctctgcagctgttctcactcactcctcccccaaatactgtgtgagagggaagggctgggtcatggatgatcacccctctttttgagatggggccactaaggcctgaggaggcttaagggactttcccgcagttgaggggaagtcaagtgtgcagcctttctgcaggtgtgccaaatgaacccagcaaaagactcacttcatcagccccaagacacagagcaggctaaaggctctgagaagtcctgcggcctggaccttgggttatctctggttagcccagagtttcccgtggagccttgctgtcaggggagcacgcagagctttggcaaacatgaagctgtggtttggagtaaagcctcagtgccctcctttatgaaagggggcccacctggcagtcagcagttgtttgttgaaggaagtaacaaatgaaacaaacagatgaatgaaagtaacaaataagcaaatgaaggaatggacgaatgcagggatgagcacaaagtgtgaatgaattaaaaaaaaaagaatccatttgtgacctaatgaatttattcattcattcaacaaatatcgctcgagcacctgctgtgtgcaggtgctggggatatagcagtaaataaaacaaaatccctgaccttgtggctattacattctagcgagggggggacagacagaaaccaagataaatgggtagaatgtgaagtatatctgagggagaaaatggagcggggaaggagagaggggaaagtacgtggggggtgcacatttttaaataggatgatggtaaatgaaggaatgtctgaatgcctgaatacgggagtgggctgaagatggagaatacataaaggtrtcaatttaaaaaaagcataaggggcccaggggcggtggctcacacctgtaatcccagcactttgggaggctgaggtgggtggatcacctgaggtcaggagttcgagaccagcctggccaacatggcaaaaccccatctctactaaaaatacaaaaattagcccagcaaggtggtgcatgcctgtagtcccagctactcaggaggctgaggcaggagaatcgcttgaacctggaggyggagattgcattgagcctagattgtgccactgtattccagcctgggcgacagagcaatactctgcctggaaaaaaaaaaaaaaaaaaagtggggccggtcatggtggctcacacctgtcatctcagcactttgggaggccaaggcggttggattgcttgagccgaagagtttgagacttagcctgggcaacatagggagacccctgtctctaaataaataaataaaataaaataacataatggatgactgcaggcacgaatgaatgacctaaggaaagaatcaatgaatgaaygaatcattgaatgaaggaatatatgaatatgtgaactagggcatggataagtgaatgaactaatgcaagaattgttgaatgactaaatgaaatagtgcttaaattaatgaactaaggcatgaacagattgatgaatgaatcattgaatgagtgagcaaactataatgaagaagaggactgcatggggcctatgtgcatggccttggtctctgtctatgcctgccccactttatctgactctggtctgaagaacccccaggccccctttgccctcccccgcaccatccagggcctgtgataacccccacttcagtgtctgtcttggccctggagaggtggagggtgggggagccctccacaccttgctggtttcctaccccaggctatcttggcacccccaccctgtttggtggctctcccgcccctatgcccaatctactgaccacgcgcccctgcccacctctcgccccagtgctatgcgctgaacctttagccccggcccccctcaccctggctgccgctgtcctgaccctccagcctgtgctgaacctcatgcctgggccttgacctccttcctctccgtgcatgtgttgaccctctccccaagtctgggtggaccccctggaggcctgtgctgaccccccaacctcccgcccacccttgcctggctgtggcccgcccttccagccgcgcagaccaacgcccgctgtgctgacgcctcctccccatttcgagtacaggcaccatgcggcccgtgcggcgcaacttctacgacccgtcgtcggcgccgggcaagggcatcgtgtgggagtgggagaacgacggcggcgcatggacggcctacgatatggacatctgcatcaccatccagaacgcctacgagaagcagcacccgtggctcgacctctcatcgctaggcttctgctacctcatctacttcaacagcatgtcgcagatgaaccgccagacgcgccggcgccgccgcctgcgccgccgcctggacctcgcctacccgctcaccgtgggctccatccctaagtcgcagtcgtggcccgtgggcgccagctcgggccagccctgctcctgccagcagtgcctgctggtcaacagcacgcgcgccgcctccaacgccatcctggcctcgcagcgccgcaaggcgccccccgcgcccccgctgccgccgccgccgccacctggagggcctccaggcgcgcttgccgtgcgccccagcgccaccttcacaggcgccgcgctctgggcagcgcccgccgccggccccgccgagcccgcgccgcctcccggggcgcccccacggagcccgggcgcccccggcggagcgcgcaccccggggcagaacaacctcaaccggcccgggccccagcgcaccaccagcgtgagcgcgcgcgcctccatcccgccggggtaagacggggcccagggggagggggcctctgcgtcgtccgcaggcaaggacgaagcccgggggtggttggccactagggcaggagcaaagattacaataataataatgacgataagtaatatccagcatgcactaaatgttcattttgtgccaagcatcaactaagcacctttacatgttcccacacatctatctccatgcataaggaccctatgaggtaggtaccatcatcacctccagttcacagatgaagaactaactcccccaagatcagacagytcacaagtgatggggccataatagcaacatcagcaatggtgcgtgttccatgtttattatttgctaaacccgttatatgtatcacctcgtttattctgccaaacagttctaccatgtgcatattatagatggggaaaccgaggctaggagagctatggtgccttctcatttattccaccaaacagttctaccatgtgcatattacagatggggaagccaaggctgggaaagctatggtgccttctcagggtcacyggggaagggtagacattggagtccagacctgcccaattccaaagtctgtgctgtgttgtcttaggatttttagagggcttcagagtccatctgtccttgtcccagtccatgcccacctcacatggtggctcgagcaagcatcagctgcttgtccaaagtatttccccataggctgcacctgaaataccacaattactctgggttaatactatggtttgcacactgggctccagggactcccggggtgacctggaatcgtggggggtggggtaatagaaagccaggcaaacgagagtctgtctctctgctcttgttttaaccagagcagccctttttggaaacacttttatgaactggctttctcagcatgattttattaaggatgggcacccagcttgtatcaagtttgcaaattcttgggttaaggtgtcccaggccccaggatagggacccagtgagctgctgttgggtgcctaccctggaccccagattcagtcatctgagcamagaaccaagycctgaggggtggcaatgagaggaaagatcaaagaccttgaacwtgggacagaccagaagagaaaagaccaggggggtttggactgtggtccccaagaggaagagagggcacccaaaaccaactgtgcttcaatcactatggcatggccgggggaattgataatgatggtccgagatcaccaaagctcagatctggatgcgacctttggggtcactgcatccagctcaccccttttattatgggcaaacaaggcctgggaaaaggaaaggccaggaccctgaactaggtggccctattcaccttttgtccctttgggagtctgacttcctgggttcgaatcccctcttggccacttctcttttttttttttttttttttttttttttttgagatacagtttcactctgttgcccaggctggagtgcagtggcacaatctccactsactgcaacttctgcctccagggttcaagtgattcttctgcctcagtcttctgagtagctgggactacaggtgcatgccaccattcccrgctactgtgtgtgtgtgtgtgtgtgtgtgtgtgtgtgtgtgtgtgtgttagtggagatgggatttcaccatgtttcccaggcttgtcttgaactcctgacctcttgtgatctgccagccttgcctcccaaagtgctgggattacaggcatgagccaccatgcccggcccccttyttgaccacttctgagctgggagacctgggacgagtccctctccttccttgagcctcagttttgtcatctgtcaaatgggagcagatcttcccaccatgtgaaaacgctgtgtacctgaacacagcatctacactggcagtagttcagccatggccgttaggactacttttgctctccaggaggagggttggcatggagggcggggaagctgtaattttccagggatgcatcacagccactaccacctgcctgcctggtcattcctctcggaggagagggtcatggggacaaacagaggtgtgtcccatgtgacctcagcctagggcaggcccagtgccaacagagagcagacttgagggggtcaaagaagaccccttggggaagccttgtccaaagctgcaggatagagtcactgagatctcagggagatctcagggggctgaagtatcagttatggccccttatagacagcagctgggctctggctgccttacaaaaagaggggctggaggtcccagaatgacaagaagagtgggtcctagaatgacaggctagggggagtgtgggaggggacagaaccagaaaaattccagggacctctgcagtaagaatttgagaaccttctctctgggtaaatttattgtaacccacaagaagactggaaatcagaaggttaaaagaaaaaaaagaaatcagaaggttgtagccagaattttcttggaacadaatggaatggaatggaatggaatggaatggaatggaatggaatggaaaacagaatagaactagaatagattggcatgtgtaatacatagtaaaaataagaattgttacatgtagcctgggaacagtgcctcatgcctgtaatcccagcactttgggagaccaaggtgggtagatcacttgagtccaggagttcaagactagcctgggaaacatagcaagacaccatctctacaacaataacaaaaaattagccaggcagggtggtgtgcttgtagtcccagttactcggaaggctgaggcaagaggatcacttgagcccagtaggtcaaggctgcagtgacctgtgatcacaccactgcactgcagcctgagagacagagcaagacactgtctcaaaaaaaaaaaaaaattgctccatgaatgttttgcatcatttctgcatatgtttaataggttgcgaggtgaaatgaatttcttagtcactgatgaaatatttgaggcgggcgtagtggctcactttgggaggccaaagtaggtggatcacttgaggccaggagttcgagaccagcatggccaacatggtgaaaccccatctctactaaaaatacaaaaattagctgagcatggtggtacacacctgtaatcccagctactgggaggattgcgtgaacccgggaggtggaggttgcagtgagccgagatcacgccactgcactccagcctgggtaacagagtgagactccgtctccaaaaaaattaaaaaaagagagagatttgaaagctactgttctagaggaggctgaaaattactcagctttcatggcctagtgttaattctccaaatatgtgctgtgggtgtgtattcacagagctgaacaagacaaacaaggcctgtgtcctcccggggcacacagacagatggggagacagacctacagcaagcaaagagtaaatgaagacgatctctggagtgagacagaagtgctggggaggtagtgggacagggtgatgtgggaattcagggaaaatccctctgaggaggtggccagatgtggagaacagctgatccatgcagagggaacagcatgaacaacttcaagggggctcgaagggcgtggtgtgttcagggaagggctagaggtgtggggagggctggagtgaggcgccagcaagaaggagaagggcaccccaggcagggcattgcaggtgcaaaggggcagaggtaggaatgaatccagaaggttctggagaccaccgggggatagaggctcccttctggaacagtgggggctgagattttttaccccaaatgggggtacaaggccaggttgggtggcctcagggaagcctgggcttgrtgctgccatcagtggggagctatagagtgtgcttgagctctagagggctgtagtgaaaaggaagttttctctktgggggtgcggatcattaaacatgtcctcctctgacctgccagagctctgttgtctccagccacatgccgctcccccacagccgacatcatttctcctgcccctccccttggggactgtttctgaccctccctgagcccagacattggcctggaaaacagaagatgtggggtgggggaaacttctcaagaactccctcatccctccccacccacgcagatgctgcccagcctcactccagcccctctaactgatcctccccagccagacaagcccggctcaaagtccccaacgctccatctccaagaaaccccccggggaaaatccctctggctctcaagacccgtggagcctgttgctggggaaggggagtaggaggaaggaagataggggtggcagaccctggcttcttccgcctaaagctttccattgctgagacagctgaggcccaagtgcagcctatgaggggaaagggatggaggtggggggtctttgaggagccaggcagacaggtctacccactgtcactctcgtccccaaaccacctcccagccctcccaaccctggtctctttgtttctgtgtctttgttttttgtttttagagacagagcctcgctcttattgcccaggctggagtacagtggcgcaatcacagctcctggcagcctgaaacttctgggctcaagaaatcctcctgattcagcctcccaagtaggtgggactacaggcacgcaccaccacacccagctaattttttaaaattttttgtagggacaggatctcactatgttgcccaggctggtctcaaactcctggcctcaagcatccgcctgcctcagcctccaaaagtgctgggaattataggcgtgagccacagcgmctggcctgtctctatgactttaagtctgtattagtttgctggggcagtggtaacaaagtaacagcttaaaccacagaaatgtattctctctttcacattcttgagactagaagtccgagatcacggtgtcacagggtagtttccttctgaggcctctctcctgggcttgtagattgcatcttttacctgtgtcctcatatggtcttccctctgtacctgtctgtgtcttaatcttctcttcttagaaggacatcagtcctattggattagggcccatcctagtgacctcattttatcttaattacctctttaaagaccccgtctctaaatacagtcacattctgaggtcctgaggcttaaggtttcaacacatgacttctttggggcacagttcagcccataacaatgtgtctgtgtgtctctccttttataatttaccaatacttttttttttgagaccgtcttgctctgttacccaggctggagtgcagtggtgcaatcttggctcactgcaacctccacctcccaggttcaagtgattctcctgcctcagcctcccaagtagtggagattacagacacctgccaccatgaccggctattttttgtatttttagtagagacggagttttggcatgttggtcaggctggtctcgaactcctgacctcaagtgatccacccacctcggcctcccgaaattctgggattacaggcatgagccactgcgcccggccaatttgccaataattttaatggcaaaaaccaccatttcttttgcaccaaacaatatctctgtgtgtcttggtctttttcagtctttccatatctctttgtagctctgtgtctctctctctctttctctgtcttctgccttttcctcttagtcactctctttccttccctggcttccttctgtccaccctccttctctcccctcctggacccaaacagatccagagccctttacaggttgggtgaccttggacccacttgaggcttggcctctctagcctcagtctccccatctgtcagacagagctaaaaccaccacctctcacatgggcagactcagcaaggatcagcttgcaagggaggtgtgaactctgcagagatcttcaatgtcattctcacctccaacctcatctcagccctggacgggtaacagcgaaggaggcccagagagggggattggctcatctagggtcacccagccagtgggggcagagtatccacctggccagggttttttccacttgcccctgtaacagacagggcggggagccagctggcagcctgggcctgggggacctgcgggggtggggaagatccgccctgtcccctgaggggtcagtgtccagtgcgttggaacacagctgtggagcagaggaaccacactcagagtttccaccccacgtggtgggtgggaggacagtgatagctgcgggcctatttccatttatcgagcgctccctatgtcccaggctctcaatttcatggcttttttgtgtgtgtgagacagggtctcactccgtcacccaggctggagtgcagtggcacaattatagctcactgcaacctcgacctcctgggctcaagcaatcctcctgcctcagcctcctaagtagctgagactaaaggtatgcaccaccatgcccggccaattttttatttttgtagagatgggcgtctcactatgttgcccaggctagtctcaaattcctgggctcaagtgatcctctcgccttggcctcccaaagcactgggattactggcatgaaccactgtgtctggccatttacaggcatgtctctcttaattctcacagatactcaatgtggcaggttctataatccccatttttcaaatgaggaaactgaggctccagaagactaagacatttgcacaaggtaacacaattaggactcagattcaaaaacccaagttgaccagcatattggggatgccccatctccagccagcctgtactgttttggatcatggtcccagaagccccaccctgattcctgtgtgaccctgcctgagctcatcttcctctctggtcttcagtttttgcatctgtgaaatgggactggcaacacaggcccacatagtccatcatgaagccagatgtcaaagcacttggatttctcaggcccgtaccctttttttttttttttagatggagtctcactttgttgtccaggctggagtgcagtggcgagatctccactcactgcaacctccgcctcccaggctcaagcaatacttgtacctcagcctcctgagtatctgggactacaggcgcacgccaccaacccggctaattttttatattttttgtagaggtggggtttcaccatgtttgccaggttggtctccaactcctgacctcaagcaatccacccaccttagcctcccaaagtgctgggattacaggcgtgagccacagtgcccagccaggcctgctcccattttaaatccacccttgtccctcccatctctatcagatttgtacaacattgccaagctgataattcctaaagagacgtcatttaagtttccgtacccttggttcttagttgaacctgagaactttttcctgtttactggccatgagtggttccttcttttgccaattacttgtgtatttctttggcttatccttccctggagctgtttattgcttccttattaatttgcaagtgttcttcctgcattaagggcattaaccctttgtctcccatcttttctgtagtttgctgtttctttttcctttatagcatatgttcatctgttttttaattaattmattcatatttattgaataacttctgtgtggcaggcactgtttggggccctggggacacagcagtgaactaaacagacagtccttgctctcttggagctcacattctagtgggagacaaacacgaaacagaataaattaattgtagaatatggtagaaagtagtaactgctacagaggaaaaatataggagagaaaggatgtagggagtgatgagaagaaaaggcctcatggagaaggtaataccttcttgagcaaaggtggaaggaggttaaaaagcaaggtatggtccaggcactgtggctcacacctataatcccagcactttgggaggctaaggtgggaggatcacttgagcccaggaatttgagaccagcctggacaacatagtgagactccacctttacaaaatttttttaaattagctgggtgcggtggtgcgtgcctgtagtcccagctacacaggaggctgaggtgggaggatcccttgagcccaggttgcagtgagccaagatcgagccactgcactccagcctgggtggcagagcaaaaccctgtatcaagaaaaaaaaaaaaaagcaaaagaactgggggaagagcattccaacatgccagacagcagaacagcatgtgcaaaggccctgaggcagagtgggtctggggtgcctgagaaggccagtgtggttggagaggctcagggcaatcggtgggaaagaagtaagagaggaaaaggcgccaggtcacacagggtctggaaggttgcggttaggactttggcttttgctctgcatgagaagggaaccagcagggctgtgtgttgggagagacgggtgggactgttttaacaggttcactctgaatgctgagcatagaccgcagtggggctgaagcaggaggccaagggcaaagggactttgttgtggtgggtgtgttttagggttttccttccttttttttccttttttctttaaatttcttgcagtgattttatgcttttatttttaaaaaatccacattttctttctccagatcttccataagtattacatttcaggggtttgaaaatgttaaagtactgacaggtacactgtgaagtcaaggaccccaccaggcccctggctgcccaccctcccccactttyctgccccgctagccactggtgtgcagtgactgtcaccccgcctcaccgctgctgcaaggtcaaaccaaacactccccccaccctgccccccacctgaagcacttcctgccctgctccctgggagaccaaaccacacacactcctgtctgcacgtggctgccccgggccgtgggaacagccggtcctgccctcccctcccctacctgaccggtcctccctgcccccaaccatctcctcccgttccttcccccgcagagagctgggcaggctggaggaccgggagggttgaagagtgacccccgcagcccccatacctctagataaatctgagcctccaataccactcacacctcaaaatgtctcccgaggggacttttacatcctttaatctctagaacatggaagtaaggggtctagaagacagaagtaaggggtcccatttcacagaggggacactgaagcccagagaagctcagaggtttgtctaggcagacggaggtgctggggtaaggaaaggggaagtgaggaccccagacagcagctgaggaggagtccatgggcacctggtcccccgggcttgcagygatgtccttcaagtctctgcagtgggggtggcggcagggacttggccccaggctgtgttccccaggactgtggggggaggagggggagaaggcagctatgaggcagagacagccctgaaagtggggaaaggtgacaggctcacacccctagaaaggagaaagggagagggtggggggtccctaaagcactgttcaacttccttctccccataaagtgacatcctcacttctgccccctcctcacccacttggccccaaatgactgagtcctgaggctcctggggctctttggggtctgctgggtaagtgtgaggtatcctgaagggggccaaggccaatgggggacctggaaactagcatcagagaaagtaacaagtctaggcctgctgggggtgggaggggagagataaggagaccagactttggaggagggaggggacttggctgccstaaagggagggtcagttgtcagtgtttcgggatcctggacccctctaggggacagagagaggtggccaaagcaggccaatggatccagttagacagccctgatctaccctgcccaggcctgagccrgctccaggatccaggtcaaagacttcagcccacctgtagagcacagagggctctctaggctggctcaactccagatggctccacagaccaacctggcagggtcagccctggcccctgactcggaaactccaggacccagtgccagctgcaccaccaaccagctgggtgaccttagtgaagtcatttcccttctctgggcttcagtcccatcatctgcaaaataaatgacaaatagagttcatctcatgtgccatctctgctccagggcagtgacttcctggagcactgtgttgaggaggactctgaagttgcatcttggcttagcggtaaggcatgccgaaattgattagtaatgcctgctgtgggtgctaggaggacagtagtggtatgcactcatatatttgacattcctgctctaactttgtctggcagaagaggcggtgtggaccagatcatacagggcctggtcatgcttaaagasggataacattaggagatatatctaatgtaaatgatgagttaatgggcgcagcacgccagcgtggcacatgtatacatatttaacaaacctgcacgttgtgcacatgtaccctagaacttaaagtataattttaaaaaaagactataatgtcaggtcgtgattagtgctatgaaaaaaaaattcagtaaggtaaggacaaagatgggctttttaaaaataaagtggttgcggccaggcacagtggcttatgcctgtaaacccagcactttgggaggtcgaggagggaggactacttgagcccaggaggtcaggtccagaccagcctgggcaacacagcgaggccctgtctcctcaaaagttttgttgttgttgttgttgttgtttaagctgggtgtggtggtgtgtgccagtagtcccagctactcaagaggctgaggtgggaagatcgcttgagcccaggagttcaagactgcagtaagcaatggttaagccactgcactctagccaggacaacagagcaagatcttgtctataaataaataactaaataaagtggtcgggaaggtgtctcagataagctgacatttgagcagagacctgtgctaagtgagggagtgtgccatgaggatatctgggaagagcaccttgggaaagggtcagcaagtgcaaaggccctggggtgggagtgtgcctggcatgcttgagaaagagcagagagaccagggtggctggagtggagtgggagaggggtgaacacataggaaatgaggttcagagggtagatgggggccagatcaggaggccaggtgttaactgtgagcaaagtgggagctgcaggaggagtgagagcagaggacagatgggatctgatttgggactgggaaaggcagagaggcttgcatggcagtggggcccatgcctgccttctggtcagagtagatttcggggagggcctgagggactcctcaggtcctgtgccagcctgggcccccaagaaggcagagctaggggtgaaggctggctccccttccgggaggcccgcaggcagcggtcgcttgtccaggcaggaggatgttctcactgactcggaggaaacagcgtgtcccacatcaaaagggggccgggtggctcccacgctcagggttcgtgggaactctgctaccctgggttctcgcaggaggcctgcagttagagagaagctggagactacctcgggactgtcccccaggctcactgatgggtaaataaataacagtcccacagtgacaccccactcacagtgctcttcccaggagcaagactgacttttgtaatctagggctatgtggtatttaaggggctccagaaattttagggcagctgagatctaaatccttcccttcctggagtaccctctgtctaactcctagaccaaacactcagcaagagcagggttacccactgggccagactgggcattatatagacctggggtagcaaactggctatactgattgatagaggctgcttggagagctgtactgaggactctgctaagcttgagagagtgctgtgatggattagtgatgtctgccacaggyaggagaccaaccagtggtggtatgcatgctcaatatttttctttccacccaatttataggtagtcctggagaaaaaaagagatactttcttcttgtgaggcagaaaggaagaaagaggggtgaggcagacctagacttaaccaggttgtctgcactagaggtgcttgaagaatgggcaggaaagaggaaaagcttgagggaaatgcctctatgcattcctataaaagtatagagagggaggaagttagagtggtgacagctgcccccctgaggaaggccctggaggattatgacagaccctgagaagggtcaaatgaatactcagtgcccctcttcctggggccyccccgcagggtgcccgacaagaaaatcaagacacctccactctcatccctgcgccaaatgatgagctttacatgttttagcacatttaactttcacaggactctatccccattacaggtggggaaactgaggcacagtgctttcttcccacctccactgaccaggtcctgggggacccagggtacccgccatcccatcctgcctccctcgggagctgtgttcattgacttccatcacaccggcgcctcctcaaggggctcaatccagatgtctgctccagacctctccacagccctcagaggggtctgggatgggagtcctggccacgtgatactatcctgtatagccgagcagccaccaagtgggtgtgtgtgcrctgcacctgtgtgcatgtgtgattgtgcctctgcatgtgtgcaggtgtgggcctcccaggctgagtgtctgtgtgtcagtgtcaggaggtgtgggtcagagcatgtgcgcatgtgtcctcgtgtgcagtgagtcagcgtgtcctcctgcgcccccatgcatgatgtgaatcagtacgcacgagtacttccccacaggcggtgcggaatcgtgtgtccgcgtgtggatggcaggccattctgcaggctgcagcgcgccgggggcttgtagggctgagcgcatgctcctctgggtttgctgcccactttacccagctctgtgcagctggggagaggggcggcagtggcaggtgcggtactggtctacatgagccaccgactcttgtccaatggagtatcctcccaggggagagctgtgtgtgcttctgtgtgtatgtgtgtgtccccgtgtgtgcacaagtctctgtatgtaggtgtggggaggcattccctggaatatgtgagtgtgtgtgtatcttaatccatgtatgtttgtggggggcgtgccctgaagtgtgcctgtgtgtatccatgtatatgttcatggtgtgcattccctagtgtgtgcggtgtgttccccaagtagacggatggggagggaggctccctggtatctgtgtgtctgtgtgtgcatgtatctgtgatgtactccctgggttgtgtgtgtttgtgtgtctgtgtacttaaacatgtgtgtgtaatgtgtcccggggagtatgataagtctgtgtggtcttctccatgcatgtgtgtatatttggatctgtggatctgtgtggatggtgtgtgccctgggtgtgtatgtctgtgtgtctgcacccactgcagcagtacccaagcctgccaagggcaccatttgcttgaagatgctttctggtgccaactgtgcctgccaaggacaggtgaccagacagcattagacaggctgtgacctgaacaggcacggccagagccaagggggctgctgcagctccttctccagctgtcactgctcccagcccttcctgccccctctcctggcacatcccccaaggccttcaggctgacccctggatttcagaacacccctcttcatcagaacgtatccagcctgggttccatgcccatcaacagcaagacaccagttcccctgcataaacaggtgctgaagtcaggaggactcaggcagacacactgtacacatcaccgcaagctctccttcagtcctcccaacgactataagtgaggtgttaatatgcctgttttacagataaggtaactgaggatcaagaagttaagtgatttgttcaaggttgtcactgcagcagttttgtggtttcctctctaagatggagagaagttacaccaggacttagtgcctgggaagcaaagaggtgaaattactcggccaggattgcacagctgacagtgatgataccgatggctgtgcttttagtagctgttaggtaccaggaactgtgcttggcccttgacacatataatttcacggaatcctcacagcagattaaaaaaaaaaaaaaggtaccatattgtccccattttacagaccaccccttacaagagatgagatgatgtgctgtgtgtcgcccagctcattagtggttgaactgagatatgaaagcagctctggctgactccaaaagccaaagctcttttgagggccagaggaagaggagagtcaggataccttttcctaggggctcttcatttgaagagaggatagtaccttgtcacagaaactgacatcagtaaatattccagaagagaaaaaaaattcatcaccaaatgcttttgaaaacctggacttatcattgttaatgatatgttcttacgcagggcttgtcagagcctttaatatgctcagatatgttgtgaatttcagagagggagacagtgacgtgttcctaacttacttgattcctgaatccttctttcctggaacgttttatggaaattaataatgctacgtctaacaagctttgagagatgctaaaatagctacaccactagcagttgggtttcaggcacagcggccaacgaaaggagccctcagagccaaagcgccctctcgagggaggagccggctgtagggtaaggaggtgtctgcactaaagtctaagggtgcatcccattggaacctgggcggaggtcctggccacccccgccccataataggatgtcagagtagaaagagagtttcctggaggtaactgcagttggcagagagaggtacaaagaggccagggtgtgtggcccaggagccagagacagaaggcgagccaggtcccctgacgtcgcttcgggggctggagtccagctgcggcctcttctcttctccccgcagggtccccgcactcccggtgaagaacttgaatggtactgggccggtccatccggccctggcaggtgaggtctggcccagggcgggaaagaagggcggggcccactaggaggcagctccgcctgtcacccggtgaccccgcccccgagatgggctggtgagcgtggcccggaggaaacgcccccttccactgggcccaggacacagggcgggcgtggcccgcagaaaggcccttcaggggccttcaaggggctgagtgggtggggcccaagagcgcaaccctcccacccacccgagggccccgggattcccagggccagtggtcgggggtctgggcggggatggcgccccgccctgtgactgcgccccctaacccccagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtacgccctccacgccctgcctcacacgagatgaaccccactaagccttgaccacaactctgtgacccctggtctccaacttattcttagcatttactacctcacctccattgcctgatctcagctccccttgccctggccccatctttcaccagctcctgttacagctaacctccagcaacccctgacctctgaccctggccaacccttgccagcctgaccccggccaacccttgccagcctgacccctgccctctgacccctgacccagttctgagccaagccttcggggacagactctgggtacyctcaaacccaccccgctgtgtccctgcaggtaagaatcccgaggatgtggttcgaagatacatgcagaaggtgaaaaacccacctgatgaggtgaggaggggatgggggggctgggggagggccctggcatggagggggcaggaaccctcacccctcctcctgggttctgggtgatacagagctcttctagtttgttcctttcttcactttatgaggttttttgatgaatagaaatacttacgtttaatagactcacatttatccatcttttgatgattgagtttttgtgtcattttcacccatattttccactaaatgtttttaagttttgcttttgatagttaagcccttaattcacctggggggtggtgaggggagccatcttcctctgtgatatatcagaattcaatatatgggaaggggctgggtgcagtggctcatccctgtagttccagctacgtaggaggctgaggcaggaggatctcttgagcccaggagtttgactctgcagtgagctatgattgcactgctgcacttcagcctgggcaacagagcctgtctcttaataaaaataaataaataaaataaataaaataacgaagaagaagaaaagaaaataaaacaatgtatggggcagagggtgtgtcctgtctccctttgccaaatgggtaccagagagagtgtggtctgctgcctatggtgacccaccaaggggcagtgctgacccagyaggtgccctgccctccccagtcctcagtctcccctgctgccacctgcaggactgcaccatctgcatggagcgrctggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggtgggttgggcgggacaatggctgaggagtgggcagggaacggagtggggtttgggggggtgctgggaactcactgccagcctcccctgcccaggatggcagcctgcagtgccccacctgcaaggccatctayggggagaagacgggtacgcagccgcctgggaagatggagttccacctcatcccccactcgctgcccggcttccctgatacccagaccatccgcatcgtctatgacatccccacaggcatccaggtgggctccccttccgcctctctggcccccagcccccacactcctccaactcctccagatgcttctccaccctgccaccacctgttcatggtctaaatccctgtactgtccctctttgcagggccctgagcaccccaaccccgggaagaagttcaccgcaagaggattccctcgccactgctatctacccaacaacgagaaaggccggaaggtgggtgcccagccgtgagggcatgggagataggcacaggcaggggctccagcaaccactggcctgggcctgtggtccccatcattcccaatccctgctctcacattcctcccaaaagcagcacccaaacagtaacgaccacagccacctccttcacacatcttatctcgtttcctgagccactgaggtcaagatcctgaccccattttatagacaaagacacaaggcttcagaaagggcaagtcacttgactgtggtcacagagaaactaagtggcggagctgggatttgagcccaggcagtccaagctgtcaccaccaccctacaggttgtctgatttgactttctgcttttcaagagcaccaagaaatccagattttcatgggaaatctctaggcttttgaatgttagtaactaatttacaagtggctctttaatatagtgtggagtccaaactaaatagagcagagagctgccagatgctttcttcaccccagaaaaaaacaggcagggccgggtgtggtggctcatgcctctaatcccagcactttgggaggctaaggcgggcagatcacgagatcaggagtttgagaccagcctggacaacatggtgaaaccccgtctctactaaaaatacaaaaattatccggagtggtggagtgcgcctgtagtcccagctacctgggaggctgaggcaggagaattgcttgaactcaggaagcagaggttgcactgagtcgagatcaccccactgcactccagcctgggtgacagagcaagactccatcacaaaaaaaaaaacaggcaggccaagcgcagtggtgcacacctgtaatccctgcacttggggaggccgaggtgggaggatcacttgaggccaggagtttgagaccaatctgggcaacatagtgagacttggagaggctgatgtgggacgattgttggagcccaggagttcgaggctgcagtgagctctggttgcrctgctgcactccagcctgagcaacacagcaagactctgcctcaaaaaaaaaaaaaaaaaaagaaaaagaaaaaaaagaaaaggaaagaaaagaaaagaaaaaacaaacataagtaacttggaaagagcttttactggaagttcaggaaatacaaatgcaaaggaaatggccaagccagcagtacgtagttggtgctaatggacgaagccataaggtagccatgatgtggcaggggagggagggaggctgaggctggtgggctggaagctgcctgtgacctcctcccggccccactgtgtccctgtccccccaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaaaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctcctcgcctggtcttttcctgccaagagaggggtgggtggctctgttcctgggggctgcagtcagccccgttggggagtgatggcttgcaagagaatgacttcagggtccttgcctcgggctggaaggggtgggggcgctgaagcagtggcagaccctcctagtcctagtctccaagaatgcagaggtgaaagtgcccttctctttcacaagagcacaaggcaatgcacacatctgctccctggcacaatgacaagaaacaaggaactcaggtgcagagctgggagcctcgagggaaatacggaggagctgggagacactgtgatcagctcatcaggatctcagagcttgtcaggaccctgtccttggggaggagggtcaggttctaactagggaaaaacagggatggaccccagccttaaatcagcctctctgcaacatgccaggacgcccctgtagttctggtggatgctgcggcttcgggcaacccctgctggccaccctcgggatagcgccgtgtctttcctggtccacttgatcccctgccaggtaggctttggtttctgtcccaccccctagtgacacaacaccggaaacgagtccttggaggcccttccagttctgccagtcacatgttcccaaacatttgtactccgtggttcattctcagacaaaacctcaacccaaactctggcatataaaattgcaagccaggcactgactcacacctgtaatcccagcaactaaggaggccgaagcgggaggctcatttgacgccaggagcttgagaccagcctgggcaacatagtgagaccccccatctctacaaaaatttaaaaattagccaggcgtgatggcttgcacctgtagtcgcagctgctctggaggctaacgtgggaggatcactgaagtccagaagtttgagggtgcactgacctatgatcatgccactgtactgcagcctgggcaacagagtgagacccccaactctaaaaacaaaataaaataaaattgcccattccccaggcctgtggtcctcaaagctgatactcatccaaatgacctacggaatctgttaaataaccctgattcttgccctcatataccctcagattctgagtcagtagctggctgggcctcagaaatctgcatttctagcagacattctagcgggtggtctttggcccacagtcagagaaactcctcccttgttcttgaactacctcattggaatccagtttgaaaaccacacatctagactttccctcctctttttatacagggtaatctgagacccaaagagagataaacagcctggcccaaggtctcccaggctccaagggtctgagtttggcacactggacccccacccagccttggttcttcctgagggtacctgattctggaagcttgtggttggagtcctaggccaagggcagggtacagaagaatcagtgaggttatagggattagcagacatgaaaacaggaaggagtgaggccatttagtgcccatctggggcaacaacatcacatgggcatcaggaattcaggtccagctgtatccagcagctcagggccaggctggcctccttggtatggatagaggccagtttggtgaagtagagaccccagtctcagtcaaataagtcaggttccttatcctatccactccagtctgaatcaagccagagggcaagtttcactcagtgcaaggctggcccctgccaaagggcttccatgccctgagttctggactcaaggcacacaggactaggcacgtctctgggagcctccaaaccacagaatcaaagaggtccaaggagacaggagactcccggggcaggatgcgctgaagagggccccctggctcttgctcctccttccgggctagctctggcatttccttaggggccaagggggcccagggccgccttccctcgctcctgctgctggaactcctcgtgggcacgatccaggtctgcgagcacctccagcaggcgggcagttgctgctctttgccgggccaggacctcaggacaggcccctaggagggagacaagaggccacaggggctcagccagtccagggcaggctgctgtaacccggacccaatggtttctcatgctgaagatgtgccttgtgccctgagaaccctaaaatccttgagaatccccacacacagccctgtggcctgataatggactggaaacaggaggacacaggagacagtggggaagtgcctgcgaagaaaaagggacctccttaaccccttagcttctttttttgggggtggaggcagagtcttgctgtgttgcccagggtgcagtgcagtagcatgatctcagctcattgcaacctccacctcctgggctcaagcaattctcatgcctcagcctccccagtagctgggatcacaggtgtgcaccaccacgcccggctaatttttaaatttttagtagagacagggtttcaccatgttggccaagctgatctcgaactcctgacctcaagtgatccacccacctcggcctcccaaagtgctgggattacaggtgtgagccactgcacccagcctttaccttctgaggtacaggagcccttacctgtgtctgcctccagagttgtatccatgttagaatcctccagtaatttcagcctggaaggtaagagggagaaagacaagtctggtccctgattcccattcctgcttcctaccccagaaattctctgagaaattagttttcctgaaccatcaccatcaccatctaccatcatcatcatcatcatctacacagcaaacatttctagagtgccagatactattctaaaccttttacatgtattaactcatttaattatcatgacaaactcatatgaggtaggtatttactattagctccattatacagatgatcactgagacacagagaggttaggtaacttgcttaaggtcacacagcatcagcagcagcatcattatcacttattgaaagctaactatctggccaggcacctacaaagtgctctacctgtattagctcatttgatcctcaggacaacccacgaggtcgccaccattattatcccccttttccagatgcactggttgggtgcagtggctcatgcctgtaatccctgcactttgagagggcaaggcgagacaggtggatcacttgaagtcaggaactggagactagcctggccaacatggtgaaaccccgtctctactaaaaatacaaaaactagtcaggcgtggtggcaagtgcctgtaatcctggctatgtgggaggctgaagcaagagaatcgcttgaacccaggaggcagaggttgcagtgagccaagatcatgccactgcactccagcctgggcaacagagccagactctgtctaagtaaataaataaataaatttttttaaaaagagatcacacagctagtaagtggccaggtcacgatttgaacccagacaggtcagcttcagaacccactctataatgagttgggacaaatctctgtcaccaaataacagtgatagtgatcctcatgacaggaaggggaagagatctatccaaggtcatttagcaagcgcagggggccaggattttatgtgaattgtgccagggtctctggagctccaggtattaaaagatcccaagacccagttctgcataagggacccctcccactgaggatgcttcccaagccctgactgtgtagacacccagtccccaccctgggccaggcccccggggaatatccaccaacacacatgggaagaatgaataaatggacacagcaaggccacggtggggggctggcctggctggtcataggaggtgaagtgggatgggtgggggcacccacctgagctggtcccgccccaggagcagctgccgatacactgtctgggcctcagcatcaggatccagtgggtcactccagtcccccagggtgacagctgagtgtgtacggctgcagccggcggctgaggggacacagcttcattcatcagtaactccctctccccttccagaagcctccacagccaggcattcgccaagccgtgctccttcttcctgtaaaatccctcctcaaacctactacttctaggccacacacggtggctcatgcctgtaatctcagcacttttggaggctgagatgggaggatcactcgagcccaagagttcaagaccagcctgggcaacatagtgagaccttgtctctacaaataatttaaaaattacccttgggtctggagcggtggctcacgcctgtaatcccagaactttgggaggccaaggtgggtggatcacctgaggtcaggagtttcagaccagcctggccaatgtggtgaaatcccatctctactaaaaatacaaaaattagccaggcgtggtggctcatgcctgtaatctcagctacttgggaggctgaggcaggagaatctcttgaacctgggaggcacagattgcagtgagctaagattgcaccagtgcattctagcctgggcaaaagggtgagactccatctcacacacacacaaaaatattagcctcacatggtggcacatctgtggtcccagctacttgggaggctgaggtgagaggactgcttgagcccaggagtttgaggctgcagggagccatgattgcaccactgcactccagcctgggcaacagagactctgtctcaaaaacaaaaataaaaaaacccactacttccgttgaatcttacatcctccactctcatccagccccacttctgctccccagactctagcagtagcctcgcctctcccggtactcctccctcattctaggctccagtcacacagacccttttccatccgtcagcctaccttgtcccaacctctaggcctttgctcatgacacctgcaacacttccttacccccatctcccagttctgtctccaatgccgctgcttaacttctgctctactcaggtcacatttaagcagcacctcctccaggaagccctccttgagtccccatcctgaggctgggtcagaggcatccactggaatctcaaacgtctcatcttggcacttataacattgtattacattgttatacattgtaatacatcattatatattgtatatacattgttaataacaatgtcattattttatatattattttatatatattttatatatattatatattattttatataataacaatgttattatttacaatgttatacattgtaatacattgttatacattgtatatacattgttaataacaatgtataacattgtattaacaaaaggccgggcacggtggctcaggcctgtaatcccaacactttgggaggccgaggagggcttatcacctgaggtcaggagttcgagaccagcctgaccaacatggggaaaccccgtccctactaaaaatacaaaaattagctgggtgcagtggtacgcacctataaacccagctagtcaggaggctgaggcaggagaatcgcttgaacccgggaggcagaggttgcagtgagccgaggttgtgccactgcactccagcctgggcaatagagtgagactctgtctcaaaaaaaaaaaaaattattgggttatgcactcatctttcttgagaacaagctcatgatgtttgagtaccactggatgctggcacctagtgagtactttagaaataacacgtcgcatacgccaagcagcgtcctatgctctttgtgtaaatcaagtcatttaattatcacaactccacgagataggcactgttatcaacctcatttcacagttgaggagactgaggcatagagaggttgagtaacttgcccaaggttgcacagccagcccaggcggaagtgggacacccgctgattgacgggtggggagggcggagcctgcagtccgccctgccccctcacctgagcgctcagcctggaggcagcaggtccagcgcgcgctgcggaaggcaccggggtggcaggcggccagcttgttcgggt

SEQ ID NO: 10814 - DNA, 12526 bp, Homo sapiens
aattttggagggctggggtagaatgctgtgaattgaatgtttgtgtctgatatggtttggctgcgccccaccgaaatctcaacttgaattatatctcccaggattcccacatgttgtgggagggacccggggggaggtaattgaatcatgggggccggtctttcccatcctattctcatgatagtgaataagtctcaagagatctgatgggtttatcaggcagtttctgcttttgcttcttcctcatttttctcttgctgacaccatataagaagtgcctttcgcctcctaccatgattctgaagcctccccagccatgtggaactgtaagtccagttaaacctctttttcttcccagtcgtgggtgtgtctttattagaagcatgaaaatggactaatacagtgtccctccaaaattattatggtgaaaccctaattgcccatgtgatggtagttggagacagggcctttcagaggtgattagatgagagtggaatcctcatgaagggattagtgcccttacaagacacatgagacagtgcgacctctctctctctctctctcaattcctctcagctctccaccatatgaggacacagcaagaaacaggctacttaaaaaccagaaagagggacctcactaagaactcaacaaggttggcaccctcgtctcggacttccagcctctagaactgtaagaataaatatttaagccactcattgtatgatatttttgttattagcccgaagtaagacaaagaagaaatattgctccaacaagatttatgagtatattttacagatctgcattggacaagttagctttccctgcaacgaccatttactgaatctttactatgtgccagaatctgagagtcatattagcatctgcaggtaaatcagccaaggttcaaagagatgactaaggccaggcacgatggcccatgcctgtaatcccagcactttgggagacccaggcaggaggatcgcctgagcagaggaattcgagactagcctgggcaacgtggtgaagcccttcctctacattaaaaaaaaaaaaaaaaaaaattagccaggtgtggtggcataagcctgtagtcccagctactcaggaggcagagatgggaggatcacttgagcccaggaggtcaaggttgcagtgaaccatcattgtgccactgaacaccagcctgggtgacagagcaataccctatctcaaaaaaagaaaagagagagagagatgaccagatttgcccagggacaccgagtgagttagtattcacactgggatttaaccccagatctgtatgactccaaagctggggctacctctattccactgggttgcgtctgcatatgtaaaaattagctgcattttaaatatttgtctaaaataaaccttaacctatcgcagggcgtgctgccccagcctgagactggctgcttcatctacagttgtttctctacttgtccttgcgtagggaagttttatcaccacaaggaccgtttctcctctgtttaatctaacacctgctagtctgagattctctaaatgtcccacaataaatatgaaaaacagtctcaggcatatttttcccctcttaaataatggagtctaaatgccaagtggccaaaagcaggcctttcagccattggcggctgaacactgtctgaacatgaaatccgtctcttcaaactatgtcaaaattgcttaataagaactcaggggaccccacattaatgaaaggatgcatctgctttgggtttcacattattgggagtgatggttcagagccagccacctatgcttgactttcactctttaaaactctgcagttaatcacagccctcattatacaaaggttacatggatataaagtttgaaagattcggttcaagactgcgagcggtggccaggaaaaaaaaaaaaaaggagaagacacaaagacaatgatcaaagaacaatgaataacattcaagactaagtcggtgcaaaattttcagaatgagaaatgaaacggaaaacttagaggataagtaccaagcacaagttttaggtattctggagacaggaaactcagaatattttagcaaccgattatgtctatgagggggatgaataatttattatctgataaagaatcttccctgagcctgtgacaagaaaggtcaaataggcaactgaagtagaacagtaaatacacgatatactactcgaaaaggaagtctggaacggaaggcgaaggaaagagcttccttggcccatgttcatcaactccctcagattacaagaagcgcagcggatgtactttttaggtaccctcatattaggaacccagaagtattcatacaaataaatgcaaataatgtatgagtacaatacttgtctaagtccttgaaaaaggccaatcttccggcatcacccacacaccagctgcaaatcttggatccaccccgttatctcccagctgtgtgagcctgggaaagtctatgcctcttccagcctctaaactgcctcatctgcacaatgggtttcacacataatataaatactttactgttaaatgctaagcacagtacctagtacaaagacaaataggaatatccaaccccccacctgcaggtgacaataataggacattttgcaaacgccccaaagaagaacttcagaactttacgttcctttgtgagcatgcgcttattgacttgagcaagtggcttatatagttcttgctggtttgcagacttgtttatatcatactttatttattgaaaatccaatactatacagaaaaacaatttgtaaagcaaagaaatgaggaacaaatctaatggctgatttaggatgcgctcttcccggtaatctacaactattaataatattaatagcttttatctttttgtttagctacagatcgttcagaacaatggagataagccctgtgacttgtgatgcgttgacgaatgatcatcttttccaagccaagtcaccagcttagacaggcatgaggctcgtattttacccgccccacataccacatgcctccccccaacacatatatcataaaagaaggccaaggccttccatccacaaaggcaaatcatgggacttaagcttttagtgtcaaaggagattgcatggaattcccacaaacagtgaagctataccagctcataaagtcactgaattttaaggagcctaaaagtaggtggagttttgcagaagtctttaaaagtgcgagcaatttactcctcagcatcctacccatcgttccttaatatcatgccatgaaaacacaggatgcggcagtttcccggcagggaaaacaacaacaacaacaaaatgaaaacacaagtgtcagtatctatgaaaagcacagcaaaatgttgagcccatgagcctaatataatggttggtactgagtgctccctatctgaaaataatgttaaagtcattatttccgatgcttatcaatgaggctgcaatcacataatgctgtcagtactatccctatcccttcactcccacaaaataaatagacccgatatcaactctattgaaaacctgaatcattacagcacttcagcagcaaaccgtgtggttgcaatcaactgagcatgcgctctctccctaaaacatgcacattccattacctctggctaataaatcttttatttttacccctcatctctctgctttctcaataatcattttgatataaaccattgcttgctgttcctgatgactaatcccttaatcatctttccaaaatatatgcagagtgtatttctttgtaaatacaaaagaaaaagcaatcacataaatagttaagatggcttttcaaatgacagttgagtgctaatatgagctacactggaaaatactaatcaacaaactaaatacacatccattaaaatgtaggagtccagacatatgaagacagaaaaagaattcattgcaactccactgaaatcaggctgataaacatctgccctagagctcctctttcagccagttggagaggttaagaaaagtaagcatcactttgcactttcatgcgtgaagaaaatattattattgttgttattaatagcagcagctaacatttaattgagcacttaatttattccacaatgggttaagactttatatacacagagttgatgtgtttaatagaaccacctgtatctctgaatagagatattatgatgtgcattttacagatgaagaaactgaggtttaaagaagttaagaaacttgcccaaggtcataagatgtatctgattctaatctttgccactataatacagcatgttttatagccgtggttatgaactggggacgatttgcacccccaagagacatctggcaatgcctggagacattttggttgccacaaacatacttgggtcacccctcccatatgagaggggaatagactcaagacacattctgggaagtcaggggtgagtcaaatagtaactctaagggagagccacctgcccctcttcccataccagccctctctgaccaacctgtggccatctcaatgtccagcagatgctgatgtttcacaacacttattgggcccctcgctatactaatggccagtccccaacagaagctcttctgcactctctgttaaacagatctagtgagggcctggcaggcatgaggaacattggttactcataacaatccctctcctctctctcaatccaccgcccctgcctcccagcctcagcctcatcccttttcctcctgcaaacaacgtagggagatggatgacatcaggtccatctgctcccactctaccctacctccttcttccacaggaccagagttttagatcccaagttccggggatctaaaatttagaaactaaaatttagaaatctaatagaaacagaagaaggaggaactcagagccccactggggtctttcaagagctctacactggaatgtcgaggtcttgctgtagctgttcatgaagtatgttttgatacctaataagctcttgttctttacatgcaatgcccctcagaggtcctgagatctcaagacagggagtgggatatgccagaccccgagaaataaagcaacagaagcccaactccaatagatactgggtaaaggaaagaataaaccatggtaatgcaggactcagacacacctatcgttgtcccagacttagagaactcacatggattcctaacacatagacactgctgctaaataaaagagagtccactgcatcttgaaaacaggaaaacatcttattccaccagccacactggcctcttggaatacacaggaaaacgataggtgcttgtcttaagaggtgagggcaccagtgtataattcacataaggatgtgaatgaggtagatcacatctgtgtgctgttccacaacataggaacaagccccactgccccgttttctttatttaaatatgaatgggggctgatgtgcctccatctcctccctctttttttaattatgccaaatggattggccttttaagacagtggtttacttctgtactgtccatgttatcctgttttaattgttttcattttttctcttctaactttggagcatctaaaacatctcagcaggagggcattttcccatgaaataattagtagtcatagtaattacatataggttcttaatatacttctatatggaatgtgttttcacttaagttgtattttattaaatagctccttcttcccaaaagtaatttgagagctctataaaggatatcttgaatataaagagacgacagggtagatcagagtggcttcctctaagaaataggatggatcctgaaattaatcactcaaaccgcagctagagagtttgaaagcaaaatctgcaaagtatgaacattgatactaaacatggtaaaaagatgggccatggggtggagcagacagacttggagtttggaagccagatggaccaagcaaggagcctgactctgagctcaccagctgtgcaattcgggtgagttccttcaccyttctgagccatcycttggctcgtctggaaaatgcaaaaaaaaaaaaaagaaaaacaccaggtttttgcatcctcctggatgagggatataaagtgcctgacacagcatatgacagggatttgataaatgggggctrttagctgtcccattgtggatgtgagaatagcattctgctggctaaaaggcagacatgaatgttctagaacatggcgatcccggaatgtgcagtgaaggcaggaagaggaagaatgggcagggaagaacaagttgggatggaggaatgaactcttatctccagaagcagagctaagaatgcccacggagccttggcacatgacagcctccgctgagccaaatggcccaaagacttctgaatgagcttttgctgcaacaaaaaactttggatcattttgagagcctcccgtgaggygccaatatgttgcagtaccttcccggccccgacactgatgtgattcatcgtaggtaacatatgaatacgctcaagctggccagcagcttgaaaaattggagtctatcaaattgaccttgagaaacacaggaaggtaatatttagtgacataccagatgaaatccttgcgcagagatgtgaggtgaggaaggacctgaagggaagtagaccagcaaatatcaagggtcaaggagttgggggatgatatagagacgaagcctaacagatgtcaccagagcaagaaggccttacgacttcacatcctctctgcagggtatgaatggtgcaatggaatgaaatggtaactacagcttctggtgcaaaatttgagtttccataatcatcatcttgggaaaatgaggaacacaatataatggcatacagagagaacaagtgaaaagatgagagatgatgaacaggttgagtttcttcagcctacaacctatcaaatctaattttaaacatctggagccacgtgtattagttttgtttctgttccattttcctttttctgtgtccccgacggtgaatgattctgaataattcttagtctgggatcactggtctatctcaaggtactacatgttagagtaaaactataaaacagcaaattctatcatctgaaattgactcacagggacccaattaaggctcaaaatataagaaagaaagactgaacagtgggtctttgacatcatccatccaacctttttccttaaagatgaggaaacaggctccaaatagatccagaggcttacccaaggtctcatcgctaattggggcaggtccaggaatttctgctctaagcatcaaacaataattaaaataggataaatgcagatgaatgtgttctcatatatattgtgttctcagaaaagaagaggataaatttaatgatgcaaaaacagttgtgctacagcattatcttccaagactggtttaaacatgaatgtcactgtacaatcaggttaccatagtgtcactagcgtccctggaattttacctttctagtttcaaatattacatcaaataggcagagttttacaattttgacacgccctcctgctagtcccaagaacactgcaagccctcagcagttgtctgtctacactgtcagtgggaatggaaattggagcaacaagataagaaatgactcgggaggtcgggcacggtggctcatgcctgtaatcccagcactttgggaggcctaggtgtgtagatcatgagatcaggaggtcgagactatcccagccaacatggtgaaactccgtctgtattaaaaatacaaaaattagctgggcatggtgacgcgtgcctgtagtcccggctactcgggaggctgaggcagaagaattgcttgaacgcaggaggtgaaagttgcagtgagtcgagattgtgccactgcactccagcctggtgacagagtgaaactcagtctcaaaaaaaaaataaaaaagaaaaagaaaaaaaagaaaaaagaaaatgactcgggaactgttaccaaaattttaaatgcatatgccctttgaatcaaggagtccagtgctaagattctgccccaggcatttactcacaaatacgtaaataaagaatgctcacagcagcatagtttaggcccaatatcagatgatatcgtaagaaagactgatgcaagaaagagagaactgtgaaacaccattgcttggaataacaaatagcaaaacaatgcaaacaacctaaatggccaccaaagggaagactggttatagcataagcacatgatggaatattatacagcagttaaaacaatgaagtagatctatatgcactaataagagatctcctgcagtactaagtttaaaaaaaaaaaaagtacagaacagaatgtgagtgtgtttgctggtatatagataacctttttctggaagaatacataatgtttatcttccaagagaaggaccaagaacgactttcacatttcatttttcaccttcccattctgcgtgtagattcaaataagatgcacgtattcccatttgtactcttctcaatacatccctaaaaattgctactatcccacctactagaggttactactttttaacattagtcagaaagacaataaaatgatcagaaaaagtaagactctgttttcttttttatttaacccaaaataataagctcagtgagctcaagataagggctcatttcaaatatactgaatttcaaatatttcatcataaatacactgaaaaagcagaaataaatcttccttttctttattttcactacttttcagtccagagtaccaaaaattttcttaagtacactgtagtctatttcttcaaatggcaagaaatctttcacagcattcaaaaatgaagacggcctccacagggtgtacccagcccccttcaggctctgctcccaaacacgctgctctatctcctcctccccctcctcccagggcctctgcacctgccattcccctaccccatctgacccttctccaccctcttcaggtctttcttcagatcttagttcaatcacttcttccttggggaccccaaaggtctcccaactccctggcatcattactgattcctaggaccactcactgctttttcaagtttacattaagatctgtgttttttgactaaatttgtcttccacaataggctgaaagctctacaaagacagtggcaacgtctgttgtccttaacagtagaccccagcacccatcacagaggtgcacttcatgaatatgtgaatgaatgaaaagtgaatgaatgcagtctggacttcattctgaaatccagcgatgtttcaaaaatcaaacagctcgcatcactctctagctcaaaccctctaatgtcttcctcaccgctatctcagagtctaccagatacccatcccccaacagcacctctcctacccactccattcatctccagccacactagcttccctgatgatccttgaaatctccaggcttgtgcctacctctgagccttagcatatgctcttctcactgctaagagaatacttctcttgacatctgcatggcttacccctacttcattcaggtctcagatcaaatgtcacaactttggaaggctccctgctgatgactccatcacactcacgctatcattccccccaccttcctctgctttacagtcctttatttactgacattatggcaaatattaaacttgattatggtctatttttcctacctagaaggtaagcctatgagggcagggattctgtttcgtttaatactatatccttggtcccaagactaatgcaagcccttagtaaatatttatgtagacacgtatcaacatcaacttctacatagacagagaaaagtaagaaatcagagatagggttaaagcttccttctttctaatcttaacaaccataagcataacagtctcctagttgcaatcatgggcgttcaccacgttttatttttcttaataaatgagttaaaggaagaaacattctcaaacccctgactaataaagcagatgacactgacaatgaactacaaacaaatgcgtgaataataatggacttgctcatgctttcattcataagacaaacaaagtgaagatgactttaaaaataaagacatgattccaagagcaataaactttacacactccactgaaatctccatatggttagcccggcatgtgtatttgacaattaaaaaaaacaacaacagtcaagcgcttacccattcttctaaaatgcgtgacactgcttcactcgcccttgccatgttcctgcaggccaagatcacatgtgcaccatggagggcaaaagacttggcggtttcgaaccctatggtttaaaggaaagtcaatgttagaaaacataacatcaacacagtgagtcatgttgaatggcctttaccggagcaccacttaaattaccccaagttctcaaccaggggtgattttgatccccaggggacagaagcaaatgtctggagacattttcagtggccacggttgtggggtagagtcctactggcatctagtgggtaaacaccaggcattacaaaacatcttaccatgaacagggcagcccctgacaacatagaaccatctggcccggactgtcaacactgtgatggtgagaaaacttgtcctagggatgcagtgatttcaaagatgaagactgggacatagaagagttcacggcatgtccagccatttaaccatcaataatgaccagatcctgtgcccacgataaggactttatgctctactctatggtaagtgtcgccagcacctctgcttctaccagtgttacctaggtttcttagccccatttcctactgagaacaattagaaaagatggacaaaataacacacgtgcatacacacccatatctgtttgaaggcatcagaagggcactatgactaagaattttgggggccaagatctgcaaaaactgcaaggccagcatttggcagcttttttccttcaaggcatatttcatttccaaacatagtggttggaagcctgagaagatgggctgagcttttggcaattttataacaaggaaaaagacataaatttgagctcaggacccaccaggaaagggccacggtaaacacaccaaacctttggtcgggatcctaaagagttataccctcgctgtaataacaagagacagtccagccttcacaagagtggaaactcagcttcaggccatttcaattcctagtttgattaaagtgatcagtccctatctatccaatttccagaagcaagagaaaatgttctctggaggaagataccattatctagagtctcaaattaccactatgattatttcaaatactcatataaactctcagacattcaaacaaaatagctaagcatacaaaaagaaaaaacttcaccaaaagccagaggggaacaaatggaaataaatgcacaggagatctgtctaatcaagttattcagaaacagtgattaaaataagtctgactgacaaattcaaggaacaaaaaggcaagatggagaattttgccagggaattagaaacaataaaaaaattcaaatagatattctgaaacttaaacaaaataagagtaataagagtaaagaagaattcagcatatagtttaacagaatacaagacacagctgacgacaagattgaggaaactacaaaataagttaacaaaaaaatccaaagtgaagcataaaaagaaaaaaataacacaataaaacaaagcacaaaagagacatatgaaacacattctcccaggctcttacacatacatgtaatctgagttccaaaacaagtgaaatagactaagaaaagcaatatttaaagacagaatggctgataatgttacaaaatcaatgacgcatacacggccaaaaaaagaagtatcctgagccataagcagaaatatgtatgtgtatgtgttgacatgtatatgtataaatgtgtgtgtctacatgtatgtgtgtgtgtgtatatatatatgtgcaagctacaagcagaaatgtacgtttgtatatatatatatatatttatgtctgtgtgagccgcaaacagaaatatatatgtgagtgtgtatctgtatgtgtgtatgtgtgtgtagatacacatatatacacatacatgtcaaagcaaggcacatcagagtaaaactgctaaaaactgcagatagttttagaagtagttagagaccagtagctacaagactgatagttatacctctcaggaaaatgatggaagccacagctgaaaaaaaataaaactttcatcttagaattctatacctagtgaaaatatttttgaaaaataaaggcagagaacaaaaattttaagcaaacgaaagctgctttttgtttgtcacctacactacacctagtgtcacgtatagacccacactagaggaaacactaaaggatgctcttcaggcaggaggaaaatgaccttagctataaacccagagatgcagaaagtaacaaagagcaacataaagggtaacgacatgttaagacccaa

SEQ ID NO: 10815 - DNA, 29976 bp, Homo sapiens
  misc_feature (1)...(29976): n = A,T,C or G, or insertion/deletion polymorphism (see Tables 1-2)
atgagattcatataaaaatattattgtaaggccggacgtggtggctcaggccagtaatcccagcactttgggaggccaaggcgggtgcatcacgaggtcaggagatcgagaccatcctggctaacaaggtgaaaccccgtgtctaccaaaaatacaaaaaaattagccgggcatggtggcgggcgcctgtagtctcagctactcgggaggctgaggcaggagaatgctatgaacccgggaggcggagcttgcagtgagccgagatcgcgccactgcactccagcctgggcaacagagcaagactccatctcaaaaaaaaaaaaaaaattattgtatatattagcagtaaataagctgaaatgaagttaagaaaattcaatatacaataacatcaaaaagcataaaatacttaggaataaatttaacaaaagcataggctttgtacattgaaaaatataaaccattgctgaaagaaatcaaagatctacatagggctgggagcaatggctcacgcctgtaatcccagcactttgggaggccaaggcaggtagataacctgaggtcaggagttagagaccagcctggccaacatggtgaaaccccacctctactgaaaatagaaaaattagctgggtgtggtggcaggcgcctgtagtcccagctactgaggaggctgaggcaggagaatcctttgaacctgggaggcagagactgcagtgatctgagatggcatcattgcactccagcctgggtggcaaagcgagactgtgtcttttttttttttttttttttttgagacagagtctcactctgctgccaggctggagtgcagtggcacgatcttggctcgctgcaagctccacctcctgggttcacgccattctcctgcctcagcctcccaagtagctgggactacaggcgcccgccaccacgcccggctaattttttgtatttgtagtagagatggggtttcactgtgttagccagcatggtctcgatctcctgacctcatgatctgcccacctcagcctcccaaagtgctgggattacaggcatgagccgccgtgcccggccaagagactctgtcttaaaaaaataataaaaaataaataatatacataaattatttttataatcacaacaagcagttttgttcttaaagatgaagaagcagtaactgaaggccagtgtagacaggcaggccctccagatgagacaggacgtggtgccctggggaacaagcaggcaacttcagctgctccaagttggccagcagcaccaagcccctactgcgggtgcagctgtgctgaaccctgtggtctccttaggaggaagcaaggtgagcacagttcccttgatgtgaaaccttccaaaggcttcctctgtttctccaataaaatccaaattccctgcatggccagcaggactccccatagtcaggctcatgcccatcttctgctcagtctccttgcccgcgtcccaacgggctttctttttttttgagacagggcctcactctgttgcccaggctggagggccgtgatatgatcacagttcactgtagcctccacctcctgggctcaagcgatcctcccacctcagcctcactctgtctctcaggccttggagggccatgatcacagttcactgtagcttccacctcctgggctcaagcgatcctcccacctcagcctcctgagtagttgggactacaggcaggcaccaccacagctcggctaatgtgatggttttttgtagagatggggtcttgcgatgttgcccaggctggtctggaactcttggcctcaagcgatcctcccatctcggcttcccagagtgcagggactaccgggggactaccggcctgagccacggctcccggccatatgggcctgtttcattttctgcacagcacttctcactttctgacacgatcttaattacctgtttattaccttgtccctccgccccccccccccccactggaatgcagcttattcccgtgtctctaacacacagtagatatttaccgggcaaagtaactaacctaaggcccatgcaccctcgccctggggagtacatcgggccccaccctcctccaggaagcctcctctgaccaagctgggttcccagaccctggggctgcctccctcccaccccgaaggcttggggccacacgggatccgtggatcccgccttagatcgggggtgcccggaggcacttacaccgtgagctccgtcacctgcgggccgcagactcgcaggcgcccagaggcgagggcgcggcgtcccggagagcttcctggaagcggcggcctctgcgaaagcgggcgcgggcgaggctgcaggcggcgcggggcctgcagcgcgctcttgtgcggtaacaataatggcagctgtcacccggccgtgcgccccgtcctcacgccccgggccggcccctgcgcggggccccgaggctgcgggcgacggagacgagccgaggcctcgcggacgcccgcccggcgtcgccccctcgcccgttcttaccgtgtccaaggccggctccccggtgcccaggaacatggtggcggcgctgcccggccgcccctcagggttgctggctcgggcgtccgggtctgggaatccgcgggcagccctggccgcccgcagcctcggggccttccctggcgccggcccgcgaccccgctgccatggcaaccaggccgccgacctacccagccgggtaagcgacctgcgttccccctggggcgaccatgcgcgtgcgcagagtccgcgggcgccggccggccgaccaggagcgctcccggagttcccggggcggagcgcgggggctgagagggggaaaaaaaccggcccggcgcagtggctcgcgtctgtaatcccaacactatgggagcctaaggcaggagattcaattgagcccaggagtttgataccagcctgggcaatgtagcgagaccccgtctctcgaaaaataaaataaaaataaaagccaggcatgctggtgcacgcctatagtcccagctcctcgggaggctgaggtgggaggatcgcttggagcccaggaggtcgaggctgcagtgagctatgattgcaccactacagtccagcctgggcgacagagcaagaccctgtctcaatcaaacaaacacacataataaactttcgtttgctttcagggtctcacccagggcgctttgctctacgtgctccctgtgcataagtacctcttgccactctcccacccttgggcttcgcaaactttttgcccttctcttatctaattatagagccagcgcctatctacgaccttttatctgtgattctgaattccacaaacttccgaaagcccttcacaactcatttgaaggccagaccagtcctaacctcaactctccgggaggaaaactctgagctgaggctatttatagtgcttatttatcccacggggtgtacatgagtgagtttcactgaataacttcttttttttttttttttgacggagtcttgctctgtggcccaggctggagtgcagtggtgcgatctccgctcactgcaacctttgcctcctgggttcaagcgattctcctgcctcagctacccgagtagctgggactacaggtgcgtgccaccacgcccagctaatttttgtatttttagtagagacgggtttcaccaccttgacaaggatggtctcgctctcttgatctcgtgatccgcccgcctccacctcccaaagtgctgggattacaggcgtgagccactgcacccggccctgaataactattaatacgtttaattatggggtgtgtgtcacactctgctgtaatctcatatttaatgtacatgtgccatgtcacatttctaaaatctgaacagttctgaattctgaaaaaacatttgtccccaaaagtttgagataagaaattgtggacctgggccaggcacgatggtggctcacgcctgtaatcccagcactttgggagtctagggtgggtggatcacttgaggtcaggagtttgagaccagcctgaccaatatggtgaaactctgtctctactaaaaatacaaaaattagccaggggtcgtgggtgcctgtagtctcagctactcaggaggctgagacaggagaattgcttgaacctgggaggtggaggttgcagtgagctgagatcacaccactgcactccagcctggacatcagagcgagactccacctcaaaaaaaaaaaaaattgtggacctgtgcaatacaatattcaaatctggagccagactgcttgggttcaaatccaaactgtgccaatccagtagctgtaaggccttatgagttagcctctctgtgcctcattttcctcatctgatgggctggtagtggtactctcctaccgttgctgtagaatcatacaagtttacagtaagtgaagcacttagcacagtgctgttgttgagttttctttactccacaattacctaactgggtgaatgttagtatctcatttcacaatgaggaaccaaatttcagggaagataactgtgcatttcaaactttttcacacatgtagttctaaggatgtacgtgtgtgtgtgtgtgcagggggcatgcaagcgtcagggaagttgcttttccaaggttacccagcacggctgggcgcgttggctcacgctggtagtcccagcactttgggaggcctaggtgggcggatcacctaaagtcaggagttcgagaccagcctggccaacatggtgaaaccccgtctctactaaaaatacaaaattagctgggcgtggtggcccgcacctgtaatcccagctactcgggaggctgaggcaggagaatcgcttgaacccaggaggtggaggttgcagtgagtcaagattgagccattgcactccagtctgggcaaaaagagtgacactccgtctccataaataaataaataaaataaaggtgacccagcaaagtcagtgcttttaaatttttaaattttaatatccataggaattctgctttgtttcctaaatctggtgttggctcccaacaatcttgctataaaacaatgctttgggaacatgagccttgtctatccactggctttgagactctcgaacacacagttagtgttttgaactcaattttttggacctagtttttctgcctgtttgctttcttaaaacacagggtcttgctctgttgcccaggctggagtgccggggcaggatcatagctcactgcagccttgaacttctgggctcaagcgatcctcccgcctcagcctctggagtagctgggaccacaggcgcatgctaccaggtctggctgattttctttttttttttttgagacggagtctcgccctgtagcccaggctggagtgcagtggcaccatcttggctcactgcaacttccgcctcccaggttcaagagattctcctgcctcagtctcccgagtacttgggattacaggcgcgcgcctccacgtccggctaattttgatatcttagagatacaaaaattagagacgagacgggatttcgccatgttggccaggctggtctcgaactcctgacctcgtgatccgcccgcctgggcctcccagagcgctgggattacaggcgtgagccaccacgcctggcctttttttttttttttttttttttttttaaattttaagagatggggtctcgctttgttgcctaggctggtctcaactcctggcttcaagcaatcctcccaactgcgcctcctaaagggctggaattacaggcatgagccacagcgcggccgcggaggacttaatttgagaacctgaagctaaatgaccaagggctttggtgcacggatcaggacgcttctctccggcacatagttttctcgctcccgccggtgcagacactgggcgccctgcaggcgaagccccgcccctccggacacaaccccgcgccttcctcagagatccccgccctcgagacgccccgcccacccaccggatgctcggcatgaaccactaggcgcctggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcggtgaggcgcgtgggccttcgggggtcgaggtcgtggtagtggggcgcggggaggccaagacccggccgaggggggcgggcgggccagggagcagcccagcccggggcgtgcgcgacctgggctcgcttcccagcccgactgtggccgcctgctctggcgccccttrtggactctcgggcctggcgctcgcggccaaaactgacttcaaagtgtggggagggttcctcttcccgggacgcagccttcccgggcattggcagacggtgccccggttagacagagccgctgaccaccccgcccacccccgaggctggacgcacggatgcacacctggtcctgggagagacaggcgccccttcctttccgcaccccgccgcccccctctcccccccgccggcttcagatgcagccaccactaatcctgggagggacagacacacggacaggtgccccttcccctcctcaccctcctactggctgcagaacagcaaatgcagccaccactgaccctgagagggacagacacacggacaggcgccccttcccctccgcacccccctgctggcttcaggacgtcaaatgcagccaccacttgacgctgggagggacagaaactttccagcccaggctggccctggggcatgggtagacatccccttgcacacatggctgaccccggamctcaaagatgcccctgactctggcccacctgcagcctgggccagcaccacgctgttgccccgactgcaccaaagaccaagggtgacagactttgagttccgraggccttgtggtttcagctagaccctcatctgcccctttcagccccrccaccagcgctcagggccccacctagaccaaagctttgcatccatccctgcagtacagacctctggtctggggatcatggttctcctggtctgagatgaaagttctgggrccccttcccaggcctgagcaggcatggtgggctrctgtgactagagcgagctgggtctggagtgggcattgaggtttggctctcacattgcctttgcagggcctgcggcctcaccatggacccagaatgcgcccagctgctcccggctctctgtgctgttctggtagatcccaggcagccggtggcagatgacacctgtttggagaagctcctggactggtttaaaacggtcactgaaggaggtaaggaggtggtgctgctgtttactgcctatccagagaccagacgcagaggctgggacagggagcaggggccagatggggactcccctgtcctggaggaagggcagaaactgccaatcagatgtctttccttcacttcctaaggattatctgtggcagactgagggcaagttaagatgaagcccgagagaatgatctggagagttagagcctgaaattcagccarttgagccaygatcagggcaccccaaggttcagttctacagaaggcgtgaacaaacttgttttattgttgttctcgttgtatttagtgtgtttaagacatcagatttgttttctttctgattatgaaagtaggggccggatgcagtggctcatacctgtaatcccagcactttgggaggctgaggcgagcggattgcttaagtccaggagttcaagaccagcctggtccaacatagcgagacgtcatctctaaaaaaaaaaaaaacaaaaattagctgtgcctggtggcgcacctgtagtcccagctactctggaggctgagatgggaggatcctttgagtccgggaggtagaggttgcagtgagctatgattgtgccactgcaccctgacctgggtgatagagtgagaccctgtctcaaaaaaaaaaaacaaagtaatacatgttctttaaaacatgaacaaaagagtaaagaggaaaattaaaccatcaacgttttaatttactcccagccttttcataacacataaagctgtatttttctggggaaaaaaaaaatgaggtcatactgtaaacacaattttggtgtcttgctttctctcttgctatcatagtgagtgttttctccacataatatgttaatgttattgactacatgttatttgctgtaggaatagaccataattaattgaatcactccactgtcagatgtttatatttctcatttttcatcattttaagtagtgtcataggtcaggcgcggtgactcatgcttgtaatcccatcactttgggaggccaaggcgggtaggtcacttgaagtcaggagttcgaaaccagcctggccaacatggtgagacctcgtctctactaaaaataaaaaaattagccgggcatggtggcatgcgccgtaatcccagctacttgggagactgagggggaggatcgcttgaacccaggaagcggaggttgcagtgagcccagatcgtgccactgcactccagcgacagaatggactctgtctcaaaaaaatagtgtcagtcgagcgcggtggctcaagcctgtaatcccagcactttgggagaccgaggcaggcagatcacgaggtctggagatcaagaccctcctggctaacatggtgaaaccccgtctctactaaaaatacaaaaaaaaaaaaaatagccagacgtggtggtgggcgcctgtagtcccagttacttgggaggctgggcaggagaatggcgtgaacacaggaggcagagcttgcagtgagccgagatcacgccactgcactgcagcctgggcgacagagcgagattccgtctcaaaaaaaaaaaaatagtgtcataatggctttccttttacataaatattctcgcatgtaaatgtttattctcatggttgataattgcattgggatagactgcatgttgttaatttctgctattctttacttcctttttttggtttaccgtgttcttttattctttttatttttaaattatattgtatttttttttttaaggatggggtctcaccgtattgcccaagctgttttcgatctcctgggctcaggcagtcacctgcctctgcttcccaaagtgccttttaccctctttgagctaaatatctaggtcttccttgttttctaatatatatatttaaggccaggcacggtggttcatgcctataatcccagcactttgggaggctgaggcaggcagatcacttgaggtcaggagttggagaccagcctggctaacatggtgaaaccccgtctctactaaaaatacaagaattagcctgacatggtggtccatgcctgtaatcccagctactcgggaggctgaagcaggagaatcacttgaacctgggaggcagaggttgcagtgagccgagataacgccattgcactccagccagggcaatggagtgagactcttgtctcaaaaaaaaaaaaaaaaaaaaaaaaaaaatatatatatatatatatatatatatatatatatatatatatatatttaagactatgcatttctctaaaagtatgactttagctacatcttacacgttttacattgcagtactttggttttaatttagttctgagtattttatgcttttcattataatttttttttcacccacaagttacttaaaagagtatcctttagtttcaaaatatggatttttccagtctttttattattgatttttaatttactttgtggaggttagaaaacataacatatgttttgaatctttatagctgttgagacttttattgagacataggacccaggcgagttttctcaatgttctagagatttcactatatgattttgatgttttggtatttgaaggtcttcaactgtggcctagtttgtagtagtcagtttttctttttctttttttttttttttgagccagggtttttgcgcgtcacccaggatggagtgcaatggcgtgaacacggctcactgcagccttgacctcctgggcagtccgcctgcctcattctcttgagttcctgggatcaaggtgtgtaccaggcccagctattttttttttycccatagagatgaggtctcaccatcttgtccaggccagcttggaactcctgggctcaagcagtcttcccgcctgggcttcccaaagtgctgggattacaggagcragccaccatgcctggcctgtatttaaattttaagaagtatttttcagtagctttattgagatataatttgcataccatgccattctcccatttaaggtgtaccagatccttttacagtttgtaagcatgagatatatatatatctatatatagatatatatatagatatagatttttttttttttgagaccaagtcttgctctgttgcccaggctggggtgcaatggcacaatcttggctcactgcaacctccgcctcctgggtttcaaacgattctcctgcctcagcctcctgagtacctgcgattaaaggtgcatgccaccatgcccggccaatttttgtatttttagtagaggtgggatttcatcatgttggccaggctggtctcgaactcctgacctcaggtgatccctccaccttggcctcccaaagtgctggggttacagtggagagccactgcacccaacctaagcatgataattgagtgttcaggcgcatgtgtgagatgtggcaccatggaaccctggtatgatgtcggtacgtgacccgtctgacatgagaaatggacaaaataaataaataaatggtaccaattcaacagttcttagtaaatttacagggctctgaaatcatcagcacaatctaattttgttccccctaaagaaaccgagtctgggttcacagtgagtccctgtttcctcctccctcccagcctctgtcatttctcctgcattgtacttgatggaaagagtgtagtttccacactcgttcattagttcagacctgctatgttcttgctaatttgtttgcttgtttctgagaggtgtgtaaaaagcttacaccaagatcatggattcatgatttttctttgagatgcatcctttttttttttttcgctttacatattatttttttctttttcttttctttctttttttttttttgtttttttttttttgagatggagtcttgctctattgcccaggctggagtgcagtggcatgatctcggttcactgcagcctcgacttcttgggctcagatgattctctcacctcagcctccctaatagctgggaccacaggagcccgccaccaygcccggctaagtttttgtattttttgtagtgacggggtttcactatgtagcccaggctggtctcaaactcctgggctcaagcagtctgcccgccttggcctctcaaatcgctgcaattacaggtgtgaggcactgtgcctggcattttttttttcttttttttttggagacagggtctcactctgtcactcaggctagagtgcagtggtgtgatcacggctcactgtagcctcaacttcctgggctcaagtgatcctcccaccccagcctcctggatggctgggactacagggacacaccaccacacccagctaattttttgtatttttttgcggagacggggtttcacyacgttgcccaggctgctttacacgttttgaagtgaggttaggtatacatagatgtaggaatgttgtgtctttctggaatttatctccgtgatcagttaacttacttctgcatgaatactgctttttgctttacagcccattttgtttgctatttctgttgctacatcagcttctttaaagttagaatttgcctactgtgtcttttctctcctgctcccagcctttcctgtcgttgcattttattgcttttagaaacaccacattgcttgtttttagtgtttaatttaatctcagcaactctttcttttaacagataagtttgatctctttaatttgttgaggcgactgttagatttgaattcttttgtattttttaatttcctgtgccttacctttgtgcctttatcctccttttctgccctccatcagattgataaagcttttttttttcttttaaatctttcctcttctggttttgaagttatacattctatttatgttcttctttttagacaagttcttgtgctgttgtccaggacagtggygtaatcacggctcactgcagccttgacctcctgggctcaggtgatcttcccatctcagcttccagtgtagctgggactatagatgcgcgccaccatgcccagcgaatttttatagagaggggatcttcctgtgttgcccaagctggtcttaaaactcctgggctcaggcaatctgcccacctcggcctctcaagatgctgggaccacaggcttatttgtgttcttcagtggctacccttatatttttaacatgagaaccggattttttaaaaagtctgaagttaattagactttccattctctatccaggcaaccgaaggacctcagagcacttgaacttcaggccatcacaaccttctattattgtcgttagtattttaattctgttttgtttcaaaacccttcaacaatgattttttagattttgaactcagtggsrttgttttttgtttgtttgtttgtttgtttttgagacagagtcttgccctgtcaccaggctggagtgcagtggtgcgatctcggctcaccgcaacctccacctcccgagttcaagcagttctcctgcctcagcctcccaaatagctgggaccacaggcgcccgccaccatgcctggctaattttttatattttagtagagacagggtttcattcaccatgtttgccaggatggtctcaatctcctgacctcgtgatctgcctgccttggccttcaaaagtgctgggattacaggcgtgagccaccaygccccgccttttttttttttagagagacagggtctccctctgtcgcccaggctggagtacagtggtgcagtgatagcttgctgcagcctcgaactcctgggctcaagcaatcctcccgtctcagcctcctgagtagctgggactgcagatgtgtgccaccatgccgggctaatttttttttattttttgtagagacagggtcttgctatgttgttctcctgccttggcctcccaaagtgctgggactacaggtatgagcacctcacccagcctgcagtgctgattcaggtggacatagtgctttttgggtcctggcctggttctcctcctctgcatgctcctcactctccttactgaaccacattctttccacaggggcttctcactgggaaactctcccaacctttgcctcaaaatgtctttttcccccactggtgcttttgagcgatagcatagctggttatagaaatacaggatgccagttctggagaggaatgtttgttccattgtacctgcttgcatggagcactgtctaaggaaaagtacccatttggaaggtgaaaatgctcttccacttttttttttttttttttttggaatggagtctcgctctgtcrcccagggctggagtgtgccrtgtgcaatgacgtggtcttggctcactgcagcctctgcctcccaggttcaagcgattctcctgcctcagcctyccaattagctgggactacaggcatgagccaccacacctggctaattttttgtatttttagtagagatgggacttcgccatgttggccaggctggtctcgaactcctgagctcaagtgaccacccgccttggcctcctaacgtgttgggattacaggcgtgagccaccacgcccagcctggtctttcactttaatttgcatttctttttcactatcagtgagacagaacattttttcagcatttttggccattcacctgttgtgaaaggtgacagtgttccgcctttcacctgttgttaaggtgttggctttctagcccttactgaattaaaattatgagtcatttgccgtatttgttgcagatatttttttcccagttggatccctaaatctaacaccctgcaagaaaagggtctgggaattgctaggagaagagcggtcatccagggggacacctggtgccntacccctggtgacccctgggctgggccntccccacagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcaggtgagcctggggcctcccacctgagtgtcccgtggagaggtgggcaggcttttcctcccgcagccaggtggggcatttgtagccatcaccatcccaagtcccagcggcctgccccraccctgtgtcctcactagaactrcmtgttttttacccccgactgtagccccctttgaaaaattcgcccggagtgatgctggggctaaggagttgaggttttttggaataagatgactggcacgggctcccagctctgaccagctgtctgagcttgcccacggccgcaagcctccatctcttcctggganggagacaggagtcgnagctgcgccatggcctccgtctcttcctgggacggagacaggagtcgtagctgccccgtggcccccgtctcttcctgggacggagacaggagtcgtagctgcgccgtggggttgtcgtgaggaccaaatgagaccgcacatcctgcacctccagcgacccagcctacaaatgaatgaataactaatgagaatgtgaatgactaatgagaatgtctttttttwaaaaaattaattttatttatttttattttattttattattatttttcgagacagagtcttgctctgtcacccaggctggagtgcaatggttcgaactcagctaactgcagtctccacctcccaggttcaagcgattctcctgcctcagcctcccgagtatctgggactacaggcacctgccaccacgcccagctaatttttgtagttttagtagagacaggatttcaccattttggccaggctgatcacgaactccttgacctcaagtgatccgtctgcctcggcctcccaaaatgctaggattacaggcgtgagccaccatacccggcctttttttgttttgttttttagagacagagtcctgctctgtcgtccaggctggagtgcagtggcagctcactgcagccttgacctcctgggctcaagtgaccctccccattcagcttcccgagtagctgggtccacaggtgcatgaaccacacctgrctaactttgttatctttggtagagatggggtctcactatgttgcccaggctggtctcaaactcctggtctcaagcgatcatcctgcctcggcctcccaaagtgttgggatacagtcgtgagccactgctcccagccaagaatttctacatagcaaggcatgagagctcgagagcctcccagagctgtgtcttccagcttcaagtgcctcagacaggcaccgctgagtctgtcgggatgcgtggtgtgagcttcagggcccttgcccgtctaccacgacggcttctcttggtgcctcacaggccctcgccaggttgtgcgaaggcacatccagtaccgttagcttgccgttcacgatgccccccagttaagcagctgcaggctccctagcagcccacccaggcaccatcttgctgcaggacagactttccaaggtgtcctagggtgctgccgtacagtgaatccgggggcccttgtctgtcagcagctggtatgaaagtaccctccaggctgggcacggtggctcatgcctataatcccagcactttgggaggctgaggcaggcggatcacctgaggtcaggagttcgagaccaggctaaccaacatggtaaagccctgtctctactaaaaatgaaaaaattagctgggtgtggtggtgggcacctgtaatgccagctactcaggaggctgagacaggaaaatagcttgagcccaggaggcagaggttgcagtgagccgagatgtgccactgcactccagcctaggcaacagagtgggactgtctcaaaaaaaaaaaaaagaagaagaaagtgtcctccagaagtatctccaccagccctggaaaactgaaaacccatctctgctttgctccacatccctggaaacctaccaggtcccctcacctctttttttttttttttttttttttttttgagatggagtctcgctgtgtcacccaggctggtgtgcagtggtgcgatcttggctcactgcaaccttcgcctcccgggttcaagcaattctcctgcctcagccttcttagtagctgggattacaggkgcatgccaccacacccagcaaatttttgtatttctagtagagatggggtttcaccatgttggtcaggctggtctcgaactcctgacctcgtgatctgccctcctcrgcctcccaaagtgctgggattacaggcttcagccactgsgcctggccaccctcacttntttttttgcttcccagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgagtgcgcccacaccccrccccattcctcatcctgcctgtgtgatcccagggaattcactgcaccttgctgaatctgagtgtctggtctgtgcgatgtctcagggttgttgcaaagactgcactgtgacagtayggctgtccagtgttctctggttggcaggtcaggccctaggagccaggacggctttctcagccacttacagatcagccgtgaggactcagtctttgaaactatttgggagccaggcgtggtgatgcgtggctatagtcccagctactcgggaggctgaagcaagaggatcacttgagcccaggggttcgaggctacagtgagcagtggttgagccactgcactccaacttaggcaacagagcaagaccccgtctcaaaaaaacaagaaacgagsctgggcacggtggctcacgcctgtaatctcagcactttgggaggccgaggcgggtggatcacctgaggtcaggagttcaagaccagcctggccaacatggtgaaaccctgtctctacgagaatacaaaaattagccgggcatgatggcgggtgcctgtaatcccagctacttgggaggctgaggtggcagaatggcttgaacctgggaggtggaagttgcagtgaactgagatcgcaccattgtactccaccctgggcaacagaacaagactctgtctcaaaaaaaaaaaaaaaaaaaacaacaagaaggaacgaattgggaagcatcacaagctgtgtgtgtttaacgctcggggggaggaggtgcttgtctccagggagcttcagttcctgttcttttttgcttttgagtggagaggcatttgggggcatcttggggggccctctgctatttgtatcttccctgaggccctctgcctcccccagctctattctggctcacccccttttccctctcttcccccatcccctacccaggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacrgaagccctgtgggtgcggctgagtccccgcgtggcctgtctgctggagagagaccccatccccgccgcacactcgttcgtggacctgcttctctgtgtggctcggtcagggccccgggacgcagctggggggcctgggtgggcaactgttttcctcggataaygcccagggatgtcccactggcagccggagactctctgaggacatggcctgcagtgaagcggcaccggggtgaccctggaaccctcatggggaaaggcctgtcttgggctgggcgcctccagtgccggagccatggcagtctcagccaggcctcraatggggttttgagggtgggggagtaatttttctctctggggtctccctgcagttctcccgtgttcagttcttccgacggcagcctgtgggagacagtggcgcrggctctgagctgcctgggtcccacccacatgggacccctggctttggggatcctraagctcgagcactggtatggtctggggtgcatttcattccgaggcgggtgctgggagctggggcaggcagggaggttgagagcgcagccctcatggcaggggagttccggacaccagggacagtcaggcggccgtgcggggtgtgactgggtggtgcgtgggttgcgcgcggcagcttctgaaggttctttagcaacagaataattgtttcagaccaaagctctgcgagatccccagaggtgagaaggatgcgggagctgctctgctyagagcagggtggtcctgccgacgccctgcgctccgctgccctcccacctgtcccccaccgcagctttggttgggggtttcggagctccccagcacacacaccatgcgggtggggggcctgggggcggtgcaacggcagagcctggggtcaggacaggtgggaaggccgtggatggcctgccagtgttccaggtgggctcacaataggggtggaagtgacctcaggacctgctgcccacagggcccaggggtaccatgagggtccagctctgagctccggggtctccgaatgtttaggagagagtagaccgggggaggatggaggaacaggcccggccctgcaggaatgcaytgtggggacactgcctccacctaggcccagacgtgagggcaggtccctcccacagagtggacgctgtacacacctggggacacccgggaggctgggggcaccccatccctgtccccctgagcgggcactgcccctctctctgggtgcatggccaggccctcctggaggcccctcagtatctgctcctaaggacatcaggagtgtcaggcccatctccttggtcaggcctgtcctccccgccactctgtcccatggcrtcccctggccagtggcctgcagagaatgtttctcggggggtgtcccaaccccctggctgatttgccccaggcttgctggggacattaggagcacagccaacttgtctcgcagccagggtcgcggcactcacctcgcgtttgtctccagtccacaggcactgaggacccaggccttccaggtccttctccagcccctggcctgtgtcctgaaggccacggttcaggcccccggacccccaggtgtgctgcttagaaagggctgggagkgcagaacctgggtccctgcggctgggggaagggagatggatgrgagtagctggctcgccacccccgccccactttaatcacacccaggcctccctccaagagcaaaggggaccggggacatggccatctcccytggtgagctgctgctctgcacctaggtcctggcctgtgctgtgggtggtgaccgtggggtggctggtgaccgtggggaggctgaagtgctctctaagggagctcttcctggcttggcccccaggcttgctggacgggacggcagacgatgccacgacggtggacacactcctggcctccaagtcgtcctgcgccggcctcctgtgccgcaccctggctcacctggaggagctgcagccgctggtaggtgcggcccggtcctcatgcagcccagcagcatccacgctggcggtgggaccgcaacgtaggctgacgccccccaccccttgctgccccagcacccttgcatccacgccagcagtgggaccacaaccttggctgatgtcccccgccccacatgcctcgaagtcccagcacccctgcatccacgccggcagtgggaccgcaaccttggctgacggccctcttcctcgcagccccagcgcccttcaccgtggccccaggcgtctctactggggrctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggtgagtgtgttctgtacrgctttggcgtggggctatccctgtgcccccactctcctttctgctcggaggcacccgggaactgctgtccctctctgtttcttctctggggtgggggctgaggggtgcaggggccgtgcaggaggtttcagctggcggatgaggccttgttctgctccttcccagagttgatggggagggtcctagggtgggggtgggggtggtttatccactcacctctgtctcaggcccccaggagctggtgacgcaggcgcttgctgtcctcctggagtgcctcgagagccccggctccagccccacggtacggtggtggggatagagagcgaggagaggagggaggcagaggcagtgggacccacccctgactccaccccgtcccgtgcaggcctctgcggatggggccttcacacagggccacagagctgctgctcagagagcttcacgatgcaggtggctgcatggggcgggcccagggcctcttgttggtgaagatacatcagcacgcaggggtgtgtggggccgtggggagcaggggcactggtcaggcggcctgcggggaattctggacaagggaaatgaggtggcaccaagacggccctgggcgtgggctttgggttctcctaagcgccatttgtgaangtgcctactccacagcccctcacggagctgggccctggcaggtacagaccttgtgccacctgccgctgagcagacagcagacaactttggaggaagggcccagggcttcttgggatcctaaggaaaaggtgccctgcgtaattggtcatgttttgatgtagaaatcccgttgcctgggttgtgggtcttctggtgagggctgccyccacctcctcctgctcacagtctgggaagccggttctgcagcatattctgccctattaaaatcagcccaggaggggcgtggggctcacagctgtgattactgtgcgttggggggccgaggtggggggatcaatggagcccaggacttttgaggccagcctgggcaacatagcaagatcccatctctacaaaaaaatagaaaaattagccccaggagtatagctcaggggtagagcatttgactgcaaaaattagccaggcgtggtgatgtgtgcctctagccccagctactcatgaggctgaggcaggaggactgtttgagcctgggaggtggaggctgcagtgaactgtgattgcagtccagcctggatgacacattgagaccctgtctctaaaaaagaaggaagcccagcgttcccttctctctccacttcctgtccccattgctgtccctggagtacgggcagcacaggtgaaggcgagggggacagacagacagcctgcccctccgtctcccgtggccctgcagcccaccctatctgctccaggttctgaagaaggccttccaggccacgctcaggtggctcctgagctcacccaagacccccggctgctctgatctcggccccctcatcccgcagttcctcagaggtaacgcagccccttgcaggggtgaacggagctggagtcgcaggggtggaggcagcaggggctgggtggaatggctcagctggctctgagggcagggtgagcctggccccaaggtcaccctgacctgtcccttcccaccctagagctgttccctgtgctgcagaaacgcctgtgccacccctgctgggaggtgagggactccgccctcgagttcctgacccagctgagcaggcactggggaggtgagtgctggcaggtggaggggctgccttccccgcctgtggggggctcactgagccagggtgcaccagcagcctcttgctggctctagaaacttgggccatgtcggctgcccacaaggggatggaggcagaggcygaggcgacaaggctcggccctcagtcacagctgcatgtggccgtttcgacccccaggacaggctgacttcagatgcgcactcttggcttcagagktgcctcagctggccctgcagctyctccaggaccctgagagttatgtccgagcgagtgcagtgaccgccatggggcagctgtccagccagrgcctgcacgcccccaccagccctgagcatgcagaggcccggcaggtaggaggtggcaggttcctcagccagcaactcccgcctggccatcgtgtgtgctcgtttgcttgcgggtggtcgagcrgccagcatgcagcgtgggagcagctgctgctgtgggcagcgcctgcagcagtgactgccgaggccctggggctgtgctgggtgtgggacctgtgcgcttcgccttctgtctccccagcacccctccacttagacatggttacctccatttgacagatgggtaaactgaggattggagggccgtgtgctcactgcgcagcatgggaaggtgtcagagcgggctgtggccctagactgcatgtccggggccagcccccatcatgtaccggagtcctgttgcgggagcctcgctcctgccacmccaccaaccatccgcacttgctccctgtcccccagagcctgttcctggagctcctgcacatcytctccgtagactcggagggcttcccacggcgggcggtcatgcaagtcttcactgagtggctgcgggacggccacgccgacgcggcccaggacacggagcagttcgtggccactgtgctgcaggcrgcgagccyngacctggactgggaggtccgcgcccagggcctggagctggccctcgtgttcctggrccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgyggagcacgctggccgagagcagcgaccacgtgganaagagtccccagtccctcctgcaggacatgctggccmcgggaggcttcctgcagggggacgaggccgactgctactgagcagaaccagastctgccactggggctcaggaccaagggaggcagcaccatgtccttytgtgggacactgccagccccagggctccagcccagcccggtggatcctctggggaagccaggaccaggagagaagcaaggtcaagaaatcccmcagtttgatgtattaaagaaatgacttatttctactcaaaataaatggcattgaagtctttctttaaccctttttgagttaatttaataataatgatctgagacaagggtccagtgtcattcattcgcatgtggatatccagttttcccagcactgtttattttttatctatctgtctgtctgtctgttttttgtgatggagtttcgctcttgttgcccaagctggagtgcaatggcacgatctcggctcactgcaacctctgcctcctgggttcaagtgattctcctgcctcagcctcccgagtagctgggattacaggcgcacgccaccatgcctggctaatttttttgtatttttagtagaaacggagtttcaccatgttagccaggctggtctcgaactcctgacctcaggtgattgacccacctcagcctcccaaagtgctgtgattacaggcgtgagccactccgcccggccaatttattttggttaaaattattcctgggggctgggcgcagtggctcacgcctgtaattccaacacttcgggaggccgaggtaggaggattgtttaaggccaggagtttgagaatagcctggacaacatagcaagaccccatctctacacatttttttttgttcagagatggagtctcagtcttgttgcccaggctggagtgcagtggtgtgatctcggctcactgcaacctccgcctcctgggttcaagcaattctgcctcagcctccccagtagctgggattacaggcgcccaccatcatgcctggctaatttttgtatttttagtagagacagaatctcaccagtttggccaggctggtctcaaactcctaacctcaggtgatccacctgccgtatctcttttgtttttaattagctgggcatggtggtatgcacctgaagtcccagctacttgggaggctgaggtgggaggattgcttgagcccaggagttcgaggctgcagtgagccgtgatcacaccaccgcactccagcctgggtgacagagagagaccctatgtcaaaacaacgcattgagtgcttggagttctctgcattcttggcagcacctcaaatctgtgctagcacctcaaatctgtgctagagaagacctgtagccctaacttctgaagaactttttctttttgcttctcttagcaccaagtgtctttcgtgtggagggagcagggctaattccgtttcattcttaccctaagagtgtagacctttaggttttcagcttaaggtgggaagggttttctataatgctccccattttgggcaggactggccctgacttctgtccccctgacccctcaaggccacagaatgagaacccaagtttgctggttttggcaaatgccctccaacaaaagggcacctcccgggtggcacagccgtgggctggtgcgccccaccagggtgcagcagtgacatcagccccgcctcggggcacatgtcccttcccggtgacagcaggctaggtgcctggaccagccgtttccctgaagacaatgaaacacgctgggtgaaatatccaaaggccaggaacactgaacagctgacaagatagcaggtaattaaatgccaggcctcgtgctggaggaaaactggactcagatacaaggccctcccacagggatctggagagcctggctctcagctctggcctgggggaactcagagagggaggggctctgcggatcagctgcccctaggcagtaacactgaaccgcagtacccagtgaaaagagactgcagggcccagcgtggtggctcacgcctgtaatctcagcactttgggaggccgaggtgggcggatctctcgagctcaggagttcaagaccagcctggctaacacggtgagaccccgtccactaaaaatacaaaaattagctaggcatggtggtgggcacctgtaatcacagctactcaggaggctgaggcaggagaatcacttgaatccgggaggcaaaggttgcagtgagccaaaatcacaccactgcactctatcctgggcaacagagtgagactctgtctcaaaaaaaaaaaaaaaggagcgagccggggcgcagtggctcacgcctgtaatcccagcattttgagaggccgaggcgggtggatcacttgaggtcaggagttcaggaccagcctggccaacatggtgagaccttgtctactaaaaatacaaaaattagctgggcatggtggcaggtgcctgtcatcccagctactcaggaggctgaggtaggagaatcgcttgaacccgggaggcagaggttgcagtgagccaagattgtgccactgcactccagcctgggtgacagaatgagactctgtctcaaaaaacaaacaaacagagactagaaactcacaccaatcattacctcgtaagtgcagttagctcaggaagtacaatatttccaaaaaggggagaggttgcaattagccaagactgtgccattgcactccagcctgggcaacaagaacgaaactccgaggaaaacctctgacacacagcctctccctctccctctccctctccctctccctccccctccccctccccctccccctctccctctccctctccgtctccctctctctccacggtctccttccacggtctccctctgatgccaagccaaagctggacggtactgctgccatctcggctcactgcaacctccctgcctgattctcctgcctcagcctgccgagtgcctgtgattgcaggcgcgcgccgccacgcctgactggttttcgtttttttttttggtggagacggggttttgctgtgttggccgggctggtctccagctcctaaccgcgagtgatccgccagcctcggcctcccgaggtgctgggattgcagacggagtctcgttcactcagtgctcaatggtgcccaggctggagtgcagcggcgtgatctcggctcgctacaacctccacctcccagctgcccgccttggccccccaaagtgccaagattgcagcctctgcccagccgccaccccgtgtgggaagtgaggagcgtctctgcctggccccccatcgtctgggatatgaggagcctctctgcctggctgcccagtctggaaagtgaggagcgtctctgcccggccgccatcccatctaggaagtgaggagcgcctcttcccggccgccatcccatctaggaagcgaggagcgcctcttccccgccgcccatcgtctgagatgtggggagcgcctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagtgaggagcccctccgcccggcagctgccccgtctgggaagtgaggagcgtctccgcccggcagccgccccgtccgggagggaggtgggggggggtcagccccccgccgggccagccgccccgtccgggaggtgaggggctcctctgcccggccgcccctactgggaagtgaggagccctctgcccggccagccgccccgtccgggagggaggtggggggtcagccccccgcccggccagccgcccagtccgggagggaggtggggggtcagccccccgcccagccagccgccccgtccgggagggaggtggggggatcagccccccgcctggccagccgccccatccgggaggtgaggggcgcctctgcccggccgcccctactgggaagtgaggagcccctctgcccggccagccgccccgtccgggaggtgaggggtgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtcaccttatccccaaccccgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggacctctgcctaggaaaaccagagacctttgttcacttgtttatctgctgaccttccctccactattgtcctgtgaccctgccaaatccccctctgcgagaaacacccaagaatgatcaataaaaaaaaaaaaaataaaaaaaaaaagaacgaaactccatctcaaaaaaaaaaaaaaaaaaaaaatctcccaaagaaataccaataaacaagaaaatagtcaaatgtaaaaaaaaaaaaaaaaaaaaaaaaaaaatttccaaaaaggtgaccacagggagaaaaacatgaagataaccaccagctcagacccagccggggcttgtggccatgcccacctgctcctgtgtgtcctgggcctcgggcaagccactcatcctctccccactgtttccagtctgtaagctgggattagtgacgctgccttctcagttgtgggaacctagaaggcagcaatgggcctctctccctaggttgcaacccggggctggcacgtagtaggtctgtttccagctgccacacacgctaccttaccaggggtccccaagagacaggacagggtgatgggcccatttcacagggggaaaaaccgaggcaaagaaaggcagtggagactcgtgcttctgcttcagtagctcctgccatggacttgacttgggaaccccctcccacaagctctgtccctggcaccctctggcactgttagccagcggaatccagctgtcaccatggcctggttcttagcacccctgggaacttttagagcctctggcctgtgctaactgaggttgggcagctgctggccagggccctagagagaggggtatcaggtagctagtgctgagtaacaaatagctccaaacacatgacttcacatgtccttagtattaaagggcctggtggtactgctgctcattgctaggcctggcaagtcctagctgggctcactcacacatctgtgggcagctgggagctagctagtccaggatggcctcagctagggtgacccaggctccatcgccctcttgccttccagcaaagcagcccagcccgttctcgtgctatagcaggagtcggggagagcaggcagaggcacgcatgtccctggaggcttaagctcagagctgggaatgtcattgctgtcaccttttattggccacagcaagtcataagacaggctcagattgaaggatggggaagtagacgccacctctagacaggagttggggcaaagtcacacagcaaagggcgtggtgattcagggaggagtggggcatcggggacacgtttgtaactgatctaccacagaggggagcccccctttgagaaagtgcttggtgggccttggtgcttacgcagccacggaccaacctgctagatggggccttcagtagggtggcgggacgtcagtttagcctcaggattcgactccgagcctcttgcgagaccacgtcttgggcagcatcgtagacccggctgtgagcacagagtggctcttccagaaagtttgttgaatgactgactgacctaagtcagtccctgtgccaggcagcccagagggaccagcccagagcctccttctcggggtgcaagcctggcttgggattggggggtgtctgcactcgtggagccccccatgcctgccgggagcctgaagacgcagagacctcctgcctcgcctcgccccctccgtggggaccctcttccccacactccttggttcctgtcggagccaagatgtgtcaccatggaaaccgcttggcaaacgctggcaggcagaggcggccaacagcagctctcccgatcgagctccgggcaccggct

SEQ ID NO: 10816 - DNA, 40260 bp, Homo sapiens
  misc_feature (1)...(40260): n = A,T,C or G, or insertion/deletion polymorphism (see Tables 1-2)
acagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgattttagtggcttttgttttctaaaatgaaaatagcttgaaatatttattataaaaataataaaagctagatataaaaatctaaagagaaaaaaaaccagtcacccttatctaatattttagtgagcagtcttccacatgttcatttataaaattggaattatttgattttgtgtattgcttttcccccctcaacatgttgtgcacaattttgtacaggcttacatggacatttttgatgacatgttttcttgtatggatatgccactacacatttaaccagtactcgatgtccatgttggttatttctaatttttcaccattataaacaaccctaaagttaatatcctcacatatgtgtttgcatactcgtctgtcaccttaggatacgttttctaaaggtagaactacagctttgaactcctaggctcaagtgatcttccctctcagcctcccaagtagctgagactacaggggggtaccaccaaacctggctaatatttaaattttttatagagatggagtctcattctgttgatcaagctgtttgtgaacccctggcctcaagcaatcgtcctgccttggcctcccaaagtgctgggattataggtgtgagccaccatgcccgccctcttctaattatctgtcatgagatggatctccagtcattgcattgaggtttatgtatttaatatatttagtgttttccctataccggggcatggatttttgtctttctttgagacagggtctctatctgttacccaggatggagttcagtggcatgatcatagctcactgcagccttgaactcctgggctctaatgaccctcttacttcagtctcccacttagctaagactataggcatgtgccgccacacctggccaatatttctttaaaaatgttttttgtagaaaaattagctgggcatggtggcgggcgcctgtagtcccagctacttgggaggctgaggcaggtgaatggcgtgaacccgggaggcagaatttgcagtgagctgagatcatgccactgcactccagcctgggtgacagagcaagactctgtctcaaaaaaaaagatgttttttgtagagccagggatctcactatattgtccaggctggtgaatttttatccattttttactgctgaattcccagcacctacaacagtgctggcaaataatagataactaaatattgaacaggtgaacaaattttttttttttttttttttttgagacagggtctcactctgctacccaggctggtgtgcagtggcttgatcacagctcaccgcagcctccaactgccaggttcaggtgatctcccatgtcagcctcctgagtagctgggactacaggcatccaccaccatgcctgtcaaatttttgtatttatttatttatttttttgtagatacggggtttcgccatgttgcccgggctggtcttgaactcctgggctcaatcgatcccgcgaccttggcctcccaaagtgctaggattacaggtgtgagccattgcgcctggcccaaatcattttaaatgtactgggagatgcactgataggaggccaaactggcagcaggactgcctgttagaagtaatcagatgatggtggcctaaactaatggagataaaaagatgtacacagagctctttaggaggtggactaagcagtactatctggttttaggtttaatgacagaagaggcctggtgcagtggctcacgcctgtaatcacagtactttgggaggccaaggcgggcacattacttcaggtcaggagttcgagaccagtatggccaacatggtgaaccgcccccccaaccccgtctctaccaaaaatacaaaaattagctaggtgtggtggtgcacacctgtaatcccaactactcaggaggttgaggttgcagtgagctgagaccacgccagtgcactccagcctgggcaacaaagcaagactccgtctcaaaaaaaaaaaaaaaaaaaaaaaagaatgacagaacaggctgggcttggtaatcccagcactttagggggctgaggtgggaggattgcttgataagcctgggcaacatggcaagactccatctctaccaaaaaaaaaaaaaaaagtgcaggaaatcagcctggtggatggtggtgccattcactgacatgtagaactgcaaatgtggcaaatttggtatgggaaggaaggggcatgtgaagaggaagatcatttagacttgaacatactgacacacagcagctattgaaacattcaggtgtgattgttgtagctggatgttggatattccagtctggagctctggagagccatctggcctggagacaaagtgggagtgagcagcgtgtttaatgatagacctggaaatggatgagatctcccagggataaggtttaggaaggactttttaggagcattaacacttaaaggatagacgtttaattttatttattcttcagaataattctgtcgaggtaagtagtatcattcagattttactgtgggaaacctgaagcttaaaaaagttaacttgtcaataagaaagctggttggtctgaggttcaaaccatatgtctatgagctcccaaaatcaatgctcctttgtatgtctcaaagcactgtacacagctggtgcttaatagttaaaatcttctatcacccctccccatttgacttgataacttaggaaggtaaaaggcatgaggcggctttcacagctgtgggacttagctcttgttaccttgggcagttgtacagattcctacaacctgtatttcagggtcgaagtgaaaatatttgtctatcactgagtgttttgtatatttatggctctcgatcaagagattatgtgtcaatgataataatcagctcttggctacatttcaattttttttcttttattttacttttaagttctgggatacatgtgcagaacatgcaggtttgttacataggtatacatgtgccatggtggtttgctgcacctatcaacctgtcagctaagttttatgccccgcatacattaggtatttgttctaatgctcgtgttttctttttttctgaggcagtctcgctcactgtaacctccacctcttgggctcaagccatccttccgcctcagcctccatggtagctgggactacagtcgcgcgccaccacgcccggctaattttttaaaaaaaattatgtagagatgggtcttgctatgttgcccactccagtgggcatcccaaaatgttactggcatcccaaaatgttaggattgcagatatgagccactgcgcctggccttttttaaaaaaagttttatccagtgacaggctgggctatacacttaatgtctaaaggtttttgcctttcagttcatatcaacgcgagtagagttagctagctatgtttgtaaacaatattccgatatgcttcgttaaagtaagccgatattaaacatttatataaatccatcctcacagggtcaatctggagataaactcaccgctgcagggggcggggaaggaggtgggaacacgctcattgacaacttcatttccatgagaatggttgctgtggtgattgctgcgtcttcccattggtcattgccgagcgtattgcggttctccgggagggttatattggttcccattccacagcggccgcaacgtgtcgagagccgtaagtaaagtgtcgcaaagcagaaggaaggcgggagtcccractgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacngcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcaggtgagagcgagcccggccaggccggcccctgttggcaaatggcgagggatggggaggagcccctgccaaggccaagggcagacgttgtaaggcgcaattcgtccccacgtttttgtagctctggactgagtcccaaagagcgtctgtggtcttcaaaaaagccagtcttatggacttattgccttgtaactagatctcccacagtcggccgtccccagactccgtgtccaccctcgtcgcccacaccaatatcgcttgctgctgcttcacttagacgtggcgatgcattggtgtccgagaccctcctacatcgtcatgcgctttcctctccaccagtccaactcctgttcattctgttaagaaaatccaaagtaatttaaatcttaacgtctcaaggaaatgacaatgaccggagtacattcttttttggttttgtcttgtttttgtttttttcttagagatggggtctcactgtgtcgcccaggttcgagttaagtggcaccatcatagctcattgcagcttccacctcttgggctcaagcagtcctcctgcctcagccttcatagtagctggaaccacaggcgcatgccaccattcttggtaatttttttaattttctgtagagatgggggtctcactatattgcccaggctggtcttgaactcctggactcaagtgatccttctggctcaccttctcaaagtgctgggattacaggcctgagccgctgtgcctggctcggaatacattcttaattcaaaataaaatgtccaaaatctgcagcttcctttcttaccaaattcatttgtttgcatcttagggaattcttccccattcttgaaaacctatctcaagaatcacttcctttagtattaataactttcttgggaccattttgggccaaactgatctctccctcctacctttgaattcttataatactttttgtttcccatttatatggtacttggtttcttaaataaatctgggcagggcacagtggctcccatctgtaatcccagcattttgggaggccgaagtgggaggatggcgtgaggtcagtagttcaagaccagcctgggcaacaaagtgagactctgtctcttaaacaaaacaaaacaaaacaaaaaacccacaaaactagccaggcatggtggtacacgcctgtagtcttagctactggggaggctaggttgagctgggaggatcacttgagcccctggaggagccatgatcatgccactgcaactgcagtctgggtgacagagcaagaccttttctcaacaacaacaaaatccacatcaatattctaaagtaatattggtcaacacctgtgaaaagaaggggtgaaaaaaagaaaaatactttaaaaagttaaaataatattgggacaggtgaacatggatgtttatcacagcagtgttgattattaaagaaggaaaatcgcagggctgaggcaggaggatcgcttgagcccaggaggtcaaggctgcagtgagccaagattgtatcactgcactccagcctgtgcaacagagtgagaccctgtctcaaaaagcaaagaaaaggaaaacaatataaatgtcagtaggaatatgattaaattccgttacatccaaacagaagaacagtacacaattattaaaaataataatttatattaacaaaaattggcaatatgaagagggaggaagaagactataagccatatttagaattatgtagaaaaggccggatgtggtggctcacacttgtaatcctagcactttgggaggctgggatgagatgatcactcgagcttaggagttcaagaccaacctgggcacatagtgacacctcatcgctactaaaaataagaaaaaaaaattattccaggcatggctgctttgctaggcagtatgttctttgggcagccatcggggccccaaccaccaccggggctctggggccaggcttcctttacttaccagcagctccygggcctctgagaccttctaacagtactttggtggatgacatggagtcatctttccagacttgctttgcctctccgttaagtcaggactatgtcaatggcagcaatcaggaagaaattggaactggtgttgatcggtgtatacacaagtttctggatattgcaagacagaatatttctttcctacaaaaaagattgcaattatctgtccagaaaccagagcaagttatcaatgaggatgtcgatgtctccgaactaagaaatgaataacattggagacatgcactggtccagaagcacttgacaaagctaaggcattggcagcaagtgctggaggtcatcacgtgcagtacaaaaagctagctgacatccatcaaggctccttggtctaccttgagcaggcattcaatatccctgcacttctgaagtgcacctgagcaaaagggtaaaggctgtgggcctgagagtgggctggtgtgggagagccccatgcagatggtttgccacacatcccttcttgtagacttggcattttggaagaactctttgacagagaatgagttgattttagttttatgctcccacctaaaattttttcactatttttataagatgttaatttcttgagtactttatttataacatgcctgtaccttgggtaaaccaagtaaacttttttttgtcttaggcaaagtttagactgttcgtatgatgatacactttcttttttatgtgggttttttttttttgcttgttttttatttttatttttatttttgagacagaatcttcctctgttgccmaggctacatagcagtggcaccttcacagctcattgcaacttccaccctcctggcttaagcgatccttccacctcagcctcccaaatagctgggaccacaggtgcctgccaccatgcccagctaatttttgtatttttagagagacggtgtttcaccatgttgctcgggctggtctcgaactactgagctcaggcaattctacccaccccagcctcccaaagtgttgggattaccagtataagccactgtgtctggccttttaaaaatttttgcatgacttttcatctttttatgtgtgtttcccatttgtttgatatgagggaaaaatttctaatagcttgagaatcaaggggatggggattttggttgtaggcattttataataattaaccccttagcagtggtgtagaaaaataggtaaattttttgtttcaagacttaaaactacctcaagaagaacaatctaatgtaacagtatttgtaacgcttccagaggtctcagatgaggaatttttttgtaaatggtttggaagaagattaaaatatcctgggttagcgtagtaacattacggtaggatccttaggttgatgctgacttttgtttggggtaagtttatattttgtgtggtgtttatttactttttttgaagaggaggatgtagtaggagcagtgttacaaatcagtttaagtaatggagtagaccctgttgtcagtggggcatagatgagttatgagggctaaagcttgctctgatggtctctttttgttttgttttctttgcttttatcttttgttttacatttggggaggggagagattttccattaaggaaggttattgctagtggatttgattccaagggtctggggtgtcacagtagggttggggaggggctgcagggtgatccttggctactgaacctccacagagagcatgtggtgcccctgccctttcaagataatttactctcttgttagttttgcaggccacctcagattctctgttgaattgctgttaagaaatacagaccagtgttgtttctgggctctcgttgggtgaggttttcctgagttttatgtctcttcttagttcacatcgtgttacccagaacacatgcttcactgtcttctgaacaggcagtactcctgtggctctgtgtcttggcttgtttagtttttttcagccttgaaggctccttcccacacttactgacatccactcatgttcctggtatgacctggattgctgcctggtccctgcaacctcccaatgccctttctgctgcattcccagagcacaggacttttctcttttctactgaccttgcttggttctcccttgtgggttagtaatttctgtctgtctctttgcccctcactaattgttcacccatgagaattaggtattattccttttaaatatacagggaccatatagtctttatcttttatacatgatacttattactcaattttgtgtgtgcaaggtatctggcacatggacctgtgattagtagcctgaggtcaacaaatctcagttagaatgcgtaggttaaacaaagcttttttttttttaaatttaatttaattttatctttatagagatggggtctcactatattgaccaggctggtctcaaactcctggcctcaagtgatcctcacatctcggcttcccaaagtgcaaggattatgggcatgagccactgagcccagcctaaacaaagcttttaaaagctcctgcaacctcaaggttgttaacctggtcatctcatggtaattasaaactctgattggctgctttagatttcttgattaaaaacctaagtaaactgattaagttttaggcattctttcaaaggtttctcagtgaaaagattgggaactattctatttggtgctttgtgaamatattttgaattagtatatgtgccagttattgccatttcttaagtccaaaatgtttttctggtcaaataaatagcagtttttcaaaaacaaaaattagctgtgtgtggtggcatgcatgtgtagtcccagctactcaggaggctgtgggaggactgcttaagcctgggagatcaaggctgcagtaagctaagatggtgtcactgcactccagcctgggtgacagagtaagaccctgtctcagaaaaaaaaaaaatttatagaatgatcctatttttgtataagactaagtatacacacacacacacatacttacattatatatacacatatagtaaaaagtttatatacatgtgaatatatacaaatacgtatgtatgtgtgtgtatatggaagagttttgcaagtatcagttaatgggaattcatgatattctaactgctttgtcttaatctggtgtcttctccttggggaactacagaacttggctctatattatttatcaaaagagattgatattacattagattatcaagagatttctgtcttctctgggttccagtgccttaggaataatttttatctggtattccttctgatccttgttatcaccagtacacactggcactaccatcttgattacttcactttagtaaaatttcctaggaaattagtagattgctgtccccactccaggttatatatgtataggagtactttttgttgttattgttcacagattcattgagttgcaattggcatataataaactgcacatatttttaagggtacagtttgatgagttttgacatatatatttatacctgtgaaacaatcactgcaatcaagatatgaacatatctgtcaccaccaaaagttttcttgtgctcctttgtagtccctccctctctcctatattcttttcctcccttctgcttgcccccaaccctgcattttgtagaattttattttattttagagacagggtcttactatgttgcctaggctggcctcaaactcctgggatcatgtgaacctttcacctcagcctcctgaatagctgggactatgtagaaattttattttatttttgaagacggggtctggctctgtcacccaggctggagtgcagtggtgggatttyggctcactgcaacctctgctttctgggctcaagccatcctcccacctcagcctcctaagtagctgagactacagggtcacaccaccaygcccagctaatttttgtattttttgtagaggcagggtttcaccatgttgcccaggcctcaagtgattcgcctgcgttggcctcccaaagtgctgggattacaggtatgtgccactgtacccagcctatgtagaattttatataaatgaaatcatattgtatatactcttgttttggtataccttttttccactcaacatcgttatttcattctgtatctactgagctgatcgtgtcttttcattttcagtctgttaatagggtggattacattgatttttgtaaatgttaaactaatcttgcattcctgggataaactccatttggtcgtagcgtattctttttatatattgttgaactgaattcactaaatttttgtttaaaatctttgcatctgtgttcatgaaggatttcagtctgtagttttcttgttatatctttgtttaatatgagatgggaagtgtactgtccttttctcttttctggaagtgtttgtgtagtgttggtgttaaacttcattacatgtttggcagaatttaccagtaatacttttttagctgtttttattttatattttacttttctccttacctagtttgatagtggcaaggatatgatatgtgaaagatgcaagaccttccattgtagcttttctacccttagtaggatttatattgtatttaaagaataattcacataaaggctgggcacggtacctcatggctgtaatcccagcactttgggaggccaaggcgggtggatcacttgaggtcaggagtttgagatcagcctggccaacatgatgaaaccccatctctactaaaaatacaaaaattagccaggtgtggtggcaggtgcctgtaatcccaattgctcaggaggctgaggcacaagaatcgctagaacccgggaggcggaggttgcagtgagccaagatcatgtcacagcactccagactgggcaacagagcaagactctatctcaaaaaaaaaaaatggtaataataattcaaataaaatgtcaatagtgattatctctgtggagtcaagctttaaaaaaaaaatccaaaacaccaaacctaatttaattttaaaaataaaggtgggccgggtgtggtggctgacgcctgtaatcccagcattttgggaggctgaggtgggtggatcacctaaggtcaggagttcaagacaagcctggccaacatggcaaaaccccgtctctactaaaaatacaaaaattagctgggcgtgatgttgggcgcttgcaatcccagctactctggaagctgaggcaggagaatagcttgaacctgggaggtagaggttgcagtgagttgagattgtgccactgcactccagcctgggcgacaagagggaaactctcaaaaaaataaataggctgggcatggtggctaacacctgtaatcccagcactttgggaggctgaggtaggtggattgcctgaggtcagcagttcgagaccagcctggccaacatggtgaaaccccgtctctattaaaaatacaaaaattagccgggcatggtggcgcatgtctgtaatcccagttacccaggaggctgaggcaggagaatcgcttgaacccaggaggtggaggttgcagtgagccaagatcgtgccactgcactccagcctgggcaacagagtgagagactgtctcaaaaaataaaataaaataaaaaatattttggccaggcgcagtggctcatgcctgtaatcccaagactttgggaggctgagacttgagtccaggagtttgagaccagcctggacaacatagtgagactttgtctctatttgaagaaaaataaaataaaagtgatttgatcattccactggaacatagcactttggtcttccggctttacaaaatatatccattgtatatatatttttttaagtgacttgatcagtcctcagtatccaggactataggtcatactgataatgttttgagattggatagttctctcctctatgttacttatgaggtcctttccaggacctcattaaactacataagtaatagaggcttgacataatagaggaccttattaaacctcataagtaatagagacttgaagggtgatatggtttggctctgtgtccccacccaaatctcatgttgaattgtgatcttcagtcttggaggagaagcctggtgggaggtgactggatcatgggggtggatttcgtcttgctgttctcatgagatctggttgtttgaaagtgtatagcacttccttctttgctctctccccttcctactccagccatgtagaatgtttgggcttccccttcaccttttgccgtgattgtaagtttcccgaggcctccccagccatacctcctgtacagcctgtggaactgtgacccaattaaacctcttttctttataaagtatctagtctcaggtagttctttatagcaatatgagaatgaactaatagaaagggctctgccttcctaataacttactgattgtaatttcctgatcttagacctacaggccaccttttccttactctttagttcaacttatttctcctttgatgatagacagtgcttgggaaactcctttgaccatgacaccagtaagccccactgcagcacactgcaactaacctaggtagtctagagactcacctagtaccagaaactggttagtcacactctatttttgggacagggttgtgtttggcctgctatattcagggtagactgtgccacagaaagcaacaattcttggtatgtgacaaatctgaaaccatgaaaccatgattgtaagtttcccgaggcctccccagccatacctcctgtacagcctgtggaactgtgagccaattaaacttcttttctttataaagtatctagtctcaggtagttctttatagcaatatgagaatggactaatacaaagggctctgccttcctaataacttactgattggtcatgttacatgttagtcaggctggtcttgaactcctgaccccgtgacctgcccgcttcagcctcccaaagtgctgggattacaggcgtgagccattgcacccagcccaaaagatttttaaaacaaaatgtgtgatatagtaatatatatgcttctttattaacacattatataatgtgtctaatatctatgatgattktaaagtaatgatgagcataaatgatattttgagatatctgcaaactagcataatagaaaggtttttttttttcatttctattgttcacaaagtcccaggtcctataatactgctacaatttatttcctgtgttcataatgaaaagaaatgctgtattttaataggagattggtgaaaagaaatttgtatttttttccctgtccaaattcatggactctgaattctctttatggatgccttggggatccttagacttgaggttaagaatttctgcattaaaaacttccttccctagtggcaaaagatggtagaaggccagcctcagaagtatccttgtgcctgaaggactgactattccaagggaagtgaggtagactaaccccactacatacatacatacatacatacatatatgtatatatatatatatwtatatatattttttttttttttttgagacagagtctcaatctgtagcccaggctggagtgcagtggcacgatctcggctcactgtaacctccacctcctgggttcaagcaattcttctgcctcagcctcccaagtagttgggattacaggcatctgccaccacactcggctaaattttttttgtatttttcagtagagatggggtttcaccacgttggccaggctggtctcgaactcctgacctcaagtgatctgcctacttcggcctcccaaagtgctgggattacaggtgtgagccactgtgccgggcccatatatataattttttggttttggttttgtttttgagacagagtcttgctccatcacccaggtaggagtgcaatggcacgatctcggctcactgcaacctctgcctcccaggttcaggcagttctcgtgcctcagccccccaagcagctgggattacaggtgcacgccaccactcctggctaatttttatgtttttagtagagatggggtttcaccattttggccaggccggtcttgaacttctcgcctcaagtgatctgcctgcctcggcctcccaaagtgctagaattacaggcgtgagccaccatgcctggcctatttcttttttttttwaaaaaaaagttctctggaagagcatagtattttgaaagtattatatgtttctgatccatctttgtctattatctcagaatctcaccatggcttagctgattgttccttactcaaaggcccacatcatattgttgacctgctggggctcgcagtaatacttgaagactgggacgccgggaggatccatttccaacttactcacatggttgttggcaggattcagttcctcacaggctttttgactgagggcctcagactgttgacctctctcatttcctttccatatgggcttctccatagggtggctcacaacatggcagttggcttccttaagaaggagcargcaattgaccgggcgcggtggctgacgcctgtaatcccagcactttgggaggctgaggtgggtggatcatgaggtcaggagatcgagaccatcctggctaaaacggtgaaaccccgtctctactaaaaatacaaaaaattagccgggcgtgattgcgggcgcctgtagtcccagctacttgggaggctgaggcagaagaatggtatgaacctgggaggcagagcttgcagtgagctgagaccatgccactgcactccatcctgggcgacagagcgagactccgtctcaaaaaaaaaaaaaaaaaaaaagcaggcaatagatagcatccaaaatggaaatcaagggttttgttaactaatcttggaaatgactttccatcacttctgtgatagtctagtcgtgagaagcacatcactaaaaccagcctgtactcaaggggaagaggttacctaagagcatgaataccccgaagcagggatcattgggggttaattttagcagctacctgctgcactacataaggtcaatatcattgtgaataattaattcattggtaatccaactctactatttggttggttataagtattgacttcaaaactatgaaagttactttaattggaagtcttatatcattgtttgtttctctttttctttattttccagaataacctgggtatcttgtggtctgaaagagaagaaattgaaactgcacaggcttacctagagtcatcagaagcactatataatcagtatatgaaagaggtatgttacatgtcagatgagttttaagttttgattgaaactagttaagaattgatagtaagaatccctcattcgtaatattggtgtractcttcactgtgccctagaacttctctatagagccatctgggaagtcacctcatagctgaaattattgcatattaaagacttcagggttttaaaaaaataatccttgtataggacataatggccacctagtctaaatacaattataaaggaaatattattctagtgttatcctaaaatactatttgcatgtttttgtatttataatctaaacattctattttagttttccatgaaaatagcactacttgaaggaaacaagaactactttaacaaaacatctgaaatctttgaagcaatggttctcaaatgttagcacccatcaaaatctggagagctcatgaaagcacagcagactgggcatccaggctctgatttagtagttctggggtggggcctaggaatttgcatttttaataagatcctgcctgggtgatgcttaaatgctgctggtctaagtactatactgtactttgagaaccactgcttcagggcaatggtttttcaatgattttttttttttttaacccgtgaaacccttctgaaaatgcagcatataaaaattgattgagttactctggttaagcaggttagaaggacccagagcccactccactacagattcttcctcctccccactgcagtagcacaaaagagatgctgtagaacttttaggggtctggggagccaacattgaaaactctcactttaggggtcacagcctgcaaaggtgacaagccactgtgttaccatctgtttccttaataaacttttttttaatatgaaagggaaataatcaggcacaatattttcttgtggattactatttgtcacagctatctgctttaaaaatccattaatacggctgagcatggtggctcatgcctgtaatcccagcattttgggaggccgaggcaggtggatcacttgagatcaggaattcgagaccagcttgggcaacatggtgaaatcccatctctactaaaaatacaaaacagcaggcatggtggcgcacgcctgtagtcccagctactcaggagactgaggcaggagaatcgtttgaacctgggaggcagaggctgcagtgaactgagatcacgccactgcactccggcctgggcgacagtgagaccctgtctcaaaaaaaaaaaaaatccattaataaagtgcttttataacattaaaaaagttgaaataacattagatatcacataaaagagactaaacatacaaaattatgtttgctaaattcatgcgtcagaatgcttgactgcaaaaggatataagaagcttggtatgcctgtaatcccagcactttgggaggctgaggctggaggatcacttgagcccaggagtttgagaccagcctgcgcaacacaggaagacctcatcactacaaaaaattaaaaaatttgccagatgtggcacacactgtagttttagctacttgggagattgaggcaggagggtcgcttgagcccaggagtttgaggttgcagtgagctatcatcgaaccactgtactccagcctgggtgacagagcaagattctgtcttttttttttttttgagatggagtctcgctctgttgtccaggctggagtgcagtggcgtgatctcggctcactgcaacctccacctcttgagttcaagtaattctcctgcctcagcctcccaagtggctgagattataggtgcccgccaccattcccagctaatttttgtatttttatagagaccgggtttcaccatgttgccaggctggtctcaaactcctgacctcaagtgatccgcccacctcagcctcccaaagtgctgggattacaggcataagccaccatgcccagcctcgtaccttggcattttaactttcttcctgaagtactaacaagagcagagtgccacaaaaccaaatagagatattagtctaccctttcttgcttttaggctcacagtcttatatgtgraattgttaatttaaaatgtaangtctgaggccaggcacagtggctcacgcctttaatcccagcactttgggaggctgaggtgggtggattgcctgacytagaggttcaaagatcagcctgggccacatagtgatacgctgtctctacaaaaactaaaaaaaaattagctgggtgtggtggcntgtgcttgtggtcccagctacttcgggggctgaggtgggaggatggcttgagtccgggagggcagtccaggaggtcaaagcagcagtgagcgaggatcctgccactgcacgccagcctaggtaaccaaataagaccctgtctcaaaaataagtaaaataaaatgtaaaagctgaacacggtgacttacacttataatcccagcactttgggaggccgaggtgggaagattgcttgatgccaggagttcaagaccaacatgagcaacaaagcaagaacccgtctttacaaaaaaaaaaaaaaaaaaagttactaagcatcaatagtatttcattaaaaatagtatttgtatggaaacataacacatatagtgaaattccttgtgtttagttgtacctctgtttcagttaagagactgatttgactgtattaatattacgtatgatgtgtgaaagccataacagtgaagtatgtacataaaataatatattgattaattcccctcatctagacaggggtaagcatggtaagcagccctcggaattgttgaagagttctctgaagaattacttatctattgtgtttgccttgggccttgcttcctgtcttagttgtttttactttatgtgaatcctgggagcccacgttgtgatgcttttagtgtttacatccagaatgtaaaatcatatttttatgaaagacgttgttcctttttgagtttaatgaattcagttaaaagcaagagtgtgtttctagatgggactatcctcatagaagtagaatgaggcagaggttaggtagttctgttttggaagacgtaagagggggttgtaagtgatttataaatattacttaatcctcatgagatagatactgttattacccttattttatagatgactaaacagaagcacaagagatcaagtgacttgcccaaggcaataaataatggaatctggttttaatgtccctgtattgaaagggggtaatacacttttgttatttccttgagaaaaaaatattagaataaatattaaaatctctcatttgatttttattagtggtcagtttagaatactactactgtagaaatatatacatttttcctatttgttttgcttatgcatgtttttaaaagagcccttttaccagacaaaattgccatttgaaatacttaaagaggggtcgggcacggtggcttacacctgtaatcccagcactttgcgggggccgaggcaggcggatcatgagatcaagagattgagaccatcctggccaacatggagaaaccccgtctctactaaaaatacaaaaattagctgggggtggtggcacgtgtctgtaatcctagctacccaggaggttaaggcaggagaatcgcttgaacccgggaggcggaggttgcagtgagccgagatcgcaccactgcactccagcctggcaaaagagcgagactccatctccaaaaaaaaaaaaaaaaaaaaaaacttaaagaggctgggcaccttagctcatgcctgtagtttcagcactttgggaggctgaggcaggaggatcactggaggctaggagttcaagaccagcctgggcaacagagcaagacccccatctctaaataaataaataagaattaaaaaaagaaaaaatacttcaagaattatatatgtctaaaagcagattggtggattttttgcatatttgcagtttaactgcaacaacagtaaaattttgtcaaatgtgaacttttgacatttggttaaaacaaataaaagggtatcttttatttgtttgactcagattttatggttaagaaaattacttgttgaggcgggtgcagtggctcacgcctataatcctagcactttgggaggccaaggcaggtggattgcttgagcccaggagttttaagaccagtctgggcaacatagcgaagccctgtctctacaaaaaatataaaaattagccaggactggtggtgcacacctgtggttccagctactcaggaggctgaggtaggaggattgcttgaggtgggaggatcgggagacggaggttacagtaagccgagattgtgccactccactccagcctgggtgacagagaccctgtctcaataaataaataaaaatttaaaaaacagaaaattacttcttgagtaacataaaaatgaactaggaaaaaatgaaatgtatttggcttgtagaagttgatttctccaggtcctccagaagagggcacttggtgtttacagtttaaaactttaaagagcttttgtttttcttaattgtaggttgggagtcctcctcttgatcctactgagcgttttcttcctgaagaagagaaacttactgaacaagagagatcaaaaaggtgagtaggtatagaaatcagcccttgcaaatatttccacatatcatagattagtgattgttcaaaaagtcacttataaaggttatagaatgtggattctgacaggagtaaaacctccatttaccacttacttgttatttgaccttgttcaaacctgagactcagtttccttatctgtcaaatagatacaataaacaaatccaactcaaakggttggtgggataatcaaaataaatatatatgaaatttacttataaaacgtaaaccatggtccggacacggtggcttacacctgtaatcccagcactttgggaggctgaggcgggtggatcacaaggtcaggagttcaagactggcctgactattatggtgaaaccccgtctctaccaaaaatacaaaaattagccaggcatggtggcaggcgcctgtaatcccagctactcgggaggctgaggcaggagaattgcttgaacccaggaggcggaggcagtgagccaagatcgtgccactgtactccagcctgggcaacagagcgagactctgtctcaggaaaaaaaaaaaacaagtaaaccattacacaaatattggtttattttttctttacagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataaggtaagcttcttgaagtagttatctaacagagtaccaatagtgagtataaaaatagaaccagtagtaccttgaaaatactatcttttaaaaacaggtagcttgtattttatgatgtacaactgaagccgaaaatgcagcccagtttgcccgtgtactaaaattttgtagctttttgttgtatgaattattttgagttttaaaataccgagttttatcattgttttacatgttacctaagaccaattctttttttaacataggcacgctatctcaactcattttagtgagatattaccttaaattgcagattttaccttgtagatatagctttatctttacgtaatggtaatctcataactctgagaatttgactgaggaagttgactgttaaatgtgggctttgataaaagcatgtgatgcatttcagttatttttcagaattaactctgtaataattttttaatgttggaaatatgtctgctgagttccaaagttctaggtctttataccatacttcttttggattgttacacagggacaatgtttttgagcttcttagttgtttatcagaatttctcataaaaatttaaaaaagcattgctcacatcatgttggtgtactcttaattgacccatttattcctttaatccttgagagtttttaatgctaaaataattttacaccaccttttctaaccagattttcctattaatccttaataagacatctcagcaatataaattacttttatttatatttcgaattcgcaagcctctctgaaattttggtagttctctgcttatcagagttccttctttcatctctctggtaacccgctgccttatccttgggcctttatcctttttgagcatttcgttagcgttggttctgtaaatgcgcccgatgattaaagtattgtcccacagaatttcattcagaaaagctattagcaggagagaaagggctgtggtgactgcagcatcgcttctaggactttggtctaagatcaagtgtgtaagtaacgctactgcatatatcagagcattcagttaactaattctcatgaatccatttcattgtcctcatccaaagtgttatccagtgcctccgcttgtgacatcttttttacagctgttggaggccccttattcattctgtttagcaactttaaaattacatattcactgtgactttaatttatacttaaaactccatggaaattggcagtactaagatatctagatattaaagtgtgattaaaatttaaagttgttaagcattacttatgtggagcatgcagtaattttcatgagacctcccacaccctgcacttttatttttttaccaaaatcttttttaagtttttgttaaaaccaactaagtcgtattgcaaaaagagggatttgaaccatgtttttaaaaatgcaattgtcatttatatcattgtcatcttcatctgattccagtgatgaggttttgctacttggtgaatccctacctggcagctgctaaagtcccacatttaccagccacctagagggcataagacactcactgttctagcagtggttgctcacagggagccaatctggacaaagctgaaatgacgataaatgttaagggattggattatagagagataattaaagtttcattatataaactctaactttcttttggcttttaagatttaacacatttttatctatagatgttgctgggctaatactacacgtgtccagctattctcaagatggcttctgaatttgccataatggaaagatacatttaatgctgcaattttaaagttatagccaaccatttaaagcctttcaggtattactaatattaagtagacattctatttaatgagggtggcttccaactaaaagttggactttaactttgaacttctgctgggtggtcctttgacttacatgacaaatacaaaatgtttctattaacaaggagatcttctctaattgtttgagaagtttgccatgcccggaattgaattatgaagtcttcaagagtgttggtaaagcagttccataaggttcatctgtagaagtctgttgactttaaaacttggtgggaagccttattgtatgtaaagtttaaagattttagaacacaggaatatcttcttacctgagtttatcctatttgcctttgtatagtaggatgtaaaggggctctctaaacctaataaaaattaaatcctcaggctgggcaaggtggcttacatctataaccccagcaccctgggaggccaaggtgggagcattgcttcaggccaggagttggagacctgtttaggcaacatagagaaaccccagaattagtcaggcttggaggctaaaggtgggaggatcccttaagaccaggaggttgaggctgcagtgaactatgattgtgccactgcactccagccttgggccagagtgagacccctgtctcgtaaaaaaaaaaaaaaaawawatatatatatatatatatatatattcagtcttctgacacaatgtaaatagtctaagaatttattgtgcatgggattttggctacttagactgaacctaaaggagtttttgagacagtttaagtctaggatgacagccattcctgtatatctattgattgtataaggagagctaactttcagttggcagttgtctttcaatccgagtggattattattaagagtttgggggcattaatattttaacctttgaggttacattttaaccagataatatgataatatatcttttgtaccttctgaatgatctgcaactctacagggcctcctttgtagtatttttatctgattttataccttttcccatattaaaagaaattatgcaagtatcagttgcaaataaagctgtgtgatagttgcattcactgttgtttatttccccaatagctatgctttatggaggccaggcactgtttatcagctgctaatgtcatttttggtcaaactggaaagatctcagccacagaagacagtaagtttacctttgcatgttttacatagcttttaaaaaaagttttattttgaaattattttaaacttttgaaaagttgcaagaacagaagagctatcatatgcccttctaaatgcaccaatttttagtattttcctcgcttggaatcaaattttatttttctctctgaaccattggagagaaggttacatacattaggctcttttaccctttcatactttagtatatatttcctaagaagaatattttcttacataatcatagatcatttatcaaattcaagaaatgtaacattggccaggcatggtggcccacgcctgtaatgctagattttgggaggccaagatgggaggggccaggagttcaagacaagcctgatcaacatagtgagaccccatctctatgtttttaaagaaattaaaaaaaaaaaagtaacattgatacaattcttttatctacactgcatatttctatttcatcagttgttgccataatattccttctagcatttgtttgccagtactggattatacagttcaagattgcataatgcattcagttgtcacatctcttcaggcatttttcgtctggaattgttcctcagcctttctttccctttcatcacttaatattaagaatataggccagttatttcatagaattactgccagctggggtttgtgtgatgtttccttatgccatgattcagatgatatatttttggttggaatactacatgcataagcgatgttgccaaatacccatctttttaagtatagtgtttcctttagtcttagaaaatcacagttaacatgtgtctttgagtcatttaacaggttttttaataagttcatcattttctttaaaaatagtttatttttaaaaatagtttgattctattnctcactgttgaacagtttccaaccttcttaygatgttttagattttgaaacatcatgtcttccttacaaatggacattctaattgtggatctgaaaaatgcagagactcttaagagctaaaggaatgtacattatcaaagtaaatagttgctttctcccctaatatattaactacattaattatagattagttgaagtctaagaggcacttgtctcaaaaaatgaataaaaactaaattgctgagatattatttaataattcactttatttaaagtaatatcgtgagatattattttgtttttactcttcataatagctgaaaaaatgacagtgaccagtgttttcaaaatgttcttattgagcattctcatatattgktggttggcatatttgttgaaaataatttggctgtatgttgtgaattatttaaaattgtgtaaactcttttactcagtaaattccacttctaggaatctgccctaaggaagaaatccaaaatccagacagatttttgcacaattatactcatgtttcaagtttaaaaaaaatgtgtgtatgtgtataaactttacaaagctttgtgttgacagctgactttgtagattacagcaagaaagctgctctgctatgtatgacactctgacccagaagcaggtcatctgaatagtttagcaccaggttctccacaaccatctgttgtgtgacatagacgtttttgtgatagtaaagaattggaaacaacaaattccaggttagaattagaagaatggttaaataatagaatatctatttaattgtatataatggtgtacttaaaaatgaagctaagagttgataatgatatgagtaaagtgtttgtggtgcgagaaagaaayatgcaaaaataatagtgagtgcttctgggtagtaggatttggggggggatctttcttcccttttccccaagccccctgcttcagtaaagatctgttacttttatagtcaggaaaaagtgatattaaaaaaattacagtacccaatgaaaattacagttgtgaccattaacttaaacaaatcacatgtatattttagctcctgaagctgaaggagaagtgccagagctttatcatcaaagaaagggggaaatagcaaggtgctggatcaaatactgtttgactctcatgcagaatgcccaactctccatgcaggtaatgcagtcagaagctgcctttttctttcttaaatgaggaaattgtaagtaaaaactcatagtggggattgtgctcattggggtcacattgtgtttaatatgaaaggtgtgtagaatgttttcgtaaatatttctttcttggttttaaatcgtattcttcgaattgcttgaatccgggaggcagaggctgcgtgagccgagattggaccactgcactccagcctgggcaacagagcgagactccatctcwaaataaataaataaataaaataaatcttactcatcattcaaggcctatcttaaatactacctcttccttgaagacttttctttggttagaatataagcttcttgagagctgggaacgatatcatattcttttttttttttttttttaracaggctctcgctctgtttcccaggctggagtgtggtggcatgatcatgggtcactgcaaccttggtctccccggctcatgcagtcctcccacctcatccttggagtacaggcgtgtgccaccatatccagttaatttttaaattattttgtagagactggctctcactgtgttgccaaggctggtcttgaactcctgggctcaagtgatcttcctgccttggcctcccaaagtgctgggattacaggtgtgagccactgtgcctaatcttttttttttttttttttttttttttttgagacggagttttgctctgtcgcccgtgctggagtgcagtggtgtgatcgcagctgcaacctctgcttcctgggttcaaaggattctcctgcctcagcctcctgagtagctgggattacaggtgcctgccaccatgcctggctaatttttgtctttttagtgtagatggggtttcaccattttggccaagctggtctcgaactcctgacctcaagtgatccatccatctcggcctcccaaagtgctgggattacaggtgtgagcaaccacacctggccaagcccttactaatctttatatacttcccagtgttatcttacacacagcatggacttgataaaatctaaaagggtagacttttaagaaatagctcatgtaatagttcaaaaatagaagcagaactgatggcagtgaagagcatggactcgaaatacactaggtaggtatgaactccagctctgccgcttcgtagctatgtctttgtggcaatttacttaatatatttttgcctctatttcctcacaagtaagttggagataatagtacttaatactgttgttatgggagttaagtcagtatatattaaggcctcggaaaagtgcctgagacatactaagtccttaataaatgttaactaccatcatcattattaatttatgcccaatcctagtttctaagcactagggaggataataaaattaatcatttagatgcaatatactaagtgtagatacataggaagmtttcctgggggattcattgtgcttttatttttttatattgtgtattaaagtatgataattttttttttttacatgggactctgcttgataaaagtataataatctttagtggttgtattagtctgttctcacactgctataaagaactacttgaggccaggtacagcgcctcatgcctataatcccagcactttgggaggccaaggtgggtggatcacttgagcccatgagtttgagaccagcctagacaacatgttgaaaccctgtctctaccaaaaatacaaaaaattagccaggcatggtggtgtgcacctatagtcccagctactggggaggctgaggcaggagaatcacttgagcccaggaggcagaagttgcagtgagccaagactgcaccactgcactccagcctgggtaacaaaacaaaagaactacctgagactgggtaatttatgaagaaaagaggttaattgactcacagttcctcaggcttaacaggaagcatgactaggagccctcaggaaacttagaatcatggcggaaggcgaaagagaagcaagcatgtcttaccatggcaagcaggagagagagagagggcaaagggggaaatgccacacacttcaaaaccatcagatctcatgagagagctcactcattaccacaagaacagcaaggaggaaatctgcccccagtgatccagtcacctcccaccaggtccctcctccaatttaatgtgagatttggccagggacacaaatccaaaccatatcagtggtaaataatatagaaccttgtgaaactactaaacgaaagaaaaccaaacaaacaaacctcaacacatcagaagcataggtcttgaaaagatgaagataattttagaggtcagagggtaaagaggaggcatattaaggaaagacaggaagtagggagaataactgtggggctttatgtgtagagaatttggagccaggaagagctgtcaagtttattctggtcaggtaaagaaagctggaaaaggagggttgcagggactattggagcaaaacagtaggctaatttaaataagcatcctagagagaacatgtaagtaaacaagcagcccaagaaggaaggaagtatacaagatttagagacttatgatctacatttgaagtaattgtgtcaagcaaatcgcactatgatttgacccttacctttcatttagttgatgtttctagtctgggaacttaaaacttcatcacttggttagtttaaactcacatatttgccatgctactaaactactcagattttccttaaacccagttttgttttttgagatggggtttctgtcacccgggcrggagtgcagtggcatgatctccactcactgcatcctccacctccctggctcaagcagtcctcctacatcagcctgccaagtaactgggacaacaggtgtgtgccactgtgcccggctaattctttgtatttttgttagagacgatgttttaccatgttgcccaggctggtcttgaactcttgagctcaagcgatccacccacgtcggcctcccaaagtgctgggattacaggtgtgagccactgcgctcacccctgactttattttttaaccttaacttcatcctttatcatctgtatatttatctgaaagaccttcttcagttcaagctttaagacatacataaatttattcaattaagtatttatttatgccaaccctgtgctagtcattggccaaggatactatgatgaacaaaaatgaacctagcctttaacttcatgtaaaagtacaattttgctaagttccacaaaggagagacacatgwtatgagaaggcacaataggaggaaataacaagcaagctctggggatgagtaagtaggagttacctagactgaagaaaagaaggcacaccatgtcaaggagctgaagcarcatgtttagaagttctgtggcgtaagggaggatgatatcagaagggatggagcaaaggctgtgaggttggagctgagggagagggagtgtgatataagctaaagttagagttagaaaggggctggagcaatcaaggctttgaagcattgttgtcttcatcttctgagcatttggaaaccttgaagggtttgtggaaagatcattggtgagacagtgtcaagtgaaaagaagaaaaggccttgggatctattatttatttttattggccaagaagagcttaccctatttcttaaccaccttagttattctttctttttttatttgcccccccccacccccaagaggtagaggagataaaactttaactaggaaggtagatttaactctttgttcactttgatgtctttaagagacctagagcatttctgtctgatatatttcactaaataactaatagcataaacatggtagcattaatcttaatggcatccttgtgaaacatttttatgatgtagattacagtctttttgtttgtttgtttgtttcttgagatggagtcttgcactgtcacccaggctggagtgctgtggcgcaatctccacttactgcaacctctgcctcctgggttcaagcgattctcctgcctcagcctctcaagtagctgggattacaggcgcctgccaccatgcctggctaattttttatatttttagtagagacagagtttcactatgttggccaggctggtcttcaactcctgacctcgtgatctgcccgccttggcctcccaaagtgctgggagtaatgtatcacatatatataatgtttcacaattctcaaagtacttttacatgtagcatttatcttattggaaggagtaactgtaaataaatttcagttcctcagaataaatgatatgtaagcagcttgtctatttaaatacttttttttccacatttcttgagtttttaatataatcggaagaaagaaagaagttttcaaaggtgtttaagattatgatacccttctaaaccaggctggaaagtaagagacttctcttctaaaaaactctgaagtttgctttaatattatttaacagcaggaggtgagtgtcctacttaaccataatttatttttttttccttcaggacaacataggagagcttgatcttgataaacartctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcycgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctamattccccccacccaaaatctttcccttttgaaaatactaaaaactaagttatgttattataaagtgtaaaatggtttgtcttaattataggagaaaaaggccttgttagaaataaaataaactgacttatttcactaatgaaaacttctgtttcctttttgttttcttgtgagcactgatacctcaatacattgatacctcaatacctttgaggtattttttgatacctcaaagatactagcttatttgaagctagagaagaatatttcttcaataacattgcacagttagaaaacattaaaatatcattcatgggccaggcaccgtgtctcatgcctgtaatcccggcactttgggaggctgaggcaggcggatcacaaggtcaggagatcgagaccatcctggctaacacggtgaaaccccgtctctactaaaaatacaaaaaattagccgggcgtggccgcgtgcgcctgtagtcccagctacttgggaggctgaggcaggagaatggcgtgaacccaggaggcagagcttgcagtgagccgagattgtggcactgcactccagcctgggtgacagagcgagactctgtctcaaaaaaaaaatatcattcatggctgagtgtggtggcttatgcctgtaatcccagcactttgggaggctgaggtaggaggatcacttgaggccaggagttcgagaccagcctgggcaacatagtgagacccccatctctacaaaacatacaaaaattagctggggcatggtgccacctgtctgtaatcccagctacttgggaggctaaggtgggacgattgcttaagcccaggaggccaaggctgtagtgaaccataattgccactacagcctgggtgacagtgagaccctgtctcaaaataaaataaaatattcacttagtgaatatttattgagctactactgtgtcccaggaaacctcactgactgatttctcatcagaggatcctggcatgtttataaacttttaagcactgttgagaaaggatatatacgtcataattaaacctcgttaatatgtgttagtcatgttaagaaatgcaggaatggagttcctatccggtgtattgtcaagatcagtcgtaacatttaatatagagaatagctctgtgctttagcctgcctgttactttgcttctcaaagcctaggtctggtcaacactaagatcctgtaacatttatgtaaaaacacacacacacacatgtgaaaatcaccttgctttccctttgagatcaattttccaggaagaaaaatctttgagtataacagtcagaaatgtgtaattcactcaatatttaactgatgtttattcaagtctttactaaggtcaggccctgctctcactcttctaatcatagaggatatggtgataaacaggataaacaaggacctgttctcacagagtgaataaacaactaagaaagataatttcgggccataaatgctgttaagaaaggaaaactgaaatggtaagctttttttttttttttttgagacggagtctcactctctcgcccagactggagtgcagtgccgtgatctcagctcgctgcaacttctgcctcccggattcaagcgattctcctgcctcagccccctgagtagctgggattacaggcgcacaacaccacacctggctgattttttgtatctttagtagaggcggggtttcaccatgttggccaggctggtcttgaacttctgacctcaagtgatccacctgcctcggcttcccaaagtgctgggattacaggtgtgagccaccacacccagcctgaaatggtaaacttttaatggaaggggtgctgtcttagctgtggtgatctggaaaggtctttgagaaggtgggaggtgacaccgagctgagaatgaaatgggggaagaaagcagccaagtcatctttaggtagggtgttcccgggaagccaggctggaacaagctcaggaaggagtttggcatgagaaagaccagtgtggctggagcagataagggtgaggagtgggggcagcagtggggagtccagatggagagggctttgtagatcagggtaaggagtttggattttattcgaggtgcagtgggaaacttcatggaattttaaaaagggaagcagcatgatctgattggaatttcttttttattttattttattttatttttttttttgagacagagtttcgctctgtggcccaggctggagagcagtggcacgatctcggctcactgcaagcgccacctcctgggttcacgccattctcctgcctcagcctcccgagtagctgggactacaggtgcctgccgccacaccaggctaattttttccatgttagccaggatggtcttgatctcctgaccttgtgatccggccgccttggcctcccaaagtgctgggattacaggcgtgagccaccgtgcccagccaatctgattggaatttttaagaaactactctggctcttagggcaaggaagggggaagggacagtcaagaaccagaggaagaagagagacaagtgagatcctgttaagattaatccaagtgagagatgaaagtggtttggaataggatgagggagtagagatagagaaaagtggataaattctggatgtgttttgaacacgctagaaggtaaagtgtagagcatgaggggaaaagaagaaccatgttaagttgaggaagtatggatgcaaagcatgtttttatgggggatacgtggatttagaattaagaattttgtttaggtcatgttgagtttaggatgttaagcttgagatgaaatgattgctatttaataatatctgcccatcagactttaaaaggaaagcgaggaggatcaagaggaggcaaagaagggagggaagtttcttgaggatagtgatatatggcacttcagctctcttgagaactgattctaagacaaatccccctgttaaaagccttccttcatgtagccattttcctctcaaccttaatcaacttcataacttcatttatatatccattcatttatttaagaagtacttagctctttttttccccacaagtatatccaatgtgtatctttatttgtaatggaagataaaaaatattggggagtaaaaaacaggtctgggccgggcacggtggctcatgcccataatcccagcactttgggaggctgaggtgggtgggtcacctgaggtcaggagtttgagaccagcctgaccaacatggtgaaacctcacctctactaaaaatacaaaaaaaaattggccaggcctgatggcaagcacccgtagtcccagctactcaggaggctgaggcaggagaatcgcttgaaccagggaggcggaggttgcagtgagccgagattgcatcagtgcactccagcctggtgacagagtgagaccctgtctcaaaacaaaacaacaacaacaacaaaaaaaaaacaggtcttatattaagggggataaagatagctatatcaatacaatggaatattatatagatttgtacatattacagcatacaagtacaagtaattataaaatgtaaaagcatggaaaatgcatggctaaatgtcaagaggatagcaacatattaatttatagatatacatttaacatctaatttcaacaattaaaaatgtatatttagcagggggtggtcatgtgcatctgtagccccagctactcaggaagctgaggtgggaggatcacctgagcctgggaggttgaagctgcagtgagccggccgggcacggtgtctcacgcctgtaatcccagcactttgggaggccgaggcgggcagaggtcaggagatcaagaccatcctggtcaacatggtgaaaccccgtctctactaaaaatacaaaaattagctgggcgtggtggtgcacacttgtaatcccagctacttgggaggctgaagcaggaaaatcacttgaacctgggaggcgaaggttgcagggaggcgaaggttgcagtgagccgagatcgcgccactgcactccagcctgagcaacagagtgagtctccatctcaaaaaaaaaaaaaaaaaaaaagctgcagtgagccatgattgcaccactgtacgttagcctgggtgataaagtgagaccatgtctctcaataaataaataaatatttaaaaatataaaaatgtaaggccgggcgtggtggctcaaacctataatcccagcactttgggagaccgagtcaggcggatcatcgaggtcaggagttcgagaccagtctggccaacatggtgaaacctcgtctctactaaaagtacaaaaattagtcaggcatggccgggcgcggtggctcacgcctataatcccagcactttgggaggccgaggcaggtagatcacgagggcaggagatcgagaccatcctggctaatacggtgaaaccccgtctctactaaaaatacaaaaaattagccgggcgtggtggccggcgcctgtagtcccagctactcgggaggctgaggcaggagaatggtgtgaacccaggaggcggagtttgcagtgagccgagatcgcgccactgcattccagcctgggtgatagagcgagactctgtctcaaaaaaaaaaaaaaattagtcagacatggtggtgcatgcctgttgttccagctacttaggaggctgaggcaggagactcgcttgaacctgggagatggagactgcagtgagccaagatcgtgccactgcactccagcctgggcgacagcaaaacactgtctcaaaaataaataaataaaataaaataaaaataaataaaaatgtatacttagtcagaggtggtgtcatgtgcctgtggtcccagctactcaggaggccgagacaggaggattgcttgagcccaggatttgaggtcagcctgggcaacacagtgagatcctatctctttaaaaaaaaaaaagatatacctgttagtggaaatgtaaaaaaaatggaaatagtcatattgtaatggaattataaactttgtttttaagatggaattttgctctgtcgcccaggctggagggcagtggcatgatctgggctcactgcaacctccgcctcctgggttcaagtgattcttgtgcctcagcctcccaagtagctgggactacaggcatgtgccaccgtgcctggctaatttttgtatttttagtagagacaaggtttcaccatattggccaggctgatctcgaactcatgacctcaggcaatctgcctgccttggcctcccaaagtgctgggattacaggtgtgagccattgcgcccggccacaattaaaagcattttgttattatttccttaatattgtgatctttatctttccaatgaacatttgaaaattctcagacaacacactaggttttcattagaggtttttttaccgagcactttttgtgtgctaggtaccttgaggacatgatctctaagccactgtctcttaaaccttagcttttattcttcttgactgtgttattcaacttgaattcaaaagataacattcaatcggctgggcgcagtggcttacgtctaatcctggcactttgggaggccgaggcgggtggattgcctgagctcaggagtttgagaccagcctgggcaacacagtgaaaccctgtctctactaaaatacaaaaaattagctgggcatggtggcacgcgcctgtaatcccatctactcgggaggctgaggcagaagaattgctagaacccgggaggcagaggttgcagtgagccgagatcgcgccactgcactccagccagggcgacggagtgagactccatctcttaaagaaagaaacaaaaaagataaaattcagaccgccaagactacatctgccccacctgcacagagcctcgccctcgccactccacagccggtccgcatgtgccgccagctcaccagggtgatatcactgggctccagcaagggcaaggccagcttcgcaggtgacgatgccccgtaggccgccttcccctccatcttggggcgcccgcgacaccagggcatgatggtgggcatgggccagaaggactccaatgtgggcgatgaggcccagagcaagagaggcatcctgaccctgaagtaccccatctagcacggcatggtcatctactg

SEQ ID NO: 10817 - DNA, 33624 bp, Homo sapiens
  misc_feature (1)...(33624): n = A,T,C or G, or insertion/deletion polymorphism (see Tables 1-2)
tcatcagagaaatgcacatcaaaactacgagatatcaactcaccccagttaaaatagcttttatccaaaatgcagtcaataatgaatgctggcgaagatatggagaaaggagaattctcatacaccgttggtaggaatgtaaattagtacagccactatggagaacaggatgaaggttccccaaaaaactaaaaataggactatcatcttaatataatccagcaatcctactgctgggtattaacccaaaagaaaacaaatcagtacatcaaagagatatctggccaggcatggtggctcatgcctgtaatcctagcactttgggaggccgaggctggtggatcacttgagggcaggagtttgagaccagcctgggcaacatggcgaaaccctgtctctactaaaaatacaaaaattggcagggcgcggtggctcacgcctgtaatcccagcactttgggaggccgaggcgggtggatcacgaggtcaagagatcgagactatcctggctaacatggtgaaacaccgtctatactaaaaatacaaaaaattagccgggcgcggtggcaggcgcctgtagtcccagctactcgctactcgggaggctgaggcaggagaatggcgtgaacccgggaggcggagcttgcagtgagctgagatcgcgccactgctctccagcctgggcgacagagcgagactccgtctcagaaaaaaaaaaaaaattagccgggtttggtggcgggtgcctgtgttcccagctcctggggaggctgaggctggatcacttgagcctgggaggttgaggctgcagtaagccgtgactgcgccattgcactccagcctgggcgacagagggagactttgtctttttttgtttgtttgtttgagacagagtctccctctatcgcccaggatggagtgcaagtggcgcgatctcggctcactgatacnnnnnnnnnnnnnnnnnnnngtcaaattccacatataagtaaactaagaaccaaaaagaataattgggcttagtagtttacaaatttggtcacctttgccaaagcagtttcaggagacaagatgaggacagaaacctgactacagcaggttcaagaataaagagataaacagtcaggaaacatactctattctttcaaacaaaccctatttaaaaaaaaaaaaagtaacttgagacaacatagacgtaatcttgtttttttgttttttgtttgagatagagtctccctctgtcacccacccaggcaggagtgaagtagtgcaaacacagctcaccgcagcctcgacctcctgggctaaagcaaccctcccgcctcagcctccggagtagctgggattacaggcacgcgccaccatacctagctaatttttgtatttttagtagagacagggtttctccatattggccaggctggtcttgaactcctgacctcgtgatccacccgcctcgacctcccaaagtgctaggattacggtcgtgagccaccgcgcccggccaagatcctgtcttaaaaaaaaaaaaatcccacaaaaaacaaaatcctgtttccatgagcagttactcctcattatctttgaacactatcctcatccccatccctaggcactttttgtcttacagatttgcctattctgaatatttcacataagtgcaatcacaaccctaggtatatttcatataaattgcccccattcctaggcagccactaatctgctttctgtctctatagatttgcctgttatgaacatttcgtaggaatacaatatgtactcttttgtgactggattatttcacttagcataatgttttcaagctttatccatattgtagtatatataattcctctttgttgccagaaatatgtcattgcatggttggatatgccacattttgcttctccatttatcagttgatagtcacttgggttgtttgtactttttttgaatattgtgaataatgcttcacaaaaattaatttacaagtttttgtggacatttgttttcaattctcttgggaatataaatccaggagttaaattgctgggtcatttggtaactctatatttaactttacgaggaaccaccaaactgttttcaaaagcggcagcaccatttacaattttaccagctgtgtatgaggattccaattccaccacatcctcaccactccttgtcattatctgcattttgattgtagctatcctattgggtataaaatgatatctcattatgattttgatttgcatttcccatgcaaatcttttcatgtgcttatgggtcatttttctatcttccttgaagacgtatctattcagattctttgctcattttaaaatttggttgtttatctttttattactgtgttatttaagtgttctttatatattccagatagaagtcccttatcagatacatgtcttgcaataatttttcccaattctgtgagttatctttctatattcttcatgatattgtttgtagcacaaaagttcttaaaattttgatgtcttattttttcctttgttgcttatgcaaaaaaagccagatgagattttaatagaaattgcattgaatctgtagatcaatttggggaatatgccattttaaccaaattaggccttccaatttatgaacatgggattctttcaatccttccaatattttccaatatttatgttcaacttctctacctcacacccagtcagagatacaatccaggtctatagtatggtggtcaaaagtacagattctttcttaagacagatttagtttaatatcccaacacttctactgattagctgtgtaaatatggacaaattacttttcttttttttttttttgagatggagtttcactctgttgcccaggctggaatgtagtcgctcaatcttggctcactgcaacctccacctcctgggttcaagcgattctcttgtctcagcctcccgagtagctggggctacaagagcacgccaccacacttggctcatttttgtatttttagtagagacggggtttcacgatattggccaggctggtctcaaactcctgaccttgtgatccacccgccttggcctcccaaagtgctgggattacaggtgtgagccaccgcgcctcccctacttaatttttctaagcctatgttttctcatctgtaacgtgcaatttttttttttttagacagggtgtctctgtcaccaagctggatggagtgcagcatcatgatctcggctcactcctgggctcaagcagtcctcctatctcagcctcctgagtagctgggaccgcaggtgcatgccaccatgcccagctaattttcgtattttttgtagagatggtgttttgtcatgttgctcaggctggtttcttgaactcctgaactcaagcaatcttcccacctcagtccccaaagtgctgggattacaggcgtgtgccaccacacgtagcctaaagtacaaattttaatacagatttcataggatgtgaggattaatgacaaatatgtgggacacttagcatagtgcctggaacacagcaaatgctcagtctgagctatttttattattatagcacttaacaattactacaaaaagttattttgactttttaaattattagagccccaatttccccctaagcatccttagaatccattgactttatatcttgtttccctacaattttctgtgtcttccttaaggataatgaaccaatctgattttttttttttttttttcagacaatgtctcgctctgtcacccaggctggagtgcagtggcgcaatctcagctcactgcaacctctgcctctcgggttcaagcgattcttgtgccttagcctcccaagtagctgggactacaggtatgtgacaccagacctggcttaattttgtatttttagtagggtttcaccatgttggccaggctggtctaaaactcctgacctcaaatgatgtgcccacctcgggctcccaaagtgctgggattacaggcatgagccaccatgcccggcctactctgatctcatctctgatcaccatgctctttcctagcctttcctcaaacggcacactcccaccccagggcctttgcatatgcttattttgctctgtctacaaatctctttccatagatataaatttggtttcttcatcaccttcttcagggtctttgtttaaatattatcttaacaatgaggctgaccatcctatataaaatagcaaaataatccctctacttatcttgctttatttttcttcttaagctttataaccacgacacattgtatatttactcgtttgtttccccttctagaatgtaagttacatgaggacagagattttcatgttttgttccctgctgtatcctatccctataacagtcctaggcacattgggtactcattaaatacatgttgaatgagtggacttcttctcttggctgggtgcggtggctcacgcctgtaatcccagcactttggaaggctgaggcgagtggatcacttgaggtcagaagtttaagacagcctggtcaacatggcgaaaccctggctttactaaaaatacaaaaattagccaggcatggtggtgtgcacctgttatcccagctgctcgggaggctgaagcaggagaatcacttgactccggaggaggaggtttcagtaagccaagattgtacgtaccactgctctccaacctgagcgacagagcaactccatctcaaaaaaaaaaaaagtgtcttctctcataggcaagtaacttcagtagtaaaacgagaagagagcagcaccaaagtagctctgctgagaggtgaagccagctggacttcctgggtggagtggggacttggtgaacttttctgtctagttagagaattgtaaatgcaccaatcagcacactgtaaaaatgcaccaatcagcactctgtgtccagctaaaggattgtaaacacaccaatcagcactctgtaaaaatgcaccaatcagcgctctgtgtctaggtaaaggattgtaaacgcaccaatcagcactctgtttccagctaaaggattgtaaacacaccaatcagcactctgtaaaaatgcaccaatcagtgctctgtgtctagctaaaggattgtaaacacaccaatcagcactctgtgtctagctaaaggattgtaaatgcaccaatcagcactgtgtctagctaaaggattgtaaacgcaccaatcagcactctgtaaaaacgcaccaatcagcactctgtgtctagctaaaggattgtaaatgcacaaatcagcactctgtcaaatggaccaatcagcactccataaaatggaccaatcagtgctctgtaaaatggaccattcagcaggatgtgggcagggacaaataagggaataaaagctggcacccccaacagcagcggcaacctactcgggtccccttccacgctgtggaagctttgttctctcgctcttcacaataaatcttgctgctgctcactctttgggttcgtgccacctttaagagctataacactcaccgaaagctccacggcttcattcttgaagtcagcaagaccaagaacccactggaaggaaccaactccggacacacttctaggagactacttccagtcaaatggaatgcgcttcctctgatcaagaaatgaatcctaccataagttcaaacatatctatacatacctatacagagtcccatccttttaaattggaagaacttcatgaaattttagagctagttctaaagtgtgcagagagagaactagagatatactaaggttaaaaggtatttgattcccacccctgcttcatcctctccccagcctcataatatatgccttctgtgtatgagggtggacttaatgactttatctttttttaattaaaaaatggatctaatactaacctactttctccaaggatacagtagttctcttggtaataagatcttagatgttcatgcttttgacaatcatggttaacttgcagctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagtgagtacagtgaaacagaaacctgctcagcttctaagtgcaggaaggacttcacagggaggcatgatcagaacttgaaaaaaggtcgtggtcacagcattttaacattttagcttaatctcttcctttttgcagaaaccagggatataaccatagttttgcctcataactgtggagctacatcagtaaccacagctcatcattttctgatacttttttggagagtcatttaaaaatggaacttgccaacctctcacattgtgccttaatttttatttttttttaaaggagggaaaattattttttagaaagcaaactataaagcaggtcagtgagaccttcaaagctgtattcccgtggttcctcagttttccatatttccctgtcccatggaggtccacagtcgtggagaaacggactctaaacacaggcgaagtatcacttggtcgcccaggctggagtgcagtgacacgatctccactcactgcaagctccgcctcctgggttcatgccattctcctgcctcatactccctagtagctgggactacaggcgcccgccaccacgcccagccacttttttttgtatttttaacagagacggggtttcaccgtgttagccaggatggtctcgatctcctgacctcgtgatccgcccacctcggcctcccaaagtgctgggattacagacgtgagccaccgcgcccggcctaaaaaaaggtctcttaaatactagggaacctggcctcttcacggtggaagtaaccactagattcaagatgggctttttttgttttgtcttgttttgttttgtttttttgttttgagacggagtctcgctctgtcgcccaggctggagtgcagtggcgcgatctcggctcactacaagatgggcttttttgtcacgctgtagtactttataatctttcttctggaaagatgaacaggataagaaacgtgtgaatcatttgtgttggggagttcaaagaaactcttaatgttaaagcaccttgcctcatcatttagtagttgggtaagactgctattacctttcatctctatcaaacattgtacttttaaaaacataaatagctctgtgaccatcagctcatgagtcagcagccatgataatctacaactggctaaggttaatttagtagcagaaactaggcaaaacatcaggcagcagttcccaaggtccaagaaactcaccaaatgaattccctttggctcatggaatatggtgaggtgttttggggaacagtggcatggaggtagcctcattaaccagttagtctcaggaactactattttattaggcttttcttttgtcttaaaaggaataagtacacatggctaatttttttttcagtacagaaaaatgaacaaaataaaaattacaggcacctttttcaatatttgtcttcatcccactcccccaaattagtcactctttaatagtttggtatgtatacttctagtcatttgaaaaatataaataaggccgggggcagtggctcttgcctgtaatcccagcactttgggagacccaggcaggcagatcacctgagaacaggagttcgagaccagcctgaccaacatggagaaaccccatctctactaaaaaaaatacaaaattagctaggcgtggtggcgtatgcctgtaatcccaactactcgagargctgaggcaggagaatcgcttgaacccgggaggtggaggttgcggtgagccgagattgcgccattgcactccagcccgggcaacaagagcgaaactccgtctcaaaaaaaaatagaaagaaaaatataattaaatacatataatttatgtatattggtatgtctgtgtccttttttttataaataattaggtcatgttaaccaactgttacctgtttttttctccagctttattaaggtataatattaaggtattaaagtataatatatactttttgacaaaaaaagtatatatttatagtttacaatgtgatgttttgatacaggtatacattgtgaaatgattaaatctagcaaattaatatattcatcacctcacattttttgtgtgtgttgagaatatttaatatctactttcttagtaatttccaagtatataatatattatgaactatagttaccatacaacacaatagatatccagaatttattcatcctaactgaaactttgtacactttgactagtatcacctccaattcctccttgctttttttgtttacttaataatgtgttctaagtctctctccctgttactatatatatatatttttttcactgttatattattttctatttgttctttttcttttttttaagacgacgttttgctcttgttgcccaggctggagtgcaatggcacgatctctgctcactgcaacctctgcctcctaggttcaagcgattctcctgcctcagcctcccaagtaggcaggattacaagcgtgtgccaccacgcccagctaattttgtatttttagtagagatggggtttctccatgttggtgaggctggtctcgaactcctgacctcgggtgatccgcccgcctcggcctcccaaagtgctgggattacaggcgtgagccaccgcacccagcccttctatttgttcttaagtcgcgtattaatccattttatcataattttcagttaacgttcttgtacatatcctttccttcctagggtaaattcctaaacatggaattgctgaggaaaaagagaggcttattatttgacactttaatagatatttccaaatcaacctgtaaaaatatcataccagtttacattctgagtggtgtatgagccagaaataatgactttaaatacattttttatagtatatcacactagttttggggttattaaagtaggaataatacttttaataatctcctagagtgctttgcaacccacatattgcatactgccttctgtgaaagctggctatatatttgttttctctctcctgctagagttccttgagggcagggattttcatcttttacatttttgtgttctttaagggaccctgaataaagtcagtactcaataaatactttgttgaatgtcatttgctaaatatattttacccatggctaggacatagattgtagccaaaactgtccaagaattcatcatcagtgattcataattatgcaaccaagaagtaggactaaattttagatgttcctcggtcatttagtgtcaaagctggctttcctcagacacagtgaaaagggtggttggttatttaactgtaatgaattcttgactttttttactgccaatgtgagaggtacttttcatggggaataaaatactgatatacaatttaaagggaccatcttggccagaatggattatttagttacagattttttttctttcccaatgagcaacaaaaaaatagaaaatatcttggatccatgtgaatttgcatagctgccttctgaaaaaatttcctaatgttgtgactttatatattcttatctacaggattccttctacttcattcttactctaagtgggtagaacaggtttcagttttctagatcatgaaagaagtactgaaatgttgagatcccatagctacttaggggtagaaatgcaatttagaaacaagatcacctgactcctattgagtttgtctttccttaatattacagagtgatcccattctggcttaaagtataaccctcttggcaattcattactttaaatttcatattatgactttttttaaaactccttttttttttttttaaggacctgacaatgtccctgtattgtggaatagcttgcaggagaaaatttttttggtgctataggctgctgtcaacctatgttactaagacacggtgagttttagccaacctgagctttgattattctgtttggcccattaaactattgtgatattatgattttatatatatatttaggtttatgattattatatatacattatatattactatatttgtgtgtgtgtatatgtgtgtgtgtgtatatatatatattcatatatatatatattcatccatggtttctggctcataactcctatggcccttattacagtcttttgytataatgtggggcactttagacctcaggggcaggcctcaggaaacaaaatctcttttaccttctcctgtcctccttttacctgcccatggcaggactctaatctgattgcgggtccaaagaccctcattccagagagggttgtgccccatactccggaggaaggaaggctgcacagagaggccaaggagaacctgaacagacaggcattgctgggtttccggtcagtctattattatkaaatcataaccattttgtccaatcagatttctacatggttgtcaatcatgcctatgtaatgaagccaccataaaaacccaaaaggacagggttcagagagcctctggatagctgaacacatggaagttcctggagggtggtgcacccagggagtcatggaagctctgcaccctccccccacatacctgacctaaatgcatctcttcatttgtatccttcgtaatatcctatataataaaccagtaaacatcaaaaaatatatatttttacttttttagagatggagtctcactctgtcactcaggctgaagtgcagtggtacaatcttggctcactgaagccttgatctcctggggtcaagcgatcctcccacctcaaacccccaagtagctgggactacaggcatatgccaccatgcctggctaayttttatatttttgtgtagagacagggttttgccatgttgtccatgctggtctgaactgagctctggcaatccacctgccttgacctcccaaagtgttgggattacaggcgyaagtcaccaaacctggccgaaaaattttaaacaaactaaatatccaataatatctaaaatatctcacacacttgaatataagttctattaagatcagactttgtctttccactgtggtacccctacttcataaaacagtgcctggcacatggtaggcactaaagtactgttgaatgaatgaacagtaagggagaaattaagtaaattaaggtactataatagaataataaacatgttaaaattatattgttctattcctgtcacttcagatgaaaaaaactgtattgaataatatttcatgaagtttcctataaataaagtagataaccccacccccttcccccaagaactaaacttcagtgaaaggtagagtaggaaaacaaaatctacaatagcacatgaagatgataaagacttttttgtcttagcctagggaaattagaaatctgtgaatttgaaatcactagcctgctttcatacagttttgggggttaaatttataccatctatgtggtgtggttctagaacccttaacctaagaaataatttttttttcttttttttctttttgagacaggatcttgctctgtcacacaggctggagtgcagtgctatgatcatagctcactgcagcctcaacctcccaggctgaatcaattctcccaccaagtagctaggatcacatgcgtagctacttgtacaccaccatgcctggctaatttttttttattgtttgtaaggtagggtcttgctatgttgcccaggctggtctcaaactcctgggctcaagcaatcctcctgcctttacctcccaaagtgctgggattataggcatgagccaccatgcccagcctaagaaatgaatttaagtagtaatcttggactgaaaatacccctggggcaccatgtgaatacaaatataaaactccttaggaagtacacactcacaaccagtgattccaatatataaagccctatcaagctccaaaatttagaggcatataaaggctgggtgcagtggctcatgcctgtaatcccagcactttgggaagccaaggcgggcagatcactcgaggtcaggagttcgagaccagcttggccggcatggtgaagccgtctctactaaaaatacaaaaattagccaggaatggtggcgtgcacctgtagtcacagctactcaggaggctgaggtgggagagtcgcttgaacctgggaggtggaagttgcaataagccgagatcgtgtcattgcactctagcctgcatgatagagtgagaccctgtctcaaagaaaaaaaattagaagcacataagcatataatcctacatgaacaagagtgaacaaacaacaaaattgtgatacttgtttcagatattgttggacatttagattgcgtgtactcctttaacagactacaagaatttttttttttttttttttttttttttttgagatggagtcttgctctgttgccaggctggactgcagtggtgtgatctcagctcactgcaacctccacctcatgggttcaagtgattctcctgcctcagcctcctgagtagctgggactaaggcacacgccaccacgcccagctaatttttgtatttttagttgatatggggtttcaccatgttggccaggatggtctggatctcttgaccttgtgatccacccacctcgacctcccaaagtgctgggattacaggagtacgccaccacgcctggccaagaatattaacataattattaaatagagtgtcttcaccacggggcggaaggatccgcgctggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaatactatccttattaaataggttaagtataggtttcatcaatgctccctttgttttctttttttttgagatggagtctcgctctgtcatccaggctggagtgcagtggcgtgatctctgcttactgcaaccttcgcctcccaggttcaagcgattcttcggcctcagcctcctgagtagctgggactacaggtgcgtgccaccatgcccagctaatttttgtatttttagtagagacagggtttcaccatattggccaggctggtctcgaactcctgacctcgtgatccacctgcctcagcctcccaaagtgctgggattacaggcgtgagctaccacgcccggccaggtgctccctttgctagagataaggagttaatggtatctactttgggatctagatgtctgaagtaagggtacattgaaggtaaaatttgttctttatcttccctagattgaatgagggtcactgaagatacagtgtttactctttgtctgctgtgaaaaagtctgttcccatctctaggtattttgtggttgatgttttatcactgtacttgttttcctttcactccactgcatgtaaattcttgcctcacagtgtaatattggcagagtancttgaagttcaattcagtaaatatttattacccttgaagttcaattcaataaatatttattgaatcgagccattcaatatgctaactacagagatacagagctgagtaaagcataccttccccttaaggagatcatagtctctcagaggagacagacaaatgaacaaataaaccaatagtgcaaccacagaagtatgggtgaggtacacagtaagacaaaggagggaatgaatgattatctatagccacctcaaaccctttttggygcaaattaggttgtaaataaataaagggaaataaccatggtaagagagggatgcagcgacagcattctcaaagatgaatgctatacaggtaactaagggtggttttgtaatggtttgattatttcccaaatacaggtatttatttgaactgaaggaagatgatgatgcatgtaaaaaagcccagcaaacaggagcgttttacctctttcatagtctggctcctctgcttcagacttcagcacatcaatacctggccccccggcacagcctgttaggtaagtccagagtggaccagtggcgttgaccagcctgtggccactacgcagaattcagcccataatgaattctaagaaagatccttgaactttggagtctagatttttcagaaagcttttgagtctcatgcttgtataactgcttctgccaactaataatttattgtatgaactctagttgtccagtcaaatattatttggtgatgaaatgaaccactaatgccttaaaccaggggttggtaaaactgctgtccaaattgtatctgctacctgttttgtaaattaatttttattggaacatagacgtactcattcattgacatattgtctatggctacttttgcactacaatgcagagttgtgacagagactgtatgactcacaaagcctaaaatatttagtatctctttccagaaaaagtttgccattctttgccttagagcagtgaattccagcctccacagaggtacacagttatgctaattcagagttccatcatggccaggcgcggtggctcacgcctgtaatcccagcactttgggaggccgaggagggcagatcacgaggtcaagagatcaagaccaacctggctaacacggtgaaacccgtctctactaaaaatacaaaaaaattagccgggcgtggtggcgggtgcctgtagtcccagctactcgggaggctgaggtaggagaatggcgtcaacccgggaggcggagcttgcagtgagccgagatcacrgcactgcaccccagtgtgggtgacagagcgagactccatctcaaaaaaaaaaaaaaaagttccatcataacttcatttttactagaagggtcaagattaaaagtgaattaaaatgaatttgcttttagaacccttttagcatatttaactaaagatatctaagccattggggtttgtcattcaaaatgcaaactttggctgggttgggtggctcatgcctgtaatcccagcactttgggaggctgaggtgggtggattgcttgagcccaggagttcaaaaccagcctgggcaacatagtgagaccccgtctctacccaagaacaaaaaattagtcgagccttgtggtgtctcaaagacagaaaacaaaatgtgaactttcagttttatatgagtcactatatactaacttccgtattgccagtgaatttctcccataggtcagaagttggagtacttggataagtagtttctagcactgcagaagaatctgaggactccatcagaaggcactaaacattatttagagatttagcaatgtttatgttgtattacggtttttgtgtgtgttatgttgtattatgaacaaataaatatgagtccttcatgaacaagtgtataggatttctccctacacatcactcatctcttagagattggcatctcagatgagtattttactctcgtccacaaaagtagcacattctggaggttaattatagaactggattggtctttacctgcagccttgaactccttggctcaagagatcctcccatctctgcctcccaagtttttgggactacaggtgtgcacttcactgcacccagctgattttattttttgtagagacagggtctttgctgtgttgcccaggctggtcccaaactcctggcctcaagtgatcctccctgccccccagccttggtctgtaccattttaagtgtgatacttatttttttttcaatgacttaataagttaactatcatgcatcttactaactaggggatattttcctttcatgatacagtcatagagtaatacaatgttatacaagaattccttctttggtctaaagtcctcagactgctaatgagaaaacaggcctggagaggttaaatggttagaccaaggttacatagctaattagctgcagttggaagccaagtatacccactttaagctgaagtagatgattttctgtgagtctaatatggctgtagtgatttaatagaaacccttgtgttttgcttttctcccttcccctttctgtttcttagagttggaaaggctcctggrtaaatttggacaggatgcacaaagaatagaagattctgtgctgattggatgctctgagcagcaggaagcatggtttgctctggatctaggtctggatagctccttttccataagtggtacatgacattattcctaacgggtacttcccagtggtcttcagaatttgggatttcacataatggtaaaatttaaaggaaaatttggggaatacaaaaggttatcamctttctattttttaaaaaaggacattaaaaagtgtcatctgctatcatcatcatttaaatgacaataaaggacattttaatgccttctaagttaggtgatgggtacatgaatatttatggtattagtctctgtaccattatacattttatttatttattttatcttattttattgagacaatgtcttgctgtcacccaggctggagtgcagtggtacaatcacagctcactgcagccttgacctcctgggctcaagtgaccctcccacctcagcctcctgagtagctgggaccatgggcatgtactaccatgcccagctaatttttaatttttttttttttttaatagagatgggggtctccttatgttgcccaggctggtctcaaactcctgggcacaagcaatcctccctccttggcctcccaaagtgctaagattataggtatgagccaccacacctggcctatacattttgtatatttctttttttttttttttttgaggcaragtttcactcttgttgcccaggctggagtgcaatggcgcgatctcggctcgccacaaccttcgcctcccaggttcaagcgattctcctgcctcagcctccctattagctgggattacaggcacgtgccaccatgcccggctagttttgtatttttagtagagacggggtttctccatgttggtcaggctggtctcgaactcctgacctcaggtgatccgcctgcctcagcctcccaaagtgctgggattacaggcatgagccaccaagcccggtcacattttgtwtatttcagtatttcataagaaatgttaaaaaacttataacatcattctaatttcttttttgaatacaggtgaataaaaatgtttccatatagctctgggtccacagacctgccattgggaaccactttgctattggctcatggctcctgtcaggctttccttctgtctttaatggtctaggtgtaaatgtagtgatgctgggatgaggttcacataggagccatgaggtcccacttcatctcttttccacggataagctaatgcaaatgttcttgccccgaagaagatcttgagaaatactatgtgctaatgtttcccaaactggcctgaatgtaagaatcacctggtgcttgttaaaacaaaaatagagattgctgggcctcactccatgccagctgctttagaatctccaggtaggggcttgagaatcttgctttttaaaaaaattttatgtatatatttatttattttgagatggagttttgctgtcacccaggctggagtgcaatggtgcgatcggttcactgcaacctctgcctcctgggttcaggcgattctcctgcctcagcctcctgagtagctgggattacaggcgcccaccaccaagcccagctaatttttgtgtttttaatacagacagggtttcaccatgttggccaggctggtctcgaactcctgacctcaagtgattcacccgcctcggcctcccaaagtgccgtacctggccttttttaaattttagagatggggtctcactggagtgcagtggctattcacaggtaagatcatagcgcactgtatgtagcctggaactcctaatggcctcaagccatcctcctgcctcagtctcctgagtagctgggactacaggcacacgccccccacacctagctgaatcttacgaggcaagtttgggaaacactattttaacaggatagactggagagaggccctgaggcaaagtttgtcattgtttaatttcattatcttttctaattttctagcctccttacacaaacctgaaatggagacagagctcaaggggtctttcattgagctgagaaaggcactctttcaactcaatgcaagggatgcctccttgctgtccacggtagattctgatttctcattctgtaggaaatttagtagagcagtaagtgtgggcaaatccatgtgtacacacaaggctagagtgacgtttgatttcttcttttgcagattatagtcctttctacaaacactggcaggacantgtgctgtagggagattgcttattcttccttcttctgcccttgtttttggcagaaccactgtcaagatcattgtctcctaaagacatgcagatctatggcaataggatctgtcagcctcataaacatttttaatgacccacatagcatgacatatacagtatcatgttttccctaagagaaattactttacattgctttaatgacttgccctcacagctttagatttcacttgctaaagtattttgattgtgcatttaatttaaaaagaaacctctaaacatttttttagttgcaaaaaattccaactttaccagggagaagaacattttggggtgttcaactgtactgggaatgttttatttttaagctggttagtgaatacatgggtgttcattttattacctcatatacttcatatgttttaaataataatacatttaaaaatatgctttcttttattcagatttctgatgctagaggaatatgttcagttagtttacttgtcctgaaatttaaacagtaaccatttaaattacgtgagctgtaaagagattggcatttttctgtgagttgttccagacactaggcccagtgctgttaaagatgagccccgcattctctccaaatgacaccaggcccatcattgtgttcctaggctcaagctcttctccgctggcatgatgctcatcagttctgcagcagaagtgggcagcccaccaagaagaacgtggctggcagcaagcgtgtgtgcccttccaataatataatctattatccacaggtaattattgctgtaagaggacagtaatccaagaagactgtgcgctgctttgtcctggggaaggaagcctgtgcaattccttaattatacactgctttagctcattggcagggcccaaagtgccagcatctcagtttccattcccctttcctagatggctcctgtggcgatcacgctggtgtcagatgggacccgatgcctgcttgcccgccaaagctcctttcccaagggaatgtattctgccttggcaggtttttgtgatataggtgaggagtttaggggatatacaggtgacactggaagatatacaatcttactaatacaatcttctctgtcttgttgctatagagcttgaattcccaagcacattcttttctatcatgtcaagaaaactgctttctggcattttatatatatatatatatatatatataaaattttttcctttccttttttttgagatgggagtctcaccctgttgctcaggctggagtgcagtggtgcaatcatggctcattacagcctcaaccttctgggttcaagcaatcctcccacctcagcctcctgaatagctaggactacaggcacaggctaccatgcccggctaatttttaaaattttttgtagagacagggtctcgccgtgttgcctaggccagtcctgaactcctggcttcaagtgacctacctgccttgacctcccaaagtgttgggattacaggtgtgagccacactatttttttaagcaaattttcaaacataggagattgttgaaagaattatacagtgaacacccatacacccactacccagattctataattttttttcctcttcacatgtaggcatttgtttgtagggaggccacaagctttgtgcctctcatcacattgaccccagattcctgttgggtgtgttataaacagaggagccattctttaggccccctgctctgagcacacccctagattccatgaatttttactacacttactttatcacaaagctgtccatctatccattaatctatcttattttttgaygcatagattgaagatattagtacacttcttcctatttcagcatgcgtaacatttgctagaattcagtatttatttacaggttggtttttttctctagtctattggggtcaaatttgcaaatggtgaaaagtggaattttatgaaagctgagtgcagtagtccctcctactgtcacacttactttagacctagcagacttaagcactgtggttcaacacacagctctggacctgattcttattgttggaatgactcagagttttaggacactcccaagagcatttcattgaaactttggagccagtgttgtgcacctttctcaaatgggctgtctgtatcacccttctagcctacagggctgtcctgaattaatctgagtgcttgtaggtgaaagtgtggaagagaccatcygccgagaagttgcagaagaggtgggattggaggtggaaagcctgcagtactatgcatcccagyattggcccttccctagtggctcactcatgattgcttgccatgcaactgtgaaaccagggcagacagaagtaagttctcatsttcccttatactgtgatatttcttttgcttcatccaacctgctcatcagcaagtacttattaagcacttgtctagtccagcatcatctagattacataaacatgtgtaaaatatgatttagggctgagcacggtggctcatgcctgtaatcccaacactttgggaggctgatgtgggcggatcacttgaggtcaggagttcaagaccagcctggccaacatggcaaaactccatctctactaaaaatacaaaaattaaggccgggtgcgatggctcatgcctgtaatcccagcactttgggaggctgaggtgggcggatcacgaggtcaggagttcaagaccagcctggccaagatagtgaaacctcatttcaactaaaaatacaaaaattggctcggcatggtggcaggtgcctgtagtcccagctatttgggaggctgaggcaggagaatcgcttgaacctgggaggtggaggttgcagtgagctgaggtcgcgctactgcactccagcctgggcaacagggtgagaatgcatcttgaaagtaaattaattaattaatttaattaaatatgatttatgccctcaaggaatttgcaacctagtaaaggaagcaaataatctccattctcccttgcatatatgtcaatcacgagacaatttattttattttattttttttgagacggagtcttactctgtcgcccagcctggagtgcagtggcgcgatctcggctcactgcaacctccgcctcctgggttcaagtgattctcctgcttcagcagagaagtatatacccttgaaattatcaaaccgtcatcactatcaatgccataaacttattcatcacttacaaaagtttcctcccaccccttttatttttctcccaccccacttttttttttttttaattttgtggtaagagcacttgatgtgagatctattctcttagcaaatttttatgtgtataatatagtattattaattgtagaccttatggtgtacagatcttcaaaacttattttgcatgactgaaacctggtaccctttgaccagtggccaccctcccttcagcccctggcatgcaactttttccattttcccctcccttcagcccctggcaaccaccattctactctctgcttctgtaagtttgactattttagattccacatataagtgagatcatgcaatatttgtctttctgtgtctggcttatttcacttagcatgtcctttgggcctatctatcttgttgcaactgcaggatttccttcctttttaaggctgaataatattctattatagtatataccacattttctttatccattcatccattgtgaatactgcagtgaacatgggagtgcagatatctcttcaagatctagatttcaatccagaagtgggatgctagatcaaagggtaattctatttttaattttttgaggaacctccatatttttttccatagtaggtgcaccaacttacattccccacaacagtgtacatgggttcccttttctctacatccttaccaatacttgctgtccgttgtacttttttaatggtagccattaaagaaggtatgagttaatagtagccatcaaagaaggtatgaggttttcatttgcatttccctgatgattagtgatgttgagcaccttttcacatacctgttggccatttgaataccttctttggagaaatgtctattcagattctttgcccatttttaaattggcttatttattttttggtattaagttgtagaagttccttatatattttggatattaactccttataagatagagggtctgcaaatattttctcccattctgcaggttgtctcttcactctgttgattgattccctgactctgcagaagctttagtttgatagaatccctacttgtctatctttgcttttcttgcctgtgctttggtatcatatctaagagaccactgcccagtctaatgtctagaaatttattcctttatgttttctcctaagaattttattgtttcaggttttatatttaagtctttaatccattttaagttggtttttgcatatgatgtaagataacggtccgatttcattcttttgcatgtggatatccaattttcccaacactgtttatataagacaatttaccttttattgtcaggagttaagagtgtcttacatatagtaggcgcacaatcaggcatcatttaatgactgactgcaggattggtcttattgctcaagtcagtcaggatgctgggaactaaaaatataaaactataggtacttgtagttgaaagaaacttaagacgttgtcttttttttttttttttttttttgagatggagtctcattcttgtcgcccaggctggagtgcagtggcacaatctcagctcactgcaaccttcgcctcccaggttcaagcaattctcctgcctcagcctcccgagtggctgggattacaggtgcctgccagcatgcccggctaatttttgtatttttattagagatgggggtttcaccatgttggccaggctggtctcgaactcctgacctcaggtgatcctcccaccttggcctcccaaagtgttgggattatgggcatgagccaccatgcccggctagacattgttttatccaatctcatcttgcacttctctagcatcactgactgatggtctctgcctgccaaagtttgcctattgtatgttttggtttttatagaatatctaatctatttcagcttccttgggatgaagtttgcattactttgcttcttgcaaagatgagactatgcttttgactatcattaacccttaccctttaaaaaaaaaaaaaaaagagtggctgggcacagtggctcacgcctgtaatctcaacactttgggaggccgaggcaggtggatcacctgaggtcaggagttcaaaaacatcctgtccaacatggtgaaaccccgtctctactaaaaatacaaagaaattagccaggtgtggtggcgggtgcctgtaatcccagctactcgggaggctgaggcaggagaatcatttgaacctgggaggggaggttgcagtgagccaagatcacaccattgccctctagcctgggtaaaaagagcaaaactccatctcaaaaaaaaaaaaagtaatatttgtatgttcttttttaattgaaaaatttatacaatcaatagagacacaaggaaaaataggtattattcataatttattctcaatgttaaccactcttaacattttagtatttgtacttccaggatttatttaatgtatcttatctttttttttttactatgttagaaatatatttaactcggccgggcacagtggctcacacctgtaatcccagcactttggggggccaaggcgggtggatcacaagatcaggagatcgagaccatcctggctgacacggtgaaaccctgtctctactaaaaaatacaaaaaattagccgggcatggtggcgggcgcctgtagtcccagctactcaggaggctgaggcaggagaatggcgtgaacctgggaggtggagcttgcattgagccaagatagcgccactgcactccagcctgggcaacagagagagactccgtctaaaaaaaaaaaaatatatatatatatacacacacacacacacacatataaaactctcatttcttaattatgcctcttttgcttctgggcagtatctagaactgactttcacctaacctgaagatcccaggtattatcttctaagattgcttagttctagaatcattttctgacctttggccatagtattctaaattttgtagctcctgaccktacatccttttcttcctwatgtctttcagatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgstagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacacctttgttctgatgtctttttctgtcctgtgaattgagaaaattttacaaggtgagaatttgggggtaggggaaaggatccctattggtgacaattaaacatttaagtccaggtttcaagtcagtgtaacaactgaagcaatgtgcaggaggaatgttagaggtcttgctgaaaagaggaaataatcatatcttcagaagattctagggacttatttgtgattaaagacaaaagctccagagaccctaaggttatttacatgtcaaagtcccataggactaagtcccaaagtcccatagcactaaagagattctaaaactagaaaagttaaagcactgaatttccttttgatctcaaaaggtcattgctctctccactgccagcaaaccatcattgctttggggaaatcaaagtgccttcatcaggaaatgttgagggataatatgtgatgggacttgattgtcttgttagattggcagcttgcctttacctgggctgaacccagcatgcagaagggaaaagcactcacaaaagagaggtcctgagatttcttcatatcttgcagttagaagaaaacagttcagggtccatgtgtattaccatctcccaatcttttctatctctatgtgggtgtgtttgtgagcgcatgtgtacacatccccaatctgaaaatactgatagaaaggggagtgtgcggaattcctggttatgagtttcccaaacttaccatggagtaactgtttgttttttgattaatgtgtttttggaaaagaaaagatgagagtggctaacagcaggagctgcaacattgaactttgcttctcagtagtgagtgggaaaagagctttgctgtagaaccccaaggatatctgaaagctgaggcagaagagagcaggcctggaatactgaaaatggcagataaataaaagaaactttggtacaggacctacctgacctgagaatatatacatgggcaataaattatgaaggtgctaaggataaatagaacccatctgggtccatgatgcagaatagaaaaacaggtaaaatcttgtgagcctggctgaaagtcagtcagccgtggcaaccagaataaaaaaaaatttcatttatatttttgcctatcaccctttctctacccaatatttaatcctcaatgaagataaacctaatgtaccacaagtgcgatggggggaaacctttttctcacagttgagctgggacggcattctggccccatttttaacatgagaaatgtagcttcaaaacaaacaataaaaatatatttaaaataattattatttaaaatgttaaaatgttgcacaatatcatctgatgtgttactttagtcaatgtgtaacacttatcctcttccttagttcatttcagtgaacactaggaagacaaaggattggagtgggatatggtatatttagtttttatttatttatttttgagacggagtttcgctcttgtcgctcaggctggagcgcaatggcgcaatcttggctcactgcaacctccggctcccgggttcaagctattctcctgcctcagcctcccaagtagctgggattataggcgcccaccaccatgcccggccatattcagtttttattagttcgtgatagtaagttctcagatgagaactctactacaccattctcctaattcctcccttggtcactggagagggaacagtatgaaactatttccattgtttttacttggatagggtaagatatagtaaaggcatctctctgctgcatacaataataaagaagaatccagagacctagattataaaaacatggtcagtatatggagctgtctgtaaagaagactttttttttgcttttaatggtgaattttatgatatatagataatacttgatttattttaggaggaatatgagcatcattttaagaaataaacatttcatcttagcaaaagatatatcagttatattaaatatcaaaccaattaattaattaaaacaattaagtacagtatcaggtatgaaatatccaaaataggcaaatccatagagacagaaagtagactagtggtttctaggggctgggagtagaagggaatgagagactattagtgagtatggggtttctaatattctagaattagatggtagggatggttgcacaattttgtaaatatactaaaaaccactgaattgtataatttaaagggtaaattttttggtatgtgacatatcaatatagctgttatttacaagtaaataagttctatatcttgcttcaggtacatacatacatgcaaaaattcactgactgtacacttaagatttgtgcacttaaccatatgcatgttatgcctcattaaaaaaattgaaaaagtgaatgagttttcaaatccaaatttgtcaacttgaaattttgatctgaggatgaatagcagtaagggagaaatttaaatatttagaattactccaagggtatattgtggtagggtatgtctttagcatgaagtgtgtgaatttcatctcaaggttgtctaggggctagattctaccctgccgagttcaaaacctgtgtataacccacagctgagatcacaaagacttgtgccaagagggccacatttggggctcatggagaagtcaatctgtaaaacttgtaatgaagaaacatttttactaaatgagtaatctaaactagaaatgaacagaatcatattcaatatttatttaaaaagaaaaaagagaagctaaatgtgctggttaattttttgttggcttacttgttggtctgtgatcggtgttgtcaggcagctgcactcccatgctttgtaaaagattggaagcaggtcctgccagtccagcttgggagctataggattccaatatatttgaaaccaggttcaggtctacatctactggtgccataacagattctcccgtaccagaatcttcctcatctgaattgttatcggtagtctgggatacaggttccttattcatagagggaaaagaaaattatgggctaatgtatcattaggttgcatggtggttacaataaaaagataactaagccacaatgtaaatttgcattccaaattaaaaaggaaacttcttatccttggtgatataaactgaaaatgaagtctacaagttatatggcctagcacacataataaaacttggttctaaaggttataacacatttctctccaggaaagattcctgcaaatcgaataaattgcatgtctattttgaaatagctcaagggctaatagaattaagaaggtacatttataacttgtctaagagtcttaaaagaaacaaacataaaagtgaatattaaatgaaataataatgtaaattttcttcaaaatgaaagaagcgagtgttcctttctttccccccagtgaaaaagcttaaaagtaaaaacacaaggctttgtggttccaaccacaaagattctaaattgttagttgggcctctgattccacaagctggggaaaggatttgaaagattacagctcgatagacttttatgtccttgctacccaaagcattgtccatggagcagcagagtctccatcgcttggggcttattagaaatggaaaaactcagctgggagtggtcgctcatgcctgtaatcccagcactttgggaggctgaggtgggtggatcacttgaggtcaggagctccagagactagcctggccaacatggtgaaaccctgtctctactaaatatacaaaaattagccaggcacggtggtgcgcacctgtagtcccagctacttgggaggctgaggcaggagaattgcttaaacccaggaggcagagggtgcagtgagccaagatcgtgccactgtactccagcctgggtgacagagggagacttccatctcaaataaaataataataataataataaaataaaacaaaataataataaaaaaaaggaaaatctcaagcttcatcccaggcctacttaatcagaatctatgttgtaacatgatcttttggtttatattcgcattaaaatttaagaaatactgctttagataaatctaatgtatggtttctactagattttgacaattctggaagtgactatagttttaaaagtggtttagatgatcaaagcaaggagaattaacattaattaaaggcctattgtaggttttactgctgtctaatttggttctcatgttaattttatgatatgaggattactggtttatagatacattcacagtggacagctgagctagacttcaaaccctaacccataagactccagggttcttgctctttccataatacctctgtttaggattagacagtggtggcattaaaaactaggatgaaaacataaacggaaggtgaatcctaaatttggctctaaattagggaaaaatacaaaataaactgttaaaactggaaagttatttgaatgtttaagatcctgtttatttacttatgttattttgttttaatccactgtggcccaaggcatagtctcaaaaggtcttgagaacatgtgccctctcttttttaaaatccatttaagctgtagtttttttaaactacttttgaaaaaaaatgtatttaagaagtagtagtgtacaatcgcattctaatttgagcatattatatgactttttattttaaatcctgatagataacgtagaataagtaatataatgaagcttatgttttggaaaattaagtctatgatcctttatcctaccagagttaggaaaacaattaacattcttatttatttcaaatctcacacaccaaaaaaagaaaaactatgataaaatatggttttagctatctgacatactagactcagaaagagaaagaggttaaaaacacacataccacttggttcctagtggtgaaacttttgctgatgcaggtgtgtgctagttcctggtccatctgggccatgtatgacttgagattatcaagtgttcctttcagggaagcctcttcgccaggttcgtgtgtttcaaagtccaagtcatcatcactatctaaacattcaaagtcttcatcatccagatcatcagaatctgactcattaggccttggccctacacagatcccaagaaagaaagagccacttagtaattattattattattattattattattattattttttagttactacacatctcaaaataattagaatgttacccacagaaaaagactaatacacacagtcagtctacttcacaaaaatcccttctacaaatggtaatgctggcagatatgtgtgcatttaatgttgtggaaaagcgtacaagctgaatcaaaagatttagcttaaaaaaaagtgaattcaattaattaaaatatttttcttaaaaaatttttaaaaatacctaataaatgaatacattttgatgtaaacattcaagccatacaagtattgtctccaatctcactctctccccagaggtaagcatcttttagcagtttccgggtatcccaatctttctctctgcagttctgtacatatatacatattataattattttttgagttatctttttattactgatttgtaagtacagtaattccaaaaaagaacaatataatatgggagccaaggtaaaaccctatttaaacacacagcattcagtcactctcaaatatttaatgaggccgggcacggtggctcacgcctgtaatcccagcactttggtaggctgagatgggcggatcatgaggtcaggagatcgagaccatcctggctaacacggtgaaaccccgtctctactaaaaatacaaaaaaattagctgggtgtggtggcaggcgcctgtagtcccagttactcaggaggctgaggcagaagaatggcatgaacccaggaggcggagcttgcagtgagccgagatcgtgccactgcactccagcctgggcaacagagcgagacactgtctcaaaaaaaaaaaaaaaaaattaatgagcagctactatatatgtcaa

SEQ ID NO: 10818 - DNA, 25976 bp, Homo sapiens
atggcgaaatagccagaccgttatatacactaattaaggaaactcagaaagccaatacccgtttggtaagatggacacctgaagcagaagtggctttccaggcactaaagaaggccctaacccaatccccaatgttaagcttgccaacggggcaagacttttctttatatgtcacagaaaaaacaggaatagctctaggagtccttacacaggtacgagggacaagcctgcaacctgtggcatacctgagtaaggaaattgatgcactggcaaagggttggcctcattgtttactggtagtggtggcagtagcagtcttagcatctgaagcagttaaaataatacagggaagagatcttactgtgtggacatctcatgatgtgaacagcatactcactgctaaaggagacttgtggctgtcagacaactgtttgcttaaatatcgggctctattacttgaaaggccagtgctgcgactgcacacttgtgcaactcttaacccagccacatttcttccagacaatgaagaaaagatagaatataactgtcaacaagtaattgctcaaacctatgccgctcaaggggaccttttagaggttcccttggcagatcccgacctcaacttgtatactgatggaagttcctttgtagaaaaaggactttgaaaagtggggtatgcagtggtcagtgataatggaatacttgaaagtaatcccctcactccgggaactagtgctcagctggcagaactaatagccctcactcgggcactagaattaggagaagaaaaaagggtaaatatatatacagacacttaagactaggggcttgcctagtcctccatgcccatgcagcaatatggacagaaagggaattcctaacttctgaggcaacacctatcaaacatcaggaagccattaagagattatcgttggctgtacagaaacctaaagaggtgacagtcttacactgccagggtcatcagaaagaaaaggaaagggaaacagaatggaaccaccaagcggatattgaagccaaaagagctgcaaggcaggaccctccattaaaaatgcttatagaaggacccctagtatggggtaataccctccaggaaaccaagccccagtactcagcaggagaaatagaatggggaacctcaagagcacatagtttcctcccctcaggatggctagccaccgaagaagggaaaatactttagcctgcagctagccaacggaaattacttaaaacccttcaccaaacctttcacttaggcattgatagcacccatcagatggccaaatcattatttatgggaccaggccttttcaaaactatcaagcagatagtcagggcctgtgaagtgtgccaaagaaataatcccgtgcactgcagtccacacatttcaatccctgtatctttaacctccttgttaagtttgtctcttccagaattgaagctgtaaagctacaaatagttcttcaaatggagccccagatgcagtccatgactaaaatctaccgcagacccctggactggcctgctagcctgtgctccaatgttaatgacatcaaaggcaaccctcccaaggaaatctcaactgcacaacccctactatgccccaattcagcaggaagcagttagagcggtcgttggccaacctccccaacagcacttgagttttcctgttgagaggggggactaagagacaggactagctggatttcctaggccaactacgaatccctaagcctagctgggaaggtgaccacttccacctttaaacacggggcttgcaacttagctcacacctgaccagtcagatagtaaagagagctcactaaaatactaattaggcaaaaacaggaggtaaagaaatagccaatcatctattgcctaagagcacaacgggagggacaatgatcaggatataaacccagacattcgagctggcaatggctaccctctttgggtcccctccctttgtatgggagctctgttttcactctactaaatcttgcaactgctaaaaaaaaaaacaaaaaacaaaaaacaaaaacaaaaaaaaaccctgttgggattcttctgatagggcacaactgacattttaataatattaaatcttataatccatgacgtatatttctgtatcggtggtatacatttccatttattcaagtcttaattcctctcagcaaagttttgtaaattttagtgtataggtcttgcaaatcgtctgttaaagtttttttctaaatattttatattttagaggcaatttactaagatgattataagatagattttggtaaaatagtcagaggcgcctaaaatctaaggctcattctaaaaaatgcctttgagttcccaattagatattgctgggttggggcacaaaggttaatacaaacacacacacatgcacgtgcagacactcacacacgcattcacacacatagatgattctacagggatgttgtaaggcagcatgtgtataggtattagttcactatagagaaaacaagagatgatagtgactggcaggaggcacagcagaaattctggggtgttgtaacattctatttcttgttctggagtaataggtgtgtttaatttgagaagattcaacaatgagtatttaaaaaatctgtacccttttctgtttgcatttataatacatttttttaatgaattaaaataattttttaaaatgtcaggagctaattcatgcatttggtgccagctttagagtcatgagaaggtggctggtgtgagtgaggcttgtcaccacgttattgtcctcttgacagtatagtgaattgagctgtaattccttgcagggggtgataatattttatgtgtcattgaaacacagctaaggaaatatcctgtgcaaggattctgggctagaatacctaagaaggagaaaataaatgggaaaatataagagaaaagaaagacgtatgagctggagggggatagaaagatgcagagagaatgtgaggggatgattgatatgaagccttgttctctaccagcatcaattgaaaaaaatactgagtatttattatttgttcacattcaccctggaagtaagatagcatgaagtgacattaagactgtatatatttataatgtaatctaattgtagagcattagtattaacatgcacaggatatgctgggacatttattctcagcctgattcttttaaattagagttaatgtacattccctatgcttccttctcattttgttcattctccaagtattgctactcatcacactgtatggaaattacttcattatctttctccctcacttttctgacacctcctagagggcaaggacattgttttattcatctacaaattgccaaagcatagcatatctttgaacctttaaggaattgcttaataaagtttgttaaattaaatgaatggcttttaagatgattatttgtgaatttataggagcataaaatctgctcctataaaatgtaaatgctgctgtttgcttaattctaatttattgtttcatttgatcatcaaaatcaatttttaatgtgaatttattagttcatctgagcatcataacagccctgcatggcacagaagggcagtattaaaatgccagttttacagacgaagaggctatggttataacataaaaacaacttattagaagtcatacaggtagtgtcagagccagatctggaatctagagttttgaattttcactcaggtaattttttctaaacaattatatcacttatggcaacagaagtcactctataaattatcctggggtgttttaactcccaggctggtttttcttggatataacttggtttctttcttttttttttttttgacagtgtctgactctgtcacccaggctggagtgcagtgactcaaatcttgctcactgcaacctctgcctcgcaggttcaagcaattttcatgccttgggctaccaagtagctgggaccacaggtacatgccaccaagctttgctaatttttgtatttttagtagagatggggttttaccatgttggtcaggctagacttgaatttctggcctcaagtgatcctcccgccttggccttccaaagtgctgggtttacaggcatcagccaccatacctggcctaacttggttccttgaccaccttttttagacagcctattgtgctactccctagtctcaccttcacctcgcctgtcctcacttcattccctgagattacagacaagaaaggccatttcatattggcataatattgtgtctatttgcaaattcatttcagcattcctactccctatatatgtacagttcttgaatacctcttttgaatcagttgaaactggtttttactgtaatctctcattaattacagaatgctgtaattctctcattaattaactagttcaatacattttttgacatgtgttcattgtacacttgtagaagaatcatgattttaccttttctgaaaattattctttaataatggatgttttctcaataatgtgtgaataaaggcaacttcaggaaatgatgcaatttttgctaatctgcaattcacagtctaagtaaaagttgtgttctctctgcaaatgctacttcaagaactaactaataagttcaaggacctgtctttctgtgtcccagtggaagaaacaatttcagtcagatgtgaaggacaaagtagacacagagaagtgaattgaaaaactcttccaatttttagtctgcctgggagactcagaatatagagttgtctcaagccttagatagaaaagacagatatgaagagtcttcttcccttcccctctcttcctccacaccctccattttcaaggggttaagatttgaagaatcatattcctatcaattagcaactttatcatctctgatatttgaaccacagcaggtgagaagagagttggaaaaggaactaaattatcacaggcgctaaatactttttaaaaggcattgctctgggccaggtgtggtggttcatgcttgtaatcccagcactttgggaggccaagttggctggatgacttgaggtcaggagttcaagaccagcctggccaacatggtgaaaacccgtctctactaaaaatacaaacattagccaggcatggtggtgggcgcttgtaataccagctactcgggaggctgaggcaggagaatcgcttgaacccgggaggcagaggttgcagtgagccgggcgacagagcgagactccatgtaaaaaacaaaacaaaacaaaacaaacaaacaaaaacattgctctgaatcctgtaagcatcggtcattgtcatcattatctttatcctaatttataatcactcataaaacttgtcagaagctttcagctttcaggctgttatgtagaaggatgggctttgcagcaggtaagtgagggatccaaccctctccatctaactctgtcacaggctttgtcacataatctctggagctttgtgtcttatctgtaaaaacaaagccatgtttgttgaggatattaactgagatacatttaagataacatagaagctctggaaactattagctttataaaagtgtcagttgctggacttgtctatcagtttccttatctctaatggaaattataatggaacctacctcatagggttcttctgaactccaaatgtatttaataaatgtaagaacacttcctgacacggttagtgcttaacaaatgtgaactattgatattattaatgtatgctccacgagggggcgtgtcggatttgaaacaccttttcatctcccatagagcctagcaccttgcacccagcaggcgctcactgcatctttgcgggatgatttcaatgttctgacctcagcctgcgctgcagggaacgtccgagtgtaacgcgttagttcgtaggccggaacccaaagctccggacgctgcgacgccggagcctctaggcgccgggacacgggcgccggaagtggcgaaggcggggtcggcgctgccgsgtgaaatcgtaggacagtgaagatgctgctggaattgtccgaggagcataaggaacacctggccttcctgcctcaagtggacagcgcgggtcagcgggcgtgggggcggtgttctgtgggctggggaggaggtcaaaggcagcgcctggcactcaacagccttctgactttcattgcagtggtcgccgagtttgggcggattgctgtggaattcctgagacgcggcgcaaacccaaaaatctacgaaggcgccgccagtaagaagggaaaggggaaggctccgcaggcttctagggcggttgcgagccattccctgtctcccgggagagaaacggattattgcgagtcctagggtcttgttccgattgtagtagaataaaaccagcagagctcttcagtcagggtgcaaatcctgcccgtcccttaagtagctgtgagattgttaaagcttctattaaatcagttttctcatggtaaaatgtacataataccaccttactttcagaaatactgaaaagtgttttgtataaatataccaaagtctgtggaatagctgggtcaactgtaaattgcaagtatttggttatcattattagttgttcagatatccgcttttgctaaaaaaaaaaaaaaagtgttgttttacccctgggtaagaggcagtctctgggattaagtcaatccctgtcgagttcctcttctgccagacttgaaggagctacgtattcaagagaagggctacgcacctgatactagtctccacagttctgcattttgttaaggttacttggtgggaaataccaaaggcatttggctgggagtggaatgacaaggagcaggagcctctggccaacttactgtttttcatgcagtgtttgaaaacatgtaataatgaatagtgtttatttttaaatacaaatatgaacaagataaatactacagtagtaatttatttgctcgtttttacttttctttctcaggaaaactcaatgtgagtagtgacactgtccagcatggtgtggaaggattaacgtatctcctcactgagagctcaaagctcatggtaagggattttctggactgttttgtgttggctggattcttaagaacggtctggtgtactctacatcatagtcctggcaggtacctgtgtgttttaataatgttgttaatggtttataattgattttttgaagacatacctaaaaaataaaaatcatatcatctgctgatatgaatacctcttgctagtataaatagctagtatagaagtacctctaattctgcatgttgttaaaccatatatgtatcttaagaagatacataagaggagggagactgtatcagtattttgtttgcgtatcagcagtatctggcttgatgaaggacaggaagggaaactgggcatcttaacaattttttccattttatactttagtaaagtacttttatgtattggtaacacagattttggaatggtggtcagtggttaaggaatgctgtttcttttactagacagaataaattagaggatatcatattcttttgtgtatttcaattattttagctagacaaagataaattttgatgttcttttaaactcaattcacttagatttctgaactggatttccaagactctgtttttgttctgggattctctgaagaattaaacaaattgttgcttcagctttatctggacaacagaaaagagatcagaacgmttctgagtgaattggcaccaagccttcccagttatcataaccttgaatggcgactagatgtacaggtatagcatttttaaaattaacttaacatagaatataagaattattttaggtttgtgtcctgtttattgtattctttaccaccttaactaagatgcggtttgaaactttgtttttttaatgttcatttttaagccatttcacaaatcattcattttcttttattttcagtgtgttcaaatcagtttaatttgcaaagtttgtaagaaattggttattttcgaaaaggagatggttatatagattttttaggttggtgcctagatgtttaaaaacttttctgtttaaatttaacagatgtagaaaagtgcacaggtcaatgtaccgctcaatgaattatcacatggtgcatttaactgtgactcacaccccagaagcatcctccttgcctcctaattactgccccttcactcctttctaaaggtaaccagcatcctgacttttaacacaaattacatttacctgtcttttaactttgtatatatggaatgactcagtaaatattcttttgtacctggcttctctcacaatattctttttgtgagattcatctttcagttgattttaaagtcacagaaacgaaagggtgtattcagaccattgcttataatcctttattaagcagagagagatgagttagtagatgtgtattgaatgccatctatttgctgattagagctgtgctaaatgctttgagacacaaaagaagtgtaagatactttctcagctggaaaagatcgtatcaccttggttagggatattaggcattctcaaaataactagtaattaaaggtagttataaaataaggttcttgatggggaataaagaatataattatatgaatgaagatgacaactgtttaaaacaaaaacaacaacaacaacaacaacacgtgtagttgtgtgtatgtgctggcgtgatccaagaaagcttccagcaaaaggaaatgaaatttcagaaggatgaatgaatagagaaaattagggtaaatattcttagtagagaaggcagaatatgttgtaaaagcccacatggatatgcaaatgagcatatgaatatgtattatagtgcacttgttctcaaatttgacttcatgttggaataacctggggagctttacagaaattctgatgtttgtgtgttatacccagagattctgatttattggtatagagttcagcctgagcatcaggattttttaaagcttcttttcacccaggtaattctaatgtgcaatacagtttggaaaccactgttgtagtggcttcttctgattcaaatggaggtaatgtccagataggttatagaaatttggttagaggggtttagacctgaaatagcagataataggaagcccttgtagatatttggataggggagtaacattaaggccatgcacggtggctcagcactttgagaggccaaggcaggcggatagcttgaggtcaggagttcgagaccggcctggccaacctgtctttaccaaaaatacaaaaattagctgggcatggtggcatatgcctgtagtcccagctacttgggaggctgaggcaggagaatcgcttgaacccgggaggtcgaggttgcagtgagccgagattgtgccactgcactccagcctgggcaacagagggagacttcgtctcaaaaaaaaaaaaaagagagagagacagtaacattaaaaaacaatcatgtaggaaagttagtctagcacccttgggcagagaatgaaagtgggaattcaaaatattaagagcatcaggccttacacattatttttcctctatgtgaaatgcgttttctgctttgctgctacctcttgactcgactctttcttatccttgtaagtctccgtttaaatcagggctcaaaaaactatggcctgtgggccaaatctggcttgctacctatttctgtaaataaagttttattgggacacagtcacgctcctttgttatgtattatttatggctgctttcaaagtacaagggcagagttgagtagttgtgccagaaactgtatggtctgtaaagcctaaaatattatctcgttctttatagaaagggtttgctgatctgtgctctaaatgatgtctccctttgggagaaatgcctcctgccactagacacagttaaattttggtggcatttgtgttttcttttcgtggcacctgtgcttcctcttttggcaagtcatctcacttatatgtagctggttttttggttttttgttttttgttttactaaactgtaaacactgggatagcagggaccatgcatgtcttatatattctctttcttcaaagcctcaacatctctatgctccacatgcttaggtgttgaccttgcttccagcttgactaagaaaagagaagcaatcggaaagaactcccacatgtacctgtcaaccacatctttcagcctgtatgaggacccacttgctccacttgtcttctctcctgttcctcttgatgaagtacccatgctcttatctacaggcagccttttcccttgtatacctcaatccatccccatttccccccatgaggacatagttctagcaattattccctctcttacctgcatcatactttgtttgcctctactgaatcgattattcccttctgtgcacagtcagaaacccagtcttgactccatgtactcctcctactgctgctccattattttgctcctttctatactaagccttttttttttttttttttttttttgagatggagtcttgctcagtcgcccagactggagtgcagtggcgcgatctcagcttactgcaagctccgcctcccgggttcaagtgattctcctgcctcagcctcctgagtaattgggattacagtgggattccaggcatgtgccaccatgcctagctaatttttgtatttttagtagagacagggtttcaccacgttggccaggctggtctcgaactcctgacctgaagtgatccacctgcctcagcctccccaagtgctgggattacaggcatgagccagcaygcccagcctatactaagacttcttgaaagagttgtctctctgtttgtatattctctcttcccgtcatctcttaaactcttcctaatcaggctttataatcttcactctactctcgtaacttactcaaggtcatggctttttagtttttatgccattctgtttattgacagcatttgtcacagtcacgccttcctacttggaatactttctttagttgccttctgggaaataacttcctgtgattctcattcaacttcacaggctcctctttctcagtctcctttgctgattctatctaattgccctttaaacattgggatgccccaaaggtcagttctgagtcttcataacttctccacttacattctcaagctggtttcatccaatttgaagtcttaaataatccccatattcttgggattctcaaatttatatctttagcctagaactgtcctctaaacttcagaatcatacagtggaagcctatttgacatctccactttggtaatttgataagcattcaaaggcaatatgttccaaactgaatcccacctttcttacccactgatacggtttggttctatgtccccacccaaatctcatcttgaattgtaataatccctcttgtcaagggtgggaccaggtggagataattgagtcataggagcagttttccccatgctgttcttgtgatagtgagttctcacaagatctgatagttttataaggggcttcctccttcatctggcgttcattctctctcctgccgccctgtgaagaggtgccttctgtcatgattctaagtttcctgaagcctccccagccatgtggaactgtgagtcaattaaacttcttttctttctttcatttttttattttttgagacagagtctcgctgtgtagccaggctggagtgcagtggtgcaatctcggctcactgcaagctccgcctcccagggtcatgccattctcctgcctcagcctcctgagtagctgggattacaggcgtgtgccagcacacctggctaattttttttttttttttttgtatttttagtagagacagggtttcaccctgttagccagaatggtctcgatctcctgatcttgtgatctgcccgccttggcctcccaaagtgctgggattacaggcgtaagccaccgtacccggccttttctttataaattacccagtctcggttatttcttcataacagtgtgagaaaggactaatacaccccctctctactgaaactactcctaccatagcctctcccatctcagatagtacgtacattctttgaatcacacaggccaagtatttttggcctcttccttgactcctctccttgcccttcatctagtccatctgcaagtcagtttcttaaaaaggtatccacagtctgaccacttcccttctatggtttgaaaaaaaaagtaggaaatttcacaccaaaattataatttttagcaatttttgaaaaattagaagtcaggcagcactacagccatgctccctcatggcattaatcagttcaagatagattgaatttaaggtgatgacagcttatataagttgcaatctccacagtaggtgaggatgtgggcctaacacttggatgccagattagttcaaatcacaaatgagaatgatttctctgacatctgaactggatctcattggttggtcatggctaatagaaataaaagccagtaattagagtaagagtggtttcaggaaaaacaaccactaacacaacacaatgtcactgaaagtaagagcaacatttaagaataaagggatcatcaggagagtaagagttaagacaaaaggcttaggatttggacagaagaaagatgtacctgtcttactgtatcttcaaattttacatttgggatagagtgggtggcatagagagagaatattccattgtcatgagcatcttcaggtacatgcagataaacaataaaaaagataatttcttatgtcccattaatccatccttgtttctatatctattcagttatcaaaccatttattgaatatctagtgcatgctaggccttgtggacatagcagtgctgcctttaagttctcacagtcttacagtaagagggagaccaaaaaataaaatttaattagaaatcagcaattataatcaagtgtgatgagtgttttaataggcatgaacgcaggatatggtataaaccagactgtaggctccaggagggcaagtattgtgtcttgttcattaccatgtgcccagcacaatacctggcatataataggcatgaatcagtgctgaacagaaagagtgggtggcagggggagttaagtgacttcttaaattatttatcatatatttcttgtacccctaacatgtgccaggtgctgtagatacggcaaagaacaaaacacagttcatggtctgggggacatcataagcagcaagtcttgtagggttcattggggaaatgactgtggataagcctttatacttaggtcctttaataataacccggtggagatgtggggatggtcatgtatgtggctcagmggtaatttatcttgtagatctttacgtctctcttgtgtgcgaatgtcccctgacttttggggtccagtaggctttaacagttctttttttggctttattgatttgctttgagtttgtccattatgaagacatttttgaaagttaaaattaagaagttgaattttctaaaattaaactcgagggctcatttacccactgaagtgagtttgaatcactgcgctattgctaggactagtacagtttaaggttgagggtatactgaatgaatgttgccacttatggagaagtgcatttaagggctagaaaagctactcagagctcattgagttcctcagcttatttgctgaaaccattgcataggattttaactggagtggattcttctgctcatagagaaatgcatatcagataagactagctaaatggctaggaaacttgtaactacatatggcgcctttcatgtttaagtaactgacttgtctcatggagactggtagtgatggacaattaccacctaattattatgcagttgtttatgggaatcaaattaatcatcatagcttagtgtctagtaggaacatttccccagacttaataaattgccaacacaattgatgtccttgttaatagcattagtaactgaatgtaccaccatcagactgatgcaggaggatgttccttttaggactggtccatttacaactacttcaaagcattcttttcctgtcttgcccacatattgtttgctctgaggctaaatagagaactgaattcttttaggaactgtagctacatgaaacataatttatgtatcctgtttcctacttgatgttttttgccagaatacccttttcagtgccttgagatatggcccttcagagtaaacatttttttctttttcttttttctaatttgcattgacataagacattttattttaaagttgcttttattgttgttatatttacagggaggaggacagaatctcatccccaataaaaaataagtccatatcaagaactttgtgggctactgttctttgtcctgtagtactgtcattcaacttctttctgagaaaaatgtcttactagatgtttgttagggatgttatgtaatctcttttctagaactgttaaagaatagtatagatatttgtataggtatttaatttagatacgttgtctaaaaattggaggatagtggctttaagtctttcaacaaaaaagtcatggcttaattacacagcaaatacactcagtccctgtctgtcggtgcagtctctctctgtcagtgtagaggaaaaacaaatataaacagagcataattgaataaataagtactgttttcaattatcatatatataatttgcatatgtgtcatctatagttatttgtactacagagatgatcttaaactggtactttagcctgcaagtacctattttatgtttggggaccagctcacccaaagggattgacttattgtttgcaaattagttggggacattaaatttcagccttggatcagtatcttgggttcttttggaagcccaggttacctataattatttggaagaagttattagtcagaatattctattttacagaattaaattaatcctgaaatctcaggtttagatttgttactcacttgaaaatcccttcaagttggaatctagtcttcttgacatgactccactatttttgataacttttttgctttctcctataacaagatgtttcaggctcatcttgtacagtttctctcctagarttcaagtcagctattgctttggatagtcctggttccttttaatggagaatctaaagattgaaaggaccttgaagttggtcattgtttatagttttgtgttttcttcttttaaaaatatgtcagtattacttattttttaaattttggaacatattatacaaatgaaaggttatagatacccagtttaaagaataatgataaaacaaataccagtacacccaccaccaagcttaacaaataaaaccagtacttttgaagaacctgtacccaattgtaaccatctcccagccacctgaaggaaaccgttatcctgaattttctgtgaatcttttctttttctttttctttttctttttttttttttttgagatagagtctcactctgttgcccaggctggagtgcaatggcacgatcttggctcaccacaacttctgcctcccaggttcaagcagttttcctgcctcagcctcccaagtagctgggactacaggcgcgtgccaccatgccagctaatttttgtatttttagtagagacagggtttcactatgttggccgggctggtctcaagctcctgaccttgtgatccacccatctcagcccccaaaagtgctgagattacaggcgtgagccaccgtgcctagcccctaatcttttctttatagtttttttaaacataaattttgtcaccaaactgtatattttttaaacttgaacatattctgtgacttgctttttttcaacattttcatttcttctatgataacccatgttgctgtagttcatttcttttctctgccatttagtaagcaattcattgtgtgattattcttggtttatctattctgttaatgaatatttgatgtatttctaatttttggttcttggaaacatactatcatgaataaatgtatataagaggttaaggtatatgcctagtggtggagttgctggtaatgcacattgttttccaaagtgattttctcatcgcttaccaggagtgggtgagagttcccattactgccacttgcaatgcttggtatgaacaggtttttaatttttgctagtctgatatttgtaaaatggtatttcatgtagttttactggctattatcctgatgtttaataaagttgaacatatttttctatattcatttgtcttctgtaaaatgcttatttagaccttctgtatatttttatcttgggttttgaggtttttttcttattaaatcagaggagttcacacattctggatactaatctttttttggttatatgtctgttgcaaaatcccttctctcggtttatgacttgttttttcaccatctttaggtatcctttgaagaaaattgagttttaatgtagttaaattttaccagttttgtctttatggtttgagccttttatatcatgtttaagaaatcttctataccataaaattggtatatattctcattattttcttttcaaaggttttaaagtttacttttcattttgaagtctgtaattcatctgaaacttaatttttgtgtatggtttaagataattataaatattatgtattcagcatggttattaaatagttactgtgctcttatttcatttaaaatcaagcttgcaagtagaagtctcaggcaacagattaaaccagcagtgactataaagctacaccttaatcaaaatggagatcacaacaccaaagttctgcagacagacccagccaccctgctccatttggttcawcaactggaacaagcattggaagagatgaagacaaatcactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactsttctctccagtatgacccaggtttcttgactctgagtaatgcaccttctataactatctaaatttctaytgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaatagttttgtagactgaggatctcattattttacagccttgaattatgtcctgtatactctgttaaagaaactgggaaaaaaatgccaactggttgtttctgggtggtggaattatggctgtttcttttcttttttaatttctatagtaagtttgaataactttcataacatttaggaaaaaatattaaaggaaagaaaaaagatcagggaatttaaatatatttttagtagatatttttatccaaacttaattcttagaatgataaacacatagtttaccagaaaactcagctgttcaaaactactcagtccccaaaggactcaggtaaacaggctgagggttttatatatagagcgctctagagtttcctttttctgtcatttttttctccatgttagtgaaaaaaacatgggaatcttaagacattaagccgtttctccttttctaggtaatattacttctaaatggagaattgtttgtgttgtttttcatctcaaatggaaacagtatttctttgaagtttttcacatcccttatgatcaggaagttctgtcagctgctatattaaagtcctcctgctataacttactcagtcttctctgtacttatatgaatttgattaagtatcttcttttccagagtttccataatcatagattactctcacatctttcttccaccaacagtagaaaatattttggtggaaatgttatgatactacattgcctctaacttaaatatgttcacttttaaaaccatcatgactgttatattcaaactcaaatacttttcttagaacaaatgaacctaactccaccattaacgtggttagttcagtaagctttatacattttgaaagtaatgtttgaattataaaagcagaataagcccattatttttcagctttcaaaaaattatataaagatgagaaaaaatactatatggcactaaaatgtgtatttaatgatttgatcacagagtagtaatggctctttgttctagatttttacagctcctctctacccaggaactccatctataacttaagtatgcacaacagccatgagtccaaaagttttgacataccataatgggcgaatatagaaaaagtaatttcatatccttagtgggttaaaaggcagtatcaataatacaaatatctatgttaatgtgctctaaaactgggcttttacttgagttgttgccattctaaacccaagcaacttttgaataagatgaactttttataattataatgtaaattatgtttgttatcattagaaatattaccaattatatgaccaccagagtgagagactgtgtttttttattgtgcttgagcctaagttgacattttttagttgcaaagactacacttttcattttcttctcttgcagttatcatatcctctgttgcagaagagtctgcccagcagccaaaaagggaaataacacaaaaaagatttgtgccttatctcaccaaccatatgaggccttttaacttttaaaattttttttactctgctctgttacactaagctataaactacccacttatgcatggcattatattgataacaaagcacattttgaaatcttttctggcttttttacatggtacagattcagttttgttaatagtaggtacttagagtgacccatattgtgtgttgaacaaaggataaagttctagtctcagaatttagaatgctcttaggctgttccatcctctaaaatagtttaatccataagctcattaggctgcagaaaggaatctcctgagggagttattctgaagaagggaagttcctctggtctggtgtctactagaattgcttttccttgaaactctgccttcttctggaaggcagaaatctaacatgattcaatggctacagctgtggaagtgtgcagaggaaaggtgaaatcattatagaatactgaggaatactttgacagaaattatccttactctttttccattgaagtggggtcccctgaggtaaccagaggtgtgatgggaaaagcaaatcaagttattttttacctgtgtgccaatgttgtgattgtcataagtccaatgagaagtggatgcctgtggttttgaaggaatgtgcttagttcacagaacgaaaaggcttctcagttaactcgaagactaaaagcacacagattaaaattcagagaatgaggaaaagaaaatccagggaagtctgagtttcattggagcaagtatagatggttaggatatgatttcctggcatggtctgaaaaccatattctttcattccaaataaataaaaaattcttacaaagctcaagtgagtttaagtgctgcaccataataaaatggcttgatttgcagctgagacttggcacaattcatagactaaaagaagagcttaagaaaagctacaggcattttttttttttttttagtatttggggggaaaaatgagcaagtccccatgtacttttcaaaaaggcaaaaattatttatctcttggtatgagcaatgtaattaaaaccttttttttatgtttaggctttcaagaatataattattgggtattcttttctatgcttgtttcatctactctttgtttttaccaagggataaatactaaattccatgcctttcttgggcccttaaaacaatttattttcatgccaaacctctcattaagcctcctccctttctttttaaaatttattttttattgagataaaattcacataaaatttaccctttcaaaatgtacaattcagtggctttaggatgttcacaaaattgtgcaaccattaccactatctgattacagaacatttttatcatacccaaaagaaacctgtaattattagcaatcactcttcattttcccttcttctagcaaccactaatctactttctgtagatttgcctattctggatatttcatataagtggaattatataatatgtggccttttgtgtctggcttctttcacttaacataatgttttcaaggttcatccatgttctagcatgtatcagtatttcatgcactttatgactgaataatattccattctatggatactccttttcacagtattttaacaagccttattcttggtcttactgtggattataatccattgcagtgtattttatgttcataaaagaactaactgatttagtaacatattttctataattatggctttttagaattgtcttcccagaatggtggctcacacttctaatcccagcacttaggaaggccgaggcaggcggatcacttgaggccaggagttcaagaccagcctggccaaatagtgaaaccctgtccctactgaagatacaaaaaattagccgggcatggtggtgggcgcctgtaatcccagctactcaggaagctgaggcaggagaattgtttgaacccaggaggcggagattgcagtgagccgagatcgcgccattgcactccagcctgggcagcaagagcaaaactccattaaaaaaaaaaaaaaaaaatcttcccagatacaagttggaagagtctgagagcaatttcttcttagccagttattagaagagttattttccagtggattgtgttttatttttagcctgattcaaaagttataccagctaggaagttagatgaactatcgaagagacttagctaaaatcagctctaaagaaaattggaccagtattacagtcagtctccatatctcaggttccacatctatgtattcgatcaaccacagatcaaaggtattcagaaatacaaaaataacaataagaataatacaaaaaaatttaaaatgtagtataacaactatttacatgtcatttacattaggtattacaagtagtctagaaatgacttcaagtatagggaaggatgtgcataggttatatgcaaacatgatgctccttgtcttatgatggatttacctttcgatattttctgtttacgatgggtttatccagatgtagtcctgtcataaagagcatattgaatgcgtgtatcaccatcctaaagtcaaaaaattgcaagttgaacaatcaaaagttggggactttctgtactacaccattttatgtaagggacttgaacatccacagatttttgtatcctcaggagtcttaggaccaatcccctgtggataccaagggacaactgtatatcctttgaaattttaacttaatagattttctactaaagtgagagatgttgtgggcatttggcagatttagaaaagataggaaagcaactgagtatttatgtcttcctatagtcatcttgtgtttttcaaattagaaaggtaaaaactattaaaaatttctttgtctatagtggaatagagaaaagggcatttgcttttccataagttcatgcctcagaatattctaaacaaattttgaaatagccacattgggagatctttaggacactgctccccagattatgaagctgcttcagccactgccttccaaagcttataagctactggaggaaatggaaaggtacataaacatcatcagttcagttagagtgtgttaggcagatgaagagctacaacaaataaggagctctgcatttataagagaggagacattagttgtcactaagggcatcaagaaggtgctatttttactgatcattttgctgttttgattataccccaatttacattgtgaaatatgctcttcccaattggctatagttagatgggactgtcagacatgggaccatgctccctgctatccacactgagactgtaagtctctcctggaactctgaaaccctcagacttaaagagaatggttgacacaaattcattttagtggcctggccagatgtttgatggcctgatacatagcctcgtgaatctgctcctgttcctgtcctttatggaccaggtcttaggtctgtcccttaattctgcagagtacctaatgcatttccaaaaaaatcattctctgcttaggttacagttttagggtctaaccctacatggtgtagagtgtaacaatacaattacattaattttgcaaaattgcatactttattatacaaaatggaatttttgtaaaacagctccacaaattgtcattatctacaagttaggcttttttttttaggataaacatacattggctgcaacaaactcatagttaagatctcacagtgtgattagggagacaagattcaaaatatacaactttaaagagcatttttcttttaatgtcctattatttgctttctgtactttatcatacctgtaaattcttgtctctgtaaaactcaataatctggtggtttcactgtaattctttcagtattaatatattgtggtctgcttgtagaaatatgatttttaaaaaaagttgggcatgagggctcatgcctgtaatcccagtgctttgggaggccgaggcaggaggattgtttgaggccaggagttggagaccagcctgggcaacagtgagcccccatctctacaaaaaatcaaaaattagccaggtgtggtggcatgtgcctgtagtaccagctacttggcaggctgaggtggaggatctcttgagcccaggaggttgagactgcagtaagcagtgattgtgccactgcattccagcctgggtgacagagtgagaccctgtatcaaagaaaaagaagataaaatattaatcatcaaatgaaacagtgcctagaatagtacctggcacaaagtagttaaattaatgaacaagcgaatgagtaaataagagtgatgagcggatagtacgtacaatatactctgtgcatgggctactgagctccacaggagaacatgagcaaaaccacacagatgatcaagtttatacattcgttgtcatcaatctcaattaaacccttaacactgactggctgtcttactgtttccctagttagctgtctcccattttcaacagctattccaaaacttct

SEQ ID NO: 10819 - DNA, 13985 bp, Homo sapiens
atctcaaacactgacagcaattaaaacctcatctccaggccccctagaagatgccaatcaaaataaactgcattcctgagacgcagggccagaaattaaaggcatttaactcctcaaggcccaggggctattgcagaagaggtgggcttgtgagatcacaaagttaatttttagagataaaatgagttcagtttctctataaattaaccattaatgtcaaaggcacactgatgcaagaccagcatatcaacccatgtcaaattaacaaggttttcttaaaacattaaccaactccttaataaaggttacaaagatataaaaggctcatggaagatatatcttatgatcaagattaaacctttatggattgtttataaaattttggaaaactaattggcttcatgctgtttttttattagggcttaatgtttagaaaattaagtcttctctctcaaagaatgaaggtttttgcccttttgttttgaaatccttatcactttggctaaatgaatgacttattttacaatgacctgtaatcctattttgtgatattaagtgtttaaaacctttgatatttgacaaactttctgaaatcaaattatacattatgtctttttctgaactaattagtcctttaagatggtattaatgggttccctaaagtccaaaagtgacatatttggcttttttggtatgaaaattatacaggaagcattgtccaatatgaaatggtgtttggttttctttgggctgtatttgtataaatatgttattagtatgtattccaaaattatgggaaactcctattattctgatatgacacactgtatgttatcagtaataattataatttttatgttaaattattgtgtgctacagaggtaacagaatgtctgactatggctgccctaaaacttttcattattcacagacaattgtcatctttttttggtccttttcagaggtagttttataatcagctataaaactcttaacaggtgttcttgaatgcatgtttctgatagctctggagactgtgacatcaaaatagagaaaaaacttcgaggactcatggagagctgaaatgttcatgaatatcaagcagaacaagaattaactgcatggactaaactaatagaagtttgaagtaatcttttttaactttttgcttaaaatgttgctgataatttgtttttcaaaatcaagaaacttttaagctatttacagcttttaacaatggagtatactcctttgaacaaaatttggagcatatttgtttttaaaactacctgatttctacagaatttggaatctatttgtgagtattctttacttatgacaatacagttatttgcataagtgcaataagaatctgttttcatttgtaacagcacacatttgaagaaactggttattttaccaaggctttgactgaaatagtgtgctttcctttaaagaattaaacttgacttatggagccaataaaaagtcccttggaaaaactagcctcatacctttgtctccacagtccctgtacagggttcctgacctgtggtaagtaaaaaaggtcacttactgacaggcccaggagccccaggtttttgttaggagctcaaaaggagaggaattcacccaactcataggtatttcatggtacaaatccatggctgggctgtgctttaaaaaagtcttctctgagattccttctgtggaaaaagttccatcaaagccaatttaaaagcttatataaaaaataattattcttgctgcactgtatacaaagaattaggccaagtataataaggaaaaccagtcctgccatgatttgtctttcataaaaatgggaaaggggagagagaaaaattatgtttcaaaaactatagtacatctattgttagattctagtcttgtgtaatgtttttcaatttttattattttctacagtttggactgaattctaatttttcttagctacatgtcttcaaaataatgttttcaatttttttccttctttttttcctccatttttccaaatttggagtcactggaaactaagatgtgctttcataaagccctgtgaaatgaagctaaacaacttgagcttcagaagaaaatagcagcgacctatttacatacataagccactttcatacctgcctactgatgtatggacttcagagtaatgtggcatatatctattttccagaattgttcttttgtttgttgttgtcctccccctattttctcttcacaggacatgagacttcacaaccttctaaaaaggagctttcctaataactcaggacctatctatctaggaataaaccatcctagccatgagagatcagacgaaacctgaggccagagactcattttcttctaaaatgcgttctccaacagatttttaaaaagaaaaggggggaaatgtgaaagtattttgggcccctcaaatcactaaactaaaggaaaacttcaagtggggaactgcttagggtaaacctgcctcccattctgttcaaagttatccctctgctcaccaagataaatgcatatatcattgccttctgtggagaggctaattagaaactcaaaaaaaatgcaaccatttgtctcttatctacctatgacctggaagccccctccctgcacctttccagaccgaactaatgttcatcttacatgtgttgattgatgtcttatatctccctaaaatgtataaaaccaaactgtgctctgaccaccttgggcacatgttgtcaggacctcctgaggctgtgtcctgggtgcacgtcttcaaccttggcaaaataaactttctaaattaactgagacctgtgtcaggtcttcaggattcatagtggttagttagcatttaaaaatcaaataacatgaggggctgggccttgatactaggtacagagcaaagtaaatctgtgtgaacgttagacagcattctagatttgggtaacaggtaactcgtggacaactactcagctcttattctgaatgcaccagcactaaactacccctaaatgacctgagaaataagattgacaacacagtggaagaaaaaagcctaataccaagtgactaaagccacatagggcaaattaggctaaagcaaagcttgaaaggtggggtaaacactcacagagttactggtgttgagaattagactgacaaaacacatgcccaagagcgctatctgactctgccaggccatgttgctatttctttggcagtcattgagaaaaaaactaacaaaacaatcctgtcctggtattgctgctgcactggggagaggtgatctatacagaagggagagaaggggaagggacagtagaggaggggaggggatgggagggaagttggcaacaatatcagttctaggaaatggtcagaagagtcactgttcagggcaggaacagtcggggccctgctatttttgtttagtaatcacaactagcctcccgggaaaattctatctgctgtccagcaggctttggaaaagagcccccctatacacacatgcacacacacaggagcatgcgcacacacacacacacacacttatgggagagagaggaaggagacccataggaggcttgggtctttgaataccaaaccaggtaaatgtgtgctttacctatgcacacccaaacacacacacacacacacacacacacacacacacacacacacacataccccagagaggttttactatttatcaagtcaggaataaattttaaattagagttcttataagagagaggaaaattaaatagaacatacaacttttagatcagagaaatggcctaaacacgcaagagtaaaattttctaggggaagtaatttgcttattggttcatttaaaatttctagatgaacacatttcctgccaaatctaattgcaagaaaggtcaccagtgagagaaagcaaaggactcttggtaccttccggctaaatcctcgatatcttttatgaacaggcctccttggtgcttgcacatattcttgcatgccctcagtcggctcttattcttgtacaagacgtagtctttgccagtgctcttattgcgaaagaaattgattccttccttaagactggcaacttcaacaggtgataggcacaacaggatctcagttgtttgttcgatgctatgaaaaggcaaacattttgagggggaaggttaataatgttaggttttaagagacaatcatttcaaactgacagctcaaaaccccttttccctaaaatattttgtaagccccttgcgttccaagtacccaggtttagtggctacctgaggatgcatttctccccaccctgatatgaatgtaaatatacttcttacttgttaaatatgcctctccacttttctagggaactaatagccctcttacttgcctgcccatcgtctgccggttcctctgcctgggtattttgaaagaacagcagttgctcatatcgtttctgttgctcatttgctcccctaaggcattagtcagcctgaaaacaggacgtttaaggtattttcctttaacagttactgatttcctttgacagttttctccctctaccacagctcttttagaagtctaacaccatattcaattctgagaagccactgtgctgtccctcccatctctgctcttgcgcatctggacttcctctgcctggaacgcagttcctctccttcaccacgcagcatcagtcttgggtcaaatagaaacgaatcgtccccttcctggttaagtcttccaagacacaccagaggtccaggctggcattcttggtgtacatccctcttctgtagaacattataacactgtaattggcacactgccctgttgacttacatttaggcacttttgaaagcactctgtatcttccttctccccctaccacttagcccactgcctttcacaggatatgtcttcactagctctctacttaatgaatcacccctcccactgcactcaatttgattaatttacaaaaagctccagccgcaaaccaagcatttgaatcttttttttcttttaaggaaactagccgttacacttctcaaaccccaatttctaaacactctgtttacagtgcaacactgaatcataacagaatatgatttctgccaagaaaggtttcaaaatagcttttgcaaatccatggtaggaaatctgggcacatgttgtttagttttatatttgactccaaacaaaaagtagccaaaattctctttgcatgttaacttaaaactgatttggagcacaagcatatttgtggcactttcagtttcatttttagaagcgctgcaaatttcttaaaggagataaaaataattttaagaacactccagggtagaaaataacagagaaaccacttccaattttaaactgatgaaggcatagctctgtaatattatgatctactttctcaaagcagattctcattgtcacctctgtcccaaattcctagtaattgtgttcccaatggacttgaaattattccaaaaatatgttctaaatgtatttgacaggaagaagccattctaaatttcatgacttcttttttgactttgttcttacgagtacagatatctgacaccaagctaacataagcactgaggcaattcctggaataattagtctaagagtttaaaaggcaaacctctctagatttttgttgttccattgaatgaattcatatagccaaagttctctgttagatttcaacttatatcacaaccatgtagaacaggttcactcaaccacacttttgtcctcagttccacgtgaaagtcacattggagcagaaggcaaaagaaaaaaatatgtgcacctatatacatgcttttctgtgtattgtttaaatgattagcttttccccaaagtatttttaaagatatcaatgaatttgcttctatcaaaatcagaaaaataaaactgtagcaaattcttgttttgctataaaacattaaaactaaaatgaattgccttttttcgaattggttttgggggtagattcgagttacaaaatggccgcccggagcgtgttcggcgcggttcccccagcggtctctggctgaaccggcgctctcgcctccctgctgaacacagcgtgaggaccccccctccatggacatggtgtttgagtctctgggcttgccgaacaccaagtcctctgagttccgcagsgcagcacyggaagcggccgagcgcgctcagcccggcgacccctgcgggctccagacccctgcgccgctkcgccctgggtttcgccgcacccaagacccagcgagtgcagcggcggccgccgaggaggttcgaaaacacggccaaaagaaatgccgagaaggaactgacagataggaattgggatcaagaagatgaagctkaagaggtgggaacattctccrtggccagtgaggaagtcttgaagaatagagccataaagaaagcaaagcgcagaaatgktggattcgaatctgacastggaggagcctttaaaggttttaaaggtttggtggtaccttctggaggaggacgctttcctggatttggtagtggcgctggagggaagcctttggaaggactgtcgaatggaaacaacataaccagtgcccctcccttcaccagtgcaaaggcagcggcagagcccaaggtagcctttggttctcttgctgcaaatggccctaccgccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaggactatgagaaatatttagcaaacattgaacagcaacacgggaacagtggcaggaattctgaaagtgaatctaacaaagtggcggctgaaacacagtctccttccctttttggctcaacaaaattacagcaagagtcaacgtttttgtttcatggcaacaaaactgaagatacacctgacaagaaggtggaggtggcatctgaaaagaaaacggacccatcatcactaggagcgacaagtgcctcatttaatttcgacaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcggaaggtgacagtggtgaaygcaaaggtggagatgaagaagagaatgatgagccgcccaaagtagtagttaccgaagtaaaagaagatgctttttactccaaaaagtgtaaactrttttacaagaaagacaatgagtttaaagagaaaggcataggtactctgcatttaaaacctacagcaaatcagaagacayagcttttggtgcgggcagacaccaatttaggcaacatattgctgaatgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagaygagttgcacaaaattttactggagaaaaaggatgcctgaacacgcgaagttggctgcggaattattgccaagttgctgcttcttccaccgcyccttaaagttagtcagtttttcttctcttctttgacattctaagaacttayagataacctaaaacttttgtgagaaagattaatgtggccaataaaacctttaaatgttaagtgtcaaaaaaccgcactctcccttcttaagaactgcctaaagtgtaaaatacatttgaatgcaatttttggaaaaaaaaaaaaaaaaaactaaaatgaattttaatacacctactttttaacatttcaatattttttcaaatacattaatattcttgaaaataaccattaaaatacatttatacaggggcacgctttttcctttttgcctcagaagtaatggcagtgtggcagtataacatcctgtctttaagttttggatatttcgtttgtcatggaatttgtgcgttcattttggccttaaaaaatattgtgttggccaggtgtggtggctcacacctgtaatcccagcactttgggaggccaaggcaagcggatcacctaaggtcaggagttcgagaccaacctggcctacatggtgaaaccctgtctgtactagaaatacaaaaattagccaggtgtggtggcaggtacctgtagtcccagctacgtgggaggctgaagcaggaaagtcgcttgaacctgggaggcggaggttgcagtgagctgagatcgccccactgcactccagcctgggtgacagagtgagactccatctcaaaagaaaaaaaaaatgaaaaaatattgtgttaaaataatttgttttaatcaagttttttttacattccttaaattttctacaacttaaaagtggtctcacttgtctcaccctaatcctgggctctgttattttctgatgcttaattatgatctaaactaggaactagttagaagtcagcttcatagtcaatgtatgtatctcacctgacttatctccatcctgttctttttctgaagattagtaggaaccagatataagtgtgtaacaaacgaatttttaaaatttacctcactagagatcacagaaaatacctatattaataaaaatgtcattggtttactatgtcgagggcctatggaataaacagtgatgctcttgaaacttattttgaaaattcaaaatctagacctcaaaaaaatacagagaggagtagagttttatgaggtaaaaatgtcattcattcatgctctgatggcacctcacaccctgaagatctcttcaaagaccagtggctggggcttctaagctcagagctgagggagaggcaaggataggaatgatataaatgtcaactatacttgcagtccaagcagggcaaggagcccaaataaagactacttatgaagctagaaatcctccagagggtcataatctgagaaaaagggtggaggaagaaaaggcaactcattcagaattttcagtctgtatgtacattttgctccccgtcttaggtattttgttttcaatgggaagatgttcagtattctgttcaagaaaaggtaaactctatgaaggccaagactacagtgcctgtcccgtggtaggtgctcagtaaatatctagtgaattaaagaatatcctcacacgaacaaaatgtgtactccatggttaaaagaagaaaaattcacctactgtaccctgtgatactcaatatctaaaatcaatcacataagcttccactttaggaaactagaaaaaggaaagtaaattaaattcaaaggaagcagaaaaaaagaaatgaaaattagagcagaaatcaatggaattgaaaacagaaaactaatagagaaatgcaacaaaaccaaatgctggttcttcgaaaagatcaaaaaagtgataagcccacagctaggctaactaatattttaaaagagagagagagggaggatgcaaaaatattaatatcaggctgggcacagtggcttatgcctgtaatcccagcactttgggaggccaaggcagaagcatcacttgagcccaggagttcaagaccagtctgggcaacaaagtgagaccctgtgtctaaggcaggtgtggtggctcacatctgtaatgccagcactttgggaggctgaggtgggcggattgctttgagctcaggagttcaagaccagcctgggcaatacaatgaaaccccatctctacaaaaaatgcaaaacaattagccaggcattggtggcttgtacttgtagtcccagctgcttgggaggctgagactggagaatcacttgagcccagaaagcagaggttgcagtgagctgagatcgtgccactgcactctagcctgggtgacagagcgagtccctctctcaaaggaaaaaaaaaaaacagaccctgtgtctacaaaaacaaaaaatacaatatcagaaatgaaagaagggacaacactatggaacttatggacattaaaaagataataaaggaatgctatgaaaaactctacgctcacaaatttgataacctaggtgaaacagaccaatccattcaaagacacaatctgccaaaacttgtacaaaaagaaatagactatctgagtagtactatatatattaaataaattgaatcggtaactaagaaccttctaaaacagaaagcatcaggcccagaagggtgtactggtgaattctactataattttaaagaagaatttataccaattttcaaaagtctcttccagaagacagaaacagagggaatatttcctgactcattctatgagcccataaccctaataccaaaatcagacaaagttataacaagaaaaaaaaactacaggctaatttctttcatgaacatagatgcaaaaatactcaacaaaatattatcagatatagcaatggataaaaagaattatatgctatgaccaaatgggatttattccaggcatgtaaggctggttcaacattcaaaagtcactaatataatgtatcaaatcaataggctaaagaagaaaagtcacatgatcacatgcatttgataaaatccaacactcattcatgataaaaactctcagcacactagaaatacagtgaaacttcttcagcttgatagagaacatttacagctgggcacagcagcccatacccattaatctaagtgtttttgggggtcaacacagaaggattacttgaggccaggaggttaagaccagcctggtcaacatagcaaaaccccattgctaaaaaataaaaataaaaaagcgccaggtgcggtggcttatgcctgtaatcccagcactttgggaggctgaggcaggtggatcgcctgaggtcaggagttcaagaccagcctggccaacatggtgaaaccccgtctctactaaaatacaacaattagccaggcatggtggcctacgcctgtaatcccagctacttgggaggctgaaataggagaactgcttgaacccaggaggcggaggttgcagtgagctgagctcatggcactgcacttcagcctgggtgacagagtgagactccatctcaaaaaaaaaaaaaaaaaaattagccaggcatggcagtatgcatctatagccctagctacttggtaggccaatatgtaagtatcacttgagcccccagttcaaagctggggtgacctatgatcacaccactggactccagcctgggagacagagcaagaccctgtatcttaaataaataaataaattaattaattaattaattaaaacatctacaaaaaatgagaaagtagaagctttcttactaagataaggacaaggcaaggatgtcgtctctcaccactgcttttctacattgcattgaaagttctagacaataaaatagggcaaataaataaataagtggtatacaaattgggaagaaagaagtaaaactgtttttgttcacagataacatgattgcctatgtagaaaatctgaaataatcaattcttaaatgtgggctgcacatagagacttcctttcatagagacttcctttcaaagagtacagtatggaaatgatgaaaaaaagagtaactttaacagtaaggaaatgtgacaatccgtcaatatcaacggtgataaattatgttagaatgtaactttaatatgatgtggtcttcctcctgcaaacccataatcccagtctaaccatgagaaaaaaaatcagataaattccagtagagaggtaacctataaaatacatggtctgtactccttgaaactcaaggtcatccaaaacaagaaaaatctaagtaaatattacagccaagagaagcctaaggagacatgatagctccttagctaatgtgatgtggtatcttagatgtaaccctgaaacagaaaaagacattaggtaaaagtaaagagacctgaataagctactcagcacattaaggcaagaaaaaaaaaagtcaaacacataaggagtggaaagaaaaaaaatcatttttgaagatacttagaactgactgtatacataaacattcagaagaacccacatataaattataagactctgagagtttagtacagctgttagatatataatcaatagtttaagaaatcaatttattctcacatcagcaataaaaaatacaaaaattgaatttaaaaatatatcatttaagatagcagaaaaggctgaggtggatcacctgaggtcaggagttcgagaccagcctggccaacatggtgaaaccccgtctctacaaaaaatacaagattagccgggtgtagtggcacatgcctgtaatcccagctgctcaggaggctgaggcaggagaattgcttgaacccgggaggcagagattgcagtgagccgagatcgtgccattgcactccagcctgggcaacaagagagaaactccatctcaaaaaataaataaataaataaaaattaaaagatagcataaaaaatgaaatatcaagaaatacatttaacaaaagatgatctctttggagaaaattataaaactctattgagagatattaagtgtatctataaacgaagagttatattatgttcatagataggaagctcaatattatgaagataatcaatttactccaaatttatctgtagatttactatagtctcaataaaacccccagaattttttttttttttttacagcttaaaaacttactctaaaatttattaagatatgccaagggccaaaaagagaaaaaacattcttcaagaagaacaaggtgggagatgagagaggatttgtcctagcaaatatcaagacttattgtaagctataataattaagatcatatagtgttggctcagtggtagataaaataatcaagggaacaggatagaggcctggaaacaagtccacatatacaccaacacttgataagtgacactgtagatcactagggaaaggataaatgtttccactaaacttgctggggtaactgggatcccatattggaaaaatagattggactccttccttattccatagataaaaatcaatttcagacaagttaaaagacttacatttaaaagataaacaatcaagcttttggaaggtatttaggagaaattttttataatcttgggacacggtggatttttttcaacaaaacacaaaaagctctacccaaaaggaaaattattgcaattttagattacaccaaaagaacatatacaccccaaaacacaataaaagagtaaaaaggtaagacacataatgaaaatttgcaacataaatatgacaaaggatttctatgcagaatatagaagaatgtctataaatcaataagaaaaagacaatctataagaaaaatgggcaaaaaggtttgaataggtacttcataaaatagaatatccaaattgtgactaactgtataaacagagctcagccttactagcaatggggaagtgaaaataaaaaccacaatgaagtaccactatacttaccagaacaactaaaattaaaacaactgcaagtactaaatgttgataataggagtatggaaactctcatatgttactaatgacaatgtagtgaggttcaatctcattgaaaaatagtgtggcattctacactaaaacagagaatacacatatactgtcacctaacaatcctactcttagctaagtctcaacactggagaaatatgtgcatatgttcttcaagatacatgtacaagaatgtacatcacagcattattcatattacatttgagtatattacattggaaacaatgcaaatgttcatca

SEQ ID NO: 10820 - DNA, 111469 bp, Homo sapiens
  misc_feature (1)...(111469): n = A,T,C or G, or insertion/deletion polymorphism (see Tables 1-2)
aataatccaggataatccccccatctcaagatccttaatttaaccacgtctgcaaagtccctttggtcatgtaacctagtgtattcctaggttccaggaattaggacctggacatatttggagctattattctgctgaccacaaaccacaatgcgtcttgtatgaactaaaggcctccaaagccccagtgtggagccagaacagcaggcggtgaaagccactatacacaacagtgaaacagccagtgtttgtgcgggttggctttggaaagaggtttttgaccttgtgatagggagaaatactgtcactcttttaaacacacggtagacacacctgtgcatatggccataaagaggatttctgcatattgaaagaatgcatgctaatgctacaaataaacaaatttggactgctctacatctggcattttatgggcgcctgttaacagttgatggaattggctctagtctgtagtgaaaatgccttactggctttctagtgaagcccctcagcaagttattccctaactttcacttcattgaacaacaacaaaatactaattttctggagggagattgggacatatttccagacaattgaacattcttttatgaccctttcattaaataattggcataaaaatgtagctccttgttgggtcagtggagtgtaatgaagttctagaatctaataatcttttggaaatactaccgttattcccattttacagaaaataccactgttttaatgagctgtatcattttttcttcaatattggtgtggtggatggggctccatggggtagcatatttagtttaaaggctatttactatgactccataagaaccaaagaaaatggaagaagaaatatctgtttgatagcggcaggagctgattcctatgaggaaaactggactgtaaatttccacatacctggctttacgggctatgcactagaaacatgaaagcattttttataactcaaattcgcaaatagcatacattattttacacgaggtatattagttatatgaatgagtcagctattacctccttaagtgaaatactttgaataaatgactacaacacttattgaaagcctccatctacttaaacctgcttaaattcactttttcaatcatttaagcacattacaatcgaacaccatttcaactgagtatttcaaatggcactggctatttcagaagacaagctgtgattttcagctgaattgagcaagaggccaaaagtaagaaaatcctgcctttcaacaatttccccagtcttcagagagtcattttcattttcattgaaaatccttcaaaaaattttacaggaccaaaaataatattatttacattatgcagcttaaaaaatgtaacaatagactatccatcccacctcattataagaaaatttaagcggggattattgcatttctataggtaccatgacttggtcaagtgactaaattgttcacccaacagagtgcaggcataaaagttctcagcacctgctattgagaaatgtgactactgaattcttcagatgaaagataatcaatactgacacctatttttattgcatttgcatatgtgatgcaaatctctctgatcacgtgctggccaggctgccatgaaatttaaacctctcagttctgtgtgggtttcctctctgcttatggttagaaatgcattttcctttcaacccctgacttctcaggctgattgttttctctcattttccctacaggcaggactgtcccttataatcatgtacatgtgcatatgtatacatatctacatatatgaatgtataaattcaatatatatttttaaaatagctgggcatggtggcgcatgcctggtcccagctacttgggaggctacagtggcagaatcacttgagaccaggagttggaggctgcagtgagctatgatcatgtcactgaactacagcctgggtgacagagccagacccccatctcagaaaaaagtaatggtacaacaaatacatataatgtcttatcagaaagaactcatctgagaaatattcatatttaagcagtcttctttaggtgcttgggattaaattattcatacttgaataatgtatggatctcatttgaagtttaaaaaagaatttcctcattgaacttcagtccagcattcaattacttttattgtagagaaaattttgtttaggtgaacacctaagcattgccactaagcgtccctttccaagcagtgggatgcagccctgaatctttgcatctcttataaattgcaagtacaagtaggtgtgcaaactctgccttggccagacaggttctattgacttccctctccacctttggaaaagccagctttgctgccattttgtgattcaattattttgttccaggtacgtttgtgctgttttgacttttctggtgaaagggttctaacatctgtctggttccctcattcattaatgactcaaataaagtcatgaacacatgttaacttttatatatgtacgcagtcatgattttaccctttccgaaaattatcttttaacagcactatatttaaatgtgtataaatatataagtaggtaggtatattttatgtgtgtgccatatgtttctaacctatataagccataaaagtaaacatccaaattaagcataaaccaaattctaaagtgcgtaaattttttaaaattttattaacgagtttataatagtgtgttaggcttaaatttaaaacaattttgtgtatttagagggtgcataacccataaaattaaataaagctgacaacattaatttcaagtgatgaagttgccacaattgggttggggagtaagaagatgatttttcgtgattacagttgtactgccattgacttggctttgactttgagcatcatgaaccatcatttgaacggtagtctctgccatgattacattttctttctgaacggtgaatgaactcaatcatcaatgtagtatttgaaggcataatcaatgtaagaggtcaccgtgagataaattaacaaattaaaaatcttaatttaaggaagtgtttttccatgtgcttttgaaatgactacactttctgccaatgaaggcttgcatgagtaaggatcagatccggcaggacttctgcttgctgcagggagacaggtgcagggtgctgccaggtcggcatgcccatatcactccatctgctgagatgactgaagcctagtctggcttgtcctattaaagttgctgcaaagtcttcatttgtacattacataatgacatcattagccttctgttggtgcatagccattacttatgtattaaattggcctctgttcttttacattacagtgcaagacaactgaagaactatattattactctatggcactgaacaaacatttagaatttagagaatgcctttattatatatatatattttttgtttttacatggtatacccagtaagtattatatgtaacataaaagattacatagtttagttactagttatacatgttcttctatgatttcaatttcacattatcataaaaactgaagttgtcaaatttctgcattttgcaatttttaataaaattttttaaatagaaaattagtgtgtttttaaaatttccttctacaatttggtctacaatcaggtgattttttgaagcatatgtaagcaattatttaagtaaagtataactgtttaataccatatgttgtcttaaatatatcttaaaataatgttccattgagtgggctgatacagcctttacactgattcacccctcctttctattttccataaaatcaggctttgagctctgctctgggctactgtcacagctgcctaattgatttcatgtttcctccaagctctctttctaaggaaaataaattttaaaatatcaaaaggtctgcattacgtattcatgaaatgatctatatttttaaggcatatttagcatatcctttccatatgtccagccagttctatgatcagcaaagaaccttgaattcagatttttaaggaaccttccttttaagaatagacataggcaacacccaacaatgcatgatggatgccttggagtatgcatgatgttaagagagccccatgatggcatggaaccccatctagctgtgatatctggcctgagggtgagaagcaaggagagttacattgtggaagggggcaggctggaaaggtgctccaggcagaaggaacagcacctgcaaaaacccagaggcaagcatacacacagagtttttagtgaatggaagccacacttttaattctggggcttaatgattgtggagtggatgtggagcagaacatcacaaagagaaagctggagggtggatcctgaaggacactgtaggtcacgtctaagaactagggctttatccttaaggcaaagggaagctaccgaaaggtttcagtttcaggcagaagagaaaacatggttaagatcaccatttaaagagaaggctcgtgctgctctgaggagagtggttaaaaatgggggcgacaagtgaggagtatttccaggaatgccagaggaatggcctggatcagagctctgcagagcaggtggttcagaatgatcaggcttctgtgcttttaggacgggggactgagagaaagggtgtttgggaatcaaccctggagtaggtggggatagtttctcctgggttataacacccagaggaggggcaaattgggaagaagatggaaaattcaactgagcatgtttggtttgaagggtctgtgtcatgttcacatgaggttccaatgagctgttggttctccgggtctgaagcacaagagacacacatgtagaaggctattgatgtccagaagcaactgggagattctaaaccagggccaggaaacttttcctccaaaaggtctgatagaaaatcttttagggtttgtgggctgtatggtctgtgttgcagctactactcagctctgccgtggtggcctgaaagcagccacagaaatacttcagtgtgtggggagagggtggtggtgttccaatacaagttgccttacagaaacaggtggtgatctagatctggccaatgggttgtggattgccaatgtctttcataaacgatacattgaagacatgggcagatctctgaggaatatgagtccttgcaaatatgcttctgagaggtcagagtataagaatcttctgggaacttatttcatattcagagatttccaacccctacatctgcttcagtgtaggagaacacacagaccagcttgaatttaggtgacggacagagaacatgagcagaaaggaaaattggagaggggccttcctggaagccaggttgaaggggttcagctgtatccagcacccttaagctgccaagtatgatatggatgacaccatgcccactggctatagcaagaagaaagcttcgattaagcagtgggtgcagaaataggcctacagtgggttatggagcacaggggaaatggagatggaaaatagtgactataaacagcttttaaataaggggagaggaaacatggtttttaattggaataggagagccaggaatttttgtttaacgtaggagagacactgccatatttaagcgctcatgaccagaagcgagtagaggctgggtgtggtggtgcacacctgtaatcccagtgttttgggaagctgaggcgggaggattgcatgaggccaaggattcgagaccagcctgggaaacacaccaagaccttgcctctacaatttttttttattaattagccaggtctcatgtctcactcctatactcccaggtacagaagaggctgaagtgggaggattgcttgagtccaggagattgaggctgtggtgagtcatgattgctctactgccatgcagcctgggtgacagagtgagactgtttcaaaaaattttttttaaaaagtcagtagagaggagacttgagcaatgcaggagagacagaagggatgctgataaggtcacagtttggctttcatgggaaaaagcatacttataaaaagagaataaaagtaaagtgtgcagatgctggtaaatttagaggtaagaagataaagtcattccaactgatgacttctattgttcccataagcagggcttcttttcatctgctgagggtaagtggggtgggtcctgggctggtggccccaaagagaatgaagaggttctgctgtagacagtgggagaataaagcaagatggaaagaggagggtttgcgggcagggctccacccccagactcaagtctaattcctcggatgagccttttattatcctctcctgggtggttttcgctttcattcattcagtataaaaatatgcgcggcgtgctcattgtgtgcctggctaccacaagttgaggatgcaaagaccaactgaatgccacccttgctctcagggagacgtgtcatgaaagaagagcgttgtcacacctgtagtaaaagataagccagagttttgcccagagaggcaggcgaacatgggggaggatggaagtctttgacactttacacgcacaccctgcacacccagccagaagtgggcagacattcccagatataccctgttcctcatgcccctcgatgagttaaaagttgtatccatctcaagaagcctaacccaaacctttatgtgtctttcttctcccatgaagcacttggtgtgttgaatcccaataaagcatcctctgtactttccggcccaaccttttatcatggggcaaatgagattagagatggcaagaggatgctgattctaaggaaaacagaaaccaataaagaaagtcatctaagaaaactgctataagtcatcattcctgcatgacattttcttattggaaatgaatgatcctgagtccattatgatgacaaaaacagaaacaagcaacagagaaactagaagctaaatctatcctgcatagaatcacttaattctcatatcctcctgtcaaataacgttcaacacttctactcacaacaaggatatcaaatcaattacatgaattgatcgtccctttycaggaccatacgtttcatgaataatagagatgtatcttaaatcaaaagatcgttttctattccccagactcacaaggtaaaaccattatacataatggatcaaattaattgaattattacctgtaacgttaccagaaatggttttcacagagtgagctataatcattgtcagtgggattaattgcattgattctatgttcattttttaaagacagctacacaacattagtttttgggataatcagtaaatgcatagggaatcagaactatccacttggctggttgttctaaactctgtcctaagcaattattcaaatattcacatacaacagctgaagtttatgtccttcacaggctgaaatgtcctaaagtcccatttcactgcacgagctagccattcctggagcccatcacaccggccacagccagtagttcaggaatggtgtataaatccaaccaagtccttcacaagtctctgcctcccattcaagagaataagaaaaatgcctgcatcttcaggttcacggggctggaagtatttgatactatttctcccagccagtagggcagcttcaatattacctcctacaagagcattcatcacacacactaagtagcctttattctgcaatctcagcaattatttttgtctttgtaatgtgctttatttttataacacttagtagaaattatattgttattaattttcttctttattgacctgattctccctctgcaatgtaacccctgcaacatctggaaacttgttctgttttctttctttcttcacttaaccttagcacctaaaactgtgtgtggttcctaagaacttgagatatttttaaggaaagaaggaattcctgagactattctgtgatgttttattttccatactttattattgtaatattaaaaataaaattactttaagatatggtattataggtaataggcaatatagattaagtctaccctcattaattgctgcttggaatgtgcagtgatacaatcattttggagaagtgttagtgtctaataaaatttccatgtgatccagaaatcctacttataggtacacattcaaaagaaaagaatgttcacatctacaaagaaacgtatgcaaaaagttcacgatcactttattcataataactgaaactggaaaagacccaaatgttcattaacaagataatttataaacacattttggtctcttcatgcaatgaaatactagtcagtcatacaaaaaacaaactgaagagagattcaacatggctgaatctcaaaatcattacgtggaggacaagaagacggacgcaagagttacgtactgcatgattccattgatgcagaattcaagaatagccaaacgcagccatgttgagggatgtcacagtagagatcagatcagggaaggggagaggagcaggaactggggcagcaaaatgtttctatttgtgtatcttggtggtgttatgtggctatttacaaatgtaaaaagacatgatgcactaaacagtgaaggttgtacttgagtgcttataaattcttcttcgatatataaaacacaatggggaaaaaaatggaagggctggcacataggttccatctccccatgtgcaaaaatcagcttagaccagcttcttttgccagctgagctcatcagagagaaatcccagccatggatgcttctttctgaagcctccctcacggggaaaactcagggtagtgatgttagaattatttctttggggtcttcctagcccagtggagccactatgccttctgaagcctcagaatgtcatctggaaagtagaacatattttgatatcatgtgccaagtggtttaaatacagaaactctsgtgttcagaacatccctgaacattgtgtgatcagctctattttctcaatggtcacaccccaagcaaaccgttgtcctggatcacctagcagaaggaaaagaatacctataccagataaagtcagagttcaccagtaaggacataccgttctatgaaacagtttgcaggaaagatgctgccctgacgatgcagcctgagagtggagtgtctgtgataaaggtgagttactttaccctatggtctagagcacacatagtcacaaagctgtttctgtgaggttttctttgtcccattttggtagtaaaatatttacatccaaatgggtccaatgaaaggaaacatccaatagtggatgcatccacagctcaaccatcattattcttatgtggatggaagtctacttccattatgactggttgtagcaacattttaaaaaatattatcataaaatcattgcaacagacaacatgtcatttatttaaccttttaagtgtacaattcagtgacattaatgacattcacactgttgtgcaaacatcaccactgtttctaaagctctttcatcatcccaaaaggaaaactctgtacccattaagcaataactcccatcccccacttgccccagcccctgatagcctctcatctcctttctgtctctgcaaatagcaacagtcatttttgatggggtttataggagatatcaatttcttagaagtcaaggttcacttcagtgcccttggttgaagatgcccaaattaaggtctttttgttccccactctgtcaccatagacattttgacaaataactgaattactttgtcatgaaacactaacatttccaggagagaaaataacatattttctcatcttaaggggttgtatttattttcccagtacattgctctgtcaattaatatatgtgtgcatgtgagtttgtgtgagtgtgtgtatgtatgtgtatgtgagtgtgtgtgagtgtgtgtgtgtgtgtgtgtgaggtatacatggtagaatgaactatcttctatcagagtctttggtatataaaaatacattaacagcaaaatcacttctttgccaacatctaactttaaagataattatggacaatgagacacccaccaaaccatcagtactaagctatatataagcaatgttctccattccagagcaagcctgcagctgggagacctaattatccccatttggcacagcaagagaggcaggcatcaccctgttaccttcagcttctcctgtcttaacaaactgtatgacatcwctcagagaagcggagataagattcttttttaatattcacttcttggaagcccataatccatttccagcatataaaggtgcagcagtttaactgtttgtacctgagatggagtcctgctgtcagatgcaaaagctaaaggtaataatctcgtgacaagggagaatggcttcatcaaagcaaatcttgctctgctttcaagatttcatccttcggacagtttgtgttgcatattaataatgtcattttgtatttcctgttttcctctagtaactgactatatatatttttttctttttattttttttgagacagagtctcactctgtcgcccaggctggagtgcagtggcacaatctcagctcactgcaacctccgcctcctgggtccaagcgattctcctgcctcagcctcccgagtaggtgggactacaggcgtgtgccaccacacccagctaattttttatttttagtagagacggagtttcaccatgttgtccaggctggtctcgaactcctgacctcaggtgatctgcccacctcagcttcccaaagtgctgggattacaggcgtgagccaccacactcggccctgactccatatttttattgtatattttgcaatggtaaaattgggctatgctgacttgcaccagggagcaaggatattaatctataaaaaagacagggaggaagaattgactcccccaagttctcagaaattttctccctgtgatttcttcctctcattgctatcaccatcattttaatttttttatcaacatgcccttttcacaagcattcttttggctacagtaggcaagctgttgacatcttataatctgttcatttgaatagaaaaatgtctttctaatattcaaaggctcttttcacactcttgtacccttggctaatttaaaactttatattattgcaattgaatgtgactagttattgaaacaaatcctaatgattaactgaatttaagtgtcattctttttcctcccccacgctttttcctaataatgcttccggaggtcacctggaatggggaacttaatttgctaggtttagtatctaatcaaagcaattgaatgtgaacttaattcaggcctctaaagggaagggtttattcatcctttgccaaacaacagcctttccttttaaggacaaaagacatattcagtacttcttgtcctttctgatacagcgtgcagggttactatttgtagaaataagtagaatgtgagtgtagggatatataatccccaagtggaaaactttaaattagagaagtaaatatgtggctgttttatgggtcttgaaaatgagtatcttatggggtctgtactctttatgctttcagggtatgtgttgatttttaaacatgccttaaaattttcaggaatgcagctgtaccataaagagaggtgttcttggggaggagagaattagtttctgtgggcactggatgttgcctgtacagtactgttctccaataatgaagcattgttttgagcaccaactctcaagtgaagatgtctcttattagcactaacagctggaattgacctggtntgggaaaaatagtatcccctgtaatgaaaatcctatttgccaattcagcaaggacagctaaaagggatggttacagtcattctcaaatagggtttgtgaaacaatgaaactatgacactttcatgaaggaaagagcttcccaaagggcaccttctttnacaacctcagacttcagagctcagtgatgtcataggcacccacatggatgagacttttctttatgcttttccaatggactgataatgattttaaggcctgatgggaattaagaagggggcactgggcgggacacttcagcttcctagagaaccctaaagacggggttccctcatcccaactgcatatgatgtagaagttttcaatcaccattagagaaccaattaggctgtaatcagtagaacaaagtgactagccagttcacaagatcagaatccatctgtactcacaaatgaagattgagttgagatacgctgtctgtcatcatttaagctaccccataagtcattgtgcaaacatgacataagtaaatgctaattaaactcaatacgcatttattgaccactgagtcactggactggaagttccttaaaagcaaggactgtgcttgttcacctttacatcccaaatatcttgcatcagggcaccataactggttcattatggggctgctgttcttgttatatattggacactaaaacaaatgaatggatgctaatctcaaggaattcacactgtgaggcataaccagcctcataaacagcttagcatcatacctgtgctttataaattatagtttacaaattacaaacagaaatagagaagagaaagccatgaattctaccttggggcttgaggtggtccatgatgccaaattagaactgagtttgaagggtggatgtaagttcatcagtgagagaagggaggaaaggaggcagctttccacagagcaaatgcatggaaacctgagtgtgaatggcttcatcaggtaacaatgaagtgtctgtcatagcttaaacccaagatttgaaaatggggtggctctacattaaatgaaatgaaaggatatgatctgagtttaaatgttcttgaggctgtgcttttagttttatgtagtgggaagccattatatactaagtgagaagagcccagatttagcaagccaaagagagattatggacataattcaggcaagacacaacttgtatttatatagagtctggcaataattttggggacaaattgcatggataaacacagtagaaatagaattgagtggaccttgtaacctatgattgatggtgtgaaatagagggagaggttgaaggtgacagaagtttctctcttactccagaatattgttgcccctgtcttgcctctgtatctatactatccccgacctctgaaactcaggttaagtaagaatagcccaagagattttgtcaccaacagccaattgttcgtatttctgctcaaagtttgctgagaaagtactgtttataattatgccaaagtcttagcccaatgcaataatgttccatgaatgaatagtacttttttgaaggaagtagagaagggatcttgcataaaatggggcaataaagagttcaccttttgaaattccagaagccttagataattcctcacagccagggcatcttttcacctagaagatagatatactcttgatgcagcttagagcatacaatttatttaactctgaaaaggaatgaggtgtccattttcctaaaaagcacaggattaaatgcacttcttgctaagaaagctagaagatgcacagtcagatgcaatttgtgatacatgcttagcacaagacaggaacacaaaggccatgcttataagatatgtgaaaactcttaagaaaatgaaaaacaaaacatttaactggacaaaatctggaaaatgattgatttatgacaagattatgaaggtatttctcatcctggaatggaggatggttgacgtcttctaagggagcacatcagatttcttggaaaaagagagatacatacacagacacacacacacacacacatatatatacatacacacacacacgtgatatatatataatttgtgaatgcacctcctaaattgcagtttctttatttgtttttattttgcaattttgaatgacattaagtgagagcatgccacctttttgcctattcccatgagacagttccttcatatttcttttttctttgcatggttggggaaattggtataaacttctttggtttaattagcactacaaattaaaatatggctttgttcttttgcagcattaatcatccgtttaattaatcaattaattaattaattttgagatggagtttcactcttgtcgcccaggctagagtgcaatggcgcaatcttggctcactgcagcctccccctcccgggttcaagcaattctcctgcctcagcctccccagtagctgggattacaggcgcccaccaccatgcccggctaatttttgtatttttagtacagacggggtttcaccatgttggccaggctggtcttgaactcctgacttcagatgatccgccctcctcagcgtcccaaaatactgagattacaggcgtgagccaccgctcccagcccagtttcattcttatcagccttactggttaccgaaatccaagtgccaggaactattttccatgtagcgaaatatttggctgcatagtattaagaatttagaaattgatttttaaattttgttagcctgtgtaatttagctatgaacaagcagccttattattagttatcttagtctaatgaaaaatatacatgtcaaaatattttggaaacagttaattacaatggtatcagttttatcttgagcagataaaaatcactgtgttgattcagtacagtgtaatgtgtgggtctttaaaaatagcttcttaactaatgcacttaaagagattaggacacttgataggacttcttttcagaagaattcttgaatttcagaaagtgtgaagatgtgctaccaatttaggggagaataatcatataacaccatagccaaataaagtgatcttaaaataccaatttataagaacgtgtaaatttaattatttagaaaagcaaacattcatttattacctaataaaaacaggagacaaatgtcgatgaactcttatgaagcattgtctataaagccaggctcttgatctgaactggggaagagtctccagggggattttgagccctttaaaatatatgcaaattttaacatgcatgttctagaaaaagttccacacctagatggatgttaaaaactttatctaatatgtgtcatctttctgggttgccagtgctgagaccacctctgtctccccatcaccccaccttgcacctagaacatactagaattcaatgcatgtggagtgaatgggtggaatgtcaaaacttggaaatgatgaaaatagaatccaagtttataaatgaagagagagaattatctcattaactgaagaagaaatttagcagcaaggtggtcactaggggctggagaatttgcaggcagccaggtaaaaatgaaagcaagaagatgtttaaataatgcaaatgtaatggtgcaatttgatgaattctcactatgggtaatgtatgtatgcaaccactattgagataagcccgcagaatatgctcatccacacgggacccccaccccatgcttactccttgtcactacctccctccctgcaggtaaccacgaaactgacttctgacactataagtgacttgaatctcttccgaattttatgtgcatgaaatcatagtgtgttcttttcgtgccttctttcacttggtggtaaatgtggaggttctttcatgaacctggatgcagaagtagttccttgattttcactgttgttgcagcagtcggttgttttcattataccaccatttattggcccattctgctattgtaagatatttggattattgccccttttttctctattacaaatagtgctactctgaatatgccttaaaaactttgttttggaagtgaaattcacttaacatgaaagtatttattgtaaagtgtacaatttagtggcatttagtacattcaaaactgttcacctgtcacctttatccaggtccaaaatattttcgccaccccaaaaggttctgaatatccttgtgcatgtttttggtggatgtatgtatgcatttctgttgtgtatgtacttggcaatgcaattgctgggtcataattatgggtatatttttaaatagctatcataaaactgccatgtagcttagatattttataggataacaccttttgggtttaaaaataatatttattcattttagccaatttggaaagcatataaaaacataaggtagaaaaccataaagaataaaaattgcccataatgctcacattcagagagagccactattaaggtttcaggatattctagccaattttttacatacacattttagtcactgcatctaaaccattttgcctttacttaatagtgaattttgttttatagcttttcctttagaaaatattttaatggttcagtaattattccattatacatatctaccatggtttattttcctatttttagacattcaggtcatttccaattttctactgttttagatatcagtgaggcgaattaatgtgcatctatcttcgtagtatatacctttgattgttttcttagaattacttcataaaggtggaatagctgggactaaggttagcatcagtcttgaggtttttggcatatatttccacattgctcctagaaggagatatcagtttatgtctcatattaaaagtgtatgaaatgtaatgaatcaatatttcactgaaacttgactcatgctggtggtctagaaaaagttctctgtcaagtcgggtagcataggttatactgggaattacatgtattctaaaatacaccagccacattatctatacagaaatacatgattttctagtggtagagatgaaaaatagaaactttaaacaatagtagaatgatttgaaggaaatatcatgctgagctacaggcattgtaaatacttatcagcctagtagtaaatagaatgttttggaattgtccccgatgaccccattctcatctaaagcacttaccagtaatttactattgatacaaatattgatgctgttcttacacctttctaggtactatgtttaaaatataacacaccatcccttcactcaaagtgtgcaatttagtaggaaaatcttactttaagtccataaaatggttaaacaacattataggaaataagcattcatgacaagagtaaaagcatttttacaagggatttgataacagtaatcccatgagttccaaagatatatgactgttataacaaaggagatagaatttgaacagatttgaagggagggaaaggattgaattgctgaaagtgggagaggtattctaggagttttgaaaagcatgaacaaaatctcaaaggagaaaaactcaagacattctagaaaagtgcaattaaaccaatgtttccttggatccaaggattaatttattttaaaatgtaaattctgggactagctaagtggattaagaagagatggaacatattggagctatgtggttaagagcacttagctcactgtacattagtttatgatactgctcttctcctgtgggccgagatctcaggcaaatgggagaaggagaatttaaaggaaaagagtggtgggatgcatcaggaaggagggcttttgaagtataatgtgtggtttggtgattgcaaggctagatgattgcgatggacataaatgtcaccctccaggaagtcaaggggccagggttgggaagaataataacaatgctgagacaaaagtatgcaggtatctcttacctgtttaataattttgcctcttgcttgtcatggtcatcatgattgctcctgaaatgggtaaaggttacctggtgaggagaatagaaagatactgtgccaaatgcaaatttgtcttgcaaatttccatatgcacatctgttaaggaaattatggtagagcatcaaatacatttgcttgtgtacagcagccaagggaatgatggaaatgcatcaaagaacaggcaccagagagttcaaaatgctacttctcccgctatctacccgtatgcctccccaaaaaactttgtcatctttggaagttatttgggtaccagccatttactctgaaaatgaatattttttttwaaaaaatacacatgtatcctgacttttttgtttggatttttctccaagataacctgatggtcaatggtggaagtgtatttgttttagaagaatcatactaataagtgaagaatgaatatttgaaagagaaaattgcacttgggtacttgccatgttattttatggtgtcattgatatattgatgattacatattatggtgtcatgatatatttatttagatcaaggcaatgatcatcaaaatctgctaaaatctttaggtgataggttgataaagaactttgaaatagttccatcagggtgacccctgcagaaccacaggtcttcttggtaattattaatcttcttcctgttgggatacaatgagaagtacctagcactaccagtaagtatgaatgccaaaacaaattgtcctggtatctaatcaagtttctagaggtaattgggaatatatagacaatttattctataaaaaagtatgtaaaacatcaccacaaaaatataacctgcaaaatttaaaatgcggaacatttttatagaaaaagatgactcagattcttacagaaataaatgacacagaaagaaaaaggcagggggaactgctatcgatgaaaataaatttaggtgatgttttcaccaaatgaatttttattaaaacaaattaactgtaaaaactgtattttttgctgaaagtcaagaaaaaatgaacacgattggcattaggtgatgttaagaaacaattgttaattttgtttgatgtgatattggtattgagtttttttaatcctttattaattatagacagtgaaaaaaattaaagatgaataatgatatgggtggctgccatcccagaaccaagggattcctgagatgtgggagtttcagtgctaagatcagaatagtcctggacaaattgggacagtggatcacttgatttctgagatttgttttaaaatactccactaggcctgggcgcagtggctcacacctgtagtcccagtactttgggaggccgaggcaggcagatcacctgaggtcaggagttcgagaccagcctggtccacatggtgaaaccctgtctctgctaaaaatccaaaaattagcagggcatggcgctgtgtgcctgtaatcccagctacttgggaggctgaagtgggagaatcgcttgaacctgggaagcagaggttgcatgaaacagagattgtgccactgcatgccagcctgggcgacagagcaagactctgtcacaaaaataaataaataaataaataaataaaatgctccactaaaggaaaactagatgggtaggacatatgaaaaatgttgatgctgaatgcactgggcagagtaccaggaggtttgttaccctgtcctttctatgtggggctaggtttgagaatttccgtaacaatacagtttctttaaaaaatatgtttccacttttaataatggcttgcacttgtttctgaattctaagatcatgttttctccattttatcatcctctggtgatgaagggaagagtgggaatcaaatgtgagacaaaataagaaggaatctccaggaatttttgggaatgacgcagaccacacagtttgttatggtgagaacttcttgcaaagatgcatgaaagtgaagaaacatccttctagttgcactgtatgttttcaaactggagacatgatgccagtaatttatttaaaggctagacaatggcaaactcaagaaagagcttatttacagagaacattatttgaatctgagacttggtataggctcacgttggaattacatggccgatacgcttatacagcatctttttccaaggaatactatcaacagcaaattaattctgtgctgctaaacctgaagtaggcagcaaacagacattttctgagacactgaactggaactttccagttcaaatggcagtttaatggcacaattcggaagggaaacagagacccctgtcacgtaatctaatatttggcaatgtttagacaaatgtttgggcaactttcaggtcaatgtttgacaagtgtttaggtgattcattctaaaggaggctgtcaaatgccaggttgccagtatcatgctaacgaagtcaaataaaatggtgtcaggagttacagtccgccccaaatatttttactctcttattgtatatacattgacactgtattgatttmgataaatcctttaagatgtacttaaataaagagaatgggaagcggccaagggaaaatagcaaaggtacctgaaagctacagaagtcaaataggaaggagagggaagtctggaggagacatccattgcctgcagcccagggccagagtttccttgcggtaagtacatgatgccttgtccagaattagggtctcagagaggccatcagttctccactcagtcctgcaagcagttcctgaagttctcaatagcagaagcagaaaggactggctgggccctctggtctctgcagaacaatctcataactcagtcattataggctgtgtgtactcacgagcatgtgctctatatgtgctcatccaaaaatccacacactaactaggacaccaaaactatctcaggtgcaggaaaccacaaaacatcacctaagaaccaagtagcagcagaggggagtgatgtgggctttttatctgaagctcctaacagtgccgtgggtgagaaagtgctgggattctgggtcattgattggaagcagccagcttggctttatttgactgactctagactccttgagagtctgataaaagggataaaatatgaccctttgtctaggatggcatttgggtgagtgccgctgagatctgccttgtgggagctcagcaaacaagtctgcatttaaaggaacataccatgtgttccaaaggctggaggagtcggctctgcctgctgaaggccagttttggggtttaaatatctgcagcgccatcaccagggcattctgagacatacatgatctttggagttagtgtcaagaattgggaagagacttacatggagggaacacttaatctgagatccygatgacgatgataatggtgatggtgatgatgatgatgatggtggtaatgatggtaatgatgggatgatgacaatggtgatggtgatgatgatgatgatgatgatgatgatggtgatggtgatggtgatgatggtgatgacaaagactagaagaaatcagtgcctgtaaattccacgccaatactccattctgaacaccccaaataaatagggaactcaaagcctaaccaacccatctgtccaaatgaattgagaatgtgctccagggacagtgaaaggatgcaggtttgaagcctgagtaggatggagaagcccagaaaaggagagtgaatgtattggattatggtctcatcttttcagggcccctgactgctgcagtggggtgtgccttctacaaaacttctctgctcagctggtatttgtgtttcttctaacaaggaaagatttgtccagggtagcctggagcattaccgagtgcatggaccaagggaagagacagacctttgctgaaacccccagaatctacactttgcttgttctgggacctaaatcacaaaacttcgtagtcaaatcctctgtttttggattgtcagataagcacaatggaataaaatgtgtatgtttgctttgtacacgaaatgggatacaacaggcatcaatatatgtgtgctaaaagaatacttttttcttttatttaatagtaatgtataaaatctaatcttgatgagactaatagtcagtacaaaattggcaaaaaaataaggtataattggcttgatattccatctgacggagcagcaaagcataggaagaggggacttgggagctagaaagttcctaatttccttagggttgggcttcttcttgaatgattcatacaccacatcctcattttaagataatcttaattaacaagcaataataactaatcaatgattttttaataagcacctactatgcttcatatgtgcaagattaggcaatttcatgctggcttcctcttttactactgagaaccaagtgggtgaaattataccttttcttagaaaagaagcaattgaatgaggcactgagggttttttaaagagcctataaagtttctacaacttcaaagtaacagacctcactggcttcacagatacaaactttttcagattaattctgaaaagttaactaagtgtatttttgcaacgaattatggagtatatatgaaaagaaaatttgttttcctttcttaaacgtgtatgtacatttttcatgtaatatgtatatgactacatgtccttatgtatatattagtcattcatgtaagtatattaggctcaggtaaagctacatagttttttatttaaataaagaaagcctttaaattgagccataatttgctgatattatatgctagtttggcaatttcgccaaattttgctcattttttcttttcattgtttgtcaatatttatatgggttacctacctatgtgttgctgcttcagtaaataagaaaaataataataattgtgaactgttttttaagtgaactatatgggaaaaatgagtcacatatctcaagtataaagataaatttctgatgtaaatatctgtgtctattgtcaatactgattttaaagtctccctgcccgacattggtcactatagaaacactgttttttgtctacttgtgtatatacatatatatatacaaatatattatatatatgtatatatatatatacacacacacacacgtgtgtgtgtgtgtgtgtgtgtgtgtgtgtgtgtgtgtgatctagaacatggaaatactgccatctggtgttatatcttaaacattattcaactgcccttgagaaaatttgaaataaatcttcagatttctagccctcgggttttgctaagcagggaaagctcttagtctcagataaatgtgttcttttgtttctcaaaggaagaggattctaaataccgtatatgttacattcaattaatgaatatttgaattaagaatccaacaaagcagttacaagatcatttctcttcatacaaaaggatccttctttaagtctgacactgcaaaattttttttgctttgatctcattgcacgaaaatgttattcagttagcccaacaattttgaaattattatttaaaagcntttaatatcatgaatgactatttgcatttgtaaagttggtgttcaaaatgcttttcagctacaagagacagaaaagggcttatggccttcaaaagggaagggatttatcacccatgtgtctgcaggcccctatggctaaagcaggaacctgaattgcctgagagtccattttaagggaattggatcaaccctgtacaaccatcatcagggcagtctggcacatgcatggtctttggagttagtgtcagaaattgagaagaaacttacagggaggaaacgcttaatctgagatcttgatgatgatgatgatgatggtgatgatgatgatgatgacgatgatggtgatgacaagggctagaagaaatcagtgcctgtaaattccacgccaatactccattctgaacaccccacataaatagggaactcaaagcctaagcaacccatctgtccaaatgatttgaaaatatgctccagggacagtgaaaagatgcatgtttgaagcctgagtaggatggagaaacccagaagaggagcgggagtgtattggattatggtcgctttttttcagggcccctgactgctgtcatggtgtgtgccttctacaaaacttctctgctctgctggtgtttgtgtttcttctaacaaggaaagatttgtccagggtagcctggagcattactgagtgcatggaccaagggaagagacagacctttgctgaaacccccagaatctacactttatttgctctgggacctaagtcacaaaacttcctagtcgaatcctctgtttttggattgtcagatgagcacagtggaataaaatgtatatgtttgccttgtaaactaaatgggatacaacaggcatcaatatatatgtgttaaaagaaaactttcttttaagttaatagtaatgtatttttcttttaagttaatagtaatgtataaaatctaatcttgatgagagtaatagtgggtacaaaattggcaaaaaaaaaaaaaaaaccccacggtgtaattggcttgatattccacctgacggagcagcaaagcataggaagaggggacttgggagctagaaaattcctaatttccttagggttggtcttcttcttgagtgattcatacaccacatcctcattttaaagataatcctaattaacaagcaataataactaatcaatgattattgttttaataaacacctattatgcttaatatgtgctagattaggcaatttcatgctggtttcctcttttagtactgagaaccaggtgggtgaataattccttttcttagaaaggaagcaattgaataagatattgaggttttttgttttttttttttaagagcctataaagtttatgcaacttcaaagtaacagatctcactggcttcacagatacaaactttttcaggttaattctgaaaagttaactaattgtatttttgcaaccaactatggaatatacgtgaaaagaaaaattgttttcctctctttaacgtgtatgtacatttttcatgtaatttgtatatgactacatctccttatctatatattagtctttcatgtaagtatattaggctcaggtaaagctacacagtttgttgtttaaagaaagaaaacctttaaattaagccataatttgctgatattatatgctagcttggcaatttcggtaattttttccctcatttttcttttcattgtttgtcaatatttatatggattacctacctatgtgttgctgccttagtaaataagaaaaaaaataataattataaactgtttttaagtgaactatatgggaaaaatgagtcacatatctcaagtgtaaagagaaatttctgatgtaaatatctgtgcctattgtcaatactgattttaaagtctgcctgcccgatattggtcactatagaaacaccgttttttgtctacttgtatatagatatatatatgtctctgtatgtgtgcgtgcgtgtgtgtgtgtgtgtgtgtgtgtgtgtgtgtgtatgtgtgtgtgtatgccctagaacatggaaatactgccatctggtgttgtatatcttatacattattcaactgcccttaagaaaatttgaaataaatcttcagatttctagcccttgggttttgttaagtagggaaagctcttagtctcagataaatgasctcttttctttctcaaaggaagaggattatgaactgtatatgttaaattcacttaatgaatatttaaattaagaatccaacaaagcagttataggatcatttctcttcgtacaaaaggatccttctttgagtctgacaatgcaaaaatctttttgctttgatatcattgcatgaaaatgttattcagttaacccaataattttgtaattattatttaaaagcttttaatatcatgatgactatttggatttgtaaagttgatgttcaaaatgcttttaggctacaagagacagaaaggggcttatgaccttcaaaagggaagggatttatcacccacktgtctgcaggcccctatggctaaagggggaaccttaattaacttcctgagagctcgattttagggaattggatcagctctgtacaacagtggtattcaaacatttttacctgaatactctctaaaagaatcttgccaacctgtgcatctcccggcacattttagttacatctacaatttgacatcataattttaactagatggaaagaatgaaatttctggcatattccaaatgtaaatatttaaagacagagctgcaacatcacgcttttaaacttttccgatgtaagctaattatcataacagtttgasacctgttatagttaattaaaatccctaaaaatgctcttctttaacaggggagaattttcaatcatttgtttttttccttggggtttaatttctattctgctctcctcagacaattttatcttaaagttatattattwgatatttgaaaatcttttattgataacttattttacttacctaaaacaaaactgcatcaaattgtaaatatttacttttcaaaaattcttgcaaccacaagactctaagagtttaaaaactttcctgtagcttgtgttattaatacatttattattatcacatagttaatcaaaacaacataagatacagcatttaaaatataagtatatatgattaaaacataaacattgatcatttttcaataaaattcattgacatgaatctcttaatgggatcagtggaggtttcctccatttttctgttattatttatttacatattcatatataatggtctctcacctttggcactattgacattgggggctggataattcctggaggggagggaggactgtcctgtgtattcattgtaggatgttttgctgcattcctggcttctaccactagatgtcagtagtatattcctagttgtggtgaccaaaagtacctccacactgccaaatcttccctgaacaatccccctcctcatgagaaccactattgaccattccttcaatttggagaacacaaagatttggaaacactgaatttcaaagggatttattactcattactatgagtattaattttacatgttaatctttcctatagagggatttttttattccaataaacacagggttgagaacaattgtaatattgttgaattataataagcctttcccaaggtgatattttttaaaataaaaatctactttatgcatgtttttgtcaaaatcttagatctatgtgcaaggctttccaatatatgggaaatttcaaattagtcctcttttcagttagcaaatcagtcctcttttcgaagtactcaggccaggcatggctcacgcctttaatctttgtactttgggaggccaaggggagaggaatccttgctgccaggagttcgagatcagcctgagcaacacagtgagattctgtctccacacacacaaaaaattttaaattaagaagtgagccagrcttggtggtgctgtagtcccagcttctcaggaggctgaggtgggagaattgactgagcctgggaggtcaaggctgcagtgagctatgatagcaccactgcactccaacctggatgatagagtgacaaaacaaaaacaaaaacaaaacaaagtacttaaccatatcagacctccttttgtcaaaacagtcaggctaaatagttcaattcaaataaatgagctactatgcctttcataaaacatgataagacctactgagaaatagattacaatagacatttttataagactgattaacaaaagcaatcaacagctaattaaatgagcctatccactttttattatagactacataaacaagaataaatctgtatgttgttccgcattttaaaatttgcagtattgtagtgtgatgtaaaaaactacaagttcttattaagcagggaatatgataaatggcataatattcttttggtaaatatgggtgttggtgttaggcttttgggaataattaattaaggaccatctataataattcagacttaaatctactaattctgttaggcattatgatcttacttttcctgtttgttgcataaaaaaaataaagaatacaaaactaaaagttaatcagcccagtagcccatataattttatgtgctattaatgggagaatattaaacattttataagatgaaataacatgggatcgactataatttaagtatatatagtattatgtgttttggtaaattaggtttccattggtattgaacaacacatgaaatctaaaagaaatcatgtagaatatttttattctgcatgttttaatccaaagtaacatgaagatctggtagatccatacatcatcagttgcatttgatcaaatcaggattattaacccatactagttcaggccttgaaggtgctttgtttttattattatatggctaaaggtattcttcttcccaataaatgacaccattggactgtatgttgagacctgaaaagaattatttacattgcaatccttaaggaaaatgacttttctagttcaacatttcttcatatagctctttttgctttattactggactctggtgagatgattgaggatgacggaaaagctgaggttgagattggtgaagcaaactcaccatcaggctcactgctcatattctgtagtgtatctcaattcaaaaactctcagtcagggcccaaattcctcatttctgactgtacccctcccccaaaacaggacagagcctgtgtacagagcccacattttaattatacttagtttccaaaccaggtagtgcttttatatacactttccagtttccaaaatttgctgaaatttcctctactcctgtcttccccattctgtttgttcctatgcattaatacattgatttaacgtcattatcgtgaacttcgaaaaggagaggaaatcatatatgtggttagtccaccacataagcagacctcttcatctttttgaccctcacaatttagatgttatttaaaaatctagttgatttcattcataactatctgcccttaactgctcttagaatagtttgaatttttataatctcacccacctaagccttttcagtttcctagttattctatgacagaagattgacagcatttaataattcttacaattgtttcttcctttgagagaaaaaaaaaagcttatcaacagagtaagaaggtaccaacaaactccttttaggtagggcttgcaaactagagcttgtgggacaattctggcccacttcctgtttctgtaaataaagttttattgggacactggcacacacattccactgtgagtgtctgtgtctatgcctgctctcgagctacagtggctgagttgggtagatgtgataggctgtatgtctgcacaggtgaaaatatttgctatctttstctttacagaaaacgtttgctgaacagtgccttagattatcatataatgtatgttacccaacttgctgctgttgggttagtctgtgccgacttgcattcattatttgtgggagatttcagatactacagttatggttttagaggacgtttctgagtctaatatgcctcccatgctttattttagctangcacattaacacatgtctggcatgtgagagtaagtcttttattttgcagctgatcaaaggtttgctttgattaagggaattttccacctacgtgtttcttgagtgaaaatgagttgcattattgacttgcatcccatttgtattttgttatattattcacgaatgtaaacaaatattaatgcattctcatcaaatgcttgctcttttatggacatgtacaatgttcatatatggttagcactgccaaacttttagcaaataaaaatacaggatgcctatcgttacagctgaatttcagataaacaacagataaatttttagtacaagtatgtctaatggaaaaaaattcaaatttaatgggatgtcttgtgtttcatctgccaaaactatttatgatttacatttgtaatgtgtatattttctagggtagcagagctctagggacatatgccaaagatgacaggtaaacttgaaatgaagaactgaaaacccacttttataaatgcaggccattgtgtttactaataccaaccttcgaagcaacagatttgtgcagacagtagttgacagagcgggagcatctccatcttgaacaaacaccaccattctaagttccccttgattaaaaaaccacctaaatccagccctaaaacatcagcctaatagctaatgtcagcataaccagaaacattccaaccctaagataaacccctctccaaccagaaacatgccaaccccgagacagcctcccctccaaccagagacattccaaccccgcaattaagtttccctcacatagaaacattctagacctacgataagcccctccttccaaagcccttaaatatcctcagtctgtaagagagaaggctcctgaccaaaattggccagaagaccctctcaagtttatttctctaaaataaacctgtccttgattactaagtctcatttcgtgtttctttcctctttctttaaagtagttggctccttattggaaaagaattatgctgtaacctagattgattaaatattacacacactgaggcaaaacaaggaaaggacccatggtctaaaggcaggagattaacatagaacctggcatcgagtaagagctgaataaatatttgttgaaggtgtctgaacagcagatacccatggaaggaaaaacaatagatataggtgtgtgctgaaattgccacaaagtaaaacgaagagctatgttgcagctacactagttcatgcacacttttgctgtataactagcctcatctagcttttgttctcccctttctaatctttagtgttcctaaccctgagtgtccaacacagtttcttaccaggccattctccaagaaatattaaggggggggggaaacagattttattatccaagtatttaagaaaatagattttttacattaaaaaatgtaaattatactgggccaactgaggaatgcagtgtgggccaggcacagtggttcaagcctgtaatcccagcactttgggaggccaacgcaggtggatcacttgaggtcaggagttcgagaccagcctgaacaacacgctgaaatcttgtctctactaaaaatacaaaaattagccgggcgtggtagtgggcgcctgtaatcccagctactccggaggctgaggcacgagaatctcttgaaaccgggaggcggaggttgcagtgagctgagattgcaccaccgcactccagcctgggtgacaaagggagaatctgtctcaaaaaaaaaaatgcagtgtgttggagaggttaagtacttggattccagagctgaccacctggacacaaatcccagccccattccttgttagctgtgggtcctttatcaacctgtgcctccgtttcccttatgtaaattagttttaataatagagcttgcaatgtgcaagataaatcaatgattttgcatacacacataaacacacagaagcagtccttaattagtaagattctaatactcctgaatttcagttaccccagtttagtcaaataacatcagtctccttacagcacagttcaagcttcagttaccatgttatgttaactgtgaggaattgcatacaatacaaactttgctgctagctcttccatccacacatcactgcattaaaaacgatgtgcatcatgatcacatatccgtttgtgcaaagacagcaaagagtgtggttgtgttgcctccttatctcccatgaaaaacacacacacaacatttaacaaagcaggttttcaacagagggatttggctaacaaagcaaagaaatgaagagtggtaaagctagaatcaaacataaaggagtcgttgaagaaatagctgactgtgggagtattgccatcatttgagagactctaggtatgcagccacagaaaagtggtgaggccaaacctgtcaacagaaatgaggtggctgtggggaaaaggatcgagatgtcccagaggaagcaatgctggcaaaaactctcaagctaaagaaactctcaaatatatcctgatatttcagcacaaagggtaaaatttcgaaggcgaatcaagcagaaaagaatgtgacaatctggtaaggcatagaaaagatgctctctctgtagcaaaagttatataataaaaagacgtcaagcagaacattttcatcactccccaaggaaaccttgcacccatcaaaatacttgatcatacttacgcatttatgtccttatgtatttataacttagaatatgagaatttacaatattttggcaaaaattttaaaggcccacagataaattataattttcccattgattattaagcttgcttcagatggcttcaacttgcatgcttatttttgtgaccctgcattactgtaccactgtgcaaactgagtacctgcatctgcatctgcgtgtgtgtgtgtgtgtgtgtgtgtgtgtgtgtgtgtgtgtgtgtgtgtagcctggcccacaagaaatactcagcagcaagtattggctggtattcttagctattatgggtaaagttgctttgaggtcagttagcggagaaggtgattgaatttctggtcacctggcaggagtaggcagtgtttccagagttgtagcagcatttaacacctgagaatttctgttcacctgaaactccttcatttgaaggcgctttagcacacaaatcagggaccctctgcctaagcacgtccagccatctttaaaaaggcttcggaggtggctcattgaaggctctcaaaacctataagtagtgatgaggtactgttcccatacccctaaatgtatccatagggccctggtgtgattaattagattcctggatgcatttcttcccatctacagtccttgtcagaggatagatagttacctttacaatactaaagaatacatgtgattaaacaagtatgatatttaaaagcttataagaagagttgactgagtgaatatgtgaacatattataatatgtaaactttctcaatatagagtagaagtgggaggccagactctggaaacagacagcctggttccaaatctaccctctgacccaaactaagatcaaccctgctatctcactgtgcctctatagccctctctgtaaaatggggataatggcagtacctacctagtagacttaagatgaggatttaataaattcgttcataaagcacttggagcaggtcttgtcatgtggctagcaatctatacatttttactcaataaatagaatgcaaaactttgggctcctgttgatttcctcgctctggatacttcccccgggatataccaaattgctattccaggtgtaaacatttccagaaacatctctgataccttttctacattaggaatttccacatcaatggctttcagaggtcatccacataaccctggctttacacaaggatattgcaaggatttcacaggagccaattgtttgaaagaaatcaatttccagagcacctctttcctaacaaatgcaaactgttcttttcaggggaacttcaggggaactcttactgtgattcagtcaataataatcaataataattattgattattaatcacaataattatagattattgattataatattatttattattgataattattaataccaaattaatatcaaatcaattataaattgattagtaataataatcaataaaaataacttgataatcaatgccagcacagaggaaatccagctcatcacattctccagccacttccaattcaccagtctgggattgcttgaagcttcaatggagcctgttgtcctttataataacattaatagcacctcttcactctcaaggacagcctgttaaattttaagcttaggagattttagcaagcactccctaagatcatacccagttttgagaatgtttacagttgtttttctggagagacatctaaaacgttcacgagattctcaagagagtctatgggcccaagaagattgaagaccactattttagaggaacagtggacccttctccactccaaggccaactccttcattctctcatttagaccctctctcctacatactcaaactttggtgtttccactcaagtccttcagcctacatctatgctcaagtctgaatcttcatctgtaaaatattttccctttagcaaccaccctaccttccttctgttcttcctggctctacttcctcaaactctaagtacttttctacaaattatggtctgttttttgcccctggcactccagcaagaccctgatgatgctcagtgtctaatgcagtgtacacattctaactctgatataaactctgtgtgtgtgtgcatgacttgatatcatttggatagcaatttatggcagaaacatcctctggtctgactctgagtctttttacaatggataactgaaactattacttgaagttcttccttcctttggacttgatgacatcattcttcactttttcttttcctaactcagggtcttctttctcaacctgttctgtggcttctcctctccacgcagcaattcactttataaatattatttaaagaatgaatggatggggattggttttggtgagacacggttccaagcttggctctgcctctgactggctgcctgactttgagcgccttcctgggcctgtctgcattcagtctccttgccaatatcatggggagactgagatgataacatattgactgtccagcacagagtagatgctcaataaattagttgatctttctccctgcaggcaaatattgtttctcttaatgacacccagtgttttgatgaccattgtgatgttgcaaactcttaaacacatatctgtttgaggtctctttacaactggagacttatttttccctttgcttaccaggcatctacatctgaacctcccatgggcaccccaaaggtcacaagtgcgggtggccctgtacctgtcctctgagacttccttttacagtctctccagctacccactcttccaaaccagccacctcgaagtcattctgtaaaccttccatttggtggctaaacccttctcacatgtaattggtaaaaaattccttttgatttgaccttcctctttgctctcagatctccacctccacagacactgctacagtccagacctccactatttccatgtgagagtgaattttgatctatatggtatcccagcctctagtctcccagcctctagtctcatcctgtttcatctgacggtccccactgctgcagaaagtagcagttgccaatatcatggggggattgatacaacacatcgaatatccagcacagagtagatgctcaagaagttagttgatctttctccctgcagacgaatattgtttgtcttattgcctcccagcgttgtgatgaccatcgtgatgtggcaaacctcctagaagatgtcgcatcaccttcctagaaagtacccctttacttctctccatgtgtaaaatctttcagttaatctccattatctagagcaaggttgctcaccctagcactgtcgacatttgggacagagtctttgctgtagggactttgtacagtgtagggtgcttagtggatccctggtctccacctgccagatgccagtagcctgcccccctccccagttgtaacagcaaaaactagacctggccaaatatcccagggagggggcacaaagttgcccctgattgagaaccactgacgtgcaaaaataaaacctatattatctcttggcttataccccaagatattgtgcccaaatatcttcaactttatctcctaaaactataactcacacagactctggaatctcttatagttctacaaaagatttactctttccaagtataccccacctttgatgactcccagactaaagtgccccatttttctactttttgtccccattttctactggaatacctttttgtccttatccttccaaactaatctcagataatttctcctgttgtaaaatcttccctgtcaacactaaagataatttgtccttcttccttatggatcctacatcacttactatctattgtagcacttgtcactgtaatttcttcttttcacaaatgttttaacctgaccactactaccacctacttacaactttttgagtttagaaaagagattctatatacttagcatgtagtacaatgcccaacacatactaggagtcttgacagctattagatagacgaataagggaatgactgaatgagtgaatgaatgaatgacgtcacatccttctctccccggcatggaaatatgttgcatgttctgcatgcagagtgagttgccggcttcatgtcaagagggaatccccctttaagaagagaatctgagctgctgttcctgaaacttcctgaaatcccacctgttcctgaaacttgctctattgagacttgagtttcaacttgatgctagagaaagttgttaaaatttatttttttaattcattgatggatgcatctctaatgtcccagtcataaaaataatcttatatttaacaaatcccagttataaatattttgcgtggggctctgcttagcatcttgatgtaaaatttatacctaagtctattttggcaaacatcaaattaaacttgtaagtataaaggaaatcagagtgtccttgacctcccaaggcttagatgatcagcagtttttaaatgacattccttgaaagcgaactttgattttttaagcactgggcctgaggctgtaatcaaaggcactgatgatatttagatgatttagaagagcacaagctgatctgccatcattcagcttgcaggatacatttatcttctgtaagcagtatgaaacacctttgtttttgtattgattctattcctttagaaaattataggttttgtcttgttatgttgcctacagtcaaaagaaacgattatggaatttacaattacaggaaggaggtcattaaagcgggccaggttggttttatcgaggctctgctttacttctattggaacaattttatgcacgcaacagcacatcaaatagaatgcaccagaggatgattttaggaacttagttaaaagccctctcaggattttgcatacattttaaataatactcagctaaacacataatcacatgtttctcatatactttcaaaaatcccatatggttagaaattgctgccagatttccctgtgttgataaacagaatgacatttaattaaacagtcctgaaaaatactttctttcttgactttatactcagacaagttaataaagtccccatttcagatgacgaaatgacacattgcctgctcctattccagttttctgcctcaaatgtcttcctggagagactccatgtatgccagccttctcaaggatttaagagtattaaaccaaggttagatggtagctagtgttctttgatctcactgtacacattgttattcatttttttcttcttcttttcttttctttttttttagatatggcggtctcactatgttggccaggttggtcttgaactcctggcctcaagcaatcctcccacctcagcctccaaagtgttaggattacaggtgtgagtcaccacacctggcctggttggtattgatttttaaaaagtgatttgttacttgttgtccatgaaacttggtgtgctctaaataggttgtttgtttcactacatgacattccatatacttaccatcaattccaattaataggaattccaatagaatggctgaaacaaattgagtagaacaattactaactcctttagacattattatgttaggctgaactattttctacactggctctatctatgggtcattgcatctggctatttagatggcaaggaaatgtaattgaactaaaaatcctagtcattgagcaacgggctgtttttgttttgctttttacctgccagctggttcctcatctttgaggtttgccctgacagctctgaagcttgggtaatatacaacaatatagacaaagtaaggaaataattaggttgtatgatagtaatacattcccatcctgaaaaccacagttttaaaatattcctattgtttcccctgtcctctgctcatttgacagttaccaggagctttgggcagacggggagagaagtgcatatgttgtcatctgacgctctgctgcctccatagcccatgttagcaattagcatggtgtagattaagtacaactacacaatagtcatcaattcccaatgttatcgatacattagaaaggggctctgatttccaattaagtactgaataattgaaagaaaaatgtgttgttgcaggttgttgagaaacacctctacctccatttaccctttcattaagaaacagggataaaaaatattgcgatatcaggatatctagaatttggaagatgtggaatcatcctgatgagtccaaggacaatccagaaaatcagctgtgattcagactccggtgtgccccgtggaggccatgggtcatccaggagccttgtatacctggaggatgaggagccacctggggggaattcattctaaggtaaaaaaatgtcatcctggcatagtgacttcgacccagttcaaaagcccgcgttgttgaagaggagccgaattctaggcatggtgtgtttacagtgagtgctgtgtttcccagattttccatccacaaggatctgaactttttaggaagagagagagagagagagagagagagaactcagaataacagctgaatgagccactctttgagagtgcagtagtaggttagctcagcaggtctgtgttgtccaaaccctgcactttccaaagaaaggtctgttctttgacagccttccaggggataacctctaaacccttggaatatcctgcctgatcataacgtgtttgtttacctggagctttgagtcatgctagacagttaatgctgatgatttatagtgggggctttgggccacctgtatcagtcttgacctctggaggggctggtgactaatttcggtcatgcagacagtcggccatgcctacatgctcccaaaaccacactggatgtcaggcttgggggagctccctgggcagcaatgttctgtgcaggtttcctcacatcactgctgggagaattaaacatcatttggttccatttcccagctgctgaaaaactgtaatgttgggaagaaattaataattcagcttaaatccaaaggaagaatgttgattgtgtagattttgtagaattttttttaaaatgttgagggaagaagggaagaccaactatgtagaaaagggagcctttattatgaacacacaactctttaaaacaagtgaagtaatacccatgtagaataaaagcaaagaaaaaagaaacaattcagataatcatcacataagaacacttatatgttttattttatcttattttatttattttattttattttgagacagagtctccttgtgtcacccaggctggagggccatggtgcgatcttggctcactgcaacctccgcctcctgggttcaaacgattctcgcgcctcagccacccaagtatctgggattacaggcgtggtgccacccagttttttttgtaattttggtagagacggggtttcaccatgttggccagggtggtctcgaactcctggcctccagtgatctgcccgtctcagcctcccaaggtgctgagattacaggcatgagccactgcacccagccacttacatgaaacatctgactgcattgctgaattcaaaatatctgaatatgttatacagaaaaatgttttggaaatctaatgaaaattaataacgaaatacaatgttctacttacagtcattgttgacttatcttaataatttgtttgttttgtaatgtgacaaaatagatctatattgttcatcttgtcaaaaatatttatgtgcagaactgtattttaaaacaagcaagtacaaaaggaaataaattaaagtacacgaatattttattacctctcaaaatagcctgacttgaaaagaccatcactccatggccaatggatctacttgatcctgaaataaccgagagtggggtgtatctgttactatcagcaggtcaaccttacagcaacaagaagaaaggcctttgacaacctgatggtcactcctgggatttctatggctaacttaagtggcaagaactagcaggaaactagttgactttttttgaagaaagaaatgacaaaagtttctcaatcagtaccttttagtcatcatttcttggaaacaactatacatcatacagttgatgcctttaaagacacgactttgggtatgggctcagtggctcatgcctgtaatcccagcactttgggaggctgaggcaggtggatcactttgatgtcaggacttcgagaccagcctggccaacatgacgaaaccccgtctctactaaaaatacaaaaattagccgagaatggtggcacgcacctgtaatcccagctccttgggaggctgaggtgggagaatcgcttgaacccgagaggtggaggttgcagtgagccaagatcttgccactgcactccagcctgggcgacagagagagactccgtctccaaaacaaacaaacaagcaagcaaaaaacataaaagcacaatccattgataaaaagggtgcagctggacatggtggaaacacacagggcatgggagggagcctgggctccacctgcaaggcgaaggccattctagccaaaggggcaggggtggctggaaggagctcgggggcgaggtcctaggccccgtccacttggcttccatcccgagtccttgcatccctccccaggaggaggcgctgaaaacttctggggacagaggccccaaagaaccaccacccaccccagtccacagcaaatatgggtggtcccttayggaaagagggaaggcgtgtcagcaggggtcgtggcccccaaggtccttcacccgcatgcgcatgcgcacttagctgaccaatcagagaggagcgtggatagccagggcagctgctctcgcgagaactgaggacccatttttctaagagagcgtcgtggtgccagtgcctgcaggttctgtgaggaagcggcatcaggggtccctcaggtgaagcgctcgcggtggggaggcaggaagtcgagcatgcggccctctcgcaaccagggtgtgaagcgcaggtgaagcgctcgcggtagggaggcaggaagtcgagcatgctgccctctcgcaaccagggtgtgaagcgctgagcggccggctgacctgcacacgggcagcccgagacccctggccccttcttggctttggagtccaccatgcacgtgctaagaggccccaggttttcaaagcaggaaatggccctggcatcgttgcctggggcctgggtcagggcgaggccctgagggtgggctgggatgggccagggcagggagggagctggagacacctgagtgatccccagggcccaggagtgtccccgggacttgtgcatgtgtgcagtgggtaggggtggggcaggggaggggggcttgggggaatggagggggtggagaggggagcaagggaggggtggtggcagagggtggagggtcggggaagtggcagacaggcaggggccgggtgtggggccagggatgggggcaggggaggggaggggtgtggggttcgtggggtgaggggatgggggaaggggaggaggaggggcggagtgtgtggggaggcgacaagcaggggtgttgtgggggacagttcgagtgggtccctccagcccggccgcccgtcaggacaggacacttggggtcacgaggggtcacctgggcatccaggcaggcaagtggcagtgcagcccctgacattcccccagagatggctggggaggtcctgtgacacccgtggtcctccgggccacgcaggtctctggggcacacaggggcagggctgaactctgtcccagggacaccgcaaggatcctgcaggggccattcaggtgtgcgaggcagctgtgagttctgcagccagccccagggacgggctggacgggccacgaaggataggaggggacactggcatcttctccgacccctcctgctcccacaggatacacggggtgggccagccccaccctttcttgaatccgagatcccgttggctctcctttcacatatcctgtttccttagcttacttagtttgactttgcactcaaccaggttcagggatcgcctctaacttcccaggacagccaaccatggagcccgtgggcaggaagcgcagcaggaaggctgccaaagctcagttggaagctcaagttacggccgcccagggggccacgaaagaaggtgcacgcccaaggagatggtctgtttgctctctgcgcggggggcacatgggcagcccgagacccctggcccctttgtggctttggagtccaccatgcacgtgctaagaggccccaggttttcaaagcaggaaatggccctggcatcgttgcctggggcctgggtcagggcgaggccctgagggtgggctgggatgggccagggcagggagggagctggagacacctgagtgatccccagggcccgggattgtcccggggacttgtggatgtgtgcagtggggaggggtggggcaggggaggggggcttgggggaatggaggtggtggagaggggagcaagggaggggtggtggcagaggggggagggtcgggggagtggcagataggcaggggccgggtgtggggccagggatgggggcaggggaggggaggggtgtggggttcgtggggtgaggggatgggggaaggggaggaggaggggcggagtgtgtggggaggcgacaagcaggggtgttgtgggggacagttcgagtgggtccctccagcccggccgccggtcaggacaggacacctggggtcacgaggggtcacctgggcatccaggcaggcaagtggcagtgcagcccctgacattcycccagagatggctggggaggtcctgtgrcacccgtggtcctccgggccacgcaggtctctggggcacacaggggcagggctgarctctgtcccagggacaccgcaaggatcctgcaggggccattcaggtgtgcgaggcagctgtgagttctgcagccagccccagggaggggctggacgggccaggaaggataggaggggacactggcatcttctccatcccctcctgctcccacaggatacacggggtgggccagccccaccctttcttgaatccgagatcccgttggctctcctttcacatatcctgtttccttagcttacttagtttgactttgcactcaaccaggttcagggatcgcctctaacttcccaggacagccaaccatggagcccgtgggcaggaagcgcagcaggaaggctgccaaagctcagttggaagctcaagttagggccgccccggcgaagaagcacacaggtaaacacagcccaaggggccagaaaagaaggtgcacgcccaagaggacggtctgtctgctctttgcgcgggaggcacatgggcagcccgagacccctggccccttcgtggctttggagtccattgtgcatgtgccaagaggccccaggttttcaaagcaggatcgagggccttaggcttcccgtgggaggctccccctcatagcagggttacagatgctcgcagagcagctcttctccatggatgcggtcctgacatccaaggggtctgacttgtgagcgttgtttactaggacttgaaccggaagggcttccaaaaatgcctcggtaaaacggtccggagcccagtgattccatgcatagctctgctttaaagctttaattggtagagagccaaaaaagtccacaaataataagtttctctacaaaagatgtccacaacagcgtcttcctctaaaaatggtttgtcttttacattttaatgcaggaaaggatccagtccgtgatgaatgtgaggaaagaaacccttttacagaaacaagggaggaagatgtaactgatgagcatggggaaagagaaccttttgctgaaaaagatgaacacacggggtaaagtgtttaagtcacttttgcctgtcggatagggtcttttaggaaaagtcagctttggttcatgtcatcactattctattctatgcggaacatttcacataagacrtatcttcccaacaaacatggcattttgtgtagcattatgataaaattttgatgtaactttttttacaggattcataccatgaagctagaacatattgcaggtatgttttaggagctattcgtagtctttgaaaattattttcaaccatacaactgttatagtaggttatatgaattagtggacgacgagactgtcttaacatgccttcttctcatatatagcatttaacatatgtatttaatgtaatgcgtttaataaattttcatacttaccttttggattgttgatgtggaatgtgagaatgcttctaacaatggtgaagtgagagggatggcttttctttcatacacatggaaatttaattatttgggggatattagaggacactggaggagaaacagctctattggttccttttagtgtacacagattaagtatatatatcaggtttttttatcttttattttaggtttgagggtacatgtgcaggtttgttatatagataattgcgtgtcacaggggtttggtatacagattatttatcacccaggttataagcatagcacctgatgggtggttttcatcctcaccctcctcctaccctccaacctcaagtaggcccaggtgtcttttgttcccctcttcctgtccgtatgtactcaagagtttttaatatgagtttttatgttcctaatttagctattctattgtcacagctttctgattttgttttctttaaagtacaagagaaaattgaattatctaaaatgatgatattctattattattccagtaataaactgtgtactagaaaaggaaagacaagttttctacccagtgagaaacatgtaattggatccaaaaactcataaattttgtattgccatgtgaactgttagttgcactgactgttataggaccatattttcaaaaaaaaattgagaaaatttctgtagagacggcggagacaatactcttatttttaaaacgctcaattcagttttcagctcttctctagcgataattcatacaagcagtatatttggaaagctttgctctgcttggtgagtaagtgctggttttgtgagctacctaactgagcattatagatggagaatgtaaaaaatatttgtattatggtgcagatcttttatgattgctgaaaactatttttagcaattgatggtagatctctgatgtgaaaccatgtttaggaaagcattccttgcagtaggacagttttctgaaacacagcactgtggataaaaatgtcatataaaaagctccaagaaaatatttcaaaagtgtttttgaatgtatttctttacttaagcctaaatttttatacccatggacgatgcttcttttattaaaatacagttaatagcatcaatcaccagattgcttaaaaaatgctcttcttattgtgtactaagttatttctacccttttgatggtcttattaaataagatacttttctgtatgttttacataatgaattgtgacagtatttcatggaaacatgtcctttgaattacaggacattttataaatgtagaaattagagtctgtgtttgtaacgctttctgcacatttaaaaaatcgaaaattacttgctttttttcatcatccataaattaagtgatttgcagttataccaattggaattagagtactaatattaatacgtaaaaggttttacagaaaacaagtgagtaaatcttgctttttgaaatgatctttgtattttacaatgtaaatgtccttccgatattgctgaaccatcatatctcacgttgatttcaatatatgcgaagaaaccacttttcaacattaacttttaatgcattttcatttactatctagctgacattaaaaagggccttgctgcaaaaagagaaatgataaaaatagataaagcagcttacaggaaaaccaagaacacaattgaacgtgctttgaaaaaaaamcaactaaaaaggtatgattgttggcttttttgcataatgatatttatatcatttctttgtatttgttggtgcaaataatttcaaaaactgtcctgtacatattggcgtctctagggagcaacatattttacttgattgttccctaagcaggtaagtttcttttgttttataacctcagtttaacagaattgaggcatattatctagaaagccaatgaagatgacctctttttgccttccagataaaaatagtcttcctgtaaaattaatttttatccatttctagaaatatggcagctgcatataagataaatgtcttcaacgtttagtctgtagatccttaacaatattaagttatgtggaaagggacaaccttatgttgtaaataggttatctattttagttaaattgttttcactattccttttagaaaatcattgttgtgccaaagtggagaaagagttaagtgaagtatttcttttgggaaatcttacaggatgaatggctatgatattcttgaacctacttatgagaacccatatgttatttagtttgaggaaatgaaaagtaaactgctgttagagaaaattattgtttctgggaaatttatagtgcagtaaactctcctttgttttcagcacataaagaatgtaagatagctgctctagtagtcagttaggaagggatcctttcagaatgacagtaactcatttcaccttttcccaaaaagaagatttcagctgctattactcccttgctactttatagtataaattatgtgaagtcagttttggtttgaataggattaatttttcatctctctatgacatatgaccgtattacttattatgtgttacaggcagaaacgtgattatagacatactcggaagttgctgaatgtccttaaagaatacatcgcagagaagcagaaagatgatgaagcagaagaagcagaagccgcagcagcagcagcagaagccgcagcagcagcagaagccgcagcagcagcagcagaagtaatagtagtagaagacgaagaggaggaagagaaggaggaggaggaggagaaagaagaggaggaagaagaaggagaagaagaaggaggaggagaagaaggagaagaaggaggaggaggaggagaaggagaagaaacagaagaagaggaagaggaagaagaagaagaggaagaggaagaacaaattgttggtatcaggcttagctttatgattaacctattgtatcaatgtctcaggtagtaatagttcatgcagaaatccagcaaagaaggaagagagcatgagcccagagaggggggcccataagtggactcatgtactaggggaatataattgccacgcagcattaggggtccaactgaggtcagcatcatagcgataaagaagttaaagtgagcccggttggcatatttgtgcaaaagcagctgtagggttggaatttcctgggttggggtgtagctgcgcacgttgatagaaggagagttgggcagggcatagatgcagggatggggatatgatgactggctgtggaatttcagctgggactgagttacctgagcacatgggggtgggcaatgggcagtgaaaagtgttccattcagtgggtgtcgggtctcaacagactcctgagctgtagtactgaagtgagtgacctacagtggcaggaaggtagtggctgtatgttgggaagatggagaaacagctgagtgcagtggtcaagggctgggacactgcagccccactgcttgtaattcaactccagcttgacgattgctagctcgggaaccatgggcaaattatttatctctgtgccgaaatttccttatctgcaaaaggagacacggtaagagaacttatgtcagagttatttggaggattgaaaggttcctgtgtaatgggtttatttaaatttttcaggatgtgatctgacccatgattgctctttatcattgctattattaatattatgtagatgttgcagtcattgggaatgataaaatctaggggatgactgtataagtgagtgccacgtagaggagaggagaacactgttgttggagattaggtcaaggtgcagaaaggcaatcattattggaaggttcatccgtgtgcatactgaaatgaccaagatttattacctgtttaaaatcttagtaagaaagaatgtttcttagttaatttctgtatatatcttacccatctgtggtcaacaaattataggaagggtcgtcaaatactctacattcaaaatcaagaattaagacatatgtgttgattatgtatgtagaagaaagaaaattccttaatcactgatgaaaaaggttattatatcattttagcatatgggtggtgaacacagttgtttaaaattggtcataaacattgtttaaaagaaagtgttaagaagtatagatttaaagagtattcctataaagctaatgcagaattatgttttgtaagtattaaaaattacccaattttcatcactatttttttgtgcttctagaaagcatttcaagaaaaacagaagaggtggcaacaacctacaggtgttaggagctggaggctgagagagatgaagccgctacttgagcaattactaaaggtctgttctatttggtaacataatacattataaaatacaacacgtgcataacagaagaaagtctgtttgtttcrgaatgtatggaaagacattttggttatgcattttaaattacttaccattttcactttgaatgtattgttccnaatttaacataactggtaaatgtatttttaggattcgtgaatagttttgtgggagttatttagaacaggaaaaggtaaattggaaattttacctggaaatatacatcttgtgtatattgttaacgcattgacacatttatgccggaggctgcacattttttgtgtgtgaagaaacagaccttggctatgttcttgagcggtaggagatacatgattcccacaagcttagcgttccaataatggaacactaggcataaatgggttttaatgaagattttattttcagttttcaggacatcaatgacacatctatggtggaaggcaggaagaccataaatcctttctggatgtcttttttacttgtgttgtttcaagagttttagttaaataggaagtaggcaagtgtaactactgagtgtctcttttatttcctgctgtaatacaggagtgttttatggcatattcactttcaaaattatcagcgactagtaatggttttacatgacaatttgtagtcataagagatggttcagatgtataacagaatgggaaagccagcaaattattaacacgttgtgaattgtgaattatctgctgtcgtatagcacattagcaaattgtcatcaatgacctcttcttcatgtagatgtacattatttaggtaacaatggaattcccttctgggaggtaaggtattctttttaataaccttgtgaaaagacatgttcatatgtcactcctctacactaactgagatgtgttaaataaactgagaaaagagtttgaaaataaaattttcaagcaacttgagaatgatctatacacaaaacagttatttaaatagaagtcacaagtagagaaaatgttgctataatgttcaccagaaaccatttattaattggtatgaacatgagactagaagttttcctgtcaatgttaatgctacatgttaccacttagggtaggaactttgctatcatcttggactcttctaagtcccttatccttcccatgcagttatcatgaggcaagttttacctctgtaatggcccttaaatttctttttttaaaattcccaccgcagctgccctagttcaagacctcattcttccttgcttgtactattaaactcttttctgagttctctcttctcttctgagccatccttcattgatcggcaatattatcttcctaaaaccctccccttcctaaaatgcttcctagcccttccctcttcccagcctgtcagtgatgccccgtctcagttcttagatattcagagactctcccctttacatgaccccctcttaggcttgccgccctctgtctttgctcctgcctatccaggttgacagctttccctgaaggaattcactgttactcttatgcttttctcatgctcttccctcacaatgctttaaaaaaatttttttttgactaagaccaatttaaaccttttgccaactaagtcaacatacgtctccatttttggctacatgtctgagtgagttgcccttccatagcagttatacaatttttgtattaattttttttatttgtgcatttgctcatgtcacaggattatggaagagattgtgcttacattttttacatcttccttagcattaacatacaccattttcaggagtrggaactgttgaactatttgttgagggaatagtatatatttcaaacatagttacatttttctctaacttgatgaggtcatatcaccaaccattttatcccttcaatggaaaccactttccgtagactattgctgataatacatgggtcactacctgctgaaaaaatatatttcatggtaagcctgcctgactttttctgtctttgctccatcttgaccttaagatgctcatcaacccattttattcaagcaaagtacatgacaattggacctgctaaaataatatttcactgaaatctggcattaaaaaatttaagtgggtatttggagctccatgtattggttacagtttttttcaaattgaaataaataaccagcatcctttgaatattaaaagctgtttccttttgacatctgattaaccctgtttaaaacgtgagatgtaaagtggtggtttgtcagtgaactagactttttcttttaggctgcyaaggacactaaagacaattattgcatcatttcttccagtgaagaaagtgaacttgataactagccgtgttttyaaaaagaatygtgtcagaactgtaagtagtgcatatttaagtttaaaaactcaggattgatgtaagcactggaatattttatttgcagaaatgtgtatcacagttacttaaatttttttttgaaacagcttttggaagagttggcacttcattgtctcttcaacctctgttattctgatgactgaagaaagaacttgaacctatgttatatgatacgagcacaacttgagctacagtaaactacatgacagtgttttgataattgttgtataaatcggtatagctcctctgtcacttgtctgttaaatgccagacctcgtttctatgatctgttgaatgaatcctagacacttctgtgagaaggcagggattgcacagttatgtacatggtcaattaaattttaacattaaagataatttagatttcagttcacctctgtggatctgtatcagtttcaaaaacgtagaaagcacgggcatagaaaagtacatttttctctaataaaagaagacaccaagcctgcccggtgcggtggctcatgcctgtaattccagcactttgggaggccgaggcgggtggatcacttgaggtcaggagtttgagaccagcctggccaacatggtgaaaccccatctttactaaaaatacaaaaattagccaggcatggtggcacgcacctgtagtcccagctactcagggggctgaggcaggagaatcacttgaacccgggagtcggaggttgcagtgagccaagattgtgccactgcactccagcctgggcgacaagagcaagactctgtctcagaaaacaagaagacaatgacaaaagctatcctatctatgcattcttttgtatttactcattaggataaagaggcaattccaatgaaagtaggacttcaaaaaatagatatactctatggccatatcaaaattattaaaaataccttaacatctgtgttcttgaaaaaattaaactactataaataattaaggcaactgagcaagatacattaatatcagtgctgagccactggtttgtgggtatgtcatttccacagacatcaaaatgacatttagtttgttttggtccatcattcaatgatacctccccttagcattgattgaaaatattttgttaacatttatgtatgcttacaattatttcacatctgtggcaagttaaattatgtagagtgctttgtttttccagtttaatattcacggattatgtggaagtttaagtatacctgcatctaaaaacttgaatgatgaattcacctacctttcctttttttaatgttaatgttttcacatgtaacaacatataacaacatgtaacaacatgtttaaaaatatatttttgcatgtaaaaacatgttaaaaagatgtacacgtttttacatgtaaaaggaattttacatgtaacagcatgtaaaaaaatgttcatttggaaactatttagtaaatatgaaattcagaatatatttggagtaagtcagttaaatgtattcttttgctgagtttctgaaattccattcatgaattgttcaaaacataatactcccattggagggagaggagcgacttcctctcatttttccttgtgctttttattttaattggcccctatataccactcttattttttctaggttttccaagtttaagaaaaaaagcaagttcattcagatagtgtttttctgcctataatcacttatacaggaataagtgagtccctgtggggagcatttcattcctaaagtttgcattttcttaaaggattttccttttacccaaagcgtgtgttggtactaataagtactcctaagtactacttcaagtttctaagaagatccttttttgagatctctttcagtagttacagaggcaaaagaagcactgcggaggtccatgtgcaagttctgttgtacatactgggctacctgactatttcttctatagtggaaggatgagaaagaggccaaaatgtacttagtggtggaacaattgatatttatgtcaccccttactataaagtgagcaactgtgtacttgaagtcacattttttttttttctttagagatattgtctcgctctggcccagccagagtgcagtggtgtgatcattgctcaccgcaatcttgaccttttgggctcgagcgatcctcccacctcagccttcagagtgtctgataacacaggtgtgcacaccatgcccagctaaaatatatattctttttagaaatgaagtctccctgtgttgcccaggccgatctcaaattcctggcttcaagtgatacttccacctcagcctcccaaattgttgggattacaggcatgagccactgagcctggctgcattatctcacttctatatggaatctagaacagttgaactcacagaaacagagaatagaatgatggttaccaggagctgggggaggtggaaggctgggaagatgttggccaaagcgtacaaatttcagttagacaggagaagttcaagagctctattgtaaaacatggtgacaacagataatgatagtattatatttttaaggattgctaagagggtagattttaagagttctcaccacaaagaaaattatacttagatgaagtaatgcaaatttcaactagctcggtgtagctatttcacgatgtacacatatttcaaagcaacctggtgtagacagtatataccatttaagttcgtcaattaaaataagttagtgaaatttttggaattaaaaataaaaacatacacttattgccctgcagttctatagtttcagtgtaaagtctngaatgagtgtctttgtgttaaaaatcaagatggcagtggggcagtgtcccttctgggggttgtaggggaggagctgttttcttgtgtttttcagactctgaaagctcccaccattccttgtctcatggcctctttctccatcttaaaagccagcatttttggggtcggatccttctcatgtggctgtctttctggttcctttctcctgcctcttttacacttagaaagacccttgggattccactggactcccccagagttaacccaagataatatccatgtttcaggtcagctgattggtacctgtcattagcaccttccaactcatttcctcccttgccttgtcgtctcacatgttcacaggttccagggatgagttcctggacatctttggagggtacttattttgcctaccaaatacaccctttctttaaatgcacctcatcttaaaaatggcattgttttaggtgggcacagtagctcatgcctgtaatcccagcgctttgggaggcagggatgggagaatcacttgaggccaggagtttgagaccaccctggccagcatagcaagatctcatctctacaaaataattttttaaatggcaccattataaagagggaggtagggtggattccatcctcttctcagcccttgtccaaaggtattgacttgcataaactgagaaggcacagtgacaataaaaagctcatccttgctacccccaaggagaaacactggctcccataagcaagtgccatgagtgtaagtctttgtgtatgtgtccgtgtgctggggaaggggttcattgagttaatggaggctttgaggtctgtactgtcttccacctggctgcaaattgtatgcgatggctcaagggatcctctcacttcaggcctcccgagtacctgggaatacaggcgtgtgccaccatgctggctaatttttttgtgtgtgttttgtagagacgtggtctcagtgtgttgcccaggctggtcttgagctcctagcctcaagtgatcctcctgcctcagcctcccaaagtgctgggattgcaggcatgagccactgtatccagctgacctatacactttgtattttattttattttattttattttattttattttattttattttattttatttattttattttattttatttattttattttattttattttatttattttattttattttattttgagacagggtcttgctctatcatccaggctggagggcagtggtgtaatcatagatcactgcaacctctgtctcctggcctcaagtcatcctcccatctcagactcccaaggagctaggaccacaggcacgcatcaccatgcccaggtaatttttgtatttttagtagagaagcggttttgccatgttgaaatagactctctttatataaaacatatgactctctattcttgagtacagattaaaaacatcagtttttattatgtgaatttgtaggagttttatgtgtaaatagaaaagaagatgcttacgataaaattaatttattgtatttaaaatgaaaattatcacataattaatatattaatatatttgcttaacaaaatgttaatattctctttaaatatcattactaacacataatccacaaaatcctgccttggatgttactacatagtttagaagttttattgcatgtcataatgttcgtagttccgtaagtgaattttaacatctctaagcacaggagaagatcatatgcatcattgcccttaccttacacctaataaatagttgatcatttcagaaatcaggcatttgaagctgtgtgaacatgagccattcatcattacagatggtcctgatcacatagatacatgatatccagcaattgcaacttacaaagtgttatcagtccaagatctgattggttctgtaaacatagatgactcattttccagtattttcaagttgcagcccgatgttttcatacatgtcatttcatacctgtcatttctgatttgccattaagcatgatctggtaaattgtttctctcgactgctcatgcagtgtttggaactggtgccatagtagatttatcttcttcccttcagtatagacagatacatgtgcttatttctaaacctcatcagctaccactaaggaccaggaagcaaaatctaaatgagtgacagcagtttcaagttattctttgattcgcttttggagtgagtttgatgcaatctcctcgccttttttagccagggccatttggtcaagttatctgtcctcaaccattcccctttgggctgtaatactgttttggcaaacacagaaacactaatgtagatagctcgcacttacagtttccagaattttttttcatacaaagaagttttaaaatgtacaaatctcttttttcctaaattcacaaacaaggttgaataatataccacatatacattttaatacatatttaaatatttgcatatgaatatatgcaatatataattaatgtaaaccattttatatttccttgcatttcttagaatcaaagccaaatcaaaacattttaagtacaatgatataatttactgataaaattatttcccactcttctataaatttacagagcctgggatttttgtcagataagctttggataccttaaagaactagcatagtccttttttaaaatatattttttaaatttagctattattcttagtagagacagagcctaggctggtttccaactcctggctcaagtgattctcccacctcggcctcccaaagtgctacgattacaagcaatgagccactgtgcctggcctagcatagtcctttactaaaaggaaaaaaaaaaaaagccaccataaatatttgctgagatattgagtgaatggatggattaaaaaatgaattaaccaatgaagcagtgtctgaatttaggagaaattctctttttttttttaggaaaattagtttaaaatgtactaaacagctccatgcaacttctccagaatgatgggcattcccctatggacatatatgaaaaatgtatatatttatagcatatatacagcttccttgattagtgtattcactttatgttgtacttttttttcaacaaatgactataaaagcctggttataatacaatttctataggcactaaaacaaacaaatagccccatccctatctgtgttcagaatttgaaagttgttatttttgggtcattttaaaccatgtttgtgtctcttttactgaatttgacttcgtaatgcttttttatttttttaaatttctttttatttattttaattttatttccatgggttattgaggagcaggtggtgtttggtcacatgagtaagttctttagtggtgatttgtgagattctggtgcacccatcacctgagcagtatacactgaaccaatttgcagtcttttatccctcacccccttctcacccttcccccctgagtccccaaagtccattgcatcattcttatgcctttgcatcctcatagcttagctcccacttaggagtgagaacataacgatatttggttttcaattcctgagttacttcacttagaataatagtctccagtctcatccaggtcactaggaatgccattaattcattcctttttatgactgcatagtttttttatcatatatatataagaaactgatatatatataagaaacatatataaaagaaacatatatataagaaacatatatatatatgtatatcagtttatccactcgttgattgatgggcatttgggttggttccctgtttttgcaattgcgaattgtgttgctgcaaacatgcttgtgcaagtatctttttcgtataatgacttcttttcctttcttttcctctgggtagatacccagtagtgggattgctggatcaaatggtagttctgacattctcccgccgcccgcgcacctctccaccccgcagtccccgctctgcggctcaccctctgctgcgctaggctcccgcgggtgctcggcccggcgcccctccgcctcctccctgccgaccctagtcctagtcctcctgctgcccctggagctgagcctggcaaacgcccttgcacctgggacccctgctcagaatctacccgagaatcacatcgacctcccaggcccagcgctgtggtcgcctcaggccagccaccaccgccagcggggcccgggcaagaaggagtggggctcaggcctgcccagggaggcccaggatagggctgtgctcaccgccaccaggcaggcttacaggctgccagggcctgaggggccgctgcctgagcagagtcctgcaggcctgctgcgggtcaaggacctgctcctggggctcgagtttccctaccccaagaaggagaatcggtgtccagggtggtagagagccaggaaacgcagcagggagtacaagagacgcagggacaggctgaggctgcaccgaggccgagccttggtcggaggtcccagctccctgatgaaggcggagctctccgaagccaaggcgctggatgcgaccatggaggattcttccgccagtctggcccccaccatgctcttcctcaccacctttgaggcagcacctgccacagaagagtccctgatcctgctcatcgcccccctgcggccccaggcacagcgcaggcctgacggggaggtgatacccacactggacgtggccttgttcgactggaccgattatgaagacttaaaacctgatggcgggccctctgcaaagaagaaagaaaaaccagggtaaactctccagtgacagtaacgaaacatcatcagcagaaggggaaccgtgcgaccatcaccaagacttcctggagggttgcgctgctatgccaaattccaccagaacctcacgtcacacagaggaaggggcgctgcctggagcccgagacggccaaaggcgaccagggatccttcatcaacgtctagccgctccgcgggactgcggatgagcccgggaggtttgcacaagatttgtttataactagcagtgggagatcaagtgagggaccagatggccgaggctgcaggctcaggcccaggactctcgaccccggaaggggtgctgctaagtaagcgagctgggtgggtacccaggtgctggccgggtacccaggtgctggccggcagcaccggcgcactctcagtccggacccacacagcctggtgtcgcgctctccgcgatggcaataccgagattgccctctactgtccgactgcagcactacaacagcttcaagttcaaaaccaagaggccattttgagagtggaaaagaaatttaaacttcccgaaagaaggtccacgggctggagataaatatggaacacctcctatggaccaggcactatgctcagcgctggactaccttacctcattgaattatcacaacgaccttttcaagtaggcattatcaccacgcgacagataaggaccctaaggcacactggagtgatttggcttgcccagaatcccaggtcaatgttcttcaaaccttaacatgctaagaatcgcctggcggtctagttgaaaatgcacatctgactcagtgggctctgctctaacaaactcccagggcatgcgatgctgctggcccagggaccccactgagaggtccgggaaagtacatggcagagcaaggacccgaacctgggccaaggctgtccagccccaagatccacgttcctgcctctccacgaccaaaaatttcttctagattctccaaggcttttggcaagagaggcttgcaccctggcattccctttctctgtggctggaataacttcactgttctctgccttccctggacaacggcgtatcatgtttaaaaacaaaacaaaatgcaaaagtaaccaaaaaaaaatgctagttctacttttagttcttcaaggaatctccacactgtaatgcttttttaaaatatgtgctttttcgctgagcccgagttaagccatcatatcccctgtgacctgcaggtacacatccagatggccggttcctgccttaactgatgacattccaccacaaaagaagtgaaaatggcctgttcctgccttaactgatgacattactttatgaaattccttctcctggctcatcctggctcaaaagctcccccactgagcaccttgtgacctccgcccctgcctgccagataacaaccccctttgactgtrattttcctttacctacccaaatcctataaaacggccccacccctatctcccttcactgactgtcttttcggactcagcccgcctgcacccaggtgaaataaacagccttgttgctcacaaaaaataaataaataaataaataaataaataaataaataaataaawaaaaatatgtgctttctatttcttgcttgtatttttttgtattttgaaattgatttaggaagtatatataatccatagagacctcagcccatttttaaagattcatgttacaaacactccaatagcttcctgtgggtttggcatggtaggaagtacaggtgaaagaagacaaataagacagaactggtattcaggagcttgagaaaatgaagaaccctggcaatcataatgcagtgtgagaagtgttatgagacatgcatttgcgggacccctaggggcacgtgtctgtctcctagtgcagcccaggaggtattgtcatggaagacatccctcttaaatcatctcccagagggtggcatctgatgaggtaggacgcaaatgcactgggttattaaagtattgcaaataactcctgcacacttctggtacaagtacaaattggtacaatccccgaggagaaatatttggtaatatccaccagtaataaaatgtattaatgatcagatatgggacccagctctcccagctgttccatttttgagaatgtttcctgcagagacacttgcccatggatgacgtggcggatgcacagttttgttcacggcagccctagccttcgcacagagttacaaacaccctagatgttcctcaggagaggaaggattcaataaaacactgtgtgtccaaatggtgggaatgccactacaatcaaatgataaggaaggctttctgagatatgatgttaggtgaaaaaagtgggttgtaaatggatgtgtatgatatactatatattatgtgaacaagggaaaatacatatatgcctttacttgtttcttataaatgtataaagtcatctcaacgtgtatgtaagaagctgacaaaaatatttgtctcagtgtgtggtgttgttatatgggactagatacaggactcgttggggtgaaggatgagagggagataatggtccaagaaacagctacaggccttctccaagcttccgcagtcatcaactcatggccaattccatttcatcccaactcctagacatttctgcctgccccagagtagaatatcttgtatatatacagatgcacacacacacacacacacattcatgtgcttggcttatggcccaaataagatccatgcataaaaattaaaggtaaaatttttcttttaaatatgtactttgtcaaacttgtgcaataattatgaaagccttaattatgaatggagtaaattaagtttgttattattatcaaagtctcctagacacaattttatttttattatgacttttaactcacagagatctttacgtgtctttttacatttttaaatatacagggccattgaaggctttcttttgatattaatttttaaatttttgtattagagtcagaaaatttcagattctttgaaatttgagaagacatactttatgtcaagtgggtaaccaagttttagaaaattttctggaatgcttgaaaagattgtgtgttctccaattatttggcgtagttttctatatgtgtccattataaggagcttattaaactattaaatcttttatatttatattacttttggtctctatgccagtcatagaccattctcacagctggtgagaatatgctgaattattccaatataatggtggatttgttcatttctatttttgttctgttaatttttcttttatgtacattatatatattaatgccatttaattagatgcatgtagatttaaattgttatagctatctgagaacttaacagattttctcaaatggatgactgttttatccataaggatgactttagcattaatatttaattcatctgatgttgatacagttaagcctcttttacttgggttaacatatatttggtgtttggttttccatcatcttcttttcaaaccttttgtgtctttatcttttcattatagagtttaatctgtttgtatccattgtgtttgtggactcatttctatcatcttatattgtactttctgttagtatacttgctgttcatatcacttttattctgtctaccttgtttgtgtttgttttattttagcttgattattaccattttattttgtcctttattgggtcagaagtcacatcctctaatttcatccttttattggatattatagaaatgttataatatatattttttgaagtgtgtacacaaataaagtgaatgagtaacctgactcttcttcagaaaaatataaagaccacacaaagtgggcacatagctgtggagggacaaaggtgatgctgggcacacagactgaccacacagagctgggtctcttcaacaatgtcgtatgtctacgtgaagaaggatgccaaggcacactctaagataatgtgtgtgcgggggagaggaggcgtgtgtgtgaatgtgtgcggcacacctgatgcatgctcaggagtgtatgtatatctgtgcaccattgtttttaattcaaaaagtgcatagctttcattttcacaggaagttatgatgcctcatacagcaagtacctttggtacatttggatagactttttaaggtagcatctcatttttgtcaccaatttagcagctgtctgcattctaaaaagctggattcaactttaaaacttccccagtctagtatagtatagtgtaaacagatcaatcaccatagaagaggaattaaacaggcatattttgagcaggcgaatggaacatggaaccactttaagtagcagaattggacctgtgtgtttaaaagcacaaaaggaactgtgaaatatctaaaatccaatagctaagagaaatttcacatggagagactgagaaacttctgcaataattatgaaagccttaagttatgaatgcaaaaagacagtgttgcagagatttctgtagtaatctccaaagatgaatctgttgcccactgaaactcaggacaataaggaagcagaaagttatagcaagactgggctaattctaattccattggccatgcccggctaagcatttcattaattctttttttttttttttttttactcttttggttattttattttatttacttatttattttactttaagatctgggatacatgtgctgaacgtgaaggtttgttacataggtatacatgtgccatggtgttttgctgcgcctatcaacccatcatctaggttttaagccccgcatgtattagctatttgtcctaatgctctcactccctttccccccaacccctgacaggccctggtgtgtgatgttcccctccctgtgtccatgtgttctcattgttcaactcccacttataagtgacaacatgtggtgtttggttgtctgttcctgtgttagtttgctgaggatgatcgtttccagcttcatccacgttcctgcaaaggacataaactcattcctttttatggctgcatagtattccatggtgtctatgtgccacattttctttatccaatctatcattgatgggcatttgggttagttccaagtctttgctattgtaaatagtgctgcagtaaacatacgtgtgcatgtgtctttatagtagaatgatttgtaatcctttgggtatatacccagtaatgggatggctggatcaaatggtatttctggttccttgaggaatcgccacactgtcttccacaatagttgaactaatttacgctcccaccaacagtgtaaaagtgttcctatttctctgcatccttgccagtatctattgtttccagactttttaatgattgccattttaactggcgtgagatggtatctcattgtggttttgatttatttgccttcctctaatgaccagtgattatgagctttttttcatatgtttattggcagcatagatgtcttcatttgagaagtgtctgtttatatactttgcccacttttttctcccattctgtaggttgcctgttcactctgatgatagtttcttttgctgagcagaagctctttagtttaggtagatcccatttgtcagttttggcttttgttgccattgtttttggtgttttagtcatgaagtctttgcccatgtttatgtcctgaatggtattacctaggttttcttctgggtttttatagttttaggttttacgtttcagtctttaatccatcatgagccaagttttgtataatgcttaaggaaagggtccagtttcagttttctggctatggctagccagttttcccaacaccatttattaaacagggaatcctttccacatttcttgtttttgtcaggtttgtcagacacgagatggttatagatgtgttgtgttatttctgaggcctctgttctgttccgttgatctatatatctgttttgataccagttctacactgttttggttactgtagccttgtagtatagtttgaagtcaggtagcatgatgcctccagctttgttctttttgcttaggattgtcttggctatgcgggctcttttttggttccatatgaaatttaaagtagttttttccatttctttgaagaaagtcagtggtagcttgattgggagagcattgaatctataagttactttgggcagtatggccattttcacaatattgatttttcctatccatgagcatggaatatttttccatttgtttgtgtcctctcttatttccttgagcagttgattgtagttctccctgaagaggaccttcacatcccttgtaaattgtattcttaggtattttattctctttgtagcaattgtgaatgggagttcattcatgatttggctctctgttattggtgtataggaatgcttgtgattcttgcacattgactttgtatcctgagactttgctgaagttgcttatcagcttaaggagattttgggctgagatcatgtggttttctaaatatacaatcatgtcatctgcaaacagagagaacttgactttctcttttcctaattgaataccctttatttctttctcttgcctgattgccctggccagaacttccaatactatgttgaataggagtggtaagagagggcatccttgcttcgttccggttttcaaagggaatgcttccagtttttgcccattcagtatgatattggctgtgggtttgtcataaatagctcttattattttgagatatattacatcagtgcctagcttattgagagttttttgcatgaagggctgttgaattttgtcgaaggccttttctgcatctattgagatattcatgtggtttttatcattggttctgtttatgtgatggattacatttactgatttgcgtatgttgaaccagccttgcatcccagggatgaagccaacttgattgtggtggataagctttttgatgtgctgctggattcggtttgccagtattttattgaggattttcacatcaatgttcatcaggaatattggcctgaaattttctttttttgttgtgtctctgccaggtttttggtatcaggatgatgctgtcctcataaaatgagttaaggagaattctctctttttctattgtttggaatagcttcagaaggaagggtagcagcttctctttgtacctctggtagaattcggttgtgaatccgtctggtcctggacattttttggatggtaggctattaattgctgcctcaatttcagaactagttattggtctattcagggatttgactttttcctggtttagtcttgggagggtgtatgcgtccaggaatttatctatttcttctagattttctagtttatttgcatagaggtgtttatagtattctctgatggtagcttgcatttctgtgggatcggtggtgatatccctttatcattttttattgcatctatttgattcttctctcttttcttctttattagtctggctagtggtctatctatttggttgatcttttcaaaaaacagctcctggatttattgattttttgaagggtttttttgagtctctatatccttcgattctgctctgatcttagttatttcttgtcttctgctagcttttgaatttgtttgctcttgcttctctagttcttttcattgtgatgttagggtgtcaattttagatctttcctgctttctcttgtgggcatttagtgctataaatttccctctacacactgctttaaatgtgtcccagagattctgggatgttgtgtctttcttcttattggtttcaaggacatctttatttctgccttcatttcgtgatttacccagtagtcactcaggagcaggttgttcagtttccatgtagttgtgcagttttgagtgagtttgttaatcctgagtcctaacttgattgcactgtggtctgagagactgtttgttataatttccattcttttgcattcgctgagcagtgttttacttccaattatgtggtcaattttaaaataagtgcgatgtggtgctgagaagagtgtatgttctgttaatttgggggatgagagttctgtagatgcctattaggtccacttgatccagagccgagttcaagtcctggatatcgttgttaattttctatctcgttgatctgcctaatattgacagtggggtgttaacgcctcccattattattgtgtgggagtctaagtctctttgtaggtctctaagaacttgttttatgaatctcggtgctcctgtattgggtgcatttatatttaggatagttagctcttcttgttggattgatgcctttaccattatgtaatggccttctttgtctcttttgatctttgttggtttaaagtctgttttatcagagactaagattgcaacctctgcttttttttttttgctttccatttccttggtaaatcttcctccatccctgtattttgagcctatgtgtgtctttgctcgtgagatgggtctcctgaacacagcactctgatgggtcttgactgtctatccaatttgccagtctgtgtcttttaattggggcatttagcccatttacatttaaggttaatattgttatgtatgaatttgatcttgtcattatgatgctagctggttattttgtccattagttgatgcagtttcttcatagcgtcaaaggtctttacagtttggtatgtttttgcagtggctgatactggttgttccttgcaatgtttagtgcttccttcaggagctcttgtaggacaagtctgtctgatggtgacaaaatctctcagcattttcttatcggtaaaggattttatttctccttcacttatgaagcttagtttggctggatatgaaattctgggttgaaaattcttttctttaaaatgttgaatattggcccccactctctyctggcttgtagggtttctgccgagagatctgctgttagtctgatgggcttccctttgtgagtaatctgacctttctctgtggctgcccttagcatttttttccttcatttctactttggtgaacctgacaattatgtgtcttagggttgctcttcttcaggaatatctttgtggttttctctgtatttcctgaatttgaatgttggcctgtcttgctaggttaggaaagttctcctaggtaatatcctgaagggtgttttccagcttggttccattctccccgtcactttcaggtacaccaatcaaacatagatttggtcttttaacatagtcctatatttcttgcaggctttgtttcttttcactctttttttctctaatcttatcttctcgctttatttcgttgagttgatcttcaatctctgatatattttcttctgcttgatcgattcagctattggtacttgtgtatgcatcactaagttctcttgctgtgtttgtcagctccatcaggtcatttatgttcttctctaaactggttattctagttagcagttcccgcaaccttttatcaaggttcttagctaccttgcattgggttagaacgtgctcctttagctcagagaagtttgttagtacccaccttctgaagcctactgctgtcaattcatcaaacacatcctccgcccagttttgttcccttgttggctaggagttgggatcctttgtaggagaagaggtgttttggttcttggagttttcagcttttttgcactggtttctccccatgttcgtggatttgtctacctttggtctttgaagtcggtgaccttcggatggggtctgtgagtggacgtcctttttgttgatgttgctactatttctttctgtttgttagttttccttctaacagtcaggcccctctgctgcagatctgctggactttgctggaggttcactccagaccctctttgcctgggtgtcaccagcagaggctgcagaatagcaaagattgctgcctcttccttcctctggaagcttcgtcccagaggggcacccgccagatgccagccagagctctcctgtatgaggtgtctgttgatccctactgggaggtgtctcccagtcaggatacatgggggtcagggacccatttgaggaggcagcttgtcccttatcagagctcgaatgcagtgctgggagatctgctgctctcttaagaatggtcaggcagggacacttaggtctgctgaagctgcgcccatagccatcccttcccccaggtgctctgtcccagggagatgggggttttatctgtaagtccctgacgggggctggtgcctttttttcagacatgccctgcctagagaggcggtcgggcagcagtggccttgctgagctgtggtgggctccaccctgttcaaacttcctggcagctttgtttaccctgtgagggtaaaaccacctactcaagcctcagcaatgcccctcccctcaccaagctcaggagtctcaggtcgacctcagactgctgtgctagcagtgagactttcaagccagtggatcttagcttgctgggctccatgaaggtgggacccactgagtcaggcaccagagggaatctcctggtttgctggtggcaaagtccatgggaaaagcgcagtatctgggccagagtgcactgttccttcctcccatgcagtctctcatggcttccagtggctaggaacaggaaatccccagactccttgcacttcccacgtgaggcaacacccaccttgctttggcttgccctctgtgggctgcacccactgtccaaccagtctcaatgagattaactgggtccctcagttggaaatgcagaaatagcctgccttctgcgttgatcttgctgggagctacagactggagctgttcctattcggccatcttgccagcaattgggtgaaaaaggttttattttgttctcagtcaactgaattatttttctccattttcttgccactcttaatacacatgagaggccctaggataacatctgttagcctgggactccttgggaacagaggaggtgctacagactccattttagaagaaagcctctattttccttatgaaatcccaggagttaaaagtggatagatctctctcaaaatccaggactctgttttgttttgcattgtgttatctgatgattttgagttttggggatatcagaaactacttcacattatgagagatacttgatgtgtaataactaggcaggaaatatactttatgtgatggctaatactggttatggagggctacttaactatttgcacatttggaacagagaggcattctctcagccacccagaagatataaaaacatccccaatctgacctgagaaatgagactcccacagatgatgggctgattgcaaaaagaactgtttatctttgggttgccttgcaatgaaatgcatggtagaaacactgtgctatcttttcccatagcatttccctcctttgggggatccaggatccagtataaaatggcactcttaattttggggatctggctttgccttcagatgtgtctgattatcagaccctaggaatgcctgctttcctgtccctgttcttccaaggcatcccccgaagccagtaatccaattaagaaaacggcaaatgaaaaatctttaaagtgttgaatcttctgtctgtgtagctatacatgtgttgtgtgtaatgtctataaaaagagctctaattgtcttaagaaataagtgcttaaattaaatatgttttaaaggaaaaataaaatctgtaatgccttttatttcatgtgatgttaatctttaataaataaaaatagtcctaaggattattggtaaaatacaagtgttgtcaaaatgcaaataggtggtctaaatcatacaattctcatactaggtttgataaatgtttcaaggttgtaaactgcctgctttacaacttggtgaggcctggggacatacaaaattaaccacacccctaattatactgaaaaaagtcagactttctctgtgtctagtatataatgaaaacaactcaccaggtttcacattaaagttacaaattactagaagttatcattatgacatgtaatttaaactactaaaaatagatttattttcaaggtgtgtaaagacagtaacgtatgcttttagtaaatgattataagaaggcatggaaatgtaaattttgcctagggataaaggattgttttaaattagataaactaaagctgaagatttaagcaagttatgaaagattgcaaaaattaatcttgcaaaaaaatcccatgtataaacagtaactaaattcaaaatggtactacatggttttttcataaattgagcatttaaataaaggcacagcaagatggtcttaagatgctagtctgccttttagcaaaacggttataaaaggtttgcaaacatttcacccatggtcaaattggttaagattagatgtaattgtctatgagatttcactaaaaattgggattaactataataaactaattcaagggtaaaatttggctttgaacaggattttcatgtaatagtaaaggctaatgaaagatttttgccttatgagtcatcattttggcaaaataaataatttatggtaatctggaattctatttcataacatcaagtattttaaacctctaactaacctgcacaatgtgcacatgtaccgtaaaacttaaagtataataaaaaattaaaaaaaaaaaagttaaacctctaacatacttaagaggcttctcaaaatcacacctcagttttaaaattgtctttcctgacacctggctttttggagacttcagaagggcccttaaagtgtccagaaaaaaaaaggttaacaggattatttaacatggttacgtatgtgagattgccaaaatgatgtttaatcttcttcaggttatattttagtgaataatattagtgtatgtttcaaaattgtgtgggatttctaaaattctaatgtttaaatatatactatcaattataattaaggttgaagttattgtaaacaacagaaagaaccaaatctctgtcagtcgtgtttttaactgtaactaccctggaaattttgtctttcacagacaattgctgtcttgctttgttccctttcaaaagatggtttataatcaagctataggactttaacagttgttctcaaatgcaggtttctaatcgctttgaagattgtaacattggaatagagaaaatatacaggattcatgaggagctgaaatgtttctgaatatcaaacagtagttgaactgcatgaattacactaatagaagtctgaagtaatcttttttaactttttgcttgaaacattgctaatctttgttttcttcttcaaagtcaaggaaacttttcctttaagatatctattgcttttgtcaattaagtaaggtaggcttcttgaacaaaatttgaagcatatttgtttttcactgcctggtttctctaaaattcggagactgtgagtattcttaacttatggcaatatggtttggatcagtgcattaagaatacattttctttataaaagccccttggggaaaaaaagaaatagacttgcctcatacagtcatctatgcagtccctgtacagggttcctgacctgcagtcaataaagaatgtcactttataacaggtctaggagctctgagtttatcttgggactttaagaggaaaggatcacccaactcacaggtatttgaggatataaacccatggctggacttggctttaagaggtcttatctaagattccttgtgaaacagagttccgccaaagtcaatttaaaagcccgtgggaaagataattattcttgctgcactttatgcacagaatcaggtgaagtataaaactaaagtttattctacaaacaatacggttctatcataatttgtttttaccaaaaatgaggattggagagagaaaaattatgctccaaaacttatcatacatttgttgtaaaattttagtctcattggttgtttctgagtgtttttgcctacattttagatgaaccctgcttactcttgtgaaccaagtagtgatctcctacagcttggaagaaacaaaaagggatgggtaaagtaaaaatctggaccaatatgctagttctgggcaattatcctgaaaatcctgccaggtaatgaaaataaatagggtacccataacctggagttttctttgggaaaataaaaccaaagaacttcatagacccccaaaaagggaaattctatatcttgacaacttaaattttagatggaaataatctactatggcacctttgtgggaattgctatactcactctactatttgcattagagctatacatagtagcaccttctaactgaaatgttggacagagagtttccattgctgttgcatttcgcttaagtattatccatatagcagaaataatagctactgacaagcagtaaacatgaaggttttactatctctgagtctgctgggactttttatcgggtttggtaatatgtcacaccctagctatgcaaagtgggttgtaataaaatggaggtttatataagaaaggatcttgtatggtaaattcttgtcctaaagagaataactggctgttaaaaagagggatgtttaggacaagttagaaagttaaacatgctgtagatggtctgtgggagtcattaaaggattaataattgcagcaaagatttaaccaaggttaacactaaagttacactagccacccaaacctaatgctatttatcctaaaaagagttttacttttatattaatgtttcagcaatatctggtggatgcaaaccagtattaaaacccactggaatggctgacagcaatcaaattccaaatggtgctgcagacaaaaccatgacacacctttcttctgaggactcttagatcaaccccaggagcagccctagcttctgttgcccacaaagcaccccctttcagcagaaagtagccagaaagagtcattgtccaacacccccaacagcagttagggtccccactccttagggggaaatagtataggaattaaaaagaaattatttaggcagatagtcagggtaaggaagtcctcagtaaggtttcccttttaataaaaagcagtccccaaatcctttcttttctaataaagaccagcctctaagatcgagctgcagacatagataagaaagctgaaagcttgcataatggcagctgtgccaataggaaaaggctatctgggggctaggcatatccaacatggtggccccatctttccttttccttgcaaatcgcgtgtgcagaagggagcagacaacatggagccaccaagtagcaaacacatttgcacaataaaaaagattagggtggggcggcaaggttctttgtgtgctatgaaaacatcacacctggtccaaccaatctttgggctctatgtaaatcagacattgcctcctcaagttagtctatagaaccctatgcactccaccacaaaactggaagacccactcaggtgcccctctctttctgcaggagggagggctattctgttttctcttcctttttcctattaaacttccactcttaaactcactccttgtgtcggttcatgtccttgatttccttggcatgaggcaacaaaccttggatattgcctcatatgagccatgtcgcttgaatatcacaggccattttatcccttcaatggaaaccatgttaaatggactatttatgattataaatgggtgactaccagatgaacaaatgtggtatttcataatatcggactgctagcttttttctgcctttgctccattttgaccttaagatgttcatcaacccatttttttccaagcaaagtacttgacctttggacctgctataatatttcactgaaatctggcattaaaaaatttaggtgggtatttggagctccatgtattgattacagtttttaaacttgtaataaataactagcatcctttgaacaccaaaaattgtttccttttgacatttaatttactctgtttaaaatgagagatgtaaagtggtggtttgtcagtgacctagccattttgttttagagtatcaagaacttggaaaagtatgatgaaagaactctttttggtgaaggaagtcaacttaaaaaagaaatcactgttttccaaagtaaaactgtgtcagagactgtaagtaatgcatatttaatcttagtaactcaggattgatgtaagcactggaatattttatttgcaaaaatgttatcacaattacttaaatttctttttttttttgaaacagctgcagcaagagttggcacttatgcagttgtctcttcaatctctgttattctgatgattgaagaaaaaaccttaacctatgttatatgatacaagcataacttcagttacacaaaaccacacgttagaccttgtttctgcaatctgttgaatgaaccctagacagttctaagagaaagcagcaattgcacagttatatacatggtcaattaaatttcaacattaaaaataatttagttttaggtttrgccactgtggatctgtatcagttccaaaactgtagaaagcatgggcatggaaaagtacatttgtctctaataaaagaagacaaaacctattttatctgtgcattcttctttatttatcagtaggtttaagaagcaattccaatgaaagtattgttgggagcaggacccccaaaatctggccataaactggccccaaaactgaccataaacaaaatctctgcagcactgtaacatgttcataatggccctaacacccaagctggaaggttgtgggtttacgggaatgagggcaaggaatacctggtctgcccagggcagaaaaccacttaaaggcattcttaagccacaaacaatagcatgagcaatctgtgccttaaggacatgctcctgctgcagttaactagcccaacctattcctttaatttggcccatctcttcgtttcccataagggatacttttagttaatttaacatctatagaaatgatgctaatgactggtttgctgttaataaatacatgggtaaatctctgttcaggactctcaagtctgaagactctgagacccctggtttcccacttcacacctctatatttctgtgtgtgtgtgtctttaattcctctagcgccactgggttagggtctccccaactgatctggtcttggcaaagtatgacttcaaaaaataggtatactctatggccttatcaaaatttttactagcaccttaacatctgtgtttttgaaaaagttaaactaataaatgattaagacaactgtgcaagatatattaatatcagtgttgagccactggcttgtaggtatgttatttccacaaagacatcaaattgccatgtagtttgttttggtccaccattcaatgatatctccccttagcactgattgaaagtatttcgttaacatttatatacgcttacaattatttcacatctatagcaaggtaaattatgtagagtgctttgtttttcaagtttaatatttgtggagtatgtggaagtttaagtatacatgcatctaaaaacttaagtgatgaattctcctacctttccttttgtaatgtgcagtttttatatgtaacagcatacaaaatattcatttccaaatgctttatttagtaaatatataattcagaatatatttggagtaagtcagttaaatgtatttttttgctgagtttctgaaattccattcatgaatcattcaaaacacaatactcccattgggggagtagaagagggacttcctctcatttttccttgtgcttttcattttaattggtccctatataccattcttaccttttcaagattttccaagcttaagaaaaaaaacaagttcattcagattctgtttttctgcctgcaatcacttatacaggaataagtgggtccttatagggagcatttaattcctaaagttgcattttcataaaggattttccttttacccaacacatgtgttggtatataagcctaagtactgtttcaagtttctaagaagattcatatttgagacttctttcagtagttacagaggcaaaataagcactgcagcagtccatgtgagagttccattacacatactggcctatctaactatatagtggaaggacgataattaggtcacaatgtacttagtgtggaacagttgatatttatgccaccccttactacctcgaataagtaactgtgtacttgaagtccctttggcagatattctgaagggaagaaagtctttgcccttaaaagttattaggggtgtgtatatatgcatgtgtgtgtataaatgtgtgtatatatatatgtgtgtgtctctgtgtgtatatatgtgtatatatgcatacacatgtatgcatacttatatatgtatatctacatgtacatatatatgtatatctacgtgtacatatatacatatatgtgtagatagatgcacaaacacatatatatgacttttgtttttagaattgtttttagttcacaacaaattgatctgaaggtctagagatttctcatttaccacctgttctcctgccataccgttctctgctattcatatcccccaccagagtggtgcctttcttacactccatgaacttacatcaacagatcattatcaccccaattccatagattatttcagggtgcactcttggttactatttttttagtgactatttttctcacatcacctgtgctatagcccctattttacttttcataaagagaacatttaatttattctttttttgtgaccattaaattttaggttcgaataccagaaatcaatcacactaaaacaagtgtaaagattcacttttctcctgaaaatggtaagacaaataacttttatttacatacatatgcttgaaaaattgtagttagtgcttttaaattctagattgaagcatatattttcttttgttccataataaacacctgcttcgaagaatggctgatatcaagagcatcatgtctcttaatattgtctcactcgacagctgaatgttgaaatgtacagtcacaaagcactaaatatatccttagagcaataacgcattgaacaaaatttagaggtctcccaaggaagtttgcctacaaaccagtggcaagtcctttcctttagcaactgaaacccaggagaaacagagtctcttgtctctgcctcttggagaggagttctcctgacaccggagggaaatggccatctcatctgcctgatgttagttaaaatttcattttggattgataggttcatatcttcgtgaagatatctaaattaaggtgatcaagtcaaatcacaaaatactctactcactccttaggaggaacttaactcttccctgatctctgtgcacacacctgatttattgcactcacagtacataagctctgagatatgaaattgaaccagaaccagacagtgcattgcattcttatccaggcaaatcaaggctcgctcagcactgctcatccaaagcacactgaaatcaattcttatttatttgtaaaacagacagtgatgatggtatctgtgtcagagggttactgtgagtgtcagaggaaacaatgatggtgagaaggttagacacatggtacatgttgaattaatgttagctattagttaccaataccttcatgattttcactgatatgtattagttgcaaatgtgtatgggataaatgtgatattttgatacatgaatatggaaggatcaaatcaggatagttaggatattatcacctcaaattttatctttttttgtgtgtgttgagaacattgcaaatctcttctaggtattttgaaatacaggataactagagttactcatctgtgctatttaatactggaacttatttcttctctttaaatgtatgtttgtgcccactgtccagcattgctttttccgggtcatccctgctactgtttccagcccctggtagctaccattctactcattacctccctgagatcaattgtgtccaggaataaatagccattaagtgataaaaattgactagttgatagttaataatcatgactggtctattctttgtctgctacactttctttcatctatgtatggcaagtgcctacttaatcttttaagctttgtgtcaaagatcaccttattcttcacctcttctggaatctgtttgttctcaaacaaaattctgtcccttttcctctcttttagtggttctgtacctttcaaaccccatattgtggctgttatttacttaactcttacccctgagagtaaaaatcttatcatagtcctagttatatttttggagcctggtgtgttcccagcaatacagaaggtgcacaatacatgtgtactaaataattgaaataataaatgctggcctggcacggtggctcacacctgtaatccctgcactttgggaggccgaggtgggtgcatcacgaggtcaggagttcgagaccatcctggccaatatggtgaaaccccatctctactaaaaatacaaaaatcagccaggcatggtagcaggtgcctgtagtcccagctactcaggaggctgaggcaggagaatcgctggaaactggaaggcggaggttgcagtgagctgagattgcaccattgcactccagcctgggcaacaagagtgaaactccatctcaaaaaaaaaagaaaagaaaaaagaaaaagaaataataaatgctgaatagacagcaattctccaaactctgtgtttatgaaaacacaagaattaactttatttgcctaattcaaacagtatcttgaaatatattctaacttcccattttccatgaattaaccagacatcgtttgttgccagattttcactaattaagcagttaaatatcttttgctatatatcattttaaaagagcacatggaaaaaaatcagacagcttaggtagttcacgtctcttgagctcactattttaaggagtgaagttcaccccgccacttgcctacctgtctcagtactcacacaacacttgcatcgatgtcctgctaatatacgttaaatcaaatattcatacctgcttttaagtgtgccctagtcaacaaacaggtcacttggttatcattatcttccatccaggatcaagataaaataagtgccagagaaagatgccttatagagattctcacaatgtactagttaccataaacaaattaattactggagcagacattcctacctttcagaaagtgaagacttgttcataggagctgagagtgaagaaaatcaattcttgttgaactgataaatgtcccttctagataattgacattgccattaaagcataaatttgacatttttctttatctgccagctacttatttcctgcatgagctattctgactttttaaattctatcttttggtcatttgccaagtgcttggcctctgggtacacacggaataaattatgcagtaaaaaacatctcagatccttgcacctacttttgatcaggtacacctgtaaatcttaaaaagcctataaagaaatacctaactagtacgttggacccaagacacaaaaaatctcacatactacaatagtaactgaagtactaaatgtttactcaacttagaaaattgcaatcgttagggggaaaatcctttaacaaaagcttaaaattccactaggtggtaaccactgttaacacacacatgcatttccctcttcatatttgggaaactgatggtcgtgtttcctttttagggtggaagaaggaattctccattaagagaagggaaggaaaatataggaaaaagaaccgctctttgaaggcttctattgtccaaatcatgaggaagagcttgtagttctgagttgcacaaacatgctttagttgtttttctgtaggatcctgggcagggtcacctgtttcacgatagctgtgtcctcagacccagtgtagnagagaggtaaaagatgttgattggataaatgtgttacattgctagttcatacctctctgagcctctcttgaagccactgcagggaaaattcctccatcttttcttcgttctgtcacttgcatattgggagcctttcctactgcccttcttatgttgctttggtttgtttcacagcatgaattttttccattacatatgtctgtatttccagggtctagcacatgactgtgctcaataaatatcaaatgaatgaatgaatgaatgagtgaacacgagtttcagatgtcctttacagccttttctcattgaagaaatgcttgttctttgcctcttcaaaagaggtgcaactcattgagaatagggttgccaaatgttgcaaaactaagcatagtcttacaaaactaaatatagatgtgccatatgatctaacaattgcactctttggtaattacccaaatgatntgaaaatttatttccacacaaaaacttgtatgcaaatgtttaagcagctttatctatcattaccaaaatttggaagcaactaagatgtccttcaatgggcgagtgcctaaacaaattgtggcacattcatacaatggaataccattcagcaattgtaagaaatgatctagcaagccatgaaatgatcagaaggaacctgaaattcatattgctaaaagaaaaaagccaatctgaaaaggctgcatggtgtatgattcctgctatatagatgacattatggaaaaggcaaaagtatggtgacagtaagatgattaatgtttacaggggttggggacaggaaaggattaattggtggcatgcagacgattttcagggcagcccaaattctgtgtgtgatactacgatggtggatactcgtcattatacatttgtcattgtgaaccctaatgtaaactatggacttcaggttataatggtgtatcagtattggctcatcaatggtaagaaatgtaccagtctgatatggaatattgaaagtatgcatggggatttgttgaggaagggggtacctgagaaccttacgtacttactgctcaactttgctgtgaatccaaacccatactaaaaaataaagtcaacccaaaaagtacgaggtactcaaataaacgtgaatttcagatacacaacaaatacttctttagtataagcgtgtcccatgcagtctctgggacacaattatacaaaaaaagtttcactgtttacctgaaattcacattaaactgagagttctatattttatctggcagccctacttgagagaagacatctgatcttatagcttcttggtgttcaccacaatgtcaggggagctgttggggacttgggttttgcttcttgaagagctgcatcagatgacttcaggagtacttcttgcagctcaagacaccacactactgaaaaaacctggatgaactggacacactttgaggagagtgatgagaaatatgattcaacaccaagttgcagggtgtgtggttgatgacactgaggttatttaatctggagaagagatgatccaggagtaataggaatgttgttcctaaggagcctttttcgtaaagattcataaagtcattttctcaagctctaagtttataacatcagtgccaatgagtgaaagccacagcaaagcctatttcagctggccagtggaattgttttctaacaacgagagtcattcgaagatggaaggggctgctttgaaaggtggtgccttgctctctcctgggggtatttgtaaaaagttggacaatcccatggcaagggtgctgatgtgagcattaccatatgaatgcgtagactggctggtgacacgtttgtgtgcacacatgcacacaaaagaaatttgacatagtactgactttttaattcatttttattgagatattgcacgtagtccaaaattcaccactttaaagtataactattcactagtttttagtatattcacaagggtgtacaagtatcaccatcaccactatctaattccagaacatctccatcacctcgaaaagaaagcccattagtaatcmccctccaatcttcccttctcccagcccctggcaaccactaatctttggattctgtctctatggatttaggactggttaatattaaagtctccatgaacttggggaatctctgtttctataaagtggcccttggattctcccacccgaacacaagcaggtcattcccaaagacaaaggaatctcagcacactggaatcaatgttaaactcaggccctcaagaagttagaatgcaccatcgttaaatcccacattcttatggcggcactgtctgttcaaataatagtttttttttttttcgttccatataaacatgcactggtgagcctgagacttaaaggaaatgccatgaagtcaaaatagtgaaaactacattttactttgtcaacctaaataacagagagtctctccaaaagaaaagatgtttatttgtgaacagggcattgcaatagaaacacacatgccatagtaaactatacgcctattcagggaggtaaaagaagacaaaggtttttaaacagaaaaatgatgagaatgatataattgttttgaaataattatctttggctataaaaatcagtaacaaaggtgacaccagtccgagtttggtcagggagttgtttggcagatgtccttatagaagtactttttctgcaaggttgcgatgacatttgtgcaaggttgtggtttttgcagccttttgtgatagtttttgttatcagacctacaagcatgtgaaccrtctccatggttttccctggctctgtttgccaggattttcttaacactagtcacccccacttcattctcacaactttcacagattgcagcctcgttcgtgtgtacaataaaccttcattttttttctttccaagtattctgcagttacagatggggtaaagttgctccctagggttttaaaattttcatttctttttttccttagtaacttgtgatcctgaagagaggaactaggaaattacaaccttgtttgcaataaactcaacatagcgtgattagaaaaactgtcctttggcaaaatagtgatgaagacatgaatgggttctctcttgttccatcaggacagctggtaaactcccacacctttgcttctaggctttcttttggyggggcacaaaaagctcagctacaataaatcatcatctagcctcagacatttatgaacagatatgttttatgagaggagcatattcaggctctgaagaaaacatctgctttttattctcaatgtatcacatctgggttatactttgcaaaagtatagaaatgttatcattaaagatgaatttgagttcaattgtggcaaaagccacagctgaaaacatatgacagagtgacagttggctaagaaagctagggcttttatttatttattttaaagctatagctaggaaagggcttacagggccacaggaaaatactctactgagagatctgaataccttccttaaccgtgttcctgcttctgggtttgctcagaggactttatgggtattttgagtcagggggaagttcacatgctgtcaatgtgtaaggaaggctctctttgatgaaatacagtgtggtgttgacttgatgagcccactgttttttcttaaggaaatacctttgtattgactgcatttgaggacaagtagtgactcataaacctggagcaatatgaggatctaataaaatcaacccctttacctcatacattcctagtggatgctccacaagagttctggggctactcagggcaggaagccatcctcacagggttcccaagaattccggacagaaagagagtcatcattcagcaatcctcaggctgcacttgcacccacttccttgtaaccacgagccccatagcactagatcctgaccatttgcatctccgttgttcctatcgaaaggatctctgatgttagaatcagaggcttctgtttaagaattgcttcagcagatcctgaattccagtgaaacagctgaggccaaccagtttgaagatccccacagaggaacccaatcagcgtgagaacacagcttcttcatcgccctgtcccatgacttcaccctgcactcttctaccaatcagtgatctccatgcttcggcccactccaaaatccttaaagcccctagccccaaactccttggagagatggattgaaggtttcctctcatctcctcatttggcagccccatgattaaacctctttctctgctgcaacctggtgtctcggggcagtgacttgccacatgcatggggcaatggacttattacggttacaggagaaccctgacctacagaaatgtggaaaaagtttacaaaccatttaggaacagcaaaagggacttgtggctacatcactgggaggaggttctgtacaaccgtgtcctcccaagttggcctggcaacagagcatccttgcaggcactggggtcagttaacacagcaggatgcagaagcataggtgaaaccaagccaagtggccatacaacccctaagcagcagtgtggcagcccctgctagctttgcttgccactgtctaatggatttggtcaataaggaggtgatgagccaagatggattctgagagtgtatgacttacacagacagcaaaagtatagtcagtatggtgccagctccccaaggctcaagtcccacctgacaacacaaaaccaggggggccaggtgacagatactgtgagctaggggtagcccctctgctgaggtcctacctctaacctacagccaggctgctttatagagacacacagaagcctgaagctgtatcctaaaggggcaagatgtagaagggcctgtattcccctcaaagtagagagatagatggaagagaagtggccaagagcctgtcttcccaaggtggggttggggaaatgtcttttagctgctccttaaaaggttatctcctctggctccagaagaaattgcagggtatcccaccatgacatgggccagaatgtggtcaacctttgcctgtgtggcccatttggtgctgggcatggtggcgccttttggcctacaaacanttgatcagtgccggaggagggaatctgtgcctcaaaaacccatgctacacagcatgggtcctctttgatccagcagaagctcttgcaatggtagcccaacaagcaacttatgatgccagtctttggaatgggcaggtttaagatcacatggagttgtatgctaatgaaattatggagcacaggtcattattgaatgttggctctcttggctactcattcaagcctgttgattatatcctgggcaataggatagaatcatccaagtttgtcttctgtgtcctccgtcttctgttctgtagtcctgtgtgcaagatggcacaataatccaagtttgtctctgttcctgctctgtcgtcttgcatctgtttcactgtttgtccattaaacaccagggcctttaagaagtaggcccaaaacctcatgggaatgaccttccccacagaggtctgagttctgagtgcttctttgtctctcttgaacatcaatcaccattgcctgttccaagacactgttgagaagccaatactaagagatgtggttacagcaggttttcctgcccaggtatcctgagaactccctggaaattcccccatcttatgattcacagcatgtctgtctgcacaccttcatccttagcatttttgtgttgcaaaccagggatatctttcttcattcatgtgctcatgggttgccaggattcttgtactatcttatattgtaatgtgtaacacatagccatcctgtgtataatgttttaatactttcagtccattcctttcatcattaaataagcatttatcgggtaactgttaaattccaggcatcgaactgaatgataaggacacagagataaatgtaatgtgcctctttgtatcattaaaagcttatgataaattactttgccatatacaactgctattatgctgtacatcagattatagctcttgtccacacgaggtgattgatgatgcagctagctctcttctaataatgaagaaaacctataaaatgagaatacttctgctgaacttattgagctgcaaaattatttggttttattatgtggtgggacaagaacttaatgcccattgcgttgattygctatctctgacctgactttccagacaacttaaaaaccagaagaaatataaaaatctttcaagatctaccaggaaaactattctgagtatttaaaagaggaaacgcaattcaggaagtgatgaaagatcaaactccggaagctactaagacccctagaggtaggatcctaggtggcaggaagttactagcaagcccaaggtggcaccacctggtggaagctgaaactcaaacaggcatatccagagatgctggaaatacacaaaggatacggacacccggagacacctgccactgcctcccattagcccaaccagctggatgcctgcttggaagagagcctgaggccagagcttgaaggcatagcccagggaaagtgagggcagatacaaggaaagtagcatatggacagagatgtgtgctctcacagggacataataaacaataagcattaaatattacttataataatatcttacgctatttttgtattttacataatgatactttcattctacatttgttgttgttgttgttgagtcccatggcaggaaggaaaagtaaagccagagcaagaagagccagtgtgtccaggatgagggtcagtttccaggttgaaagatttaggtcgggggaggctttagaaggtgtcactggagcaagttttcaacagctgtaaggtgttagttgtgcaaaattaccccccggtgtttttcaggcagaggaaacaacaagaacgcagatcctaaagggaagcagactagaaatgttccaaaatctgcaacaaaacagaaagaaaagcatgcaaactgagagcagaatcacttaaagtcagaaaggagaggatgccccggattccccaccaaggagagaagcaggcagctgaaaagtagaatcttccttcagtcgggccctaagcgggcaaatcacatcaaagcaacaacaagatgcatttattataaaatagtatttgatctgtaaacatgaataattcattcattattcagtaaagacttattgaatgtttgttatgtgtcaatagtggcaaatttggtagacaaagccctgcctccatggagcttatgttctagttggagagatacagaacacgcaagtaaataaaataagcaagtgaatgtaaaaataaataacacaacttgagggagagggaagcgttaggaagaaaaatgaaggggaataagggtttagtgagtgatgcggtagagggtatatgtagatggagaaatcagagggtcttcacataaacacctttctcagcttatgataatccattttatttttaaaattattttcatcaatatataataggtgtacatatatgtgataatgtaatgtatccacttatatattttatttctatacaatggctattatataacttttatacgtgatctatttttggttttagttacatagggctataaataaaaatctacttaaatactgtattttaagtattgtttaatcccatttgacatgcacatcgatactcataaaggctatgtctatttctgttagatgttgtagaagtgttttcctcttggtgaagaatgagacggtgatgtttgagcagagactagaggacctaggaagactggtgtgaaaatgtctttggcatagggaagagcatttgctaatcttctgaagaaagcataagcttcagtgcagtaagaaattccactggggctggagtgggcagaggagtgggtgagacaagacccaagaagggcagtgcagatgagaaggggttgagcaggccaggcagaagaggttggttctcatctctgaaggaagggaaatcacgagggggtggaggacaaggcaggccgtcgtgtgttttgcactttacaagctcactcccagcagagcatggtggcctgcacctgcagtgccagtattttgggaggctgaggcgggaggatgacttgagcccaggagttcaactccatcctggatgatgtagcgagatcccatctctaaaaataaaacataaaaaatttaaaaagctgccgctggccaacatgggcaaatagtgtagagggcaagtgtggaaggaaagggtgccttaaatgacgatgaaaggacaaatggaaaacaaataaagcacataaaatatgagcatatatttacaagagataatgcaatgtttagttattcttaaaaaatacaacatacagaaaaaaaaaacacacacctgtttgttaaaatatcctatcaatttatggcagcaaaaatagtgaatagcgttgtaagagcagtttgttaatgtagcaacattggtcatggtcaaaaaactaaacatgttctaagccatcacttcataaatactataaagacagatctcacattttgcagttataagctgcacattatagtaatcttataaaaagcaccacgcattttatcttattcattcctagtgggtcatgttaatgtgcgtgctagtcttagaaacccagctagtaataatctaccaacatctttatgtcaccggttttatgactttattaggaaccaaaaatctcttttttactgacatttcatgtttactagactagtcatttagcatgaaaaataaaaatcaatacagttagtcaatgtaattttaaaatctgagatgattgctctagaattgcttttaatatatctcctagaaatcccgtaatactggaaataaatattggtcacacacatttagaacgtagaaagaaaacccagcctggttgtaattcggtatggcgggagtcgtgatcttgactggatacagcagagttgaggagcattttagcaccttagtagaaatcatagactcagtttaaggatcttgaaggcatttgaccatttaattcattttcttagctttactctacagagctatttgttccattcttcatccaaaatgcggttttaacattacatgagaaaaatgtgggttcttttctctaatgttctcttttgtcttcatggaaagaacgagtataggcaaattagctggcccgtagaacaaagcaaaccacgtaccagtttaaaagagacctacgctgagtgcatgttaccatgtccctcgtttatgcacacagaataaggattggggtgtttcaccctcataaccaagctgtgagatgtgagctagagctgcctatttcacaagacctatttttatttatttatttattttttatttatttattgtgagacagggtctctgttgctcaggctgaagtgcagtggtgtgatcacagctcmctgtagcctcaacctcctgtgctgacatgatcttctcacatcagttttgtgagtatgtgagaccacaggcacctgccaccatgcccggccaatctttctattttttttttttttttttgtagagacttcgttgcccaggctggtctcaaactcctgggctcaagtgatcctccctcctcagcttctgaaaacactggcattacaggcctgagccaccgtgactggctgaaacacctaccgtttacatatattaacatcactgaaattgaagtgtatctcacagcataatcaacagtgtcttatagtcactcttggccagagagcaagcaggaaggtcatctctacctgcacatgcatgtgctgggcctggccatagtctcttcaaatgagttttgtgagctgttgttgctacaagtgggaattctatatgcccagcagatgccattgacagcaggaggaattgtcacctctctgaaaatcaaagaaatctgtttcaaactatgggaggctattgtagctgacccaagcatctcccagagctgtcgtgaaggcctcagactacaatttgtaagaaacgtcaggctgatttctaatacacatttcttaacttccaggggtagctgattgaattgacgaggaaaacaaaaacaaaacaaaacaaaaaatactacgtgtttaatcacacaagcaagcctctgcagatcacttgaaagcagaaataaaagtgctgagcagatgcactctctccccccacatttccctccctccctcaacctccagccaacctcagctgctttagaggggaaggctagggctaaggtctctctgccgccaggctgaattgagtaccatgtggatctctgcaattgtgctgggaactttgtgcggagaagtgattcaaattattacggctttgttgaatacaggcttccaagtcaccatcccacggggttccatgtgktgagtgaacatccaagttcagctcatttgggcgaataaggttccctatggcatgttgaatgcccttgtgtgggtggggcctttcggaggcaattcagcatactgtttatgttgcttttacttgtgaataagtattataaattgatgcattgtagtctgtttcttgtcctgtgattgtttggggcaggggcagggacttccaatcatggagaaccataggtgcaaaattgttagtgttttgagggacccacaacactaacgtcccttttgagctataatctctatgactgacgatttgccaagtggagcctctggcagaagaaggcagcctccacccaggggcctcctggggtcgtggattcatgcctcccctaatgtacctgtcaagtacagccctttgcaaggcagcacttagcttgctacagggctcttgtcaaagctgaacacctgagctgtggaggtctccttgttctccagcctgctattactgttttggggtgcatcaatggtgactcaatgactaacgagacaggaaagggcccaataagcctcagttgtccagtggaaatagaattatcaagaaggctgcttacctggcaccagggcatctccgctttgcattttggcagtaatttctttttgggaaactttatttgctccactcccactggttgaatggggcctttggttccccaagtttcccctaagtgccagggcctagttcaccgatggtttgcctaagatgaaacccaatggtatccactgtgttgccatggatgttcagcttcagcaatgtccacgcaaaacctggagtggggagaactcaaggctgttttcacagctctgcacaagactctgttgatgaaacttgttttattttatggactcgcaggggcttcttagttggaaaattcatacatcacagcagctgactgagccatgtgacatgccactgcagatagccccattcaagggctctattctgatgaggcaacctggaataaagctgcatccctcagattacccactgctgatgggaccaatgatgacctcggacctgaggtcccatttgggggctactggaggtgccctctccttgttcaacattcattattttagaacttattcaacacagtgccaggaatgtttgtcaaatcactcaaaatggcatgctggttacatatgatcccagcagagcaagaagaggactgcaagttcaacattgaaaagcaatcttaacatttttagtcacaaacattcataagtttgttaaaaacaagagctcatgcaatagaaaatgcaaactgcatagtcagaaataaagtgtggagtgatggagataactctggctgttaataagtaaccttcaagagggtggagactttatgtagcctgctattatatcaccctgtctagaccaggacttgaaacatagaaggaggctcagagagttactgagtgaataaataatgttgaacttgctgccagagaggtgaaacacaaaattactgggagaggggagatcaaattagaaacaaagctatttaagcttacttttcttccaccatcaagagaaaaaggagaataagagcaaacaaatgaagcaaaataaatgcttctcattgttcttcctgtggacacctttgatacctgatagacgataaactgtcagtaaattgcagtttattgggagggagctcttgcaggtgctatttccagcctttctctagttagagaaaggaagatagaaaggttttcatctctataagaagttccattgagactatttgaataggaactgcaagaaggcagggtttgggtggggcatggagtagtggaacagtagaagaaatggaaaacatccacattggttaatttttccttcgaaacatcacccaaaatgttttgaatgaaacattctgtgctgtgggttgtttaacatcttttttaaaatattgtgtcctgtgttgtgtgtgtgtatctgtgtgcatacgtgtgtgttacgtgttcgtgtctgtgtgtgtgtctctgtgtgtgtgttgttatataatgctgttttagttgaaggatgtgtttatttatttggttggttttcctagaactaatgratgatttgaaaaacatgggattggttatgtcagtgcttctcaattggggagcggggcgattttgccccaccggggtccctttggcaatgtcggagacacagttggtgttgtaagtggtaagaggttctactaccatctagtggtgaaaggccagggttgttgctaaaaatcccacacagaagacagtctccaagacgaagagggatcctgtctaaaacgtcaatggggttgatgttgagaaaccatgagtttcccattattttaatccaattaccaggacttttctgaaatctactatttgaatttagggaaaagtattcttcttgttgattctctaacctggaggcattcaaatcaccaaggtgctttaaacaatactgacaccaaagccaccccagaccaattaaatgtggatgtctcgcagtagggcctaggcctctgcattttaaaattcctaatagtttttagcattgagcagcacccatttaaatgatataatgtaggccgggcgcggtggctcgcgcctgaaatcctagcactttgggaggccgaggtgggcagatcacgaggtcaggagatcgagaccatcctggctaacacagtgaaaccccgtctctactaaaaatacaaaaaattagcccggcgggctaattagtgtggcgggcacctatagtcccagctactcgggaggctgaggcaggagaatggcgtgaacccgggagacggagcttgcagtgagccgagatcgcaccactgcactccagcctgggcaacagagcaagacttcgtctcaaaataaataaataaataaaataatgcaggaactcaaaaccacccacagttgatttatcttatccacactaaaagtatccacaaataaaatgacacaattctccaacttaaaccagaatttaacagctgtcattactccataagttcctatgtacttgtttatattttataaaagaagattttctttcacttaaagaaaaatccacattaaaaaacagaaaagaaagttttggaatataataaaagtatttccttctttgttttgacaactttgtggcaaccttcaagttctaagtccatttctttatagtgaatatttcagtgactcatcagagaggcaagctaataataataataataataatagttcaccttatgtagtatttcatgctgttagtgtgtgagattgcaagtctaaatcaaagccattataatttatctgtaattagaaaccagcacttgccgagcaaggtgcttgtaatctcagcactttaggaggctgaggcaggcgaatcacttgaggctgggagttcaagaccagcctagccaacatggaaaaatcccatctctaccaaaaaatacaaaaatcagccagatgtggtagcacctgcctgtaatctcagctgctcaggaggctgaggcaggagaatcgcttgaacccaggaggcggaggctgcagtgagctgagatcacgccactgcgctccagcctggatgacagagcgagactgcatctcaaaaaacaaacaaacaaagaacaacaacaacaacaacaataaaactcagcacataaaaatgcctgtggattgagaattttaaaatcgcttttagaataattagcggtggggggaggggggagggatagcattgggagatatacctaatgctagatgacgagttagtgggtgcagctcaccagcatggcacatgtatacatatgtaactaacctgcacaatgtgcacatgtaccctaaaacttaaagtataataaaaaaaaaagaagaataattagctgtggtttgaacttaaacagtctgcttttttacttggattcttattcacttcccttcactttaattacagtggtgcaagtattatctctctctctctctccacccccgtctctttctctctttctctctctctctgtctctctccgtctctctccgtctctccccaccatgtgctcagaactttcccggaattagttacgaagttagaaataaacagaagttgacttatcatattactgaatagtctcccaatagcatttaaaaagcacatttaacaggagtctctcctgaaactcacccaagtaattggaaagtaaatgagtcttaacagagataaaagaatacaattcaataaaagtagcagaaaacctcaaatgactgacacagagagatttcccacatattacttcccaatattgcattacttaaaatttgcccaaattacccgtctgcacattccagagctcaccaacctgtagatataaggaaagacatattattgtagtaactatttttctagcttgtggtgccttttaaaatcctctgaaatctccttatagctgttttatacccacacttactcctatgtgatctcatttggcccattttattttgaacattatgcatataatgctgatcctgaaatccgtgtctcccaggagagtgaaaaactataaagaaaggcattccctccctgcagacaggcacagtgagctccacagaaggccagcctcattcttatgcctttgcgtcctcatagcttagctcccacatatcagtgagaacacacaatgtttggttttccattcctgagttacttcacttagaataatagtctccaatctcatccagggcactgcaaatgctgttaattcattgctttttatggctgcatagtattccatcatatatatatcacagtttctttatctacttgttgattgatttgggttggttccacaattttgcaattgtgaatggtgctgctataaacatgtgtgtgcaaacatctttttcgaataatgacttcttttcctctgggtagatatccagtagcaggattgctggatcaaatggtagttctacttttagttttttaaggaatctccacactgttttccatagcgactgtattagtttacattcccaccagcagtgtagaagtgttccctgttcatcgcacccatgccaaagattggagacttggggagaagagcgggagggggacgagagacaaaaaaactacaaatatggtgcagtgtacactgctcaggtgatgggtgcaccaaaatcccactaatcaccactgaagaacttactcatgtaaccaaatacaacctgtaccccaataacttatggaaaaataaaaataataataaaaaaagaagaccagtgtcattgcaagcatgggttgtttaaaccacggagttctcatcttctcctcatgtgtcagttccctgtcttggactctttaccttctcattttttctgacagtgacatattgtttcactaggtacttgagacagctctacaaaagtctagggctattttatccccaaggctaacacttttcagtcatctgaacactatcttttggttccttattattcctaagaaaaacactcaattactaagccttattcttctctgactttccatccagaaagaatacaaaacaaacaaacaaacaaaccattgctttctgacccattcttttaacaaatgatgcatttaatattgcaacagaagcttaggaccctgtgttgctgcttaagtgaccatgcagtgtctggcactgttattttgacttcattatatttttaattttcaggtacactgagttagataaattgtaactcctggtcygtgacatttgcaacattgttccaggtatagcccattttacttatttagctaactatttaattaggtattgttaatagcgtaatggacaccagaaaatcccactgccactaacaaaagctaggccttatacaatcaacaaatcctcctgttttacccactattatcttataatctatgtctacgatgatcgcttcttccccttttatataaatttattgcatatacttgtgttttttttttttttttgagacagagtctccctctgtcacccagcctggggtgcagtggcacgatctctgctcactgcaacctttgcctcctgggtttaagctattctcctgcctcagcctcctgagtagttggtactacagtgcatgccaccatgcccggctaatttttctatttttgtagacagggttttgccatgttggccaggctggtctcgaactcctgacctcaagtgatccacccaccttggcctcccaaagtgctgggattacaggcatgagccatggcgcctgccctattgcatatatttgctactaataagtattttttttattctagttacctttaactttataaagagatagtatatcttaccatgtgtagtctgttggcatttttttcacatactgttaaggtttttgtttaacatatgcatttctgtagttaattttaacagctgtacaatatttcagtatgtgaatgtgcaagagtttatgcagctgttgtcctatcgatggacactttattggtttcaggattttgataacgtgagctgtgctgctgtaaagttgcttggtcaagactttgataatatatatgcggtagcttcagttgggttgcaccaggagtgaaaatgagggatcgtcatctatgcgggtggttggttttttggtggtgatgtccgactcttttccagartcattgcattaatcgatactcgcaccagcaaagtatcaaagatgctttgaagccaggtgcagcggttcatgcctgtagtcccagctactcagaaggctgagacaggaagatcgcttgaatccaggagtttgagaccagcacgggcaatagtaataccccatctctaatatcttaaaaataaaagatgctgtagagccatacactttcaaagaagttagcatggtcagacttctaaattgcagctgaattagcatggtcagacttttattaaattgttgccaaagtaaaaaataacagagagtgtgggcttattttatattttttccaatcaccaatgatgctaaacatgtcttttagaaacacgtttcttcctctgtccatgcctgtttataagattttctcttttttttttttgttctgtttgtgctcttttcttttcatgtgtaggaattaattccatattctttattccaacactttgtctggtgtgtattgtgaaggcattttctaccacattgtaattagtctcttttctttctttaagatgtctttggtaaacaatatgccttaattttaacatgaccaagtggattgaaattttctctctctctgttttttgtttgtttgtttgttttgttttgttttgtttttttgatggagtcttgctctgtcaccaggctggagtgcagtggcatgatctcggctcactacaacctccacctccctggttcaagcaattcccctgcctcagcttcctggatagctgggattacaggcacacgccaccatgcccggctaatttttttttttttttttttttttttttttttttgtatttttagtagagacggggtttcaccatgttygccagactggtctcgaactcctgacctcaggcaatcctcccgcctcggcctcccaaagtgctgagattacagatgtgagccactgcgcccggcctctctatctttttttagttaatgcattttgtgctttacttaagaagtatctctctaatactaaattcatctttgatctgacacctgatttgtctctcaggtaatggtttgaggatttccttccttgcttcgctggtcctcttcaggctttgctggaggataattcattattgccatcttaagctttgtcttcgaaggtgtcttgtctatgagggaacttcaggctccagtgtcaactctgactttggaagcaagttctggggctttctcccagggtagccctttggtgccccctgctggcaagtgtaaccaggacagccagcattaaatcagccaaactactaatacattctgggaagcagagagaatgtggtctgatgaattttgggtttaggcctccataatttcagataacgtttatgctattcgtaaattcttatatcatacttctgaacacctagagtaaaaattacatattgaatacaacaattaagaagttgtaagaaaaaaagaggccgcaaattgaggagtgtcgagtatttccagttccaggcaaataatttgttgagcgcctatcagaaatagccatcagccataagaagtggagatggacatggacatgtaaacaaagacttgataaggcgtgrcgaacataataaaaatgaacagcatgaagaaaatactcaggaggtgtcatctgagaatgttagaaaaggctgcccataggacaatacagttacctaaggtggggacaataatacatttctcagtgcaccagggttggcaggccaagaggagagacgaccatttcaggggagagagcaacatccaccactggcatgggcatggagtgacagcgtgaaggcgccagctgtttagttcttccgtagcgtggctgacactgatgggtctggggaaagatgaactttgaggagggaagacattataaagcaactcttactgcatgataaacaactgtcacatcagcaggggggatccagccatgatttttaaagagggcaacaataatagcatatcctaattttagaaagacgtgataagagctaacacttccggtggtgttcaccgatattaactcagtgaatacttatgacaccacaaagttggtatgtttttcccattttccatttgagaacactgagctacagagaacatatataatatccccaagtccacacttctaaaagcttccacagggtcgactggggttcatacccaggcagtcttttgcaggctctatgctttcagcagcttttatttaattgaccgtcttgggtacttttgcaataggccaggcacgcttcctgcactgggcaatgggggctgggttcctgaggcaggattgtgcgtgtgtctcgcccttggaaacgcccaacagggagttggtcttacgtagcgtagtgaaagctcagggcagaggtggttgagagagacacatgcaaatcttacagctctgcagagcaactagggaaaggcccccaaggagccactcgtagacaccgcctctttgcatagctgcttgacccaaagcagagtcttcatctctgggaaggaaactcagggtctgtggtgggccccggtcaaaaataaatgacccacacctgggccagagcccctcacccaagtggacaccaagtcaggactggcaaacgagattctggttttcacagcatagagagaagacagagccccagtactgactgggctctgtaaggtagagcaacagtgtcctcaattcctgccacatggacttctttcccatgcaaagcctccttgtccaacttgcccttcgattctatcacatggaacagattatttcaagaacagtgacgaatccagaaggatgtaaaaagaggctccagggaaaaaaactgaggaagagacatgggaaatctagggatatgtgctgtttaggaacaggagtttcaaaggaaggggtcttgggaataagtcagttccataagctcaacaaggtaagagcaaagcagatggggagatttttgtatcctcagcaagaagtaattcccttgtctgctgagtggcttgaagaccactgagtgggaaatcttctggtccaaaatgacagaaaagacccgtgttctactttgaaaaaatgaacaacgataatgaggacaggatataactgctaatctagaattctgttgtagaaagagtattctccaaaaataaaaatgaaacaaagacatggcaatgcatcccctcaaaaagaaatctgaggccgggcatggtggctcacgcctgtaatcccagcactttgggaggccgaggcgggcaaatcacctgaagtcgggagttcaagaccagcctggccaacatggagaaaccctttctctactaaaaaacacaaaattagccggacgtggtggcgcatgcctgtaatcccagctacttgggaggctgaggcagaagaatcacttgaacccaggaggcggaggttgcggtgagccgagatcgcaccattgcactccagcctgggcaaaaagagcgaaactccatctcaaaaaaaaaaaaaaaaaaaaggaaatctgagaaaatctgtttccaatagaaccatactaatatatatatacagttgcatatatttaacttcttccagcagaaggaatgatcccagatggaaacatggaaatataagaaagaagaagcaatgtaaaggataaataaatattaaatcataatgaatattgagtgtataaaacaaaaataataaggcttgtaaaatttaaattatataattagaattaaaatgtacaaactgacaaagaaaaatagagtctacaaatagtccttgtacttatggaaattttgtgtatatatacatacaaaattgtatctatctaaattatctatctatctatctatctatctatctatctatctatctatctatgatgtcttataatcccttaatgtctgagtaggcagttatgatagtcataactttaaagtttttgcagacaatgataaaaagtcttttgattttaaataaacaatgaacatgtgcacctaatcttctgaaaacagaaaagggtttagatctcttttcatttctttctttgtgcataatgccaggaagcagtaattcactgggcgacatcctactaatataaatgagctgaccatttctccaatcacgccactggtcttcactggcttcctctgtatcagtaattcaggagcatttctgcctgtatgaatgctctcaactgaatgcttttcctagcaccgtcctcctccatatatgaaaagcattatgaacattgagatgctggaaataaattcctcagggataaataccacctgaactctcatcaattcagaatggtagctactaattatttgcaggagaggaaaaagaaaagtgttgaatacatatggacacctccccttcagtttctttttgagcacagaagttgttaccatgttgctaactaccttagctatctcaggcaatgtccagaaagaccaggaagaaacattcccattaggaatcgccatttaaacatcaagtgaatcccattcaccatctttttttcttttctgttttcttattattttagaaaacagggtctcactttgttacccagcatggagtgcagtggtgcaatcacagctcactgcagcctcaacctcccaggctcaggcgatcttacttcagcctctctgggactaggggtgtgtgccacttgccctgattattttattttatttatttatttatttatttggcagagacaaggtcttgttatgttgcccaggctccatttaccatgtttgatattcaactgttgtccatctgtgtcccagtgaaacacagattgctaagaaaacaaaaggcgaagtgaactcctggccttggcactccatggaactcaaagtcgacctttgatgtgctacatagtgcctgaggagggctgggcattcagagtcccagaaacaatgaggagaagagaccagaagggagtcagctttgctctctgactctgaaacacccaaaattcaatctcagagcggaatattctccagttggttcatgctagccactacagaaaatcctggaaataaaatatgtctctttgttttgttttatttgtggtcctaggggatgctttttattagctccagtggatacagaagaggaaacagttagttcatgccttagttacattcagaggccctgcccgcttggtcttggagcaatgcagggcttcccccaggtttccaaacatgtttatgttcatctcttggctgttgtctcatcttgtgcagagcggctggcgagtgttgaaaggtagtttctgggtcttcttcatgttctctaaggcagcagataaagcctgtcaactttttttgcccttcttttccctggcgtcaaattttattcatatgttctcacattttacaaaatcttaaaaagcaagccatgtaggagctgcaaaaaaagtggttccaaacagatgcttccatagatgtaattcacagtccacctttgtcagttaattttgtagggaatatttggaaagtgtttaaaagttaggaaaaaattgtttgaaactgctatactaatctccctaatttaggtcagtgtgactgtagagatgcaggaacgccttgcaatattgaaatccacactggaagtaattaagttagtgctaagtgaaaatgtggcatgattaccccagtcagatatatgctgtagagtggacagctttgtcctaaaattaggttatctcacagagacggttctgtgctttccttcccgttttatttaaatggccagcgtgtggcgctgtctcctgttaaaaagctgcttttgtaatttccagcggcttctctccaaatcgcttggtatttatgtggctcaatgtcaatttcaaaaggcttgaaaacatcagagaacaaaaacccacttaatactttcaacagaatagagtttcagtaattctgaagagcacttgtagatttattttcatgtttaaacatgaaattcagaataaacatgatcatttatttgagctttgtttaaaaaaactgcttcaaaaaagtctcattttacaaaattttaagtacaaattttactgaaaagaacattatgctcttcacatgaaaaataggccactcgaaagtgagaaatgtcatttttaattaaagttatatcatttaagacttcactaaattcatgcttctattaatttgtttatgcttctccaaatattttaggggcaagccagtaacatttttgtcatacatttttgaaatacaatagttattgtttatatttttaatagcctcccacatttgactttaagtatttctaactatttgtatgtttttcaatatctacggcttgtacggagaatttgacatgagagccctaagtatttatggttgcttataatagtgttggtaatgttagaagtagggtaaaattagctaactgccttgtcactggggcaagcgttcattttacgggcgtcaagcagcctgtgaaaccactgggtttcaaaaacccaccctccttgctgggtgcagcatctgttctgctgtgtaagacaccagaatcaacagaggccatcacatgtgctagagagaccgattcatggtggggctccgggagggaaagtgcacccacagccgaacatcaccattgcacatcaccattcccatcgccagacaattgctcttgacacatgaaaatacgtcctctgacatactttatttatttatttttattttattttattttgagacggagtctcgatctgtcaccaggctggagtgcagtggcgcgatctcggctcactgcagtcttcgcctcccaggttcaagtgattcccctgcctcagcctcccgaggctggctaatttttcttttttttttagtagagacggggtttcaccacgttgcccaggatcgtctcgatctcctgacctcgtgatccgcccgcctcggcctcccgaagtgctgggattacaggcatgagccaccgcacccggcctattttttactaattattttaactttagtaacgattgcagccaggaaaaataccttagcaatttcttagtccagactctcagcacaagtgtaaacaggcagcaaacaaatttaacactgattgatgatgacatgacaatatgaaagggcaaagagacaaattattgagaagtggtggtagttagaaatcatagtatttgacaatttttcgtatattttgcaaaggaagtttaaatgtcattaaaatagtctttagtgcacaaaagtaataggaaacacaattctgaaactttgtaaaatcttaggaaacatcaagatgactaataaaagtgatcgctttaaactgtatggactgcaactaaatttttataatctcgttgaaggtgaaaaatgtgttatatgctaaagttatcmccaaatagggtatctagccttgcaaggtgataaaagaaagcagaagactgtaaatggatgcggtggtcttttgtgtaaactagagtgtatattcaaagaccctatgccaaaagcaatcattgttatttgtaaaatcattaaattggccatcgggaacagatgggtacagtaccataaaggtacacctcattcctgcctgaaaccatattgcgaaagatgaaaatctgacatttatccattcagttattaattgtatcctgtgctgtgcagaagagaaattaagtctggaggagaaggaaagcggttaaagaagagctttagcggaactgagctagcaaagcctgagaacattgcctgagagggtggaagtatgggtcatggccagtgagcttgcagggcacactccttcatcttgccactgttgcttttcctgaagtgaactgcagtttctaagggaagatgcacactcttgcatcatcaaatggaggcaactagaaaggaaactagacctcatctgtgactttcttcccctcactttactttcccctgagaaccaaaaccagggacgatgtcgttttgttcatgactcctaaatgctgtcatatttaagtatttgttctccaagttttgagtgagttctcattttgcttttccaagagaggcatgtcagataaagattatatttgctaccttcaaactttatccttatccagtgtagctgaaagccctttaaaaaggcaagttgctttctgaaaaaaacaatgagtctaagagagtcttagctaaatgtactggaaaaatatgtccatttgattgttaagaaatagactagtatgtccaatccatataaacacacatctaaaaaaagatactttaaacaacagtaaatcatagatgctatttaaataaaattttttgtaccatttttaatggttatgtacttttttttatttgtttgttttgttttttgttttgagacagggtctggccctgtcactgaggctggaactcaacggcatgatctgggtgcactgcagcctcgacctcctgggctcaagcagtcctcccacctaggtttcctgagtagctgggaccacagatgtttaccacctaccaccattcctggctaatttttgtactttttgtagagatggggtttcaccgtgttgcccgggctggtctcaaactcctgagctcaagtgatcctcctgccttggcctcccaaagtgctgggatcataggcatgagccaccgagtcgggcttcagatgtacttttaaaatcaattatccctcaaagtgtagtccctggttgaatttgtatagaatcacttggggtattatttaaaagctgacatttcaaccctccaccccggatatactgactcagaatctctcaatttagggccctggagtctatgtttagtaaagatttcaggtgtttctcattctctgcagaaaaacaggaaaaaaaaaaagaaagaaaagaaaaaccaataattaaaatacaaggaaaataataatttttggaaactgtgaaagagggctttattttgtgtgatttctccagaacctgaccaagacaaccacacattttggtctatctttgttcatgtagatataaataagagataattaaggtgcttttctactctctttgttaaatgtgtgtttgtctatttaagtcaaaccaaagtcaatgtgaagttaaattcttctctagacaaattcggatcatgggggtcaaggagatttggagaaagacatactaagtaccgtcttactagctgcacccgagggtcctacccctttatccatcatttcctcagcatactcttagggttctcctcccctgtggttggctttcatgaacttagattgtggcttacctggtaatgtcaaaagtcagagaacttccatgtttcagtttgcaaggtgagctgcataataagttgggcatacatgggcagaatgaaaacaaaacaaaacaaaaaaacaccgaaatttgactgttattctgactttactagaatgctttccttttaaaagttactttaagctgcaattaaagtaaataatatgagaaaggcctgcgtaatcacagaggatgtctgtgattattctaaaggaagaaagcaatataactgcaaatattattttaacatatttataataaggtggctctatatgtttaaaaccaagttttctgttaaactgactgttctcctttgtggtttattacaaaacgcatttattcatagaaatgaatatgctatggaacccatataagtagcacacacactgctttttaaaaaaaaaaaaaaacggcaacccctgtgaacatccaaaggctgtttttaaaagctcagcatgcttgtccttgtgatttcactttctggaatatgcatttcatgatatgacatgcaaaattataaatcaaagttacctaagaaaatgtcggtgtacataatatctttgccttcaccaagaccacatatttgcttaactttaaaattccaaacaggccaggcacggtggcccacgcctgtaatcccagcactttgggaggctgaggcaggcagatcacgaggtcaggagatcgagaccatcctggctaacacggtgaaaccccgtctccactaaaaatacaaaaaattagttgggcgtggtggcgggcgcctgtagtcccagcaactcgggaggctgaggcaggagaatggcgtgaacccgggaggcggaggttgcagtgagccgagattgcaccactgcactccagtctgggtgacagtgagactccgtctcaaaacaaaacaaaacaactccaaacaaacactaggaaaggatcccctacagcttttggaaatgtttttagtaattcacaaatgaaagtgacaacatttagaagacaatctcggtattcagacatcattatttattgacacttggctttatacacatgcctgcttggggtcattatagttagcttctttactcttcgttaatattatgtttaacatacttaaaaaatatttccatttgcaattctgagcaattttaaaacaaatcattgaagtcgtgtaagcttatgccaaaattactaggtttccagcccaagtaaagagtggccccaacctttttggcaccagggactggtttcatggaagacaatttttccatggacctgggggtagcaagtgatggcttggggatgaaactgctccatctcagatcgacattagattctcataaggagtgcgctacctagacatctcgcatgcatagttcactataggactgaagctcctatcagaatctaatgctgccactgatttctcacctgaggcacagctcaggcagtaatgttccctggcctgccgcggcccagttcctaacaggccactgtcattgtgaagagtttcaggatggtgatggcagaacaggccttctaagagtgcgactgtaccattgtacagcttgcatgtccatgaaactggctttgcctatagaaccttttgaacaagatgaccctgattttctaattcgctgagaaacacaccaaggccaattaatttgactggcctttctgatttaagctatgtgaagaaatacacatgtaagatgatgtatttgaaaagcactcataataggatagctgcagatggctgtcattgcaatttgttaacaggcagatctcaaaattgcagagtggaacctgtgtataagaatagggaaaagggtgggaaattgcaaaacaactatataggctttgtgcaaagaggattccagccttctgatgtagctttgagtagagcgagtgcatctagataccctgactgtgcttagctgggtgcttatagagatcccgttttcgaaggtgaaagtgcaattgggtaggagagggtggagatgtcagagcaaaggaacagcagtcagttgttgtccattcgaataggagtgtgcctgggtcttttttctctgggctctcctacctgcaaggggactgtcacttcctgatggggctcaggggagtgtagagctttgttacaagttgtgtcttatcaatgcctcctgtctttctgtggcaggatcctggctggggagggagaatttgtgtgctgagagaacactagacaaaaacgacaggagaggacggagcagccattccaaagctaaaaagcctgagtcaagaggctcgggcaaatcgtggggaaagaaagagattaagacgcaagtctatttagaataaatcactcactttggggcgtgcaaggcttactagaaaaacagacacctgaggaaacaaggcgtgtggacctaaaggtggttagctatgcactgagactgtctccagggaaaacagtgcgggagggagggagggagggatgcgggaaggacggaagaaatgcaagagggagagaaggaggaatttgtctccgggacactgtagggcaaatgtccacgctcccctccccgtctgtcttactgccatttgttttcttcacttctttccactacctgggcaaaggaaattcgaatatgtgaaagcgtgggaaaagcctggacccaggggaggtcggggagaaagcaagccacttaggggcgcggggtcaatccccaggcaggtgggacgcccctgggggtcctgaggcctcttccctcctgctgaagggagcacccctcctggcaggcctggacctgctcacaccgacgtttacctggacggagggggaaggtgggaggggcaggaagcggttggtgcgaacgggagaggcgcctgcgtgggagctgggcccctcgagacctgcgcggcgtggaaagccgctcggcgtcgccctcccccggagcgcccgggctcgcagctgacgagaccggcccatgggccctgcgcccggcccccctgtcactcacacgccttccagccaatggtgcggcctcctgtccccctcaccccacccctcgagggcgagctgggagggaggtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttccagcacttccaggtacggggaggcccccgcccgggttctttctggggctgcggccgcggcgtgggcgcaccggggcgcgcgcctcccagcctgggctcgcaaagttctcggccagcgccgccggctgatcctggcttcccctgggcgtggatcttacagtcggggtgctggaactctcctttccagcctcttcccggctcctgaaaagaaaaagaagcccgagacatcttgccccaactccctccttcccagcaggaaaccaaaggcgatttccctggggagggagagtcgtggatgctgggagtgggtgtgtggatgtggcggtttcccgggaattggagtgcgcgagactccgggcgggcggcgactcccgcaaagtcccaggcgctccggggcactgggagggagtctgggaggcgcgtccggctgcgcctggggacctcacctcgagccccagccccgcaggtgcccgcgggccgacactttgtctcttttgaaagatggttttcactctctgagggctcagagctcgctgcccacccttggagccccagccagggtacttgtgccaagtcgtgttccagggtgcgtgtatgcgcgtgttgggggtgcgagtggctgtgcgcgcctcaattcggaaccccaaagattcaaggtcttgccctggactagcgtagagcgtcagggaagaagtgccggggacaggggatttggcggggccgtattcggatactcctcaacgagtcccgggggaaccgtcccccaaaccccgaacgtaggttctttcagcctgagggtggggagtatgtgtgtgtgcgcgcgcgcttgtgtgggaggctccgggagccgcgcgcttggctccagcgggttgccgggactctgccctgtggcgcggacccccgcgggacttgcgcgaggctccgggtgcgggtgggcgcacgagagcaggttccggactcagcgcgagcgagtgcagctgctgcctgtaccagccctgtcgagcgtgcgagctctgaaatcctccgcttatttt

SEQ ID NO: 10821 - DNA, 13377 bp, Homo sapiens
ttcccctgacctcgacacaagtacattcttgtcattcctttcactccaggattggagtctctccctcattatgctgggctgggaagaagcaaatggcttagtggtcagcagtgtggatttgcaaatcagaccacctgggttcagatcttaggtctgacagctgtgttaccctgggcaagtcctcacctttctgtgcctgtcccctctttgctgtaaaatgggggtactaatacttaagtcttcccttcccccacagttgctactaacaaacagaaaaacggtacccatgtgctccagggtcacctctgacctttttttcctccagatgtccagctcgccgctgtccaagaaacgtcgcgtgtccgggcctgatccaaagccgggttctaactgctcccctgcccagtccgtgttgtccgaagtgccctcggtgccaaccaacgtgagtgtcctctccgtggagactggcagacgaggtggtgggtgggaaagtcttttgtatcactgtctgtctatccatgctccactcctgtgtgtctccctaaacttgttcttttcctctattcctagggaatggccaagaacggcagtgaagcagacatagacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttacagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacccagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctcagcctcccgagtagctgggactacaggcgcctgccaccacgcccggctaatttttttttgtatttttagtagagacggggtttcactgtgttagccagggtggtctcgatctcctgaccttgtgatccgcccgcctccgcctcccaaagtgctgggattacaggtgtgagccaccgcacccggcctggccccgccttttcaagtggggaagatgtgtacagacagtacagcatagtggttgtgggcacagactgtagagccatactgccttgctgcaggcctccagccttggtagtgtgacttcaagcaggttgtttcatctcctgtacctttgttttcctgtttgtagtcagtgcgtggtagcagcactgacttcatggactttttgtgagggttaaacacgtggaattgcagctggcatataaggactggatgggtgtttgttaattaaaaagtccaggccggaaagaggtgctctggaagctgagagttgtccctggagtatcccaggttgccagggcactgcagctaaatcctgatggaggagtaggagctcaccctggtggggaaggatggacattcaggcagagagcaaaatcccaaagatcatggcggagcaggcgtcgtcttgagaattggaagcaggtgggtgtggtaggagtgagctcagactttggctggagacagagttttactccagtgtctcacagggcatggcagacagacagcagcgggtgtttgtcaaataaatgagtcagctcttctccaaactccctcctcccagctacctcttcacctttcctggtatagtccaggggttcattttcgacccccacagagtctgatacacagtaggtgctatgtgtttgtgaaagaggctgacccagcaaagcctggatgtgtttgccttgaggactgcctgagtcctccacaccagccctccattttttccccttcaccccaatgctgggcctgagcctccatctctccacaggtggtggtgctcaccaacacccccctggaggaccagctgcgagtgggtgagttctgtcacaaccgtggcatcaagctggtggtggcagacacgcggggcctgtttgggtgagtggcagcccacctccctccctgtccccttttcccccaactcctaccaagcccaggccaagactctaggctctccctgccctcatcccttctcagctacccaggttttgggttctgtgttttcatctctccccatgtggcacaagtaccatcttacatcccagcagtgataggctgagtttgctcagcaagttttcactacatcttgagggacccgtgggacctgtatgtgcatgggacacaggcaccagccctattgcttccctctacaggcagctcttctgtgactttggagaggaaatgatcctcacagattccaatggggagcagccactcagtgctatggtttctatggttaccaaggtaaggagaccagccctagggttcctggcaggcaggtgggctgcagtagtccttcctgtctgctcttggtaccctgggcctgtttctgagactcactcttcctttaaccaggacaaccccggtgtggttacctgcctggatgaggcccgacacgggtttgagagcggggactttgtctccttttcagaagtacagggcatggttgaactcaacggaaatcagcccatggagatcaaagtcctgggtgagctgggaccatgggggaagcagaggggaactagaagatatgttcctgggttctggccggggagttgaagggagaagacatggcccttggttcagagttgggaagacacatcctggtgtttgagatgaactacagacaatcctgtggggtccaataagagctggtgggcatgggggagaggtactgtgtttgagctattcctgggagaatgtgtccctggtatctgagctgagtggggaaaaagtctctggtgtttgaacagggcagatcagcggatctacttgtgtgtgagctgatttggatgggaagcagagaaggtcttcccgtgtagacttggagccagggacacagggtctcacggggtctgagctgagtctggggcacaggagagatggtttctgatgtccaagtggagcctggagctgagggaagacagcttctgatgtctgagctgagtcggggcaggaggttccttatcttgcaggggttgtggattttagggagaatgggtagactgacagctctcttcctgccctctgtaggtccttatacctttagcatctgtgacacctccaacttctccgactacatccgtggaggcatcgtcagtcaggtcaaagtacctaagaagattagctttgtgagtgtgtcgatgggatcagtgggctgtggggggtggttctaggcattccctagttctccattcctctcttctggttctgatgacctctccccccgccacagaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggtgggtgagtgggcgagccagccagcgcagacatgcctggcactgcaggctcaccatgcctctctgcgtgtccacactccctgccctcactgtggcctgacatatcctctcttggttctttctggcccaccaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggtcagcacgggtggggagaggcaggattggggtgggccaggttcctccatgactctgtcacttgctctctgtctgtgtcaggcccctgttaaccactgaccaccccctctctcccttcccctctccaggcctgctccgggaagttcatgcccatcatgcagtggctatactttgatgcccttgagtgtctccctgaggacaaagaggtcctcacagaggacaagtgcctccaggtatgtgggtgggacctgtggggagggcatcattggggacatttctggggaggcctctctaaccctcctccctttgcattccttagcgccagaaccgttatgacgggcaagtggctgtgtttggctcagacctgcaagagaagctgggcaagcagaagtatttcctggtaagtggtccccttggatgtctgctcccctcatcttggcctctggccatcacccctggggcttccttcggcatctcaatgcaaccggtggcgcattctctttgccattctccttatcttgaagggaagcccagtgcatccctcgtttccccttctggtgcctccttcctcacatgactgcgtgtcatttcttagagtcctgcaacctgaagatgtggtgttagcccctctccccgtctctcaggggagtgaggggtgatgggtagcttcacactaacctgcatcaccctgaccagcctctgcctgtcttcttggttgcttcttaggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacggtgagtagggtaggaggttggggctttgtcgtctcactttcctcctttttcttttttttttttttttttgagacggagtttcgctcttgttgcccaggctgtagtgcagtggcgtgatctctggcccaccacaacctctgcctcctgggttcaagcgattctcctgcctcagcctcctgagtagctgggactacaggcatgcgccaccacgcccggctgattttgcattttaagtagagacagggtttctccatgttggtcaggctggtctcgaattcccgacctcaggtgatctgcctgcttcagcctcccaaagtgttggtattacaggcgtgagccaccacacctcacccctcctttttcttgttcccattctttctgtcagagatctttctgcctctgccagaagcccttctttttggcctttctttccctcagcttctgtttttttttttttttttttttttttttgccttaacctctttttagtgctggttgggacagtgtgtctggggtcctcaaaactactctcaagctcaattcacctagagtacttacaggactcagcatatagtcgtgcttgtggctacaatttattacagcaaaaggatacagaccaaaatcagcaaagggaaaaggctggtgcaagtttctaggagtcttctcccagcgggagttaaacaaggcggcctttatttccccagtagcaacagtaactacagaaataacagcaacaaggtgtaacaagacatgaaatgttgccaaccagggaagcttgttagactcagcaccacctcttttacttggggctggtcatgtaggcgcccccttcctggcacataacaaaatttccagactcccagaaggaaaggtgttcagcgtaaactgtattgtttgcatgaacggtttaggcacagtgaaccactgataccaggtagggagcggtgggaaccttcctgaattccaagttcccagacaccagccaaggagccgaccttggaagcaggcctttccaagggttgtagtttcagtctcctaggcttacacttctctgcacatatggaaactgggttggttatgcagggttctctgagaagctttctgtaaggagcagtgtcgtttttgcttacccaggatttattccccctttcatttatttcatttattcaccagatagttttagtactgttttaggtattggggatataccaaggaataaaacaagattcctggagggagaggggaacggacagcaaacaatagacacaatacgatcgtgaggtatatagttaatgttggtgatgagtgctcctcaaaggaaacaactaaaaccagacaagggaagtcggggtgtcagggagaatggtttgtagtattgatgacaatggttaaggaaggcctgagttctgcaaagacctcaaggatatgagggactagagtgccctctgctgtggaagagcctgcgcaaagatcctgaggtgggaggggtcagggagccaactcattttacggtaagtggaggtgggatccaggggaggattctgagcagaggagggacgtggcccaatttgggctttgaaaggatcctgcttgtctgtgtgccagcatcctggtggtggttgggggagtctgcatcaatcctgggtgctgttacctgaaaaaatagcaggtgttagacgaaagaacagatgtctggcccattgtctccagtctgttcctgtccacagcttccctttatgctgagcccctgccacatgcatcatcatcctggccatgtggcattgtcacagaccgtctctcctgctagcctcctaactcagggcctgggtcttccccagcattaagtaaatcagtctcaggcagacagccctttataggtgtttgggccaggtgcggtggctcacgcctgtaatcccagctctttgtggggccgaggtctttgagctcaggagttcaagaccagcctgggcagcatgacaaaaccctgtctctaccaaaaatacaaaaattagccacgcatggtggcacacacctgtggtcccagctactcgggaggctgaggtgggaggatcgctggagcctgggaagttraggctgcagtgagccgtgatcatgccactgcattccagcctgtgtgatggagagagaccctgtctcaaaaaaaataaagatgtttgttgggtgaatgcacaaataagtgagctttgttcccccatccccaccctggaactgcactttcttaaccctttagaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgtgagtttggaggcgggtgaggtggtcacgggcaaagttgtgtgtgtttcggtgtgtatataccaagaggggtgtccgtctttctgtcctctcctgatgtttctttcctagctctcgctttgtgctccccacaggcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcaggtgataagctgtgggagaagggaaagaggccaggcatctggccaggctgctgcctctccgcccccaggcccttgccttgccttcagatgttgcatgcctaagtgtaagatgtgccttttctccaaacctccctccctcacttcccaccaggcagcctaggtttctagaatgactcattcttttttcacttttattttgatttttttttcaacacatagacaaatattaagaatattatgatgaatactcaaataccattcctcacctaaatttaacaattcttaatgttttgccacattttcttcttagatttatgtagatttttcttctttgtgcttaaatgtgtcacagacatcacagccctttactccctactatttcagtgcctctgccaagtgaggatatgttgctgtagaacagggtttcttagcttcagcactactgacatttggggctggttatttatttgtcatgggagaggggatgtcctgtgcactgtaggatgtttctcagcattcctgacttctgcccactagatgccaatagcactctccctccatcatgacatctcaaaatgtctccagacattgccagatgtccccaggggtgccacatcactcccagttgagaactacttctgtctaacagaaacatcattttcatgctcagcaaaattaacaatcattcttaccatctcttctagttatttatttgtctctaatggtccatattcaggttttccccagctgttactcaaaatgagtttaacagctggtttgtcaggatgattctgtgtgtatggtgcatttatctacagaacagtgcatatattatctagctcggggtgtccaatcatttggcttccctgggccacattggaagaagaattgtctcgggccacacataaaatatactaatactaacgatagctgatgagctgaaaaaataaaagaaaaaaagatccgtgcataaatctcataatgtcttaagaaaatttacaaatttgtgttgggcagcattcaaagtcatcctgggctgcatatgggccacaggttagacaagcttgatctagctgaagttttacaaagtgaacacacaggtgaccaccacctgggccaagaaacagaacctagggattaccattgtgctgtcagaataattcttagtgcagtgtttgaggccaaaccatttagaatagtaggagtatgagggtgggaacaaaatagggaagggaaaaaaaaaacagttccatctgtcactttctcccttctgacactgcagttccagagtgggtatgtttgtatttgtgcaccaaccacagtcttgctaggtcatgtgtaaccttgaacttaacctctctgtgccgcagattcctgttctgtaaaatgggaatgacagcatctacctcacaggactattgtgaaccacttggcatttactgtgtgcctggcactgttttaaccaagctttaaatatatatgtatttgctcatttcttcctagcaaccccatgaaggtaggtatcactgttgtaacacctgttttagagacaaggcacagaggtaaagatgttatcctgtgtgcctgaagtcacaaaactaggtaatacgtggcatagctggaatctgaacctgaatttctaacatctgtacactccaaaccacctcgctaatgactgcgaactgtcctaggaattctcagaggccagaagttctgtcttgtttgctattttattttttgagacaggtctcattctgccattcaggctgaagtgtattggcacaatcatagctcactgcaaccttccaactcctgggaagtgtctgtacgtgtgtgtgtgtgtgtgtgtgtaagtgtctgtgtgtacgtgtaagtgtgtgtacgtgtgtgtgtgtgtgtgtgcgcacgcacgcgtgcccgttacgttgaccaggctggttgtaaactcctgggctcaagtgatccacctgcctcagcctccaaaagtgctgggattacatgtgtaagcctctgtgtccggcctctgtcttgttttctgccaagtcctcagggcctggatagggatcattgttggtttggtctgagttttttgtgttttaaaaaactgtggtaagatatacctaattgaagtttttattttttatggaggcataacatatctagaataaggtacacagatttttttttttttttttttgaggtggagttttgctcatgttgcccaggttggagtgcagtggcgcagtctcggctcactgcagcctccgcctcccaggttcaagcgattctcctgcctcagccttccaaagtgctgggaatacaggcgtgagccacctcgcctggcactcagatcttaatacatttttaggctgggcatggcggctgacacctataatctcagcactcaggaggccaaggagtgaggtttgtttgagcccaggagttcaagaccagcctaggcaacatagcaagaccctgtctctacaacaaatcttaaaaattagccgggtgtggtggcatgtgcctgctgtcccagctattcgggaggctgaggtgggaggatcgtttcaacctgggaggtcaaggctgctgtgagccgtgattgcatcgctgcactccagctcgggtgacagtgtgagactttgtctcaaacaacaaaacaaaacagttttccacatacacagcactattgtaaccactgcccaaatcaacttcattgatttttctttttttgagacagtcttcctctgtcacccaggctggagtgcaatggcatgatctcggctcactgcaacctccgcctcccgggttcaagagatttcctgcctcagcctcctgagtagctgggattacaggcatctgccaccacgcccagctactttttgtatttttagtagagatggggtttcaccatgttggtcaggctggtctcgaacccttgacctcaggtgatccatctgccttagcctcccaaagtgctgggattacaggtgtgagctactgtgcctggcctggtttttcaattgaggtgggggaatggggaaggctagagggcttccccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacgtgagtaactcgagtgccctctcgccctgtccctgtccaccagccaaggcatcccggctgctttcctcatgacagtaacacttggcaccaggcacacttttcacatgaatgagtggctgttggggcctcatgttgtttggggtcgggactagttttccatggagaaagtaagattgctctggagcccactcttgaggctgacatgtaatcctatcctctgtcctcttcgattcctgatagagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccaggtaatgcccagttgttgggtccatttggcagaatgtgtttccctgaaatgggagcctgcagtgtgggtcctcccactgtggagtccagctgtggcaggtgccctgaggcatggggatctgagaagagtgattgatcctgacctgctttttcctcaccctagttcctttgagcaaagaggcttggttgctattgcccttgactgtggtgtgggctgcgtcatacctgattcccagtcagggctgtagggattatgggggagaaattctggagttaagagcacaggaatcaatatgggttcaaatccaaactctacttgaacttaggcaaatcacgtaacttctctctgtacctcagtttcctcgtctgtgaagtagaaataatagtgatctatctcatggggggtttggggaggattaactggtatttattaaaatgaagttagtacaatgcctggtaatccatgagagtttgttaaatgatgggctgtttagcacaaaatggctacccagtgattggtaattgttctctcagccagatctctggttcaacctgtgggaccctacagttgaggtattttgtgattggctccagtccgcatcgagtgcccaacccaagatagtgaattgggggcacatctggggcctaggtgaagcgtgaagattgtcagagaggccttcactctcaggtcctgttctcaaaaatctctccatcccttagctcacaagctcaggagcgccgttctggtctgggcccaaacgctgtccacacccgctcacctttgatgtcaacaatgtaagtctcctttctagggtcttctggggtcaggtggagggtgaataggtgggaaggaggtggcggctccccactcgagggctgatgtgctcacccttccctgccctgccttctcctagcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttggtgagggtgtttggccagttggccaggagtcaccccacatgtccccggcctagtccagcctccccaccagtcctctacccctggttctgctctgctctgtgaccccaggcctgaggtttacccacaccttcctttgagcctccctttgacatgaagagggtaggttggggcaaattatctccctccctcctcctccttcccactatctggccctcaggagaacttgctgttttactcttgctctgtgtatttcccttagttttgttctttcttctgtttcttcttgatctgttcatctaggaggtatgatctctaccagcagtctctctcccttgatactttcctgccttgtctccttccagatccgcccccatctgtacatctacctgcatgtttctctgtgcatcttcaccctccatagtttggggctgcggtttactgacacccccaccccaccccatctgcatattttttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttc

SEQ ID NO: 10822 - DNA, 98311 bp, Homo sapiens
  misc_feature (1)...(98311): n = A,T,C or G, or insertion/deletion polymorphism (see Tables 1-2)
tgaccgcaagtgatccctccgcctcagcctcccaaagtgctgggattacaggcgtgaaccactgcgcccggccactcctggctaattaattaaatttttttgtagagatggatgtttcagtatgttgcccaggatggtcttgaactcctgggctcaagtgatcctcctgccttggcctcctaatgtgctgggattacaggtgagagccactgggcctggtaatttctaagaattatttttacaaaaattgcaaaatgggccaagcatggtggctcatgcatgtaatcccagcactttgggaggccgaggcaggtggatcacctgagatcacgagttcaagaccagcctggccaacatgctgaaaccccatctctactaaaaatacaaaaaatcagcaaggcgtggtggtgcgcgcctgtaatcccagctattagggaggctgaggcaggagaatcacttgaacctgggaggtggaggttgcggtaagctgagatcgtgccactgcactccagcctaggcaacagagggagactctgtctcaaaaaaaaaaaaaaaaaattgcaaagttgagtttactatttgcagtgaattttattcattcaaggattatcttataatttctgcatttaatttggcaaacttcatcagattccccaagagaggatgttatttcaggctgccctcaaaaaccaacattcctttgtcaacaagaaggtcttaggacgtgacacttgaattttacttggaggaactgggtccctggacaggcacccaactgggtccctggacaggcacctgctgacctaaaccagatggtaaaatgagacttaacaaaacagttgtttgcagttgagattttaatcttttgcatagctcagaagttcccacccaactcttttgttagtagcacaggggctcatgggtggttcttgttgcacagaccaccaatggggttgccaaataggaggtgagatgctgctgtcctgttgggtcagcggcggcagttctaattgcctggtcaaagtgggatcagagataaaagaacagacctgtgggtaccagtgcaatgagtcatgagaatgtctaaagatgtctggttctgcgcagatgtagccccaagcactgacactcagatggctcacatggccaggaaatgccccgctgggacttacacagagaggagcccgttttcctctgaagatgctcaggaggtagtctttgggtgggctggtgtgtgtttaacaccacgcgtccttttcttactcttcatcctttttattttttacattatttatttatttatttacttacttatttgagacagagtcttgctctgttttccaggctggagtgcagtggcgcaatctgggctcactgcaacctctgcctcccgggttcaagtgattctcctgcctcagcctcctgaacagctgggattacaggcacatgccaccgtgcccggctaatttttgtatttttagtagagacggggtttcaccatgttggttaggctggtctcaaactcctgacctcctgatcctcctgcctcggcctcccaaagtgctgggattataggcgtaagctaccacgcctggcctatttatttatttattttattattactattttcttgagacggagtttcgctcttgttgcccaggctggagtgcaatggcgcgatgttggctcactgcaacctctgcctcccaggttaaagcaattctcctgtctcagcctcctgagtagctgggatcacaggcctgtgccatcaggcccagctaatgttttgattttttagtagagacggcgtttcaccatgttggtcaggctggtctcatacccctgacttcagattatccatcagcctcggcctcccaaagtgctgggattacaggcgtgagccaccgtgcccggcctatttatttatttttaaacagggtcttggtctgttgcccaggctggagtgcagtggcaacgatcatagctcactgcagcctccacctcctgggctcaaggaatcctcctgcctcagtctcctgagtagctgagactacaggcatgcgccaccatgcctggctgttatttttatttacttatttatttgaaacagggtcttactcgtgtcacccaggctggagtgcagtggtgtgatctcggcactccagcctgtgcctggtctcttcttcctttttaacaaaaggaacaactcaaaaaggcaatgatatctggctagatttaataatatattttgccctttattgtattcacttttatgtttctcctctaacagggaaagtatcactggttttccccttatggttgtgatatagttgccttttaaaataaaatttgggccaggcacagtgactcatgcctgtaatctcagcactttaggaggccaaggcaggaggatcacttgagcccaggagtttgagaccagcctgagcaatatagtgagaccccatctctacaaaaatttaaaaattagccaagttagtggtgcacacctgttgtcccaactacttgggaggctgaggcagaagaatccttcaagtccaggaattggaggctgcagtgagctataatcataccaatgcactccagcttgggcaacagggcgagacactgtctcaaaaactaactaaataaatttaattaatttgtttaaataaagtaatttaaaaaaaagattattggccaggcgtggtggctcatgcctgtaatcccaccactttgggaggctgaggtgggaggatcacttgaactcaggagttccagcccagcctgggcaacatggagaaaccccgtctctacaaaaaataaaaaaaaattagccgagtgtggtggggcatgcctgtggttccatctacttgggaagctgaggtgggaggatcatctgagcccgggaaacagaggttgcagtgagccaagattgcaccactgcactccagcctggatgacagaacaagaccctgtcttaaaaaaaaaaaaaaaagattattaagttaacagcagtacagatggcattatgtgcgacaaattgtaaaggcaatttgagctttaagttggcagaaaaagatggcaaaaatccaaaggtggtaggcaatgacctcagccagcaaggggagtgctggtggccacttcattgctctgagccttgctcttctcatctgttgaatgaaggttattgcttttatttgcagaagggtctcaagaacgaaacatagtatctataaactccctggctagagtagaggctctattattgatacgtttattagtattatgaaggtaagagagtggcccacaacttcctgatccttgaaacagtagtagctgtttacaagtaatagtgtgacctgtgagtgctgaaattagattgatagttgtttcttcttcttctttttttttaatgtaattttttttccccggaggagtttttcttcaatcctcaaggacttagctcctaaggggctttggtggaggtcctggggcagcacctgcaggattaaatctggatgagggtgttctgtcctttcaggctacaggagctgaattcctgattacatttctgtgactggcacaactcacccagtaattgcaattacctttggaccaacccagtagcttcacgtgcggtttaggaagcgcataggctcgaagacactggcttcagaaacgtccctgacagctgcaacctctactatgtttccaatgactaacgttttttgttgttttgaaacaaggtcccactctgtcgcccaggctggagtgcagtgggcagtctcaaggtctcggtttggctcactgcaacctccgcctcccgagtttgagtgattttcctgcctcagcctccccagtagctgagattacaggtgcccaccaccacgcctggctaatttttgtatttttagtagagacggggtttcaccatgttggccaggccggtctcaaactcctgacctcaggtgatccaccagtctcagcctcggcctcggccttccaaagtgctgggattacaggcgtgagcctccgcgcccggactttttttttttttttttaaagatatgttaacgctgggctggttttgcagcacattgcattctgttccacctgtggcatctatcgcgaccgctgagggcggtccctttgctgggggagaagcagttgtaacagtaagcagcggccgggaggagcatggcccgcgggctgggtgtccctgcttaggtggcaaggtcctggcttcacgtgctgccaggcgtctgcccacagagtctagcagccagcaggaggttggtggcagactgatacaaaccctgtccccatgggtcaccctttccctcctaaactaagttcatccctactttccaacactcacttttgtcctactgccctccatcagcccgagaaaaaaagaatccaagaataataaaagagccccattttgcagcctagaaaacggaggtggttaagaaccgtgctccacggccgggtgcggtggctcacgcctgtaatcccagcactttgggaggctgaggcgggcagatcacgaggtcaggagatcgagaccatcctggaaaacactgtgaaaccccgtctctactaaaaatacaaaaaaattagccgggcgtggtagccggcgcctgtagtcccagctgctcgggaggctgaggcaggagaatggcatgaacccggggggcggagcttgcagtaagcagagatcgcgccattgcacttcagcctgggcgacagagcgagacgagtgaggatcacttaaggtcgggagttcgaggccagccttgatatcatggtgagaccccgcatctatttaaaaacaaaacaaaacaaaacaaaacaaaagctgtaatcccagcactttgggaggcaggccgaggtgggcagatcacaaagtcaggagttcaagacaagcctagccaacaaggtgaaactgtctctactgaagattagctgggtgtggtggtggacgcctgtagtctcagctactcgggaggctgaggcaggagaatcgcttgaacccgggaggcggaagttgcagtgagccgagatcgcgccattgcactccagcctgggcgacagggcgagactccgtctcaaataaaaaaataaaaaaataaaataaaaaggccgggcgcgttggcccgcgcctgcagcccctgctacttgggaggctgaggctggagcatcgcttgatcctgggaggtcgaggctgcaaagagtcgagatcgcaacactgctctccagcctgggcgacagagcgaggtcccatctcttaaaaaaaagaactgtgctcaaggacatctgccgtgtctggggcgcaaaacccctcctggtcccctctctcagggcagtccgcgagcccagcggatcccactcgtctttgcagcgcggacagggaatcggctgagttgatcccatgccaacaagcccgagtagtccgggcaaggcgctcggcggggcagtcaacgctccctccgccatgggctcccctcttgggaaaagcttttccaaaccgccgggcccagggcccagagctcccgccgcgccctcgacgtggcgtcgagtctggccccttcccccgcggcgcacgggcttcacccaggagggacgcgcctggatccacgccttcctcactgactccccgggctccagggcagggtgcaggtccacagccagggcttcgctgcggcccctgagaccccagtgcctttcctgcgctctcgcggcactcgcaaagttgagtcagccacgacgcccacagacaaccccgaggcgccgcgcccagggcgcagctctccgggtgacgagcgcctcaaggggcgcgggttcggggcccgcgacggggcggggcgcgtctccagggctccagtgctcggcctcaggcggggctagaagggccgcgggacggggtgggagtggaggggcggggaagggcggggacaggggcggggccgcacgtcctctcgggccagcctcagccgccgcgcctcagtccgccgtccgccctccgcgcccgcgccgctagcatgaccgacgcgctgttgcccgcggccccccagccgctggagaaggagaacgacggctactttcggaaggtgggcggcttcgggcgggcgggcggggacctgcgggctccagacctcctttcccccgggccctgcaggggccgtgggagcgcgcagtcggggtccactaggccgggagggggagggggcgcactgggccggcgctggccggacggaggctggcggggaggagtgggggcggcgatgtccccggcgtcccgggcaggtggcatccgggactgggcggggagtaggggaggcgcatgtggccgctccgcgcaggtgcgggcggaggacctggaggggtgcttgggtctcccccctcccaccccccgccacccctcgcttgcgatccctggtgcctggggaaaggacccgttcctggctgcgctggcgcccttggcctctgggcgcgttgcaagagcgcttggtgggagcgcgggtggagacagaccatcccaggcgtgttggcggtctcatatttattttaggcgctctgtcgcccaggctggagtagagtggcgcgattatagctcactgcagcctcgacttcctggcctccagcgatcctcccgccccagcctcccgagtaactgggactgcaggcgcgccacctcgccacgctaattttttgtagaactggggtatcgctgtgttgcccagactggtcgcgaactcttgggctcaagggatcctcccgccccggtctctcaaagtgctgggattacaggcgtgagccactgcgcccggccggcggtctctttttgcctccaaaatgcttccaaagtccgcctgtgggacttttcagggagcaggggagagctgctggtgggagggagcctccggcgttgcaccctcctccgctccgggtcgtccaggagggcgtgagcaccgcaggtgaggcccacggtcttgtgcgtctcactgtgtgccaaagcggatttgtcttgttgtccgggagacttggcgggggctggcggcgggcggcgggcggcgggcggcgggtggcgggtgccggcctcgcaggttcttggcatgtccaggagctcttgggctcacactacggacttstgcccagaagataacagtcagggagctcagtccctcaaaagcgaccccagcctgtggagcaggggccctgggatacccgcaggcggcagggcctgggctacaaagatgctttggagccgggagtcatggtgatgccttccaagccttcctccctctaggtcctgagcaagtctaaaaatagcttttggcccttggccagggatcactgagagggtggagagattgttgttgattttcgtttttataatagatacgacagtgcataattataaatagggaagtgaaactttcccataaacgaatcaattcttaattgttcaaagccttaggatccagttcttaaatggtcttggcatcttcctccttctcccaggtgacacagagagactgtgggctttgctcactggtgaggagccctgggcaggacagtgtggggcagagtgggaaaacttcttttttgtgaagttgcttttagcattaaaaaaaaaaaaagtagttttgaggtatatttaagttyaaagatgtcatcatggaattacaggattataacttctaattatgtgtggcgtttgggacagaggatcacaggccatggaattgcaggaggaggcctggcctgggaattcctatgtctgtcctcgggccccggggcctgactgccactcccacaaaattgctgtgtggcctcccgcaagttgctgcctctttctgggacatttcctccccagattgttctctgagcaggtgtagctctggaactccagcagcacctgggggaaaatggcagcaagagaagcacacctgtgaggggtggtcccaagcctcccagaacacattttcctgtgggagccctccgtgtctgtgagcccaggggaggacttcttgctccgcactgggaaagagtggatggcaagagagctaggaaaggtgcacagttgggtgtttttcatttattaattattattattattattattattattattattattatgaaacagagtctcactctgtcgctcaggctggagtgcagtggtgtgatttcggctcactgcaacctctgcctccggggttcaagcagttctgcctcagcctccgaagtagctgggattacaggcgcctgccaccacacctggctaattttttgtatttttagtagaaacggggtttcaccgtgttgcccaggctagtcttgaactcctgaccttaagtgatccacctgccatggccttccaaagtgctgggattacaggtgtaagccactgcgcccggctacaggtgtttttttttttttccccctgagatggagtctcgctctgtcacccaggctggagtgcagtggcgcgatctcggctcactgcaacctccatctaccagtttcaagtgattctcccgcctcagccttcccagtagctgagactacaggcgcatatcaaccacgcctggctaacttttgtatttttagtagaggcaaggttttgccatgttggccaggctggtcttgaactcctgacctcaggtgatccacccacctcggcctcctaaagtggggtgttttttagatgcagtttctctggtgttggatgagagaatcaggggtgcaaaataagaggaatcattgttttacaattaaaatcatcaattttgaaaatgagaccttgtaacaattgttgtgctactccatgttaagtcataccagttcgaagagtctatttatcctaggaaaataaaaggtgttgatgctgaatctttcctgatctatgacctgagccagtttgacctaaagcaaatgagggtcgggtgtggtggctcatacctgtaatcccagtagtttgggaggccgaggcaggcggatctcttgaagccaggagttccagaccagcctgggcaacatagcaagaccttggctctataaaaaattttaaaaataaaaatgaaaacaaaacaaaaccaaatggccgaatgaaaggcaggtgctgaccaggcgtggtggctcacacccgtaatcccagtattttgagatgctgaggcaggtggatcacttgagatcaggagttcgagaccagcctggcctacatggtgaaaccctgtctctactaaaaatataaaaattagccgggtgtagcggcaggcgcctgtaatcccagctacttgggagactgaggcaggagactcgcttgaacccaggaggcggaggttgcagtgagctgagattgtgccactgcactccagcctgggcaacagagtgagmctccgtaccccygcaacccaaaaaaaaaaaaaaatcccagcactttgggaggctgagtctagtggatcacgaggtcaggagatcgagaccttcctggctaacacagtgaaaccccgtctctactaaaaatacaaaaaattagccgggcgtggtggcgggtgcctgtagtcccagctactcgggaggctgaggcaggagaatggcggagcttgcagtgagccgagattgcgccactgcctgggtgacagagcgagactccgtctcaaaaaaaaaaaaaaaaaaaaagaaaggcaggtgctgtccaggtgaaaggagagaaagagcccttcaggaagagggaacagcttggacagagctgtggacttgtgagtgctttgtaggcccccccagggtgtggaggtgtttgtgggagccaggcagttcagggtcatgcatcttgcttgacctgggaactgtggaatccatcaaagtatttaaagcaggaccagacctgtgagatttgtgtaagaaaaagaccrctttgacacgtgaatggtgaatgggtggcgaatgggaaagaagctatggtggagccaggcagggaggcattgggaggatttagccccttgtaatacctatcatctttgcccttccttctcttttacggactactgatgatgcagtcagtgacagtgctgtgagtggggtgcagtgcctcacacctgtaatctcagcattttgggaggccaaggtgggaggattgcttgaggccaggaattcaagcccactctgggcaataagcaagaccccatctctataagaagtttaaaaatcagcctggcatagtgttgtgttcctgtaatcccatatactcmggaggcctaggtgggaggatatccggagcccacgaggttgaggctgcagtgagctsttatcatgtcactgcactccagcctggatgacagagtgagaccttgtctcacaaaaaacaaacaaacaaacaaagaaayggccgtgtaaacacagcctcaatcacccattctttccaccagcttgcacccttagctcagaccaggggtccacacagaaggcagggattctagtgatgaggaggttggaatgatagagctggagaaagggcaatatctggcagagagggaaagaactgatgtgattggcagggaaggagctgccaatgagaatccaaaatgcctgcctattagccaggtgtggtggcacccagctatggtcccacctactcaggaggctgaggcagcaggatcgctgagcctgggagatggaggctgcagtgagccgagatcacgccactgcattccaacctggacagcagaatgagaccctgtctcaaaaaaaacrtcacaatgcctgcctgaggygtctggtcatgcgcctcctcaagatccatgaatgcgggtgaacgcggaggctagtgtgtagacttgatggccctcatgggatatccatgtggcggtcccagcagagagcccactccatgggcccagcagccatgcaggcgccctggctggagatgcagttttgggtggcaccaactgggaggcagttggggtattgagtgaaaggatctgggctagaaaggatcctccgcttaagaggtgggtagagaggtgggaggaaagccagaagggtggccaggtctaggaagctgagaggtcagtcttgttagtcgagcaaggcgtgacaagtcagaagaatgctggaaggtcctagatttagttctttaggagtcgttaggaaatgcatggttggagaattggggacaaaastcagtgtgacagggtacagggggagaagggcagggaagatattrctggagaaagaggggagctgagaagagagaaggcagctttgttttagaatgtggaagtccagagctggttaaagacaaaggtgtggcagggcacagtggctcacactgtagtcccagcactttgggaggccgaggcaggcggatcacctgaggtcagaagtttgagagcagcctggccaacacggtgaaaccctgtctctactaaaaatacaaaaaatgagcaaggcgtggtggcgggcacctgtgatcccagctactcgggaggctgaggcaggagaatcgcctgaacctgtgaggtggaggttgcagtgagccgagatcgcgccactgcactctagcctgagcagcagagcgagactccgtctcaaaaaaaaaaaaaatgataaaagaaaaaaacaaaagtgaagaagttgggtggggaatggctggagattcagggagaaggtgagctggggatggggcccaggagtcgaggcggggggtgaagattgccaacagctgctgcattgattgggtggctgagccagccgggggcagtgagtgagaacccatgaggcttcccatcttgtattattattwtttttttttgagacagagtcttgctctgtcccccaggctggagtgcagtggcacaatctcagctccccgcaaccttcacctcctgggttcaagcgattctcatgcctcagccacctgagtggctgagactacagatgtgcgccaccatgcccggctaattgtattttttagtagagacagggtttcaccatgttggtcaggctggtcttgaactcctgacctcaagtgatccacccaccttggcctcccaaagtgctgggattataggtgtgagtccctgcacctggacctgtattttgactattgggatttctttgttgttattgagacggagtctcgctctgtcgccaggctggaatggaatggcgggatcttggctcactgcaacctccgcctcccgggttcaagtgattctcctgtctcagcttcctgagtagctgggactacaggcgcgtgccaccacgcccagctaatttttgtatttttagtagagttggggtttcaccatgttgtccaggatggtctcaacctcttgactgcgtaatccncctgcctcggcctcccaaagtgctgggattacaggcatgagccactgcgcctggtgactattgggattttatgcacacttaaggatcaaatgaatttccactgaagtcaggcttctctttcatcctgttctctgtgtcatgccttccctccccttttctttaaaatgacattatgctccattcatccgaaaaggatttatggagcgacagctcagtgcctgacccctcctcaggttctggggcattccagaccctgactcgatacagtttctttggcagcagttcccagcaggtctcgtttcctggagtgctgagcagtgctgggaattggtgctttgttgggatggctccggccatgcttgaaaaggaatcagcctcttggctttttttgtttctgaaatggagtctcgctctgttgcccaggctggagtgcagtggtgcactctcggctcactgcatcctccgcctccggggttcaagcaatactcctgcctcagcctcccaagtagctgggattataggcacccgccaccatgcccagctaatttttgtatttttagtagagatggtgtttcactatgttgtccaggctggtcctgaactcctgacctcaagtgatttgcccgccttggcctcccaaagtgctgggattacaggtgtgagccactgcgccgagcccaggagtccccttgttaattggtctttttggaatcaggtaggatgacttggctgtacagagcctcaagacataacttagcctcaggttggaaatggacacccgcagtacagatctcctggtctgggctggtaccttgggaggtctctgaaaaaagaaacctttcaggtctatttttttttttctatctttttttttttttttgagatggagtttcgctctgtcacccaggcaggagtgcagtggcacggtcttggctcaccacagcctctgcctcctgggttcaagtgatgtgcctcaggctcctgagtagctgggattacaggcatgtgccatcatgcccggctaattttgtatttttagtagagacaaagtttctccatgttggtctcgaactccagacctcaggtgatctgcctgccttgacctcccaaagtgctgggattacaggcgtgagccatcatgcccagcctcaggtctattataaaatcatgtctctcacttttttcttttcttttcttgtcttttctttcttttttgacagggtgttgctgtgtcatccaggctggagtgcagtggcatgatcatagctcactgcagcctcaacctccctggctccagtgatcctcctgtctcagcctcctgagtagctgggacaacaggcatgagccacaaagcctggctaatttttaaattttttgtagagacggtctcactgtgttgcctgggctggcctcgaactctttttttttttttttttgagacagagtctggctctgttgcccaggctggagtgcagtggcaccatctcggctcactgcaagctccacctcccgggtccacgccattctcctacctcagcctcctgagtagctgggactacaggcgaccgccaccatgtcsggctaatttttttttttttttttgtatttttattagagatggggtttcaccatgttagccaggatggtctcaatctcatgaccttgtgatctgcccgcctcggcytcccaaagtgctgggattacaggcgtgagccactgcgcccggcctggtctcgaactctttgggcccaagcctcagccttccacagtgctcggattacaggcatgagccaccgcacccagctttccctggcttctcactatattttttctttctcattatgttactgtgtttaaacagaggtacagctctataagattattataaattactttctcaacttatattactataatttctcaagaagtggaaatgcaacttcttttccccagatttttatgctcttcctactgaaaatcttggaagaattattgttctctggcctgtagttaaatgcagagtaatgtaattttctagaatgctgcatcctgatagagattccttttctgcaactgcccctgtaccccacagtactaaaactcacaggaaaatctgttgtggccatgaagaaaagcagctggaaggccgggggtggtggctcatgcctgtaatcccagcactttgggaagctgaggtgggtggatcacctgaggttgggagttcgagaccagcctgaccaacatggagaaaccccgtctctactgaaaatacaaaattagctgggtgtggtggtgcatgcctgtaatcccagctactcgggaggctgaggcaggagaatggcttgaacctgagaggcagaggttgcagtgagctgagatcacgccattgcactccagccagggcaacgagcaaaaaactccgtctcaaaaaaaaaaaaaggaaaaaagaaaaaaaaaagaaaagaaaagcagctggaaacaaactagagaaagcctttccccagggccattgaaaggcccaaaatgaaaggtcttggcactatgtggaagaggagagtgagtacacagtgaggcattgtcacttcttatctctgcctcttcatcctttgggaatgctaatgccccaaaatgaatttagctccattgtttttactcaagagctgtaggagaagttgtttcttgttcacagaaacctccagcctggacagggcctccgggttcattgtgtcctggtttatggtccctgttgactctgggcttcctggaggctccggcagagaaggaaggagaatttttgtttgttgttgttktttttttttttttaacccagaagctccttgcagtcttctctctgcaaggagcagggatctactctttgatgaatgagcagcattcatcttagtgagggctaatttcgtgttagacacttgtgtgcatcttttatgaacgcwtgtgtggatgaggaagccttctgatgggctgagtccaccaggaacagcgtgggtcatgtgggatcagcagctccagctctattggtactgatactacccctccggctgtttagatccatccccttggacccttgagtcaattcccaggtggagagggagggaggcagaggagagtaaaggttggtgatgctgaccccactcctgattccccatgatggtctaaaacagytttttttttttttaaagatgacagaatctggctgtgtcacccaggctggagtgcagtggcaccgttgtagctcactgtagccttgacctcctgggctcaagtgatcctcctgcctcagcctcccaactagctgggactagagatgtgattaaaaattgccacacctggctgatttttatttttattttttgtagmgatggggtcttactgtgttgcctaggctggtcttcaactcctggcctcaagcaatcctcccatctcagtggtgggctattacaggtgtgaatcactgcacccagccctaagccagatcttaaaggccaggctggatccaggctgactgtggccttggagaggggagggtctgcccagctgcatggtatccaccatcagccccgaggrtctgcctgaccaacagtcttcaactgtgggatcctggctgggaggtatcccctggcagaaacagaattttcagggtgactcagaggagagacaacgtgatgaactataacactgtaaatgtcccttgtttcctggggccatttggatggttgccacgacaccacctgatgctactgggcnttggctttagcctgatcaacacttcctcctttggctcaggtaccagcgtcccgtgacacaaaggctgcattggaggtagccataggacacagtcgaactgcaggtaccgctcagccagaggctgggtgtctggcagagcagcagtaatgggtgccaagtgaggacaaggttccccacttggagcaccagggacggagacaccacggtgaatgatgtgagtccctcagggctgcccattcagaccctcggagttccctatggccaggtttccatttgattgtaacaagagaaaaggggaccagcacagtggctcacacctgtgatcccagcactttgggagtccgaggcaggaggatcatttgaggtcaggagttcgagaccagcctggacaacatggtgaaaccctgttyctactaaaaatgcaaaattagtcgggtgtggtgctgcgtgcctgtaatcccagctactcgggaggctgaggcaggagaatcgcttgaacctcggaggtgggggttgcagtcagctgagattgtgccactgcactccggcctgctgggtgacagagcaagattctgtctcaaaaaaaaaaaaaaaaacaaagaagaaaaaagggcaggtggtaaaaaaacaaggctggatgtagtggctcacacctatratcccagcactttaggaggccacggtggacagatcacatgagctcaggagttcaagaccagcctgggctgcatcgacaaaactctgtctctacaaaaaatacaataaaattagccaagtgtggtggtgtggacctgtagtcccagcttctcgggaggctgaggtgggaggattgcttgagccccaggatattgaggctgcagtgaatggagatcacgccactgcagtccagcctgggcaagagagtgagatcctgtctcaaaaacaagaggctgggcgcggtggctcacacctgtaatcccagcactttgggaggctgaggcaggtggatcacctgaggtcttaggagttcaagaccaacctggccaacatggtgaaaccacgtctctagtaaaaaatacaaaaattagctgggtgtccaggtacagtggctcacgcctgtaatcccagcactttggaggccaaggcaggtggatcacgaggtcaggagttcaagactagcctgaccaacatggtgaaaccccatctctactaaaaatacaaaaattagccaggcatggtggtgtgcgcctgtaatcccagctactctggaggctgaggcaggagaatcgcttgaacctaggaggcagaggttgtagtgagccaagatcgcaccactgcactccagcctgggcaagagagcgagactccatctcaaaaaaaaaaaaaaaagcaaaactgttaaaactgttgttgagtgtgtcctaccagttgaaataagcagatcattggtctggaaatacagttgattcatggaaatgttcacgatttgatgtggtgggaggcacagtaaaagcctagttattcaaggctgggcgcagtggctcacacctgtaatcctaacactttgggaggctgaggtgggtggatcacttgaggccaggagtttgagagcagcctggccaacatggtgaaacctcgtctctactaaaacaaaacaaaacaaaacaaaacaaaaattasccaggtgtgttggcacattcctgtaatcccagctactcaggaggctgaaacaggagaatcgcttgaacccgggaggtggaggttgcagtgagccgagatcacaccactgcactccagcctgggcaacagagcaagacttcgtctcaaaaaaaaaaaaaagttattcagcatattgaaaaataactgtgattggcacacagtaggggtttatagagatttctggaagagactgaagggagctcgtaactaaagattatggctgtgttgactcatatcgagcccccctccacccctgtgtgaatggattgggattcccgggggaggcggctgggccctcacctccagccctgacacctggcagagatcctggaagggcaggagggctgttgacaagtactgaattcatgtttttatttttatggacatggacaagctagattctttccacccagcctgccctgaatctccagtgtggtgaaaagttaaattagatgtatgtgtgtattgcagtgtactgcatgctattttctgtgctttctcattgattgctctggctgacttataaacaagcaattctgttttccagagtttggtggttgagtgagggattgcgtaaccaggaaggagtgagaaaggcagagaaaataatctttgctggagaagcagctaaaaacacctgccttcctgtatcccgtgggaaggtctctctggctgggagctggcccagccctaccgtgtcatctctcacttagttttacgcctgaacctttagatcccaagcttgcacattgccctaaatttgctggaaacacctctgcatgtgtgagctttatctttggctgtgcagaagaagggcccatactattgcctatagtggaggggaagcaggtgccaggcactgcccagaatggagcagggcccccataggggaagaaaaactgccctgttccaggagtagcttgaccaccctttcctttcttcctaattaagtgcctgcctccagttttatattttttttttaacttaacataaatttatttttcacagttctagaggctagaaatccaagatcaaggtgccagcacggtcagtttttggtaagggctctctttctgactttaattctttttttttttttttttttgagacagggtctcactctgtcacccaggcaggagggcagtggcaagttctcggctcactgcaacctccgactcccgagtagctgggactatagacacacgccaccagcctgggctaagttttgtattttttgcttgagacagggttgcaccatgttggccagtctggtctcaaactactgacctcaagtgatccgcccacctcagcctcccaaagtgccatgattatacacgtgagccaccacaccaggcctttgtctgattttagacagccactttctcactttgtaagaaacttgtaacagtggcagaaatgtcactgtagctgtgatctgtctgttcactgaacagatttcacctaggataacattctgaggcttttctctgggcacacatttagttgttacaccacattatttagctgttttatgagcttaagaacagtagttacaagcaaggtgaatccgcattgctgcactcaaagctttcagataggtgtgtgccacactaatataaacggttgctgtacacgtacagagaaacttctctagtaacgaactgtagaaatgatccctggaagtacagtcttcctgcctgtgggctttgtctaggtgctgctcttaaatacgtgtcttacaggtgaacaatctgactgtacattaagggcangtaagtgacctgtaaagagagttttcactctaggccagtgcggtggctcgcacctgtagtcccagcactttgggagggcgaggtgggcagatcacttaagtccaggagtttgagaccagcctggccaacatggcaaaaccctgtgtctactaaaaatacaaaaattagccgggcatggtggtgtgcacctgtaatcccagctactcaggaggctgagacaggagaatcgcttgagtccaggaggcggaggttgcagtgagttgagatcatgccactgcactccagcttgggtgacagagtgagactctgtctcaaaggaaagaaaagagttttcactctaggtaaacttatttgagttagtacttttttagttgcaggtgctagaaaatttaatccaaaataactttggcagataaacacaccctagtatgttcctccaatagaattctatcccacaataaaaaaggaacacacaaattagccgggtgtggtggygggtgcctgcaattctagctactcaggaggctgaggcaggagaatcgcttgagcccgggaggtggagtttgcagtgagccgagttcacgccactgtgctccagcccgggcaacaagagcgaaactctgtctaaaaaaacaaaaaaaggaacaaactactggtaaatgaaacagcatgggtgaatctgaaaacatsgtattgagcaaaataaaccagacayaaaagtctacatcctatctgattacatttacatagttcaaaagcagacaaaaatatgtggtgatagaaatcagagtattggttgcctggggatgatggaaatgttctgtgttctgtattttgataggagtgatggttacgcaggtttatatgtttgttcaaactcattgaactatatacttaaaatatgtgtattttattatatataaattrtatctcaattcagaaaattgagatacaaagaagggaatgaattggttgctgtaaatgaaaagtacagagggatggcttcaggcctagcttgatccagggctcagatgacatcgccaaatctgtttctcagctcagcccacctggggttggttccctgtctagggagacactcttctgctggtggtaaggtggctgcaactgctcagtgtcacagcctcccaggttcaaggccaatgaggacctcttcctgatgggtttcgattgaccctgatcttcaggctttggttttccaatgggccaggcagaagtcagatgttcttccctttggaaaggatgttgggggagcatggatttacacacacacccctgccccccaccaggccatcatgggctatgaggcgggagagtgggctggcatcactgttcccccaaaagatgtggggtgatggtgggcagccatcacccatgaaggggtgtctgggggttgcatgcattcctaccgctcacaccgcctcaccgctcatcctggagcagcaggaaggacagggtcttaaatcccaccccaacttttactgcctgcctctaggatctcaagttgctcatatagcctccttgctgcagaaccatgggatccgagatgctgtaccagggtccacataagcgggccgaccccaggagttgcctgtaaagctggtgatgacacgggggttcactcagtacttgcttttcttgggtgttggctgtttgcccactcttcaagtttcgggactgacggaaatgtccgaaccttagtgtgggaagggaatagactctgtggaggagaaagtctcacttcactgtagaacttgtcaacagcagatcccgaggtcaggacagctcagttggccccacaggtgtgagaggtttagccccagtccctggtgcaaaccctcactccagtctcagagcggctttgtgttctgttgagaaccaatccctgtctctgagttgcagaggctattctggaagctgtttgttcagggctaaggtctcgttattacacaagatagggggtggggtgagaaatgtatgggtggggatggtggacccgccaccttgtcccctacagagcagcccctggcaggggctagtagatggccaatagtttctggtgatgccagggagtctttctgacagtcttgtccagatttacctctcagggaagtttccacacacagccccgtgggtgtttcttgtgttccccagcaaagcccaacattcctacctgtcaggaataagtaatgtggtttcgggcccaattactcagtcaaatctaaccctaagtgttcctatgccttatctagaaacctgaccacatatctatgggctggttagggcgtactgattccaggccagcagaagttggggaaagtatacgaacagaaaaaaaaacattcttatccgtagtttggaatggctgcttatctgagctctgggaatgtacgtaaaggaattagttattcaagcttccctgtaaaatgaaacacagcagtggtgatccaggtaattcagagtcaaactgaatcgtcgtcatttttggaagtggaaaggaaagagatgaacagttattttagttatttaatatttaattataatagcttaacattaaagttttttttttttttttttttttgagactgagtctcgctgtgtcacccaggctggagtgcagtggtgttatcttggctcactgcaacctctgcctcccgggttcaagtgattctcctgcctcagcctccagagtagctgggattataggcgcatgccactacgcccagctaatttttatatttttagtagagacagggtttcaccatgttggccaggctgttctcgaactcctgtcctcaggtgatctacccrcctcagcctcccaaagtgctgggattacaggcgtgaactactatgcccggccaaagatattttaatcttaaatctgaagaaagacaaaattggaaaccgtttaatgctttaaacgatattaattttaaaatccattccagggctggatgccatggctcatgcctgtaatcccagcactttgggaggccgaggcgggtggatcacctgaggtcaggagttcgagaccagcctggccaacacggtgaaaccccatctctactaaaaatagaaagattagctgggtgtggtggtgggtgcctgtaattccagctactcagcaggctgaggcaggataatcacttgaacccaggaggcagaggctgtactgagctgagatcgtaccactgcactccagcctgtctacagaagccaactcgaattccgaatatctgtgcaatttgaacttgggggaaagtgtccttgcgagacagggaaaattaggttgtggggctatgtgggggatgggtggtggtgacctgatgggaaatgagaatgagaagtcttttatttttattattatttaaaaatttttattattatttgtagagacagagtctyactctgttatccaggctggagtgcagtggcgcaattgtagctcaccgcagcctcaaactcctggcctcaagcgatcctctggcctcagcctctcaaagtgcttgggattacagttgtgagctaccatgaccattctggccaagaatgagaaatctctgtggaaggagaatactgggattcctgaggaggtttccgctatagataactcacatctccctccctggggtccaggccatgggtgtggcttgggcagaggtcggagaggccaggtgtgtgcaggcctgagatgtgactcagggagagagaaagggcagtctcttcaccacgtaatactacccgccagaccgctcccagggagtaaccgcagtgggcaggacctagagataagcgtcaaagaggaatgtgggcgtaacccaggtcctgaggcttctacctgtctggggtgggaagaacaccattcagytaaaatgcagcttttattctgatcttaaacttttagcgtgaagcrttgtaatccaaataccccagggcacaatggtcagagaacacagacaatttgttgaaaaagaaattaaagtgtcaagattatatggaaaaacctttaccttcactgttataataaacatacaaattagaagaatgagctatctatttttgcatgtcaacttgacagaaattaaaaataattttcaaccagacagataaaaagacaatccagtttaaaactgggcaaaggagagctgggtgtggtggctcacacctgtaagactagcactttgggaggccaagatgggcagatcacttgaggtcaggaattcaagaccagcctggcaaaaaaatggtgaaaccttgtctctaccaaaaaatggaacaattagccggacgtggtggcatgcacctgtagtcccagctgctcaggaggctgaggcaggagaatcacttgaacccaggaggtgaaggttgcagtgagccaagatcataccactgcagcagtccagtctgggtgacagactgagaccctgtttcaaaaaaaaaaaatgggcaaaggatctgaattgatatttcttcgaagaagatatacagttggccaataagttcatgaaaagatattcaacatcattaactgtcagggagacacaattcaaaaccacgatgtgagacagcacacacataaggtagctgtaataaaaaagatagaccagcacctgtattggtgagatgtagatgaattggaactctcatcctgttagttgggttgtaaaattgtataaccactttgaagagcctgatagttcctcaaatcattaaacatagaataaatcatatgatctagaccgggctcagtggctcacgcctgtaatcccagcatattgggaagccaagccaagcggatcacttgaggtcaggagtttgagatcaccctggccaacatcatgaaacccgcctctctactaaaaatacaaaaattatctggtcatggtggtgcacgcctgtaatcccagctacccgggaggctgaagcaggagaatcgttcgaacctgggagacagaggttgcaatgagccgagatcgagccactgcactcaagcctggacgacagaacaagcctctgtctcaaaaaaacagaatcaaaaataaaaacaaaacaaaaaaaccacctgatctagacattttatttctatatttatagccaagagaaacaaaagcacrtatccatataaaaccttgtacgcacataaacagccttattcgtaatagtcaaaaagtgaaaacactccccatgcccattgtatgatgaatgatgaatggataaagtacacaagtgtggtgtatctatgtaatgaaatcttattcagggacaaaaacggacaaagttctgatacatgctacaacctggataaaccttgagaacatcatggcaaatgaaagaagccagatgcaaaggccacatattatatgattccgtttatatgaaataatcttgaataagcaaacctgtaaagacagaaagtagattggtggttgcctagggctggggttaaggggaaaaggaaatgaggagcgatgctaatggctacttgctttttttttaggctgatgaaaatgttctaaaatcagatagkggttgatgggcgtggtggctcgcgcctgtaatcccagcactttggggggctgaggtaggcagatcacttgaggttaggagttcaggaccagcctggccaacatggcgaaacsctgtctctactaaaaatacaaaaattagccaggcgtggtggtgggcacctgtaattccagctactcgggaggctgaggcaggagaatcacttgaacctgggaggcagaggttgcagtgagccgagattgtgccactgcactgcagcctggatgacacagcaagactccatctaaaaaaaaaaaatcagatagcaytgatggttctgtaactcctgaatatactaaaaaccaatgaattgtttattttaaaagggcaaaacgtatggtatatggattatatctccataaagctgttactaaataaaaaaagtaggccaggcgcagtggctcacacctgccatcccagccctttggggaggccaaggcaggtggatcacttgaagtcaagagttcaagacgagcctgggcaacatggcgaaaccctgtgtctactaaaaatacaaaaattacctggacatggtgacatgcacctgtagtcccagctacttggaaagctgaggcatgagaatcacttgaacccaggagtcggagattgcagtgagccgagatcgcgccactgcactgcatcctaggcacgcagcgagactccatctccaaaaaaaaaaaaaaaaaaagtagatactcagtaacagtgagggggaaagcggtcacaagggtgtgggtgcctttctgtcctggaggatgattgggctggcccatgggtagccctgaaaggtttgatcttataactctgccctagagatatgtctttaattaatttatttatttttgagacagcgtctcactttggttgccgaggctggagtgcagtggcataatctcggctcactgcaaccttcagcacccaggttcaagcgattctcgtgcctcagcctcctgagtagctgggattataggcgcccaccaccacacctggttaattttttgtatttttagtagaaacagggtttcaccatgttggccaggctggtcttgaactcctgacttcaggtgatccacccgccttggccttccaaagttctgggattacaggcatgagccacagtgcctagctcagaccttgtctctaaaataaattacataaataaaatagatgagaaggaaagaccaattcacagtggctgttttgcaattgtgttgttatgagcgacttttctttatacttttcaatattttctatgtagatgctttgttttcagaaaagattatttttaaagttaaacattttccattatattaaaccctgtcatcatttttagagtggccgacctctgaaggggcatctcttatttttcctcagggctgtaatccccttgcacaaaccggccggagtaaattgcagaatcaaagagctgctttgaatcagcagatcctgaaagccgtgcggatgaggaccggagcggaaaaccttctgaagtaggtgtcttctggcttccctgcctctcctgagtcctagtcatctgttccctaaactcccaggccaggctcttggtttcagctttgggtttcctcctcatttctggcatctggagtcgtccctttcttgcctatagcttggttatgttgaaaacagatattttaccccgcctgtttgtgtgtttggggattgggtgggtgggagatagatgcagacggtgtggcntttggcttcaattcagtcagccatcttgatgggaagcccaatttttgtctcgaggtttgttttctggctttctctgggacttgtctattttctccactgcctgacactatgcctggtgcagaatttgcttggtaaatgtttattgaatatataaaggaaagaaaagcagaaaggaaggagaggggatatttctattgccagtgtccaccttgctaatgagagggctcagtacacccccgtgatctagggcactcattagtatgctctcgtggtaaaacagttacttayccagcatagaactcagagaagccttacctgtgtctagacctctataaaccctctccaggcaacgaaatgcaacaaaagacaatgtgccagcactctgtttacaaagagtgcagagtttcttcttccttcagagttctactggagaccatggttagccccgtgccrccttgttttttgtttgtttggagacagtcttgctctgtcgcccaggctagagtgcagtggcgtgatctcggctcactgcaacctgtgtctcctgggttcaagtgattctcctgcctcagcctccccagtagctgggaccacaggcatgcaccaccatgcttggctaattttttgtctttttagtagagacggggtttcaccatgttggccagcctggtcttgaacgcctggcctcaagtgatccgtctgcctccacctcgcaaagtgctggaattacaggcgcgagctacygcgtctggcgycatgccaccttttttcttttttttcagatggagtttcgctcttgttgcccaggctggagtgcaatgtgcaatcacagctcactgtagcccccaacctcctgggctcttcaagcaatcctcctaacagcctactgagtagctgggaccacaggcatgcaccaccatgcccgactaattttttttttttttgagacggagtcttgctctgtcacccaggctagagtgcagtggcgtgatcttggctcactgcaacttctgcttcccaggttcaagtgattctcctgcctcagcctcctcagtagctgggattacaggtgcccgccaccgtgcccggctcatttttgtatttttagtagagacgaggtttcaccaacttggccaggctggtctcgaactcctgacctcgtgatccacccgcctcagcctcccaaagtgctgggattacaggcgtgagccactgtgcctggccaatgcccgactgattttttaaaaattatttgtagagacagggtcttgctgtgttgcccaggttgttctcgaactgttgtcctcaagtgatcctcctgccttggtctcccagagtgctgggattacaaacatgagccactgtgcctggcctgtgttgcttttgttactcacggaatacctgatgacttgaggtcctgggtgggaagtttgtctgggaatctcttctccagctccttttgcaactgggtgcaaagcaggttgttactggaggaggctgggaaaaatactgtagcgttttggcttttaaaaagtcaagcagtgtccctatcccaagacaagtttggacatgggaattgtccactcccatagcagagagcaactcatgtcatctgtgtgacgtgagagaggcccccrattttgggactccctgtcatgtgctgggaaggcygtggtatgttttgtggcctagggttctggttgacccttggacaggcctgctctgtggccaagggggcaggtgggcagccttgatggtgtatggctttcctaggagtggacaacaattgatttacctattcatggattcattgagcaccttytttttttttttgagayggagtttcactcttgttgcccaggctggaatgcaatggckcaatcttggctcactgcaacctctgcctcccatgttcaagtggttctcctgcctcagcctcccaaatagctgggactacaggcacgtgccagcacacctggctaattgaattttttaaagttttagtagagacagggtttcaccgtgttgcacaggcttgtctcaaagtcttggcctcaagtgatcctcctgcctcagcctcccagagtgctgggatttcaggagtgagcccctgtgcctggctattgagcacctgttaagtggcaggcacagttgaggtgcctgaagatcaggcgaggctctgcttttgtgatttctcttgttggaggatgggrggagacttttatagacaagtaaacaaatcagatcacctagggaagtgatgttttctagggaataatgaactctgaatatcatagaggttggcccaggatggccagccttagagacagagggtggtcagagaggcccctgtgagcagggaacttggactttctcaggcaggaactagggcagttttgtgtgccttgttctcttaacgacaacagcagtcaccctttctgaggcccgagcctgactcaagctcattgttaaactggcagtggttgggttggcaggggcaggagtggggggttgttaatgattctcacagtggcctaaaggttcaaagtaccccttgctggagaatgttgtcagaggaaaccctgaaggtatttattaatctgactcaacaagcaccaacggtttcccgaaaacaaatagggcattttgccaagctccgctctggcccctcagtgtccctgggcgacccattacgtggctgtctctgcaggccatgggtggtttcagttgtaaattaggccctgctttccttctgtttgtcttctggttcccaggtttcctaccgcagcccccaaaggaaagtagatctgttggaataggggtgggggatgtttggaggtgtccccagaaatgcaggaatggaaatgggggtgctaagcccttatctgaggactgtcagagggtatcgtggctaggcaggcacttgaaaaaccagattttatgatccttcaaagtcttccccttctctgatccattccagctgggagtccatgagcttcctggagtttttttaggaagccatcaaatatttcaaatgcacttttttcaggtttgtttgttttttttgagacagagtctcattctgtctcccaggatggagtgcagtgtcgagataccagctcacctgcgcaacctccacctcctggattcaagtgattcttgtgcctcagcctcccgagtagctgggattataggcatgtgccaccatgcctggctaaattttatacttttagtaagacagggtttcacggtgttggccaggctggtctggaactcctgacctcaggtgatctgcctgcctcagcctcccaaagtgctggaattacaggtgtaagccaccatgcctgaccgtactttttcatttaggccaaccagagacaatattctgtcttctcccagcttccctcccttgagaaaagctagggtagaaatatgatgaagtttatctgaaattgaggcagtccttgtgaaatttaaagcagggccggtgagcactgtggctcacttctgtaattccagcattttgggaggccgaggtgggcgaatcacaaggtcaagagatcgagaccatcctggccaacatggtgaaaccccatctctaaaactaaaaataaaaaaattagccgggtgtggtggcacgtgcccgtaatcccagctactcgggaggctgaggcaggagaatggcgtgaacctgggaggcagtgcttgcagtgagctgagatcgcgctactgcactccagccagggccacagagcaagactccgtctcaaaaaaaaaaaaaaaaaaaaaaaggcaggttgcctagttttaactagttttagctaactagttctttgattctttgaacaagagcaggtcatttaacctctctgggcttcaggttcccctgttgtgctgagagttgttgggctagatcagaagtgacctgctccgaggtttacagggatcaggtgggctttaaatgagtgaatggggctggattctgtgctgtgagacaatagggagtggtggggactgtggtgaagtgcacagcatatgccctgtctggatgaggcaactgcagtttgcctcatggagggtagggccagagttgctgtatcttctaattttttttttttccaggagaagttaggaatttttttttgtttttaatctgattgttgaattttttttttttttctttttgagacagagtcttgctctgtcacccaggctggagtgcagtggcgtgatcttagctcactgcaacctctgcctcccaggttcatgtgattctcctgcctcagcctcctgagtagctgggactacaagcatgcgccatcatrcccggctaatttttgtatttttagtagagacgaggttttgccatgttggccargctgatctcaaactcctgacctcaagtgatctgyctgcctcagcctcccaaagtgctgggattacaggcatgacccactgtgcctggccgattgttgaatttttaagttttggggactcgtttcagaggggggatagtaacatcctgagagccaggtgaacaagtccctcgggccttcagtttagtttgtgacctctggacgggggtgatgaaattctgggtcaggagtgacgtgaggtggccttggctgtcatgagagtgacttgaggttgatgacagctcacaccgtcagttgtgggagggctggtgtgtgtctgtggtggggtttgcaggccctccatagcctttggggctgacatcaacatcaaggcccaccttcctccattgagagacaggctgggagcagatgtcctgccggtctggctgatcagccacctcagcaggggatgggacagtcctcgctccagcctcctgaaaccctggcagagcgggatttgggatcagatggactaaggctaagctgctctaataaggtcgctgaagctgcggcaagtcactatgtcaatgtggtgcttattcctggaaggatagttttattaaaagacttgggagaaaaataattacactaaaacaaatggggacagaatgcaacatacacatgtattactttaaaaaaaaaactttttagaccaggcgtggtggctcaagtctgtaatcacagcactttgggaggctgaagcgggcaaatcatttgaggtcaggagtttgaggccagcctggccaacatggttaaaccttgtctctactaaaaatacaaaaattagccacgcgtggtggcacacatctgtaatcccagctactcgggaggctgaggctggagaatcccctgagcccaggagttcgaggttgcagtgagccgagatcgcgccattgcactccagcctgggtgacagagtgagaccctgtctcttaacaaaaagaaaagaaaattagctgggtgtggtggtgtgcgcctgtaatcccagctacttgggaggctgaggcaggagaattgcttgaaccagggggacggaggttgtaatgagctgcaatcatgccattgcactccagcctgggtgacagagcgagactccgtctcaaaataaataaatacataaataataaataaataaaatttttatatttattcattttgaggctgggtcttgctgtgttgcccaacctggagttcagtggtatgatcacagctcactgcagcctcaaccttctgggctcaagctgtcctcccgcctcagcctccacaggtgtgtaccaccatastaggctaatttttttttttttttgagatggagtctcgctctgttgcctcctgggttcaagcgattctcctgcctcagcctccctagtagctgagattacaggcacgcacccccatgcccagctaatttttgtatttttaatagagagggggttcaccatgttgtccaggctgttctcaaactcctgacctcaagtgatccgcccactcggcctccaaaagtgctgggattacagacatgagccaccacacctgactggcattcggctaattttaaaaatttttttgtagagactgggtctccctatgatgctcaggctggtctcaaactccagggctcaagcaatcctcgtgcctaggcctcccagagtgctgcgatgacagctgtgagccaccatgcctatttatttattttttgagaggaggtctcactctgttgcccacactgagtgtagcagtgcaatcctagtgtgtccggaattggtgggttcttggtctcactgacttcaagaatgaagcgacggaccctcgcggtgttacagtgcttaaatgcagcgtgtctggagtttgttccctctgatgttcggatgtgtttggagtttcttccttctggtgggtttgtggtctcgctggctcaggagcgaagctgcagacctctgcggtgagtgttacagctcttaaggcggcacgtctggagttgttcgtctggagttgttccttcctcccggtgggtttgtggtctcgctggcttcaggagtgaagctgcagaccttcgcagtgagtgttacagctcataaaggcagtgtggacccaaagagtgagcagcagcaagatttattgcaaagagtgaaagaacaaagcttccacagtgtggaaagggaccagagcaggttgctactgctggctcaggcagcctgcttttattctcttaactggccccacccacatcctgctgattggtagagcccagtggtctgttttgacagggtgctgattggtgcatttacagtccctgagctagacacaaaggttctccatgtccccaccagatgagctagatacagattgtcaacacaaaggttctccaagtcaccaccagagtagctagatacagtgttgattggtgcattcacaaaccctgagctagacacagggtgctgattggtgtgtttacaaaccttgagctagatacagagtgccgatcggtgtatttacaatcccttagctagacataaaggttctccacgtccccaccagactcaggagcccagctggcttcacccagtggatcccacaccagggccgcaggtggagctgcctgccagtccggcgccctgcgcccgcactcgtcagcccttgggtggtcggtcgataggactgggtgccgtggagcagggggcggcgctcgtcggggaggctcgggctacacaggagcccacggagggtggcgggggggctcaggcatggcgggctacaggtgctgagccctgccccacgggaaggcagctaaggccaggcgagaaattgagcacagcagctgctggcccaggtgctawgcccctcactgcccggggccagygggccggacgtcggctcctagtgcggggcccgtccagcccacgcccacctggaactcscgctagcccgcaagcaccgcgggcagccctggttcccgcccgcgcctctccctccacacttccccagaagctgagggagccggctcgggccttggccagcccagaaaggggctcccacagtgcagcggcgggctgaagggctcctcaagtgtcgccaaagtgggagcccaggcagaggaggcatcaagagcaagcgagggctgtgaggactgccagcacgctgtcacctctcactagcccactgcagacccaaactcctgggctcaagtgatcctcctgccttagcctcctaagcagctgggactatacacgtataccaccattcccagctaattttcattttcaaattttctgtagagatgggggtctccctatattgcccaggctggtgttgaactcctggcctcaagtaatcctcctgcctcagcctcccaagattgtgccactgcactccagcctgggcaacacagcaagactcccgtcaccaaaaaaaaaaaaaaaaattaattttctttcttactatattttgcaggaatcgatattattatctttttttttaatttttttttttttgagatggagtctggctctttcacccaggctggagtgcagtggcctgatctctgctcactgcaagctctgcctccygggttcatgccattctcctgcctcagcttgccgagtagctgggactacaggtgcccaccaccacacacagctaatttttttgtatttttagtagagataggttttcaccrtgttagccaggatggtctatatctcctgacctggtggtctgcccacctcggcctcccaaagtgctgggattataggcgtgagccatggcgcccggcccgatattattatctttaaagcaaaattgaggaatgcctttgttctccagatatcgggatatctggacactcccaggtctgggtctgttttagaaaacattattaatttgttccctttactgtaaacatttagaggctaggaatggctaattttctgagaatgcagcccagcaagtctcagcctctttttccagccctcactcaaaatggagtcgctgtccttcgaacgcctctgacctacacctgtgctagcaacgaagctcagacgccagggttgatttctgaatcatggttgcaccaaaggtcagcattacagaaaccaaccctgagaccccacctggctgccaacagtttcaaagtgaccaacctaaagaggtctacatcttaagggcagctcattgatttgttggaaatgtatttaaaaaaaatttttaggccaggtgtggtggctcaagcctgtaatcccagcactttgggaggctgatcctcaagaatcacttgaggccaggagtttaaaaccagcctgggcaacatggtgacaccttgtctttactaaaaatacaaaaattggctgggtgtggtggctcacgcctgtaatcccagcactttgggaggcagaggcaggtggatcacttgaggtcaggagttcaagactagcctggcctacagggtgaaaccccatctctagtaaaaatacaaaaaattagctgggtgtggtggcacacactgtaactccagctacttgggaggctgaggcaggagaatcacttgaacctgaaggtggaggttgcagtgagccaagatcgtaccactgcactccagcgtgggtgacagagcaagactccatctcaaaaatactccatctcaaaaataaaaactaaaataaaaaacatatttgttttagagacagggtctcactatgttgcttcggctggtcttgaactcctagcctcaagcagtcctcctgcctcagcctctcaaagcactaggatcataggaatgacccacttcacctggctttcttgtaaatctttttttttttttttttttttgagatggagtcttgctctattgcccaagctggagtgcagtggtgtgatgatcttggctcaccacagcctccgcctcccaggttcaagcgattctcctgcctcagcctcctgagtagctgggactacaggggtgtgccaccatgcccagctaacttttgtatttttttttttttttttttttgagacggagtctcgctctgtcacccagcctggagtgcagtagcaggatctctgttcactgtaagctctgcctcccaggttcacgccattcttctgcctcagcctcccgagtagttgggactataggcgcccaccaccacacacagctaatttttttgtatttttagtagagacagggtttcactgtgttagccaggatggtcttgatctcctgacctcgtgatctgcccacctcggcctcccaaagtgctgggattataggcatgagccaccgcgcccggccaacttttgtatttttagtagagacggggtttcactgtgttggccagtctggtctcaaactccagacctcgtgatccgcccaccttggcctcccaaagtgctggggttacaggcgtgagccaccgcgcctggccttgtggcaaatcttaaatcaaaaattgttgccaggccgggcgcgatggctcacacctataatcctagcactttgggaggatgaggcaagaggattgctttgtcttagcagtttgagaccagcctgggcaatatgtttagacccctgactctattaaaaaaaaaaatgttttgccaagatgggaggggggagacatggcaaatttatatataaaggtggaaaaataaagagttggcattacgtggaagctctctagggattttggtggggttcttagggtctcagtttttatttatttttattttattttattttttcttttttgagacggagtttcgctcttgttgcccaggctggagtgcaatggcgcgatctcggctcaccgcaacctgtgcctcccgggttcaagcgagtctcctgcctcagccttccaagtagtgggattacaagtgcctgccaccatgcccggctaattttgtattttcagtagagacgagatttctccacgttggtcaggctggtctccaactcctgacctcaggtgatttgcccacctcggcctcccaaagtgctagtattatacgtgtgagccactgtgcccggcctattttaatttttattttttttgagatggagactcgctctgtcgccaggctggagtgcagtggcgtgatcactgctcactgcaatcttcgcttyccaggttcaagtgattctcctgcctcagcctcccgagtagctgagagtacaggcgtgtgcccccatgcccagataatttttgtatttttagtagagatggggtttcaccatgttggccgggctgatcttgaattcctgacctcagttgacctgtccaccttggcctcccagagtgctgggattacaggtgtgaacctctgtgcccagccttagtttttatatttaagtcgaacctactgtggtactaagcaccaatcagctccctcactgcctagagggagtagtcttcactctgtcatttgttcttccatgaactaaaatttgttcagcgcccccatgatgtggaaagggctatgccagattctaggaaaaaaataccaagagaaagaaggcttgtcctctaggaattataattgaattataattatttatcttccctcattttaaagtagatttgaagtaccttaacatattcatacaacatktaagattaaatcaggagtgaatgaagatatgaaggcaagagaaagaagaataaaggagagatttagctggaggtaaggctagtgcatgccacaaagtcctctatactttgtgaaatgtgagccatggtttgtctctgagcttcctggcaggcaataggaggaagggaatatatttggaacacattttatattcactagacaaaaggaatcccatttgtaagaagaaatgaacccattcctgatactgagggatgggaggattccgcccccaccccaatccttgtgaacattatcagctacaggatcagtcgttttctcaataagctctttgtagcacaggttttacaagctgcagattgtgacctgtggtgtgtaatgacatcaattcagtgctttgctgtggcataataaaagataaatatttggtctttgtcctgttcctgtgttcctggcacagagctcctgagtgataaaagtatcttttgtatgctaatgagatcactcttggtgggaggctttagaatggatgctgatccccagaaagcacaagccatggtgagagggctggaaatttcagctcctccctacaccacctctggagaagggagagaggctggagatcgagctcagtcaccagtggccaatgatttaatcatctatacgtaatgaagcctccataaaccctgcattaggctggtcacggtggctcacgcctataatcccagcacttcgggaggccgaggtgggtggatcacctgaggtcaggaggtggagaccaggccaacatggtgaaaccccgtctctactaaaaatacaaaaattagctgggtatggtgacaggctcctgtaatcccagctactcgggagcctgaggcaggagaattgcttgaacctgggaggtggaggttgcagtgagctgagatcgcaccactgcattccagcccgggggaaagagtgagactctgcctcaaaaaaaaaaaaaaaaaaaaaagaccggcccggtggctcacgcctgtaatcccagcactttgggaggctgagacaggtggatcacgaggtcaggagatcaagaccatcctggctaacatggtgaaacccctctctactaaaaatccaataaattagccgggcgtggtggcgggcgcctgtagtcccagctactcaggaggctgaggcaggagaatcactgtcccagctactcgggaggctgaggcaggagaatcactggaacccgtgaggcagagcatgcagtgagccaagatcacgccactgcactccagcctgggcgactccatctcacacacacccacaaaaaacctacgttagccaggcgcaatggtgcatatctgtagttccagctactcaggagggtgagggaggatcactcaagcccaggagcccaggagttggagaccagcctcgggaatatagcaagacaccatctatacaaaaaaataaaataaggctgggcgtcgtggctcacgcctgtaatcccagcactttggaagcctgaggcaggcggattgcttgagcccaggagttggagactggactgggcaacatggtgaaaaaatacaaaaattagccgggtgtggtggtgcatgcctgtagtcccagctacttgggagtctgaggtgggaggatcatttgagccctggagggcaaggctgcagtaagccatgatgtgccactgcactccagcctgggtgacaaaacaagaccctctcccaaaaataatagaatagaatrgagtagaatagaatagaatagaatagaatagaatagaatagaatagaaagaatagaatagaataaaattctgaacgatgaggttcagggagcttctgggttggtgaacacattgaggtgtctggagtgagcatggaagccctgcccctctcccaccataacttgccgtgtacacctcttccaattggctgttcctgaattgaataacataaaccagtactggtccatcaggtgctttcctatgttctgggagtctttctggtgaattaccaaacctgaggaggtggcagtgggaacctttgattgacagctcatcagtcagaagcacaagtatccccctctctcccaggatgtgtgactggtccctaaaatgggggcagccttgtgggaccgagcccctactctgtggggtatgtgcttacgccgggagctggggtcagaatcgaattgaattgttggatacccagttggtgtcagataatcagagaattggagggttgcaaacataattgtgttttaaaaagaagttattagagtagactagactatgctggagtggatcacgcctatgacttctgtgagacttttgttgcaggggcatgtgtctgtgtgtgtgcatgcatgtactgagttgtaaaataaaatgtatttcttttttctttttttygtgatggagtcttgctctgtcacccaggctggygtgcagtggtgcgctctcagctcactgcaacctccacctcccgggttcaagcgattctcatacctcagcctcctgagtagctgggactacaggcgtgtgccactatgcctggctaatttttgtctttttaatagagacggggttttaccatgtggcccagactgatctcgaattcttggcctcaagtgatccgcgtgcctcggcctcccaaagtgctgggattacagatgtgagccactgcacctggcttaaaatgtatttcttactggtgccatagccatacacacacaaacatctctaaattgatgaaattcatcaagctgagcctccagtatcttattttctggggcagtccaaatgtgcgtgtgtgtggacttccagggccacaagaggaagagtgttgtcacacgtggtgagggcagagacttcgattttacgagtgttctcaccattcccagactgataagattgactcactgtgcctgaactgtttgtacaaatggtgtggtttatgtggaaccacttgccttccttctgggaatccagaattttggagcatgctaggcagaggtgcctatgctatcagcccccagtaaaaaccctggacacggagtctctgagcttccctggtagatggcattttacgtgtgttgtcacaactctttgctgggggagttaagcacggtctgtgggattccactgggagaggacccctagaagcctgggccgggcctcctcccaatttcaccccatgtgcctttccctttgctcattatgctttgtgtcttttgctgtcgtaaaccatagccatggcttttgcaagtcctcctagattaacactgaacttgggggtggttttagggaccctgacgtacctatggatgtcaacctgctttagcgctatttgttgaaacaataatcttttccacattgaattgatttggcacttttgttcaaaatcaattgtaaagatttactacataaatgtaaacatttattcctggactcttcttcttttttttttttttttttctgagatagagtctcgctctgtcgcccaggctggagtgcagtggtgctatctcagctcactgcaagctccgcctcctgggttcacgccattctcctgcctcagccccccgagtagctgggactacaggtgcccaccaccatgcccagctaattttttgcatttttagtagagacagggtttcactatgtcagccaggatggtctcgatctcctgacctcgtgatccgtccgtctcggcctcccaaagtgctgggattacaggcgtgagctaccacacccggcctattcctggacttttattctgattcattgcctatctttatgtcagtaccatgctatcttgatgactatggcttcttagtaagtttatttttaattttttttttggggatggagttttgctcttgttgcccaggctggagtgcggtggcgcgatcttggctcactgcaacctctgccttccgggttcaagtgattctcctgcatcaggctcccgagtagctgggattataggtgtccgccaccactcccagctaattttttgtatttttagtagagatggggtttcaccgtgttgaccaggctggtctcgaactcctgacctcaggtgatctacccacctcaacctcccaaaatgctaggattacagacgtgagccaccatgcccagcccagctttttagtaaattttaaaatcaattgtcttccaactctgttcttatttttcaaaattattttgcctattgtaggttttttttgcatttccatatgaattttaggatcagcttgccgatttctattaaaaaggttagtgggattttgattgaggttgcattgaatgaatgtaccaactaaggaggcttgatatcttgacaataatgagccttcccatccataaacatagaatagctcttcttttaatatatctcagcattgttttgtagttttcagtttacatgtcttgtgattcttttgtttattcctgagtattttattctttttgatgctattgtgaatggaatggttttctcaattttaagattgttcattgctagtatatagaaatagaattggccaggcacagtggctcatgcctgtaatctcagcactttsggaggctgaggcaggaagattgcttgagcccaggatttctgggccagcctgggcaacatagtgagactccatctctacaaagaaacacaaaaattagccagcgtggtggtgtgcacttgtagtcccagctccttgggaggctgaggctggaggatggcttcagcctgggaggttgaggctgtagtaagccataatggtgacattgcactccagcctaggtgacagactgataccctgtctagagaaaaaaaaaaaaaaaagaattgatttttgtatattgattatgccctgtgaccttgctaaatttattagtactaatatttgttttatggatgccttaggattttctatatataagatagtgccatctgtaaataaagacagttttatttcttcctttctaatctggatgcctttaatttctttatttgcctcattgattagaaatagcaaaagtgggcatctttgccttgttcctggtgagaagaggaaagcagtcattcaccactaagtgtgatgttaactgtgggtttttgtaggtgtcttttatcagatttcataaattctcttttattcctactttgttgagaatttttattatgaatctgtgatggattttgtcacagtgttttcaatatctgttgaagtcaccatgtgtttttttgtcctttattctgttaatatattatattatattgatgttcagatgttaaaccaaccttgcattcctgggataaatcccacttagttatggtgtacaatcctatttatatgttgctaggcttggattgctaatactagtcttacagaatgaattgggaagcattacctctcccttcattttctcattcatttattttattttactttctatcttatatatttttatattttatttcattttatcttattttagcttttagagacagtgtcttgctctgtcacccaggctggattgyggtggtgtgatcatagctcactgcagtatcaacctcctggactcaagcaatcctcctgcctgggactataggcatgcaccaccatgcccagctataatcatccatttctttctttttttaaaacaaattttatgtttatttatttatgtactgtgatttctcccaccgaaaggaatcattcatttctttttttttttttttttttttttgagagggagccttgctctgttgtccaggctggagtgcagtggcataatctcagctcactgcaacccctatctcccaggttcaagcctcagccttctgcatagctgggactacaggcatgcaccaccacacccagctagtttttgtattttttagtagagacagagtttcactatatgttggccaggctggtctcgaactcctgacctcagctgatccacctgcctcggcctcccagagtgctgggattacagacgtaagccaccaygcccggctggaatcattcatttcttttcaagtgggtatcttatggtattttagggcatggctgggagcagttttgttttctcttctcaagactgagtgtttgcaggatgtcatagagttcatgtctgcagctcacagtgtcattgcctgtgtccccagctccacgtactggcaggtgtgctgcaagctgggtaggtgccctgtgtccctgggataccttaaccgacactcctggccctcctctgcaagctgtgccctgatcctccctgcagggactggggattgggtctgctcacctagaagccaggatacctggctgagggcacttctctccctcttctctttgaacagagtggccacaaactcaaaggtgcrggagcaagtgcggctggagctgagcttcgtcaactcagacctgcagatgctcaaggaagagctggaggggctgaacatctcggtgggcgtctatcagaacacagagtaagtgggagcagcacaccttccaaaagcctctgagccagagatccttcgtacatccagggtgctgcacaaagaggtcagatagcgttctagactggggtgtggcagcccccactttcggaagtgagagaaccatcaggtttggggttgagtgaggtgctagactggaagggatgagcccatttgttgggaaatacctgcagtgttggacaaaaaggcatttgtgaggccgggcacggtggctcactcccgtaatcccaacactttgggaggctgaggcgggtggatcacctgaggtcagtctggccaacatggtgaaaccccgtctctgctaaaaataaaaaaaaaaatagccaggcgtggtggtgcacacttgtaatcctggcttctcagaggctgaggcagaattgcttgaacccgggagttggacgtttcagtgagccgagatcacactactgtactccagcccggctgacagagcaagactctgtctcaaaacaaacagacaaaaaaaaaaaaaaacaaatgaacacagtataaaatctagtgtaaatatacgtgatgagccaagataagtttaaaagttagatgccttggattttatagttaattttcagtaattccgcgtagtcacatttcatagacacgcaaacattagcaagatatgttattaaattcaactgaacagacattaagcaaggatattttagtgggtcaccataactttcctaagaaatattaaagggacattgttaggacaatacctttccaatgttggctaattatttcctcatttatttgccaaggaacaaaaagcatacacaaatactttgggattaaggccaaaggccaaaattgaccctgtaaggggaggccactatgcacacacagagattctgtgcactgtacttacgttggactgcagtctgtttcctagctggagggacaaactgaaacagaaaaatccarattaaagtaacacaccagtctccttttaaggttgtatttccttttttttttttgacacagagtctccctctcttacccaggttggagtgcagtggagcgatctcagctcactgcaatctccacctcctgggttcaagcgattcttgtgcctcagccacctgagtagctgggattacaggcacgcaccatcacacttggctaattgttttttttttttttttttaagtagagacagggtttcatcatgttgcccaggttggtcttgaactcctggtctcaagtaatctgcccgccttggcctcccaaagtgctgggattacagatgtgagccactgtgcctggcccctaggtcaattttgaaggcactctattgtatcattctccataactcaattttggaatcgatttcttcaacgtgaaagccaacaacaccatccctcagaattgcaatacatctccaaaaatggagatctaactatgaaagaaatgcccctcttgccttatgcctgtaatcccggctcttcaggaggctgaggtgggggatcgcttgagcccaggagttcaaggccagcctgggcaacatagtgaaaccccatctctacaaaaaataggaaaattagccgggcatggtggtgcacacctgtagtctcagctactcagaaggctgaggtgggaagatcacttgagccagggaggtcgagactgtagtaatggcaacagaaaaaagtcctgtctcaaaaaacacaaaaacaaaacagaaccctaagcgaaatgcttctttttaaggagaaataactttgagacagttcagagaagggtttacgtgcttcttcagtgtgggcatgagacttctcaaaaagtaggtgggccccaggggaaactcagtcggaaaatagctcccgggatttgggaaccttgagtcacctatggaatgtgtgtttcctggtgctggtcctctgcagggcaccggggtggtttcagagctggaggggaggcgtcagtgtgtgaaacctcgctggctcttccctttgtgacaccacatgcctggcttacctgtgggctcctgtacggtttttattgtttgtttgttttatctttttttgagatggagtctctctctgtcacccaggctggagtgtagtggcatgatctcggctcaccgcaacctccgcctcccaggttcaagcaatcctcctgcctcagcctcctgagtagctgggactacaggcgcatgccaccatgcccagctaattttttgtatttttagtagagacggggtttcaccatgttggccaggctggtctcgaactcctgacctcgtgatccacccacctcagcctcccaaagtgctgggattagtcatgagccaccacacccggcctcctgtgcagttttgaacgcccagtcagtgcgacagctaatggaaggttctcccagcctatgctctggtgttcaattccagtgtttgtccaaaaggttcaggttctggaggaggcgagatggggccaaggtttgggaataaatgtcggctgttccacactctcatttgccatgccgaagagcagggacgtgcaacacagggcttcccacagagtgaaccgaaggtctctggattggtccctgggctctagagtggccagtcactgccctgtgtcattgggaagagggagagctgtgcagattcaacacggcaccatgcatttgggtcctgcgctcttctgttttcttttttttcttttttttttttttttgagacggagtctcactctgtcgcccaggctggagtgcagtggcacgatctcggctcactgcaagctctgcctcccgggttcacaccattctcctgcctcagcctcccgagtagctgggactaaaggcgcccgccaccttgcctggctaattttttgtatttttagtagagacggggtttcaccgttagccaggatggtctcgatctcctgacctcgtgatccgcctgcctcggcctcccaaagagctgggattacaggtgtgagccaccatgcctggccctgttttcaaagtagattgtttctttcttagcatggttgatcttttttttttctttttttttttttttcctgagatggagtctcgctcttttgcccaggcctggagtgcagtggcgtgatcttggctcactgctacctccacctcctggttgaagtgattctcctgcctcagcctcctgagtagctgggattacaggcacacaycaccatgcccaggtagtttttgtatttttagtagagacggggttttaccatgttggccaggctggtcttgaactcctgacctcaggtgatctacccatttcagcctcctaaagtgatgggattatgggygtgagccactgcacctggcctgcactactgtgttttcaargtagactgtttctttcttagcatggttgatctttacagtcttctaggaggtaggtgggaaagaaataacctcatggtgcagatgggaaaactcagggaggccagaaggcacctagagggcgctgtcattgccacattggggctggggtaccctggagctgggactcaggacactcgctcctcctcttctcattgcctggacagctgcaaacctggcttcctgccctgagtagcctggaggagccttcagcaggatccngctttccatgcccccggatgggactcacctggctgtagcacagctgcactgcagagccaggttcagcttacagctgcattgtcccctcgccctgcccagccttcctggccttcttgtggggctgggctgagcagcccaaggaggtctcctgttacaggtcagggagctaaatccttgtttgcaaaacacagcctgagcttcattcacttccttctggccctgcccctaggaatgtaggctcagggagcactccccaggcgacctgtggttacggagtgktcagctgggggagaggaggtggagggtgtctgaccctgggctgggaggcaggtgcatttcggtgtcagatggggcttctgccctgacggcatctcctgtgccggtggtgggacgcctagacacttcccaaagaagaggcccctatgaacccagagttgcaaatgtgagggtattggagagcttccacagctgtggggcccgctgaggggggcagaggaggtgggggtgaggagstgacaaaggaggcagcagggtggtgcacccaggtgggagcagcaagtgcaccaggcacagaccctggcacacaatagactctcagcacagctgccgaaagaagcattgagactgagctgggctcagaggctcacgcccgtcatcccagcacattgggaggccaaggtgggcggatcgcttgaggtcagaagaccagcctrgccaacgtggtcaacatggcgaaaccccattgctactaaaaaaatatacaaaaattagctgggtgtggtgtcgtgtgcctgtaatcccagttactcggggggctgaggcaggagaattgcttgaacccgagaggcagaggctacagtgagctgagattgcgccattgcactccagcctgggcgacagaacaagagtctctaaaaaaaataataataaaataaaaaaggaaccattgaggcattgaaacyggaagataaatcagtgtcaagatgccaggggcctgatgtgttaggaggggtggtccagcagtcttagggagcggggtcagttttagagcagagggtggggcatgaccagagtcatccttatggaaaatgagcctgtcagccaggtgagtacaggatggggtaaggagggggcacacacctgagctgggctgctgagggcaaggccgtggggtgcacaggggtccggttgggggtgttcatacataccttgttgtgttcctcatagggaggcatttacgattcccctgattcctcttggcctgaaggaaacgaaagacgtcgactttgcagtcgtcctcaaggtaaatctcaaagccatgggcaccagactcagtgtttaaaatggaaataggccatttgcagtggcgcatgcctgtagtcccagttacttgggaggctgaggcaagaggatcgcttgagcccaggaactggaggctgcagtgagttgtgatcatacaactgcactccaggctgggcaacagaatgagaccctgtctccaaaaaaaagaaaaaaaatggagatagagaaaatatgtatcccttgcaatggccttaggctcaacaggcagagtcagttgatatctacagagtgaccctgaggccyttctcagccagctacatgcataatttatatgtttattcctgccatatttttgttgttgcctttgatggcttctgaagctcctcctgggtcttggacaaggcaggttggaaacccaggagggcctttcccaagaggccaagtcaaagagggtctgtagtggacatgctttgaaatttaaaacttatatcctcttttattaatagtgtatttttttctnaaatcatataaccagtttaggttatgtctttagaagaatagctaaagttttttctctaacattttattatgaaaatttccaaacttttcaaaaaattttaagaattttatagcaaactcctgtgtactcaattcttccaagaacatactgccagcattgcttcctgacatatttgtccatctgygcattcttgtgtctgttaggttggtttgaaggtaattgcagtttttccattgaaagtaatggctaaaggccgggcacagtggctcacgcctgtaatcccagcactttgggaggctgaagcaggcrgatcacttgagctcaggagttgaagaccagcctggctaaaatggtaaaacccctgtctctactaaatgtacagaaattagctggacrtggtggtgcacacctgtaatcccagttacttgggaggctgaggcaggtgagtcgttcgaacctggaaggtggaggtggaggttgcagggagccgagatcaygccactgccctccagcctgggcgacagagtgagatcccatttcaaaaaaaaaaaaaaaaattagctgggcatagtggcatatgcctgtaatcctagttactcgagaggctgaggcacgagagagtcgcttgaacccaggaggcagaggatgcagtgagctgagattgtgccactgcactccagcctgggcagcagtgaaactgtgtctcaaaaaaaaaaaaaaaagagaacgaaagtaatggctattatcagtctgtcttatttgtaatgcaatttcaaaggaaatcaaagatgtcaattcactccccttaaatatttgaataaccagagtctttgcttgtgtgtcccccagccacattcctgggtatctggactcctctcccatttgcagatcctcataagcccacctgtgcctggcactgtgctgggtgccagagatgccacaagccctgcctgcggggcctttgggtcagtgggggtttcaagtgggaagtggaagaggtgcttcagtggagaacacaggagagaccatgccccgatgctggggctgggagaccgtcctgtgcctggaataccctcctcttccttccctcttcaactccatcagtttgagtttttaaccagtcacctccaaattccatcaaggaggggaaaggggatgaggtgcagggtggcccaagtttgcgccrtgcagcccaggcattggttataggaattaatcctagtatcatgaaaattgctttgaagaaatattttacgttctttttttttttctttttctttattattttgagacagagtctcactttttcacccaggctggcatgcagtggcatgatctcggctcactgcaacccctgcctcctgggctcaggtgatcctcccacttcagcctcctgagtagctggtactataggcgtgtgccaccgtgcctggctaattgttgcatttttctttctttctttcttttttattgagatggaatttagctctcgttgcccaggctagagtgcaatggcgtgatctcggctcaccgcaaccttcayctcccaggttcaagcgattctcctgcctcagccttacgagtagctgggattacaggcatgtgccaccatgcctggctaattatgtatttttagcagagacggggtttctccatgttggtcaggwgggtctcraactcctgaccacaggtgatccacctgtcttggccttccaaagtgctgggattacaggcgtgagccaccatgcctggctaatttttgtatttttcgtaaagacagagtttcccactgttgcccaggctggtctcaaactcctgggttcaagcagtcctcctgccttggcctcccaaagtgctgggattataggcatgagccactgtgcctggcttattttactttccatgataatcctctwaattggctcatcttggactacttttagtttagaaaagaaaacatcttatgacattttgactattactatttttttctttctttctttctttctttttttttttttgagctggagtttcgctcttgttgcccaggctggagggcaatgacggcatctcggctcactgcaacctccgcctcccaggttcaagtgattctcctgcttcagcctcctgagtaggtgggattacaggcacccgccatcatgcctagctaatttgtatttttagtagagatggggtttcactatgttggccaggctggtctcaaactcgatccacccgcctcggcctcccaaagtgctgggattacaggtgtgagccgccgctcccggccaactactacttttaaaagcaattggttaatactttggaagcacttgacgttcattctcagagacagtgagttgtttgacataaatagaggcctttttgactgctgccttgtttaaatcctgtgagtttggggtttattttggaattggagaagggaagttggtattctgaatgtttcaggactcaagtttactggaaagtttgtattctgggtagaaagcaatgaaaacaattcgggaattgcagctttatgccacactgccacagcctgcctgaacttttacctgagacttatgcccagatgcaatggctcatgcctataatcttagcactttgggaggctgaggcaagaggacagcttgaggccaggagtttgagaccagcctgggcaacagaatgagaccttgtctctctctctctctctcttttttttttgagacacagtctcactctgttgcccaggctggagtgcaatggtgcgatctcagctcactgcaacctccaccttctgggttcaagcgattctccttcctcagcctcctgagtagctgggactacaggcatgcaccactatggccaactaatttttgtgtgtgtatatatatatttttgagatgaagcctcgctctgttgcccaggctagagtgcagtggcgtgatctcggctcactgcaacctccacctcctgggttcaagcaattctctgcctcagcctcctgagtagctggggtttcaggcacccactaccacgcccggctaatttttgtatttttagtagagacggggtttcaccatcctggccaggctgatcttgaactcctgacctcatgatacacctgcctcaggctctcaaagtgctgggattagaggcatgagccaccgtgccaggctaatttttgtatttttagtagagacagggtttcaccatgttggccaggctgatctcgaactcctgacctcaggtgatccgcccacctcggccttccaaagtgctgggattacaggygtcaaccaccatggccagtcatctctctctctyttttttttttttttttttttttaagagatggggtctcctcactatgatgcccaggctggtcttgaactctcctggccccaagtgatcttcctgcttccacctccagtaaaagtgctgagattatagatgtgagccaccacacccagccgcatctctatttttatttaaaatatatgtgtaatgtgtatatatataaatgcaaaaatagatgtgacttgccactggtctgtgggactcaaaacaatccacatgtctagaaatgtctgttgctgctgttgtagaagtttctttacgatttaatttgtctgttgcwtggtgctgtgctacaagaatgtaagcatttttttttttgagatggagtttcactcttgttgcgcaggctggagtccaatggcacgatctcagctcactgcaacctctgcctcctgggttcaagcggttctcctgcttcattctcccaagtagctgggattacaggcatgtgccaccacacctggctaatttttattagtagagacatggtttcaccatgttggccaggctggtcttgaactcatgacctcagatgatccacccgcctcagcctcccaaagtgctgggattacaggtgtgagccactgcatccggccaagaatgcaagcattttaaaggaagagtctcttggagaaacttaggaattttataggcatttttaaggattcaactgggtcatgttctgaattccacattaaagcaaatgaaaatattcacatgttgtggacatggccaactgccattcggcacaggcttccaaccatgtcattttagcctaaaagagactctacaaatgtcagtcatatgaaaatgagaacgtttgacggactttctgttgtattttttcccttccatatttgatagaaacacaggtactgcagaagtggttcagcagactgaattacggcagttccatttcaaatctgacttgtgtgtccgtgtgatgttttataatcagtgaagcttcacagtgtgattttgttttattttattttatgtatctatttatttagagagggagtctcactctgttgcccaggctggagtgcagtggcgcaatcttggctcactgcaacctctgcctcccaggttcaagygattctcctgcttcagcctcctgagtacctaggattacaggcaccygccaccacacccagctaatttttatatttttagtagagacagggtttcaccatgttgtccaggctgttctcgaactcctgacctcaagtgatccaccctccttggcttcccaaagtgttgggattacaggcgtgagccacagcagctggccgattttgttttattttaaagaaatagggccaggcacagtggctcacacctttagtcccagctacttgggaggttgaggtggattgcttgagcccaagaggtcgaggctgcagtcagctatgattgagcccctgcactccatcctggaaaacagaatgataacttgtctcatttaaaaaaaaaaaaaatttcgaatcaatgaaagaaaatgaaataacatctgttcttcagtaaagtttaacagttttctgcttaattatattaattttatccctagaaatgtacttttgttgctattrtgaaaggtattatttctctgttaggttttktttgtttgtttgtttgtttttgaaacagagtctcactatgttgcccaggctggagtacagtggtacaatcttggctcactgcaacctctgccccccaggtccaagtgattctcctacctcagcctcctgggtagctgggattacaggcacctgccaccatacccagctaattttttgtatttttagtagagacagggtttcaccttgttggccaggctggtctcaaactcctgacctcaactgatccgcccacctcagccttgaaaactgctgggattacagatgtgagccaccacacctggctgtctgctaagtttttctaattggttattgcttgtataagaaaggaagaatattgacttttcttttttactattgactttcatgtgttaaattctttgccactttattgaattcttattaatttagtaatgtttcagttgatgctattgggttttataaacatgctgttacgttgcaaaaaattattttgattgtttctttctaatattttatgtctcttatttttcttaatgtgtgggctagagaatgtttggaattaggctaagtaataacagtgatggtagaaattctcattttgtccctaatgttcacagtgggtttcagttaggattttttttttttttgaggcgaagtctcgctctgtcatccaagctggagtgcaatggctcaatctcagctcactgcaacctctgcctcctgggctyaagctattctcctgcctcagcctcctgagtagctgggattacaggcacctgccagcatgcctggttaatttttgtatttttagtagagayrgggtttcaccacgctggccargctggtctygaactcttggcctcaagtgatccacctgccttggcctcccaaagtgctgagattacaggtgtgagccaccgtgcctggccagttagataatttttttatcccactaagtacgttaatctaccctagtttactaagtttcaaattcaggatcacatataaaatttaatcaaaatcctctttgactttcataagattggagtgcagtgatgtgatcatggctcactgcagcctcaacctcctgggctcaagtgatcctcctcctgcctcagcacgcctggctaattttttattatttgtagagatggggtttcactgtgttgtccatgctggtctcaaactcctggtctcaagtgattctcccaccttggcctcccaaagtgctgggatcacaggcatgagttactacacctgaccccttttaaccaccatgcccagctattttatttttttattttttaaatttttaatagagttggggtttcaccatgttggccaggctggtctggaacacctgacctcaagtgatctacctacctcagcctcccaaagcactgggattacaggtgtgagccaccatacccagcccatggccaagtttaaagaaaagaggcatagtcagctgggtgcagtggctcatgcctgtaatcccaacactttgggaagctgaggtgggaggatcacctgaggccaggagtcsgagaccagcctaggcaacataggaagactytgtctttatgaaaaataacaatattagctgagtgtggtggtgcacacctatagtcccctctcctggagaggctgaagtgggaggatgacttgagcccgggagttcaaggctgcagtgagctatgattgcaccattgcactccaccctggacgacagagcaagaccctcatctcttaaaaaaagaaaaagaaggcacagcaaagttgtgtatttagtacaaatccatttttgtaagacaagtgtttgtctgtttgtgtgtctgtatgttgaacacacaaaaacaggaggagctttaatgtaraagttgtgtaaagaggttactcacagtcacttgggaagacataattgagcgatctatgtgatcacctttcttgcagcttgggggagccagcacttgtaggggygggggtggggcgacagggcaaaaccccatctctattaaaaaacacaaaaatgaaattagcttgtggcacgtgcctgtggtcccagctacttgggaggctgaagtaggaggattgcttsagcctggagaagttgaggctgcagtgagccgcgatcgcaccactgcactccagccgaggcaacaaagtgagaccctgcctcaaagwaaaataaaataaaataaaataaagtaaaataaaataaaatgcctttataacatggttaagggtcttcttggcaaaggaaacctgtatctggagactgttattgacagtcctaccctcaggrtctgtgctgggaaacttgtccgggtcctgagggaggcccagaattgcaagtctgagcccctgaatagctgcagtgtttgcagtatagttgaatgtataggccatagagtggtctcgaactcctgggctcaagtgatttacctgcctggtcttcacaaagtgctgggattacagacgtgagccacgatgcgcagacacaaagacatttttaagcaaaaaattaacttcaactctcacttttactgaagcagcacaacatttaaaaacataggcgtgtgttgcagtggctcacacctgtaatcccagcactttgggaggctgaggcagatggattgcttgagcccaggagtttgagaccagyctgggcaatgtggtgaaaccccatctctactaaaaatacaaaaattagctgyrcatggtggcacatgcctgtaatcccagctacttgggaggctgaggcacgagaatcacttgagcctgggaggtggaggttgcrgtgagccgagatcgcaagattgcactctagcctgggcaacaggagtgaaactctgttttttgttttttgtttttgtttttttaaaaaaaaactatggccgggcacggtggctgacatctgtaatcccagcactttgggagggcgaggtggggggatcacctgaggtcagaagtttgagaccagcctgaccaacatggtgaaactctgtctctacyaaaaatacaacaattagccagacattgtggtgrgcgcctgtaatcccagctccttgagaggctgaggaaggagarttgcgtgaacccgggaggcagaggttgcagtgagccgagattgtgccactgcactccagcctgggctacaaagagagactccgtattwaaaaaaactacataaattaagaaaataaattcccccactttgaaaatcactataagtttttctttattctgcctttttaaaaatgggttcacaattgacatattactattatgcacacatatggttttcagccacactttataacatctgacctcatttttctttaaggattttatcctggaacattacagtgaagatggctatttatatgaagatgaaattgcagatcttatggatctgagacaagtaagtttttgtgtgcagcagagaggggagggtggcttttccgagtcttcagggaaccccattattgcacgcttgtggtcttaacagaatcgcgggtggatagaggtgatggttggggggtgctggaatcatccattccacttgctgcataagaaaacygtagaaggaggccaggcgcggtggttcatgcctgtgtaatcccagcactttggggtgtggaggtgggcggatcacctgaggtcaggagttccagaccatcctggccaacatggtgaaaccctgtctctactaaaaatacaaaaattagctgggcgtggtggtgcatgctggtaattccagcactttgggaggctgaagngggtggatcacctgaggtcagaagtttgagaccagactggccaacatggcaaaaccctgtttctactaaaaatacaaaaacaagccaggcatggtgctacacgcctgtaatcccagctactcgggaggctgaggcaggagaatcacttgaacctggtaggtggaagttacagtgagccaagatcgcaccactgcactccagcttgggtgggtgacagcaagactctgtctcaaaaaaaaaaaaaaaaaaagaaggaaaaccatagaaggggagagccctgcctcagggctgggactggattccaggatttctgacttcctcccaggttctttccacccctcccagagtttacgatgccagtagcgaggtcatcatactgcagaaatagttacaggcacctgctggtatgtgcagggcaccttctgggaagggccatcagctgtgtcctcctctgctcatgccctcttgggttcttttcctygcaggcttgtcggacgcctagccgggatgaggccggggtggaactgctgatgacatacttcatccagctgggctttgtcgagagtcgattcttcccgcccacacggcagatgggactcctgttcacctggtaggtgcttgaggtctgcgctggcgcttcacgtgttatggcagccacaattttggagcctcagcatcacagacgcccctctgcgggtgcccctgtgcacctcagccccctttcctatcttgcatttatctggggaagtctcnaaagatgtcaatacattggtatttatttatgaaggtgatccgaggggagatggctccaacagactgtggcctcttgcttctcagaacaagcgagccaaggagaagagacatttttcttgctcgttgtatcactggggaagcacgggggctctgaagtggaattagccagaagcgagattcttatcycagattggacaggggcatgcatgtgtatgtgtgagtgagagagagagagaaaatcaggtcttatccagtgaggcaaaagcaccaaacagaaatagatcaggtttcttttgaaatggggtctcactgtgttgcccaggctagtcttgaattcctaggctcaggtgatatttctgcttcagcctcctgaatagctgggactataggcatgagctactcactcagcttagatcagatttaaaaaaaggaagtagagcatttgattcttctccacaattggtattttcagacaagatcaggcacgtcagggtggtatggccgtagacccaattggtattttcaaaggttagtatagtttaaatacttgggaggccgggtacagtggctcacacctgtaatrccaacactttgggaggccgaggcaggcagatcacttgagcccaggagtttgagaccagcctggacaatgtggcaaaaccccatatctacaaacaatacaaaaatttgctgggtatgatggtatgcacctgttagtcccagctacttgtgaggctgaggcaggagaatcacttgagcccgggaggcggaggttgcagtgaaccgagatcacaccaccgtactccagcctgggtgataggagtgaaaccctttttcaaacaagaaaaaaaaaggctgggcgtggtggttcacacctgtaatcccagcactttgggaggccaaggcaggcrgatcacgaggtcaggagttcgagaccagcctgtccaatatggtgaaaccctgcttctagtaaaaagtacaaaaattagcaaggcatagttgcgcgtgccttgtagtcgcagctacttgggaggctgagacaggagaatcgcctgaacccgggaggcagaggttgcaatgagccaagatcacaccactgcactccagcctgggtgacagagtgagactctgtgtcaaaaaaaaaaaaaaacaacctaaaaaaaagtactttggagatgctgcaccccttctctgagtgtcgttaggagtgtcagtgaaaggagaacacatcctagaagatcaggggcatatcagaattcaatgtttctacagctgatgggtggctactaatgccttcctcatggaaagcaaaggaaagggggatgacttttcctaacaatgcaccaggctgtctgcatggccgaaaaggcgaaaggtggtttctccttagtcatgaattagggagaagctgtctgcacaccccctggttcatgagtaaactttaaaacaagtcctagggccaggtgcggtggctcacgcctgtaatcctagyattttgggaggccgaggtgggtggatcacctgaggtcaggagttcaagaccatcctgaccaacacggcgaaaccctgtctctactaaaaatacaaaaattagctgggcatggtggtgggtgcctgtaatcccagctacttgggaggttgaggcaggagaattacttgaatccgggaagtggaggctgcagtgagctgagatggcgccactgcagtctagcctgggcgaaagagcaaaactctgtctcaaaaaataaaaaataaaaaaaataaaaataaaacaagtcctaggctgggtgtggtggctcatatctgtaatcccagcaggttgggaggccaaggtgggtggatcgcttgagcccaggagcttgagaccagtctaggcaacacagtgagaccctatctctacaaaacaattagagaaaatttgccggtcatgggtggtgcatgcctgtagtcccacctacttgggaggctcagatgggaggatctcttaagcccaggaggttgaggctgcagtgagtcatgatcatgccaccgcactccagcctaggcaacagagtgagactttgtctgaaaaaataaaaagtaaaacaaattaaaacaaatcctgagtttttagatttcagaaagaattatgaggggttagtaattgccatatttcatttaggagaagccataccgccttggcctcccaaagtgctgggattactggyatgagccaccgctcccagcccattttttttttttataattgaagaacttacctgacacatcattatcacccagagtccatagtttccattagggttcattcttgcacttgtgtattctgtggcttttggccaacatagaatgrcagtgatccacctttgcagtgtcatacagaagagtttcactactggaaaaatcctttgtgctccccctccstccctccscctaagtcctggcaacccctgatctttcttctgtctccagggttttggcttttcagaatgttggaatcacacagcgtgctatacagtaggtagcaatgttcaggttggctctttcacttagtaatgtttcctctgcatcttttcatggcttgctggttcatttctccatttttagtgctgagtaatattccattgtctggatgtcccatggtgtgtttatccagttaccccgtcagatatttttgtgtgtggctgtggcggtcagtgtgattagtcstgtcatcttgcttggaaacaaaagcctcagtgcacatgcattcttgacttttactgaagaaatgagtttgttgttgttgttgtcgcccaggctggagcacagtggtgcgatctcagctcactgcaacctccgcctctcgggttcaagtgattcttccgcctcagcctcctgagtagctgagattacaggcgcccgccaccatgcctggctaatttttgtatttttggtggagactgggtttcaccatgttggccacgctggtctcaaactcctgacctcaggtgatccacctgcctcggcctcccaaagtgctggcattacaggcgtgagccaccgcacccagccaacccaggagtttgacagcagtttgggtaacatagaccycatctctacaaaaattaaaaaaaaaaaaataggcaggtatggtggcatgcaccagtaatgccagctattctcatgaggctgaggtgggaggatcaactgagccctaaagttgaaggctgcagtaagctatgatcacaccactgcactccagcctgggcaacagagtgagatattgactcttaaaaaaaaaaaaaaaaagaattttttccacttgtagcattaactagccaagtaatctgtattctcggaatgcatttctttcacataggtatgactctctcaccggggttccggtcagccagcagaacctgctgctggagaaggccagtgtcctgttcaacactggggccctctacacccagattgggacccggtgcgatcggcagacgcaggctgggctggagagtgccatagatgcctttcagagagccgcaggtatgtctcctccagggctgaccagacggagccttggccccacccggtggcaccaggggaccccccactgaagagaatctacaggtcatccctcgcaagggccagaccagtctccagctctggtgtaacttcccattaagaaacttgctccggccgggcgcggtggctcacgcctgtaatcccagcacttcgggaggccaaagcgggtggatcacaaggtcaggagatcgaggccagactgcatctcaaaaaaaaaaaaaaaaacttgctcggtggttcagacctcagtctgggatggctgatgtacatggtgaatcctgtggctgacgatcttttccagacaagtggcccctgggatggcagtgcataactgtttctttcaacactgtcatgaagagcagaataacttttcccaaatagtgaaactgtaggcttctttttcttgtattaggtgtaccttatcagtgcgtattactctccgtgcctttatttatttatttatttatttatttatttatttatgagatggagttttgctcttgttgcacaggctggagcgcagtggcatggtctcggctcactgcaacctccacctcctggtttcaagcaattctcctgcctcagcctcctgagtagctgggattacaggcacccgccaccacacctggctaatttttgtatttttagtagaaatggggtttcgccatgctggccaggctggtctcgaactcctgacctcaggtgttccgcctgcctcagcctcccagaatgctgggattacaggcatgagccaccgcaccctgcccctccatgcctttatatcacctgcattctgccaacttctccagcatgaggtgggtgttctcaaccctttgtcaagtgatgcattcaaaggatgtctcatagctcagttcccttcttctgggaactgtcttttgttattttattttatttatttgtttattttgagatagagtcttgctcttgtcacccaggctggagtgcagtggcacaatctctgctcactacgamgtctgcctactgggttcaagtaattcttctgcctcagcctcccaagtagctgggattacaggcgcctgccaccatgcctggctaatttttgtatttttagtagagatgaggttttgccatgttggccaggctggtctcaaactcctgacctcaggtaatcttagtatgagaatgaggtgcggtgttgaggagaaaagcagcctagtgcttacacctatagaggactggggtcaacagacccagcgctgtgggtgagcctggcttggctcacctgtgcctgcgggttctgccttgctcccccatagcagggctgtgtctgggtcagactccacgtggggwtggatgcaagagcagggcacagtgtagaccacagtgtgttccccacgctagctctatagcgtgttgccttctgggctgatcatcgacattctgctttggggtgtgatccccttccacccgtgtggatcattgtttgatatcactttgccctgcaagcttgtgaagaaccatagctttgccactttgactcatcgtgaaatttctgatgttataatgattggtcctaccagcctgggccacacaggaggaccccatctctacaaaatatttaaaaattagccaggcgtggtggtgtatgcccgtagttccagctactccagtggctaagacgggaagatcacttaagcccaggagtttgaggctgcagtgagctatgattgcaccactgtactctagcctgggtracagagtaagactccatccctaaaaagaattttttttttttaaattaatgaaataggctgggcatggtggctcatgcctgtaatcccagcactttaggaggctgaggtgggtggattgctggagcccaggaatttgagatcagyctgggcaacaaggcgaaactccatctctacaaaaagtacaaaagttagctgggcctggtggtgcatgcctgtagtctcagctacttgggaggctgagayagaaggatcagccgaggttgtggtaagccaagatcgcgccattgcactccagcttgggcgacagagcaagaccctgtcccaaaaaataattaattaattaaaaaaataaaarattggtctatcgggatgaagcgatatgctaagattccaagtatgagttgatttcttttgctgtaaatcttttttctggactcatctttctgaggaatcttaggcaggcactctgtgtcctgtctctgagattatatcaatggagacaaactatagacgaaatgaagcaagtaggagaacagtggggagtgtgagggaacccccatggagctcgcagctcaaaacagcaggtgccatccctccgcagggcagggctttttttttttttttttttgctcagcaacaaaaccagaggaaccagttggatgggattcatatgagagattctatttcagttccagattgattgtcagttagcgctttggacagttaattttctaaactacaaagaagtcagaggaaggctgcagcatgaaaatttccattggagcagacggattgagattttttttttttttttttttttttgagacagaatctcactctgtcgcccaggctggagtgcagtggcgagatctcggctcactgcagcctctgcttcccgggttcaagtgattctcctgcctcagcctccggagtagctgggattataggcgtgcaccaccacacctggctaattttgtatttttggtagagatgggcttttgccatgttggccaggctggtcttgaactcctgacctcaggtgatccgcccacctcggcctcccaaagtgctgggattagaggcatgagccaccacgcctggccagaatagatctttcttgaggtccaggggaaaagccctggactgctgaatgactcagatcttatgtgtgagcctggtcccctgtgagccccttagtccttctgcctgccgtctgcttgcatctccatacctgtcgtgatggaattttgtcccaggtgacacaggagttgtgrggagcaggctggtttctttactcaatagagatgtgttttggaaggtaatccaatttttaaaaattgggttaaaaggctgggtggggtggctcacgcctgttatcccagcactttcagtggccgaggcaggcagatcacctgaggtcaggagttcgagaccagcctggccaacatggtgaaaccccgtctgtactaaaaatacaaaaattagctgggtgtggtggtggacacctgtaatccctgctacttgggaggctgaggcaggaggatcgcttgaacctgggaggcagaggttgcagtgaactgaaatcacaccactgcactccagcctgggtgtttatttataaataaataaataaatagtgttaaaatatacatatataacttaaaatgtactattttaaccagtttttttattatagtaaaataacacagaacataaaattaccattttaattattatcttaaattttaaaaattttaaaattatcctgccaaccagaagcacattttaaccatttttaagtgtgcagttcaatggcattaagtgcatttgtacattcatagtgttgtgcagccattaccactaaacatctccagaagttaaaaactttttttgttggttaggcaaggtggctcacacctgtaatctcagcactttgggaggctgagtcaggaggatcacttgaatccaagagtggagaccagtctgagcaacatagggacaccccatctgtacaaaaaattttaaaattagcttggtgtagggtggcacatggctgtagtcccagctcttcaggagactgaggtgggaggaccgcttgagcccaggagtttgaggctgcagtgagccatgattgtgccaccgcactccagtctgggcaacagagtgtgatcttgtctcaaaaataaataaaataaatacatttttaaaaagtatatattttttaagagacaggggtctcagtacgttgcccaggctggtcttgaactcttaatgtcaagcaaccctcccacctcagcctcctttatagctgggattacaggcagcagcccctgtgcccagctatctccggaactttttcatcatccaaagcaaagctctgtactcagttaaacaataacttcccattgcctgcttttccagccccagctaacctctattctcctttctatttctgtgaatttgactattccgggtaccttatctaaatggaatcctacaatattggtccttttgtgactggcttgtttcacttagcataatgtccttatttacactgtaccatgtgtcagaatttcattcctttttaaggctgaaaaatattctgttgtatggataggccacattgtgtttaatcattcatctgctcatggacgtctgggtggtttccacttttcagctcttgtgaataatgttgctattaacacgggtgttcaagtgtcatttaagcccccactttcaattgtttggggatatatatcataggagtggaattgctggaccatataattgagaatcaaattttttaatatgttgtaggacaccggttcttttttttttctcctgtcttttcctttttttttttttttttttttttgagacagagtcttgctctgtcacccaggctggagtgcagtagtgagatctcagctcactgcaacctctgcctcctgggctcaagcaatcctcctgcctcagcctccagaggagctgagactatagtcgcacrccatcacacccggctaatttttgtattttttgtagagacagggtttcaccacgttgcccacgctggtcttgaattcctgatacaagtgatctgctcacttcggcctcccaaagtgttgggattatgggcatgagccaccgcactcggcctcctatctttctctatagcaacgtgatgaagtaaatatgaacccgaactaatgggcaaaacattttccacttttaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatscggaatgaattcttcatgctggtgaaggtggctcaggaggctgctaaggtaggactccctggttcctgtgactttggggagtgggcaggagatgctggcacaggagcactggaagtagcggggccttcccatgggagcttgcctgtgacctgggcattgtgccagctccggccagtactgctggcttgagttttcttggcaagtgttggtgtttcagatacagatcactgattccatctgcagcttaacctaaaaaccagcataatgacagcagcctgatccccctgttaactgtgacaatgacagaangaggggtctcttggagttgctcccagattctggagcagcccctggcaggggctgttgcatgggaagaagaaagggctctttctctgcaaatgggttcatgagggcccttgtgcngggctgcccyttcccagtgtcccttctatttcaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccagggtaaggcctggggggttcgggagtttggcgagggctgtggtccagctgccccaggggcgattctgagctgagtgagagctaactgccttccctggagatgctcacaggctgaaggcagaggatgggagtgacccatgactgaggcagctgccgcacaggccatggtggggttaggggttataagcttctttagagggaggaagaagaggcacctttaattctgcctgggtgcaagaggatgaattttcacctggaatctagaatctaagggaaggccaaaaatgctggcatcaagataagtaacattttaaggtaatattttaaaagaatcaaaattaatgcaggccaggtgctgtggctcatgcctgtaatcccagcactttgggaggccaaggcaggcagatcatttgaggtcaggagtttgagaccagcctggccaacatggtgaaaccctgtctctactaaaaatacaaaaattagcagggcatggcacgtgcctctaatcctagctactcgggtgactgaggcaggagaatggcttgagccagggaggtggaggttgcagtgagccgagattgtgccactgcactccagcctgggtgacagagcaagactccatctcaaaaaaactaataataataaaataaaaattaatgcaaaaaaaatctgtgatgatcggaattttatttwattttattattttatttattttattttattgttagagatggggctggagtgcagtggtatgatcatggctcactgccttcttgaactcctgggctcaagcgatcctcccaattcagcctcccaaatagctgggaatacaggcacatgccactacaccagttaattaaaaaaaattttttttttgtagagatggagtctcactatgttgcctaagttggtttcaaactcttggcctcaagcaattgtcctgccttggcctccccaaagtgttgggattacaggcatgagccatggtgcctggccagggatttttgatctaatgagtactaatccaggcagcctcccaaggaattaaaaagacagcctctggagccagacttcctgggttcatatctcagctcttccatgaatgagctgttttaccttgggcaagttacttagctgtcctctgcctcaattttctcatctgtaaaatgggtatatggagagaacctgcctcacaggctgtcatgaaaacgaaaacgaagggcctgtacgcaaagctcaataatgctttatatactgtaggttctctgaaagtgtgagccgccactcctagtactatatagtctattaggtgagacaagatgtgaaaacaaatagaaataccatatagtgcctcggtgattgctgtagagacacaaatgcagcagcaggtggactccatggtacagtcatggatggcttcttagaggcagtgacatttgagttcaacttttccatctgcacaggagggaagggtcagcctagagggagtaaagtgtctgagcacagaacagaggcggagggtgctggggaagtggagagtggttttgtgaggtttgagagcaggatgcgcgccacgaagggtgtggttgaagcaggaaggggctctgctgcaggtgtgcaggcccgcagaggggtgcaggccgggcatgacagggtctgggctatgccaggaggttctgtgtggtgggtgagttggaggaggtagcgtgtgggggctcagggtcaaattacaaaccttgccgggtgtggtggctcacgcctataatcccagcactttgggaggccgaaatcggtgtggatcacgaggtcaggaccagcctggccaagatgctgaaaccccatctctactaaaaatacaaaaattagccgggcatggtggcatgtgcctgtaatcccagctactcgggaggctgaggcaggagaatcgcttgaacccgggaggtggaggttgcagtgagccaagatcacaccactgcacccaagcctgggtgacagagcgaaactccatctcaaaaaaaaaaaaaaaaattatgaacctctggagtgtgactggtcccagtgagcaagagctttggggtagccaggcatagtggctcacacatttgatcccagcactttgggaggctaaggcaggaggatcgtttgaacccaggggtttgagaccagcctgggcaatgtagcaagaccttgtctttacaaaaaaatttaaaaattagcctggcatgtggtggtgcatgtctgtagtcctaactactcaggaggtgaggtgggaggatcacttgagcccaggagttcaaggcggcagtgaactatgattgtgccattgcactccagcctggtaacagagtgagaccgtctcaaagaaaagaaaaccttgagggttagackgcctggggtgtgtccgggggcagaaaggagacccatgatcccaaatgccttgtgaaactgcagaaaaaaggaagctggagacgtggtagagaaatctctacgtgggtctgtggccagrtccatgagaggggatttaacctgtggttctcttwgcagtgaagccaggcacggatctggaccaccaggagaagtgcctgtcccagctctacgaccacatgccagaggggctgacacccttggccacactgaagaatgatcagcagcgccgacagctgggtgyrtgtccccctgcacccasatgtgggccccacttggtgcccagctggtcctgctcacagccagccacagagaggtccctgaagagggcccggganaggggggtgttccgagtcatcgtggccactttgggttcagaagtcatgaggcgcggtcctgagcctcagagggcttcccaggctgtgttctcatgggttccatagcacccaggcctcccactgtggagccaggactttaaccatctcccttggggtccacagggtggcatgtgtcangctaacagggaaggagacgtttgttgatttccttatgcatggctgaattaccaagaacacctaatgactggtaatgcagtgtcctggtttggtctctgccatgtctcagtgtgaatatctcttcccaygtgcagacctcacctccaccaccctaacctgcccctctgcgcaccacccatgcacacatacgcagcttctccgtctcagtgatggcaactcccacccctctaggtgctcaggccagaaaccttggactcactctccacgcttcttttctttcctcctctttcccatcccctcccctctgctcccctcccctctcctcccctctgttcccctcccttcccctcctctcctgttctctcctctcctcttccctcccctgttaccctccgctccccttctctctcctcctctcttctcccctcctttcctctctcctctggtcctccctctccctcccctccttcctctcctcccctcacccttcccctctcccctcctcccctcccctctcctctcctttccttgttccttgttgctttccttttctctccctttcctctcctctctcctttattctttccttctttcctttctctctctctctcctccccatctacccgtcctccctcctttcctctttccttttctttcatttgttttctttgacagcatcttgctgtcccccaggctgcagtgcagtagtgcaatcacagctcagtgcagcctcgaactcctggcttcaagtgatcttcctgcctcagcctcctgagtagctgggactacaggcatgcaccaccacgcccggctaatattgtaaaaaggtttttgtagagatgcggtctcactatgttgcccaggctggttttgaactcctggcctccagcgatcctcctgcctctgtctcccaaagtgctgggtttacaggcatgagccaccacacctaacctcttgtcttactttctcaccctacatttgattagcaaatccctttggctgtacttagaaaacatatctcaaatctggccactttaatcctgctgccctggtggaagccacatgtgtacagtgcttatttaacaaacattcactcacttaaaccccacacaacactatgaggtgcgtctcgtggcatccccattttacagctgaggaaactgagacccagagaggtcaygtggcttgccctgctcatagcgggttttcctgctgccccttcagagcctggtcgtgcaggtcagatcacatcagtcccctgctctcactccagtgggctcccntctcacgcagaacaggagcgagagccctyatctcacacgcgtgaggtccgccatgatctggcctggctctttcttccctgcastcattctctcccrccctccctgcctccaggcacaccctagctcctccttgcccttgaaaacctgcaygtgcccctgccccagggccctcgcacctgctnctctttcacatcaatcagggctctgctcaaaaaggaccatatcacaaagctttccttggccgggtgtggtggctcacacctgcaatcccagcactttgggaggcagaggtgggaggatggcttgaagtcaggagtttgagaccagcctgggcaacatggagaaaccccgtctctaccaaaaatacaaaaacttagccagatgtggtggtgtgtgcctgtagttccagctacttgggaggctgaggtgggagaattgcttgaacctgggaggtggaggttgcagtgagccgagatcgtgccactgcattccagcctgggtgacagagcaagactccatctcaagaaagaaaaaaaaaagcctttctctgtcacccatcataggacaaccccattcccagtcttctcttaccatctccgcttaccctgctttatttttccctataacctcatcaccaccccatccattacatatttcttgtcttgttagttatctgtcgtcaaccactacatgtaaactccatgaatgtgggggcagtttgtttactcgttgctttatctctagtgcccagcacatttggtaaatatttgttgagtgaacatcttatggacacaagtgaggttattacatacgcattgaagggaggcttgggctgggcgcggtgactcangcctgtcatcccagcagtctgggaggctaaggcaggcagattgcttgaggccaggagtttgagaccagcctgggcaacatagcaatgataatgaaatgatgatgatagtgaaaacattatccaagtgtggtggtgcatgcctgtggtcccagctgctcaagagtcagaagagggaggttcagttgagcccaggagtttgaggctgyggtaagccatgattgcaccactgtactccagcgtgcgaaacaaagtgagaccctgtctctaaatataaaatataaaatgaaaaaaataatattttaataaaaggcttgttgtaaccaagcgagttatagagaaatgccacactttgagactaattcaggagtcctttattagccggtgactgagagacggctaacgctcgaaattctctcgggcccgaagaaggggctagattttcttttatactatggtctaaacaggggagggggggttaactgaagcaattttacagaagcagaataggcaaaaagttaaaaaaaagtaattggttatagaagcagttacaaaaaatacacagttccaggtgcaggggcttaaactatcactaagagataaatgcaggggctttaggtacctgccactcagcacatccccaggagctgctggtacagcctgcctcagtatcttatcagcagtttgcattcctgggtgtgcttggagtcagcttacactagttattctcttaagggggataagcgggggctgcaagtgaagaaactaaaatggagtctgtccggctctctctgctaggagagagtcactcaggttaaaacaaggtagggtatcacgggctctagctatccaggcagatcctttagaaaagagaacatccaacctcttgggctgccccttgggcccttatgctctgcttggtggatctgcaagtcacgtgggtgctggcttccgtctgcagggaagtcccacttgcgcagagccatggctcatcacgaggagtcggtgcgggaggcsagcctctgcaagaagctgcggagcattgaggtgctacagaaggtgctgtgtgcsgcacaggaacgctcccggctcacgtacgcccagcaccaggaggaggatgacctgctgaacctgatcgacgcccccagtgttgttggtgagtagcctagactgtgttccctctytgggggtgcctgtgccgcggaaagagtacgcctggcctgtgggggttgagcgagccctygctgtgtgcttggcacaaggagggctgcacagggragggacrgaggtgctgctttngccctggagttctcttttctttttgagatggagtctcgctctgttgcccaggctggagtgcagtggcgtgatctcrgctcactgcaacctctgcttcccgggttcaagtgattcttctgcctcagcctcccgaggagctgggattacaagcacccaccaccacacccagctaatttttggatttttagtagagatggggtttcaccatgttggccaggctggtctcgaactcctgacctcaagtgatccacctgccttggcctcccaaagtgctgggattaccagggtaagccaccacacctggcctagatacactttttatgctgtttgttctcgtgtagaatcagcctgccctgggatcctttgttagaaattgaccagccttatgttaagggtagtccgagcctgctgtgaagatgctggtgggggtatgtagctgtcagtggtcatgatttgccaaacctccttttcactgggaaatcctcataccacattaataatgaaaaggtcaagcacggtggctcaaacctgtaatctcagcactttgggaggccgaggcaggaggattacttgagctcaggagtttgagaccagcctgggcaacatagtgagaccccatctctacaaaaaattaaaaaaaaaattcatcaggtgtggtggtgcatacctatagttccagctactcgggaggctgaggcaggagaatcatttgagtccaggaggtcaagctgcaagcgagctgtgatcccaccactgcactccagcttgggcgacagagcgacaccctgtctcaaaatagtaataatgatgaaaacagaaagcacggtatcccaggactgtgtccagtgaggcatggaacttccataacaacaacacttgaaacatagatgacttctcaataggtttttttgtttgtttgtttgtttttgagaggtcatttcgctcttgtctcacccaggctggagtgcagtggtgtgatctcagctcactgcaacctctgcctccctggttcaagcctcagcctcccaagtagctgggactataggcgcatgccaccacgcctggctaattttttgtatttttagtagagatggggtttcatcatgttggccaggctggtcttgaactcttgacctcagatgatcctcccaccgtggcctcccaaagtgctggggttacaagcattagccaccgtgcctggcctcctcattagggttttatgagtgccagagaagcccactaagccccttaagtatcaggaaaccccatgggaatgtgtctggttatcactccttggtcccagctcgggaaggagttatacctcccatggctcactggaggcacccaaatggaaggtacagttcaccctaggtcgggggttgagctctgttccatcttcttctgctacttgtctaaaccgaggggaaggatgtgtgactaagagaaagttctgtactgtctccttcccaaggatcactttttttyccccccggagtctgactctgtcacccaggctggagtgcagtggcatgacttcaactcactgcagcctctgcctcctgggttcaagtgattctcctgcctcagcctcccaagtaactcggattacagtcacctgccaccatacctggctaatttttgtatttttaatagagatggggtttcaccatgctggctagactggtcttgaacttatggcctcaagtgatccacctgcctcagcctcccaaagtgctgggattacaggcgtgagccacaacactggactattaggatcactttcaattacagaaacgtttatcctcccatttctaatcctctattctagctaaaactgagcaagaggttgacattatattgccccagttctccaagctgacagtcacggacttcttccagaagctggtatgttgaatgctctctacattcaaatgacctaaggggacagctcttcactttggcgagtatggtgtcttagtccatgtgggctgctataacaaaatgcctcaaactggggggcttatgacagcagaaatatatttcttagttccggaggctgggaagtccaagaccaaggtatgggcagattcggtatctgctgaaggcccatgttctggtttataggtggggycttctacctgtgtcctcatggcagaaaaggtgatgagcttccttgggcctgttttaaaagcatgtatcccattcttgagggttccaccccaagactgaatcacctctcgagaggccccacttcctaataattacattgatgattttaatatacattttaaattttaataaatattaataaaattttaatattttaatatacaaactttgggagggtacaaacattcagaccatagcatattttattttattcatttatttttatttatttgttttttgagacagagtctcactctgttgcccaggctggagtgcagtggtgcgatctcagctcactgcagcctccgcctcccaggttcaagtgattctccagcttcagcctcccgagtagttgggattacaggcctgtgccactacgctcagctaattttgtatttttagtagagacggggtttcaccatgttggccaggctgatcttgaactcctgggctccagtgatccgctcacctcagcctcccaaagtgctgggattacaggcctgagccactgtgcccggccccatagcatattttaaaggtagtttttaggtattgtctatttaaaattttttaaaaatattttttagttttttttagagacatggtctcactgtgtcacctaggctggattacagcggcatgatcatagctcactgcagcctgaaccttctgggctcaagcgatcctcctgccttagctaccctagtagatgggactacaggtacacaccaccatgtccaactaattttcatttcttgtagagatggggtcttgcctaggctggtctccaactcctgggctcaaaccatcctcctgcctaggcgtcccagagtgctgggattacaggtatgagccactgtgcctggcctgagatttttttccttttttttttttttttttaagacagggtctaactctgttttcacccaggctggagtgcagtggcacaatcatagttcactgcagcctcgaactcctgggctcaagaagtcctcctgcctcagcagcctgagtagatgggagcattggcrtgcaccaccatgcctggctaattcttttatgtttttagtagagaatggttcccactatattgcctaggctggtctcaaacccctggcctcgagcgatccttctgccttggtcacacaaagtgcttaggattacaggcatgacatgcctagtcttacattttttatattagagattttatttatgataattttggccgggtgcggtggctcacgcctttaatcccagcactttgggaggctgaggcgggcggatcacctgaggtcaggagtttgagaccagcctggccaacatggtgaaaccccatctctgctaaaaatacaaaaattagccaggcatggtggttcgcacctgtaattccagctactcaggagaattacttgaacccgggaggcagaggctgcagtgagccgagatcacaccaccacactctagcctgggcgacagagtgagacaatgtctcaaaaaaaaagagaaaaagataattaatacaatgcctaaaagataattttattgaaaatatattgggtatgtttgagaagatggctttccagsttctygcatgactgctgtagcatgtatgcccccagatgtgtcatttgtccctgaacaaggccaagtgagatcttcaaggacagcaggcaaaattccctttagctttcaagcgtctgatccagccttcaaatcctacacctaacgatgctctcttccaaagggccccttatctgtgttttcggctaacaagcggtggacgcctcctcgaagcawccgcttcactgcagaagaaggggacttggggttcaccttgagagggaacgcccccgttcaggttcacttcctggatccttactgctctgcctcggtaagcacatgcttttcttgattggcagcaaacacagatatctgggtgattgaatttagggtgggttcacccatgtcaaaggcctgacttgatgtgaagggcctcatgggtgctacattccctaaaagaaaaggattaatttttactgtctttcttttgtttgttttatgtttttagttttttttagactttgggaggtggaggctgcagtgagtcgcgatcgtgcagtggcgcgatctcagggctcactgcagcttctgcttcctggtttcaagtgattctcctgtctcagcttcctgagtagctgggattacaggcacgtgccaccacactcagctaattttagtttttgtttttgttttttgagacgcagtctcactctgtcgcccaggctggagtgcagtggcgcgatcttggttcactgcaacctccacctcctgggttcaagtaattctcctgcctcaggctgctgagtagctgggattacaggtgcgtgccaccatgcctggctaattttttgtgtgtttttagtagagacggggtttcactgtgttagccaggatggtttcgatctcctgatcttgtgatccgcctacctcggcctcccaaagtgctgggattacaagtgtgagccacctggcccggcctaatttttgtatttttagtagaaatggggttttgccatgttggccaggctggtctcgaactcctggcctcaagtattctgtctgccttggcctcccagagtgctaggattacaggcgtgagccactgtgcctggccaattttggctttttttttttttttttaattgcacccaggctggaggacagtggcaygatctcggctcactgcaatgtctgcctcccgggttcaagcaattctcctgcctcagcctcccaagtagctaggactacaggtgcccaccaccacacctggctgatttttgtatttttagtagagatgggtttcaccgtgttgtacaggctggtcttgaactactgacctcaagtgatctacccgtctcagccacccaaagtgaatttttgctttcttgatgcraacttacgcaaatacctattttgttaatggggactgattcaaggatttgagtgaacaaaacgttgacttaatttcaacaatactttttcaggtggcaggagcccgggnaggagattatattgtctccattcagcttgtggattgtaagtggctgacgctgagtgaggttatgaagctgctgaagagctttggcgaggacgagatcgagatgaaagtcgtgagcctcctggactccacatcatccatggtgagcgctgacacctccctgggcagtcagtagtggcgtggagtgaaatctgcatgagttcagccccagaggtgtttaccagaccctctgtctcctgcctgtgtaacatggtacaaatgactggactcccaggcttgtaatcactgtaatgtgctcaccttgggtcaaagagaaaattggcaaactttttctttttaaagacagcgtcttgccctattgcccaggctggtttgcagtggtatgatcatggcttactgcagcctctatctcttgggtttaagtgatcctcccacctcagccacacgagcagctggaattataggcacccactaccacccctggcyctttctttctttctttctttctttctttctttctttctttattcattttcttttttaattttattttttttttgagacggagtctcgctctgtctcccaggctggagtgcagtggtgcaatcttggctcactgcaagctctgccttccgggttcacaccattctcctgcctcagcctcccaagcagctgggactacaggcgcctgccaacatgcctggctaattttttgtatttttagtagagacgggggtctcaccgtgttagccaggctggactcgatctcctgaccttgtgatctgccagcctcggcctcccagagtgctgggattacaggcgtgagccaccatgcccagcctattctttatttttttgtagagacaggttcttgctatgttgccaaggctggtcttgaactcctgggctcaagccatcctctcaccttggcctcccaaagtgctgggattacaggcgtgagccactgcaccctgctagcaaacttttaaaaatatcctgtagataaaataatcaactgatctatttttctgatcaaattgtttaattacaaaagtaatacatactcatagtgaaaaaaataaaaaacaaaaaaaaattctaatggtacagaagtgcttaagacaacctgtgaaagttaagacaatccctctgtacgccctagaggcagtgtcagccatgtcctgggagatttgggaagcatttgagtgtcttcaagttcacctgcacagttaccgcctttaattttccccacgtgaggccaggcacggtgctcatgcctgtaatctgagtacttttggaggctgaggtgggcagattgcttgaagtcaggagttgaagaccagcctgaccaacaaggcaaacactgtctctactgaaaatataaaaattagctgggcatggtggtgcacgcctgtaaccccagctactcaggaggctgaggcaggagaacagtttgaacctgggaggtggaggttgcagtgagtggagatcgcrccattgcactccagcctgggcaacagagtgagactctgtctgcaaaaaaaccctaaaattttccccaagtgctaggattcatgccatacttaatgacgttctcctctgcactttgccacacttaatgatgtaccctcgaccttccctctgtaacaacactcatttattcattcaacaaatattgattgaggatcagttgggtgccagacactctcttaggtgtcagagctccagtttacattacacagataaggtccctgccccccagcgaagctggcattaaagtcagcaaataaatgttcaggattttgataagtgctgtaaaggaaaaaagacctgtaacagggtggaatgactggggagggggcgaggctctatctaggcagggatggaccagacatgagagtgaccaggaggttcgagccagttgcagagggacaagaaaggccttctgggcaggggcacttacaggtacagagcccctgcagcagaataagcttctcctaccggagaggcaaaaagaagggagccgtgggaagtgaggtaagaaggaggccttggcggcaatggtgggagcttggaagccacttggaagcccctttcagaaggggaacggcgtggtgtgatgtttgttttagaagggcgtctgctgccggagactggccatggcacttgtccaggctggtgacattagtggctgaggtgatgggggtggctgtagagttagagagacgtgagtggccctgggacatagtttggaggtagagctgatgggggatttgtggatgatttgtgttaaggagacagtggacagggaggtgaggcctcagtttttggcttgatcaatctcatgggtagtggttatttttctacctttaatttcttttttctgttgttgttgttttgtttgtttgttttttttgttgttgttgttgtttttgagacagggtctcactctgttgcttggctggaatgcagtggtgcaatcgtagctcactgtagccttgacttcctaggctcaggcaatccttttgcctcagcctcccgagtagctggaactacaggtgtgtaccactatgcctggctaatttgtttatctatctatggtaaattttttttggtagagatggggcctttatatattgccaaggttggcctcaaactcctggccttaagcgatcctcccacctccgcctcccaaagtgttgggattacaggcatgagccaccatgcctggcctggttatttttcataatgatgggtaatgggtgtgagggaggtgaaggagagagaaatcaagagtcatgttttgaatgttccagatgctattagcagtcagacgtaagcataaaggaggagatcgaatgtgaagtcttacagttcgaggaagaaatcagagctagaaataaatatttgagaatcattgcacagggatgatatttgaggctgtgagacaaaatgcagctccctgcaagggggctagggctgagggctaaacatttagagatcagttggaagagaagcaagtgcaaagaaaatggaggagagttcagagatgtcggaggaaaggagcttctcaaattaagaggagaaagctttgcagtgagagggtgatgggttgcattgaatgcagttgagtggtggagaatgaggtcgccttagctgtgcctattgtatttggcagcaggatgaaaagacactttggtggagaggtggcagcagaagtcagttgagagagggccagagagccaatggattttgagtccatggatataaaatgctcagcataggcaaatccagagacaaaaagtagatggtgctggggctgggcaatgggagtrgggagggactgctgaagggtcataaggtagaaggtttctttttagggggatggaaatgttctgaaattaggtagtagtgatggtcacctaactttgtgaatatactaaaaatcactggtgtcttggcatgctggctcacacctgtaattccagcactttgagaggctgaggcagtatgttcgcttgagcccaggagttcgagaccagcctgggcaacatggcgagaccttgtctctacaaaaaataaaaaaaattagcgaggcatggtggcgtatgcctgtagtcccagctgcttgggaggctgaggcaggaggatcacttgagcccagggaggttggggctgcagtgagctatgattgtactactgcactccagcctgggtgtcagagcaagaccctgtctcaaaaataaaaataataaataaaagccacagaagggtattaaaatggtgaattttatgcatgtatgtgaattatatctcaaaattttttttttttttttttgagacagagtcttgcactatttcctaggctggagtgcagtggcgtgatctcggctcactgcaacctccgcctcctggattcaagtgattctcctgcctcagcttcccgagtgactgggattataggtgggcaccactatgcctggctaatttttgtatttttagtggagacagggtttctccatgttggtcaggctggtctcgaactcctgacctcgagatccatctaccttagcctcccaaagtactgggattacaggcgtgagccacctcacccgacatacttcaaattttaaaagaagataaagtcaagggactcagagcatcttgggagaagggatcataagaaatcatatttttagggacaaaatccatggagtttctggacaagtgattaaggtccccagcagaaacagaaaagacgtttgtccaaaaggaggttagagaaaagagccaagccacacactgaaggttggagtagggaccccatcagcagaggcctgagtttctggggcatgccctgccccctgtgagaggtgcaaaggcttgactttcaagcctgtgacatcgttacaccaggccaaggaaggggctgctgtagtagctgaaagtaagggttctgcactcagacagtctagatgtgtatcctggctttccaccaccagttgtgtggccttcagcaagtcagggaatagctgtgagcctcaggataaactgagtttacataaagcccttacaagagggccaaacaggagctacatttcaatccacaatagacattataatgatgataaccatgatcatgatgtttattcttttcacctagcaggtcctctttaatttttttaaaaataatgtttttaggctgggcacagtggctcactcctataatcctagtactttgggaggccaaggccggcggatcacttgaagccaggagttcgagaccatcctggccaccgtggcaaaaccctgtctctactaaaaatacaaaaattagcaggatgtggtggtgcatgcctgcaatcccagctatgtgggaggctgaggcatgagaatcacttgagcctgggaggcagaggttgcagtgagccgagatcgagccactgtactccagcctgcgtgacagagtgagaccctgtctagaaaaaagaaggtttgttttttgttttgagacagggtctcgctctcgttgccctggcgcaatatcggttcactgtggccttgactcttgggcttacgtgatcctcccrtctccgcttcctgagtagctaggactacaggcatgcaacaccatacccagctaatttttcgtattttttgtagagacggggcttcaccgtgttgccctagctgttctctaacttctaagctcaagcaatccgcctaccttgcctcccaaagtgccgggatyacaggcataagccaacatgcccggccaaataatttcttttgttgttgttttttgtyttgtttgttttgagacagggtctaactcagttgcccaggctggagtgcaatagtgcaatcatagctgactacagcttcgagttctaggactcaaaagatcctcccttctcatcacctgaggtcaggagttggagaccagcctggtcaacatggcaaaaccctgggcgtggtggtggcgggcgcctgtaatcccagctacttgggaggccaaggcaggagaattgcttgaacccaggaggcagaggttgcagtgagccgagattgtgccactgcactccagcctgtgcaagagagggagactccatctcaaaaaaaaaaatcctaccaagtagctgggactataggcgtgcaccactatacccagctaatttttaatttttttgtagtgacagtctcattttgttgcccaggctggtcccaaactcctgggcttaagcaatctgcctgcctccgcctcccaaagtgttaggattacaggaatgagccactgcaccaggccaaaagtaatttccttttgtcttttattaattaattttgtggtgacgaggtctaactaagttatccaagctgatcttgaatttctagcctcaagagaccctcttgaatcagcctcccgaatagttgggattacaggcgtgagccactgtacctggctctttttttttggagacagagtcttgctcttgtcatccaggctggagtgcagtggtgcaatcttggctcactgcaacctcacctcccgggttcaagcgattctcctgcctcagcctcccgagtagctgggattacatgcacccaccacgatgtctggctaatttttgtatttttagtagagatggggtttcaccatattggccaggctgatcttgaactcctggcctccggtgattggcccgccttggcctcccaaaagtgctgggattacaggagtgagccaccatgcccagcccctggctttttaaaaataattttttaaaaattatttttgtctattaatttttatgataaggattttagataatgacagtcaagcactgtttttagcgactgagcctttcaaacaaaatcaaataaagagaacatttagcctagcactctggctgaactgatgacctgctgcccttggctaccctcttgactacagtggggatccctagttgaacaaatctaagcttggaatcaagctctggaattaggccctgactgccgttcacaagctgtgtaaccttcagcacgttcataccctccttgggcctcggttttctcatccagaggatggaagagttaggcctacacagtggttttaaactgtgctctgtaaagccctaagagttctagaggggtaccccaggtggatttgagtgaggaatgggtggtggggaaagaaacagtaaatggagctgggcacagtggctcacgcctgtaatcccagcactttgggaggctgaggcaggtggatcacttgaggccagaagttcaagaccaacctggccaacatggtgaaaccctgtctctactaaaaatacaaaaattatctgggtgtggtggcatgtgcctgtaatcccagctacttgggaggctgaggcaggagaatcacttgaacctggaggtggaggttgcagtgagccaagattgggccactgcactccagcctggtgacagtaagactccgtctcaaaaaaaaaaaaaaaaaaaggcttttaaaagaaagtagtggtacacattgcaggagtgagagagtgtgtgtgggtatgatactggggtggacctggaggggaacagggtcaagaaaggctttacttttttttttttgagacagtctcgttctgtcacccaggctggaatgcagtgagtggcgctatctcagctcactgcaagctccacctcctggttcatgccattctcctgcctcagcctcccaagtaactgggactacaggtgcccgccaccacgcccggctaattttttgtatttttagtagagacagggtttcaccatgttagccccgatggtctcaatctcctgaccttgtgatctgcccgccttggcctcccaaagtgctgggattacaggcgtgagccaccacgccccgccaagaaaggcttttcaaagaatgtgatggtacgcattgcaggagtgtgtgtgtgtgtgtgtgtgtgtgtttgtgtgtgtgtagagatctgggccaagaaaagcttttcaaagaatgtgatggtacgcattgcaggagtgtgtgtgtgtgtgtgtgtgtgtgtgtgtgtgtgtgtgtagagatctgggaggcaagggtgcctggaggagagagggaatgggatccaggcacacagaagggcttggtcttgggggacggatgccatgaagtatacggcagggatgtcaggagggtgcgtgagtggcttcaggaggagagcgaagataagaaacaagtatacaggagaaaaggaaatgaaattactagggacacacagaagtgccaggaaatgggtgcctattagaggtttggggtcaggttagaattccaagggaagccttggtgagtgtcctccagcaacgcacaacctttcagatacaggccctaggggaggcagagggtggagatgagcgagtgggggcagatggaagagaactgagggtatttataaggcagtggttttgatacacaatggactttgagcagctgagggttgggaaatgctttcaggcctcacatctgtctccaggattattcgttttattattgttttaaatgacattgtgtgtgctccgtaaaacatggtggagttagcggtcagttttccagaaaaggaagaggcatctccatccttaggggctcgaagtaccccctactttattgctgcataactcagattcctctgagggtttattttatttatttatttattatttatttattttttgcaatagcgtctcactccatcgcccaggctggagtgcagtggcgtgatctgggctcactgcaacctccgcctcctgggttcaagtgattcttctgcctcagctcctgagtagctgggattacaggtgtgcaccaccacacctggctgatttttgtatttttagtagagatggggtttcaccatgttggccacgatggtcttgaactcctggcctcaagtgatctgcccaactcagcctcccaaaatgttgggattacaggtgtaagacactgtgcccggcccctcttagggtttatattaggaacaatgtcctcaactattgcagcgatatattgtatgcctaattttagtgccagaacatagtagaccatcaataaacatgtggcraactaaacaatctcaatrttaggcaaaccttagaagccggtgatagcccatgtggaagtcttcagaaagcaagcttccttagatttccagtttgaatcctayatgattcttggaaagttaatagtagagagtgtttaatggtacaaagtttcagctgaggaagatgaaaaagttttagagatggatggtggcagtggagcataatsatgtgaatgtaattaatgccaccgaactctacacttgaaaatgataaaaatggcactccagcctgggcgacagagcgagactccatcttaaaaaaaaaaaaaaaaaggaaaaagaaaaaaaagaaaaaaagaaaatcaggtgtagaatagtgtagtwtattccttttaagaaaatgaatggtaatatayttaggtacatataraaatacttgtacatcatctctagaagtataacatggagggccttagaagcccaggtgacagggagacctattgctcactgcatactctttttttttttttcccttcccttcccctcttccattcccttctcctcttccctttccttcccctcttcccttcctttcccctcttcccttccccccgcccccccccctttttttttattttgagacagaggtctcactctgtcgcccaggctggagtgcagtggcacaatcacagctcactatagcctcaacctcctgggctcaagcaatcttcccctctaagcctcccaggtagctgggactgtagttgtgagccaccgcgccccaccctgtactttcatattcgtgaccatgagtattattactttctcaaatagaagaagaaccttaaaatatgagttgtggctcctaagcttaaattgttactattgagtacattccttaaaaattatccttgttgggccgggcgtggtggctcacgcttataattccagcactttgggaggccaagacgggcggatcacgaggtcaggagatcgagaaggggtgaaaccccgtctctactaaaaatacaaaaaattagccaggtgtggtggcgggtgtctgtagtcccagctactcagagaggctgaggcaggagaatggcgtgaacccgggaggcggagcttacagtgagccgagatcgtaccactacactccagcctgggcgacagagtgagactctgtcttaaaaaacaaaaacaaaaaacaaacaaaaaattatccttgttggacctggtggtgcacacctagagccccagctactcaggaggccaaggcaggaagatcrcttgagcccaggagtttaagaccagcctgggcaacatagcaagaccctgtctcaaaaaagaaaaaaagtttgtccttgttttaagaacctaattctatataagcattggtcacctgagtttccgaattatgtctgttcaatttattttttggagacagaatcctgctctgtcacccaggttggagtgcagtggtgtgatctcagctcactgcaacctccacctcctgggttcaagtgattcttgtgcccaggctccaagcagctgggactacagacatccaccaccacacctggttaatttttgtattttagtagagatggggtttcaccatgttggccaggctggtcttgaactcctgacctcaagtgatccgccttcctcrgcctcccaaactgttgggattacaggtgtgagccaccgcgcctggccaaacttcgtagtttttatcatctatcttgatgatgcctgacgccctttttcttacttttctatgtgcagcataataagagtgccacatactccgtgggaatgnagaaaacgtactccatgatctgcttagccattgatgatgacgacaaaactgataaaaccaagaaaatctccaagaagctttccttcctgagttggggcaccaacaagaacagacagaagtcagccagcamcttgtgcctcccatcggtcggggctgcacggcntcaggtcaagaagaagctgccctcccctttcagccttctcaactcagacagttcttggtactaatgtgaggaaacaaacatgttcaggcccngaacatttccggtgctgactcggccttaaacgtttgtgccataatggaaaatatctatctatctgttctcaaatcctgtttttctcatagngtaaactcacatttgatgtgtttttatgaaggaaagtaaccaagaaacctctaggaattagtgaaaaaagaayttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaytgctatttctagaaaaagtctagtgccaaatttgtcttattaaataaaaakaatgtaggagcagcttttcttctagtttgatntcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcanccacctttgggaaagtgtatctgctgctcctagggccatgcttgtatacatatttaaataaacatattcatttacccgagttaatatttctttttacttttatttcattttcattccctcctctttcaaattgtttctccccaatgcacacagtttctaatgttctgatttttttagttactaacatttcacaaagcagaacttaaaaagctgtcaagttatcttagtattttctaagacagatggtatctttgtgcttattttttgtttttgtctttttttcaagacagggtctcgctttgtcacccaggcaggaggacagtggcgcaattgtggctcatggcagcctcaaccttccgggctcaagcaatcctcccacctcaccctcctgagtagctgggactacagacatgagccaccatgcctggctaatttttttgatttttttgtagagatggggtcttgccatgttgcccaggctgatctcgaaatcctggactcaagcaatcctcccacctcagcctcccaaagtgctgggactacaggtgtgagccactgtgcctggcctgtgtctattttttgaatgggcaatttgtaccttttgatccccagcccctgcttccctcactagatgcagctgctgccatcattttcttgtatccttccattgttgggcctttcatatacaaacacagcctgttctgcctcatgcatgttgagttttcaactttaaattttttttttttttttttgagatggagtctcactctgtcatccaggctggagtgcagtggtgcaatctcggcccattgcaacctccacctcctgggttcaagcgattctcgtgcctcagtctcctgagtagttgggattacaggtgtgtgccaccacacccagctaatttttgtatttttagtagagacagggcttcaccatgtcggccaggatggtctggatctcctgaccttgtgattcaccccgcttggcctcccaaagtgctgggattacaggtgtgagccactatgcccggccgttgagttttcaactttaagtgggaacttcagacttcatactttctgtgtgcagaagacatacgcagtgattataaacaaactgtacatctgccaaaaaaaaaggccggggggagggaggaacaaaggaaaggaggaaggaactgttgcgcagttatttatttacattggaaacagccctcgcagtacgggtatatgaaggccagacctgatgaacagcaggtgaaactctgggaacccagggcttaggatacacagtgcttccttgtacatttgtttccttcagatggtcacatccaccactgaagctttttagaaggcactttccatgacagatgcaggtcaaggtcgcacattaaaatcggccctaatgctttttgctgagtgtgagtccctgactctcttgcgaagatcccaccagcccttttcgtcttagcagaatgaaggcagtgccctctgcggcccactaacttcacaagctgaactcagacgctaaggcaggacgacccacgggctccattcaagcctcgcctcatctttcactggttgctgctggagaaaatcctttttcttttttttttttttttgttgttttctttgagacggagtctcgctctggtgcccaggctggagtgcagtggcacgatctcagctcactgcaacctccgcctcccgggttcaagtgattctcatgcctcggcctcccaagtagctgggattacaggcacctgtcaccatgcctggctaattgttcctatttttaggggtttctccatgttggccaggctggtcttgaactcctgacctcagatgatccgctgtcttcggcctcccaaagtgctgagattagaggcgtgagccagtgcacccggcccattctcttggtttttaaagctgaaaacaagatcctggtgtttgtggtctcgggagaagatgccgtggccctgaggccagccctcacctgggctgcgtgaagaaggcatggatctgctgtgccactgcttgtccgaccacctgctccagttccccaatggaagcattactcagttgctggatgcttggaaacttctggaggagaaggggagctttaacttttccaactcctgggatctgctgcacggttcgaaggagcgaaggctcagacagcagcagggcccgtttcttcccgagaagagggttcttactgggctctttggtttgctcttgaacctgaaccacaatgaaagcaacagcacgtgagcgccctctggaggactggccgttttcttaaaatatgttttgtagaaattgcgtttttccatttggctcagcttgacttaagggaacaaatgttttcatgtatcatgaatataatttctcagacatcagtaaaattattgaaaggtgaaccacacaaaggagttaagacattaatttacaaaaatgtgcgttttcagaatgtttagaaaaacacacagatgaattcaaacactttctgttggtccattaagaaacatttcagttgtgcaggattaaatgatggctacacctaaactaggcctacttcacgcaggagctgcaggaagcctgcctcaaaggagaaacctggtctagttagtggtggttatactaaggcagacaacagtgttatatcaaggaaagttaggaacggtgacgcaagggatatggtagagagggatctgtgaaccattcatggctgcttgcatcttcaatgtggctctcaactctagctccacatcagagggggtgatttaaaaacaacacacacataacaaagaaaacaaaagtgaaaaaaacaaacaacacacacacacaattgatgttccccatgctgggatcagaggcgtaagctactaaactgattttaaaaataagtgttggcggccgggcgcgatggctcacgactgtaatcccagcactttgggaggctgaggcgggcacaacacctgaggtcgggagttcgagaccagcctgaccaacatggagaaaccccgtctttactaagaatacaaattagctgggcgtggtggcgggcacctgtaattccagctactcgggaggctgaggcaggagaatcacttgaactcaggaggaggaggttgcagtgagccgagactgcatcattgcactccaacctgagcaacaagagcgaaactccatctcaaaaaaaaaaaaaaaagtgttggttggtgcggtggcccagaactttgggaggctgaggcaggcagatcacctgaggtcaggagtttgagactagcctggccaacatggtgaaactcttatctctactaaaaatacaaaaattagccgggcatggtggtgggtgcctgtaatcccaggtactagggaggctgaggcaggagaatcgcttgaacccaggaggcaaaggttgcagtaagccaagattgcaccactgcactccagctggaatgacagagcaagaccctatctaaaaaaaaaaaaaaactgcccaggcatggtggctcacacctgtaatcccagcactttgggaggccaaggtgggcggatcatgaggtcaggagtttgagaccagcctggccaatatggtgaaaccctgtctactaaaaatacaaaaattagccgggtgtggtggtgcgtgcctgtagtcccagctactcgggaggctgaggcagaagaatggcttgaacccgggaggtggagatggcagtgagccaagattgtaccactgcactctggcctgtaggacagagcgagactccgcctcaaaaaaaagggaaaaaaaaaaacttgcacaaggtgctgatgcttaacaaaaatacgggatgagacaaagcagcttctagttaacattttctttctttctttctttttttgagacaaagtttcgctcctgttgctcaggctggagtgcaatggagcatctccactcactgcaacctccacctcctcagttcaggtgattctcctgcctcagcctccggagtagctgggattacatgcacccaccaccacgcccagctaatttttgtatttttagtagagacagggttttgccatgttggccaggctggtctcgaactcctggcctcaagtgatcctcccgcctccgcctcccaaagtgctgggattacaagcatgagccatcacgcctggcctctaggttgacgttttcaccagcgaaagggcaggataatgactgatggagccatcacaccctgagaatctaaaatcaggtctccaacttgtatactttgtgatacacttgcctggagtgtgtgacaagctgagctggctgcagaggcagcttccgcatttaaattcctcgaagagattttataaaccaagtcagagaatgacatagattggattgatggttgcttctggagagcagctgagtgtccatgaggacaggactaccacgaaggtgtaggaatcggtactcaccaactggatgacgaggcaggatgcttccatctggctggccactggaagcagcaccattccaaggtccagcacagtaaacttctgtagggctgggaagtattgttcactcatccgggttttttcaacgactacaattcctttaagattattggacttgaaaggaaaaaagacagtaagtcattttgcaaccaaattgcttttcaggttaagaatgctatcacttcgtgcctgacctggccaatgattttaaataaatgataccaagggatggagggaagggtggggtgagacaaatcaatgttcgagtttctttaatccaatgcttacatttcttttttgtttttgttttttgttttttgagttggaatctcactctgtcgcccaggctggagtgcagtggcgtgatctcggctcactacagcctctgcctcccaggctcaagcaattctcccgtctcagcctccctagtagctgggattacaggcgtgcgccaccatactcagctaatttttgtatttttagcagagacagggtttcaccatgttggccaggctggtctccaactactgacctcaggtgatccacccgccttggcctcccaaagtgctgggattactggcgtgagccacagcacccagcctaatacttacatttctaacccgaacaagcctctttctgtagccatttcctgccaccaaatcagcttcggtgacataaagaatgcagcatctgttcgacagataaaagtctggtgtcaagccatcctcgaaaatgagcttaattttcccttaaaatacagagaagaaaatgagttccataagctttggatgaaaagatggcaataataggcagattttttttttttaatatgtcaggggaggaaagggctggcagagggcaggccaccgaccttgcatctcctgcgccagctgtgacccgcgccatttctcattggccacaatatgccccaaaggcacgtgcacggggcccgtatcatcaggggggttcttttccatggatggtctccacctaaggagggaaaagccaggcggcacttgagcaggctctcccgcacacggccctgcattccactccaagccagggcctctggggcaggatcccctctgcaaactgaattatttgtcaaagaactgtcaaataagattccctttataattactaataagaaaacacaggctgggcgcggtggctcacacctgtaatcccagcactttgggaggccgagcgaggcgggtggatcacaaggtcaggagttcaagaccagcctggccaagatagtgaaaccgcgtctctactaaaaatacaaaaaaattagccgggcttggtggtgggcacctgtaatcccagccacttgggaggctgaggcagagaattgcttgaatccggaaggcggaggttgcagtgagccgagatcgcgccactgcactccagcctgggcgacagagcaagactcgtctcaaaaaaaaaaaaaaaaaagaaaagaaaaagaaaacacaaaggcctgaatgaaggccagggtggctggagacgggatgtgtggtggtggaggtggtaatggcattggattccaataaggccagaggcacgatcagatttaagttttaaaa

SEQ ID NO: 10823 - DNA, 102090 bp, Homo sapiens
  misc_feature (1)...(102090): n = A,T,C or G, or insertion/deletion polymorphism (see Tables 1-2)
cagaactgttttagggctctgagtccctaaagaaagatcttgaggcccataaggaatttcctggtgagcaaattgtgagggaggtatgtagtgttttttatctttttagctatcttatttaggaataaaatgggaggcaggtttgcctgacaccctttggcttagtgattttggggtcttgagatttatttttctttcacattgtgtacatttcttttaaatatatccctcagtactttatcattttagttgcaattgtgtatggaatattcttccattatgtcttctaacatgtttttcttcacagattaaggctatttatttatgtgtgttcatttcacatcccgtgtattcagcactaatgcccttcacggactatgtccagctctctgcctcccgcttgtgggcacatgggaggatgtagttcctgggccccgtgtttggagggagcctgtggctagttcttgccatggattgtaacagaggtgagatatcacctctggaccagagtatttgatttttgatgggagatgctcctggctttttatccttcttccacagtcataggcttatagtggctgctctataagcctgaatcctggaatgacaagctatgtcacagagttcagtcaacccatggtggatgtgtggaacaagcaaaaagtaaacctgtgttgttatgacctctaggatttggaggctgtttgttaccatgttatagtcactcctgctgtttatggtacgctctaggtaattgtggtgtcagtgtagtgtgtttcatggtagtttccactttataaagtttctgccttttaatttcctatgcagatattcatacctcttatatcttctgttttcatatgtactttggatttgttttaatcaggtatgcagatatggaaattattgttataaaggaagaagtttgttactcacaattccctggaagcagggtgcacaacataccacacagggctacatggggaagccctgtttctgtatttctgttttaggttggctacttgacttatttttcatttttatcattcctactgtgctatctgtagtctgttttctcttttctcccttataatttaacttcatttctaaaacagtttgactccttttcccccctgagtttaatcagtttctgtttcacagtcaggaggcagagtgagtaggaggaaaaccagagcaagagcctttgttgcagtttccatgggaaggattgggcagggcacggcaagcaggctaagctggttgagggttggctagtctgagtaattccagcaggcccaaagtggaggggctgtcctgagttatctggtacctggccctgggctgattagaggaggggaatattggcctgcagtgtaggaaaggctgtggttgaggggtctgggctttggattaatgggtttatatatgaaaggcaggcttgcagaaaagtagtttgtcatctctaggaatttgctagcccaaggagatgcagcttctcccaggtcacaaaggccccaagatgtcaaagcgtcataaaatacaaagaataaaaaacatgattaatatacttcattgccaattgaacagttttgccttataaagtggttttcctcatattacttaatgctttttggcctgaattctaccttgtttgatacaagatcataatctcagttttgttgttactgttgttttgtctttgtcttgtgtacctgataaactattatctatctgttttagttgtgacctttataaatcactttgctctaggtgtgtctcttatatacagcaaatgattcatctttctttttagagataatgtaaaaatccttttctttaaatagttgcattaagcctacttaaatttattgctctcacagatacggttggttttagttctgtcatagtttctatttttctgtgtaaatattttaaatgtctttcactatgttatcttagctttttattttagaatattttttctgatattttaaaaaactatgttaatggttacttttttaaccactagtataacaatacaattatgtttataactagtggttatataagtttgcctttatgtaatatcctatatccctttttctttagacaatatcagtttattccctatatgcctcaataaaacaagcttctatcttcttccttcattctcccctctctcttctaccatctaatttaaccaatagtatatcttttgtctgttcttattgtttgcccttctactattaaatatgcttacatatacatatttgacctgtcaactgtagttttgttttttttgttgttgttatgtttgagacggagtcttgctctgtcgcccaggctggcatgcagtggtgcaatctcagctcactgcaacctccacctcccaggttcaagcaatgcttgtacctcagccttctgagcagctgggactacaggcgtgtcccaccatgtccaggtaatttttgtatttttggtagagacagggtttcgccatgttggccaggctagtctcaaactcctgacctcaagtgatctgcctactttggcctcccaaagtactgggattacaggtgtgaaacactgcacctggcctgacctgtcaactgtaaacattatctttgcagtctcatgtataacagctgaggcattgcaaatttattctgctttctaaattctaccatttttgttgattgtgtcattttcattttgacagaatattgatattcttcttcatcacttgtatctctacctttgcttttccttagatgtgcagttaaataaacttactgctgcctgactgctcctttgccaaactcttattcatctcttgattggctggagttcatcctctattaattttctcaaaaagtgtccatttgagaaatgttttctgaacgattcatgtttaaaatggtttgtctacagcctttatacagaaaagagtagactggatgggcataaagctttcttagctcatattgctttctttccttcagtatcttgtagatgtggccctattgtcttttggcattgactgttgctgccaagaagtatgttgctaacctgattttctttcttttttgcttacatatttaaaaaattctctttatctttaaaagaggataattttaaaatatgttggtattggctatactagaacagtttccttatatacagtgtgccctttaaatgtgtaaaatcaaatatttcaaaaagtttgcttttttaattaaagtctttaaattctttttttttcctttccattatttcaggttttttatttggggctcaaattatgagtatgttggatttttttacctatactcggtatctaacatttttctttaaccctgtgtttctttatttctgttttgtctactttacttttcatttttatcattcttactatgctatctgcagtctgttttctcttttctcccttataatttaacttcattcctaaaacagtttgactcctttttcccctgagtttagtcagtttctgtttcacctcctcctgtgagttcatgtatatctgatttatagtttttcttcagagctgtgatacttttgtactaaattaaagcagctcatccctctctgagtgccaaaatacatatgttaagtttaacttgaaatccactgcctcttaagacaatgaaaaaaaatcaaatgatttaggagtttaaggcataaacattttcagcagtaaactgtactagaggttgtagttcttaccatgaaatctgtgtctactagtaatccaataacttgctttttggtgataatcagaaattgaggcatcctggaagaaaaacttcacaggaagcttcctcagtctttgaattattttggttaaggtcttcttccatacagctatactgtcttgctgcttggaggaactattcctggaagaagaaacagagtaagcaaatacagaaagataggacaacaggaatacagtttgaagatctgcaggagaaaatgaatattttcagctgtgtgtattgctatccaaaataaattagaattctgaacatatagaattagataaggagactagaaattggatagtcagctaatatctcccatagtcaaatatttggctttaaaacttaggatgtaagttgtaactagaattaagcttattctcatagagatggaattaatcttcaaaggagggtataaattaagagaaaagaagagcaagaagaaaaattaggggaatccatgtgttttaagggcaggaagaggcaaaggaaacagtgaagggaccatagagtgtcccagggtgcagaagaggaagtgtgaaaatatccatgttagaattaggcttctactgccctcccatggactttatggcctcagtgtgtttgggagatggcattagtaacagttgaatgagaaactcacggagtatagataagtccgtgtatttgaatctcagctccgtcgcttactagctggcttttaactctgagtgctggaagttaaacataaaacagaaacctataattaatgagaataatggtaactaccatgtattagtgctttccataaaggaagaactttacaaacactatctccttttctcatttaaccctcataagaattctcattagatggattgtgttatcctaattgtacaggaaggaatgcaaggccttgggtgatgaaatgatatattcaccatcagagaattagttagaaggtggaaccagggctcaaaaccaggccctagaacctgtgttcttgactgttcttctgggttgcattccttcatcagggacatgtagcctgtggctgccccagtcttccagcctcaggtttcaccatgggcctctgcgcctttccttctcatccttacttgatgtgacatctgttggggttcccagtaacttaaaatggaaaagatgagaagagagcttatttttatttgctccttaaaattaaggctaagtttttaattctttgatttctttttaaaattttttaatttttaattgttatggatacataatagttgtatgtattgatatatacatacatcaatatgtatattgatggggcagatgtgatattttgataccagcctacaatgtataatgatcaaatctggctaattgggatatccatcacctcaaacatgcatcatttcttttgtgttgggaacattccaaatctacatttctagttattttgaaatatacattaagttattgttaactatagttgcccaatcgtgctataggatgatgcctaactgaatcgggtgtagtgtgtgatactccttcctgccgttacaagcccactgactctcagagtcgggaatcagagtgcccacgctgcctccaactccccagtgtagctgtgcctagtgctgcgaagtgccagtccagcaccccgtgtcggggtgggagccctgctgagtgcgtacccacgctgggcacacctgcccagcctggcatcacacctggtgcagggcctgagctcagaagcctatctcccaccaaagctcactaacaagagaatccctcccaagcttctgcttcgctcatattaagcttaaaataaaaagtaaaactctgagcaaaagcccaaagaaactttgagaattatttcaattcatttttctttaattgatgctttgttcccctcagagagtaagctctacaacttgattttcaaagggggatgtgatgatcagggatgcagtgtttagatgtgtgtgtgtgtgtgtgtgtgtgtgtgtgtgtgtgtatgaacctaaaggctctgagactgtatatagtcacatattttagatggacgtcacttatgggtgtgaaattctgcttttagagtcatgcagagggccatttttcccctttgaaaaacaagaactactggtaaaaattcattagtttatgtcctaatgggaaacccttcttgtcacagttcttctctatgatgagaccattattcatgcgttcgtattgtcacctcttgtcatttcttgtccacaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaaggtaccgctgagggactgagcctaggcacagcygcccaggccagtgcaccgcagcttgcaggcgggttgcgtggtacaaagaatggtggggtcatcacctcccggatgcagacatattggcctctcagtgccttctttctcacactatgccgaaatgtcctttgttgcttctatccatggttccaacctctacctcagaaaagcagaaaaatgagtctgatttcctaggaccccaaaagcccaataagtgagtaaaagccagcattcctcctggagtcttggttttttcagaccaaacatctctagttctttcacatatttccaaagtaacacagtctccaagtctgttcagcatcacatttcttgtcccatgcgctccatcttctctatcctttttcttcattatgaaagtaagatatgcttattataacaaaggaaacaatacagagatatatgaggaaaacttaagagcattcgcctccacacctcccagatctcaccagtgtaatgacggctgataacattctggtggtctcctcctgctcctcttgctatattgttcaaaatcaaacacatcagagtcaaatgcacagcacactgcaaagtgcttgtttcactgagcaggagatgatgaacataatctctcaatagctacattttattctataatgtgttaatttttagatcactgctgtattcatggtgattctgtttttgcttgggtttttgtcgttgttattatttgttaattgccactgaaagcaatgctgaaagaaacatctttatacctctaatcttacatactggtgcttttgtttctatgggtttgcattcccagaatggatttgctgtgccaacacatgtgtgtttctagcttaataattttagggcttctttcctaatatattgctactcaccatgtgtgaaaccgggtgtttcccttcaatcttgccagcactggaaattacaatgtatggtgtgctgggccattctttcactgctgtaaagaaatacctaaggttgggtaatttattttaaaaagaggatttcttggctcgtggttctgcaggctttacaggaagtatggtgctggcatctgctcagcttctggggaggcctcaggaagcttacaatcatgcagaaggcaaagggggaacaggcacttcacatggccagggtaggagcaggagagagtgagttggaaggcaraggtgctgcatacttttaaatgatcagatctcatgtgaactcagaatgagagctcacttatcaccaaggggttggcccnagccattcatgagggatctgcccccgtgatccaaacacctcccactaggccttacctccaagatggcggattgcatttcaatatgagatttgggtggtgacaaatatccaaactatatcaatccactcctgggccctcccaaatctcatgtccttctcattgcaaaatacaatcatgccttcccaacagtccctcaaagtcttgacttgttccagcattaactcaaaagtccaaactcttgtctgagtcaaggcaagtcccttccacctgtgagcctgtaaaatcaaaaacaagttattcactcccaagatacaatcgggtaaacattcccattccaaaagggagacattggccaaaagaaaggggctccaggcctcacacaagttcaaaacccagcaggacaatcattaaaccttaaagttccaaaataatctcctttgactccatgtctcacatccagggcacaccagtgcaagaggtggactcccaagaccttgggcagctctgcccctgtggctttccagagttcagcccccatggctgctctctgctttcagcttttccaggtgcagggtgcaagccactggtagatctaccattctggagtctggaaggtggtggcccccttctcacggctttactaggcagtgcccccatgaggactctgtgtggggcctccaacctcacatttccccttggcactgccctagtagacgttgtgtgtgagggctatgcccctgctgcaggcttctgcctggacacccaggcttttccatacatcctctgaaatctaggcagaggttgccaaacctcattcactcttgcattctacatgtctacaggtttaacaccatgtgaaagtcaccaaggcttatggcttgcaccctctgaagcagcagcctgaactgtatctgggaccttttgagccaaggctggagctggagcagccaggatgtggggagcagtgtcccaaggctacacaaggtagcngggccctgggcctggcccatgaaaccattctttccaactaggcctgtaggcctttgatgggaggggctgctgtgaaggtctctgaaatgccttcaaggctttttctccattgtcttaggtaatagcactcatttagcttccttttcgtcatgcaaatatctctagcaagtagttgctcctcaggctgcttgaattcttctgaaaaagctttttctttctttgccacayggctaggctgcaaatttttcaaacttttacattctgcttcccttttacattctgcttcccttaaatataagttccaactcntatctttgctgcagcatctgaatgcagactgttagaagcagccatgccacctcttgaatactttgctgcttataaatttcttctaccacataccctaaatcatcaagttcagacttccacagatccctagggtatgaacagaatgcagctgagctctttgctaaggcaaaacacgtgaccatttgctccagtccccaataatttcttcatatccatctaagacctcctcagccttgactctgttgtccatttcattatccgtattttggtcataaccatttaaccagtccctaagaagttccaaactttccctcacttgctgtcttcttctgaatcctccagacttccaacttctgcccattacccagttccaaagttgctttcacattttcaggtacccccttggtactgattttctgtgttagccctttcttgcattgctatgaagaaatatctgaggctgggtaatttataaagaaaagaggtttacttggctcatggttctgcaggctttataggaagcatggtgccggcatctgctcagcttctggggaggcctcaggaagcttaaaatcatggcaggcctcaggaagcttaaaatcccaaagagggaacaggcactttacatggccagagctggagcaagagagagagagtggtgggtgggaggtgccacacacttttaaatgaccagattgcgtgtgaactgagcaagagctcacttatcaccaaggggatagtccaagacattcatgagggatctgcttctaatccacacacctcccaccaggccccccctccaagattggggatcacatttcaacttgagatttggagacaaatattcaaactacatcaaatgtgtttatgttgtttttctactctgaagagtggaaaatggtgtcttgtctcatcttgtcatttgcttcttaggccattggatttcccctttgtaacgtggctgttcgcatactttgtccatttttctattgattggtttgtcttttcttatcaatttgttgctctctttgtaataaagactaaaacatatatttcctctatatgtatatgtgtttttcccacatatcacttgccttatgactttcttttcagaatattttcccatacacaatgtttacattatcttgttctcatggctgatgagctttctctctcactttggaaggtttcttggactacagaattactgaaatatattcttttttttttttttcttttgagatggagtctcactctgtcgcccaggctggagtgcagtggcgcaatctcggctcactgcaagctctgcctcatgggttcacaccattctcctgcttcagcctcccgagtaactgggacacaggcacccgccaccacgcctagctaattttttgtatttttagtagagacaaggtttcaccgtgttagccaggatggtctcgatctcctgaccttgtgatccacctacctcggcctcccaaagtgctgggattacaggcgtgagccaccgtgcccggcctgaaatatattcttatatttaatttaaattttgttctttgagtcttttcatcaatttgaaatttttgtaaatagcaaagaatctggttttgctttctcctggattgagagagagttattcaagtacattttcccactgaactaaatgccagctttgccttatattaaattctcaacatacctggacctatttccataccttgttctgcccacccctgtggctgcccccctgttacacttgactcagtggtttcacagggtctcaccctcaccttctattgctatgcttttcctttttttgtgtgtgctgtttttgaatatttattttgccatctaaaccttaaaattataattctgagtggaattggaatggatttttatttaattttaaaaataatttgcatttataatattgttcttctatccaagaacattatgtatgcctctccacatattcagattctgttcagattttaagcatggaaaaaagaaactcattttttacttatttatcttttatccagtgaactacataaattctcttattagtcatttgcttaatgactaagagaatcncttggatatctaagtatacaatagtatcatctgaaataattgtawgttcttcttcatatttatacaattaattcagttttttattttattgaattaggtagactctcctgaactgttgcaaatgaatgctgtctttgtttctattagctcagcctattattcaagctatattgaatctatatcttggattattctcaactgtttattctgttgtttagaaaagccataattgagttagaaattttaatacatattatctgtgtcttctctgagtttcatcctttctgctgtatttgttttgatgctatcttgttaggtatatgtatattcataattttttagattatcttcctcgtgtgttttttgaccaatatataggctgtctctttgtcaagccatttgatataatggtttttatcttgaaatctgcttttgttgatattaaacagctaccctggctttctgttggttcatatttgccagaaatatcattttttctgctgatataatttcaacttttcyatatcctttcatgttaaatgtgattcttgtagacaatttattattaggtttcattttattatccaatccaagaatctctgtcttttgagtggttaattcaatccattcttctgtcctatcttctctatctagttaaatttttctactggtttgcaagttacacattctacttttactcacattgcaattactgctattctattaaaatcattattttggttttcttcctattatttttaaaaacttaacaactatattttcccctgcaaaatacatgtattaatatgattttatgttgttctgtcctgcctctacttgctctcaatcttatttagatactttttgttgcctttgcttatttagataacaattaactcctttatttattcacatgtattcttttctcttttgctaaaaaaaaaaaaaccttcctcaaagactacttccaaaaacagtttttgcatggtgaatctcctaaggccttgagtgcctaaaaagatttacatggtatacttaaattttcatttagtagattaaaaactctagattgaaattattttctttgaacaccttccaacccttcctccatcatgttcttgcaccttgttctcangtcttctaagagattcacttgacctgatgttttcacatccctatttattctgcacatgaatgcattattagtcccattaacatttttttaatcccaagttaattctttgtctttattattrttattattattttgcattctgatattctatttatctctttgcatgtatttactaggctcattttttaatctagtcctcctggccagtactttgttgcctttctttaacagtttccctgaagctcctggggcacgcagttatcatccatcttcacttgtgctggagcacaggctctggtggatgctcctccagatgagagtcggggaagggtactcaagctggagagccttagatgttgtcatttgggctctagaagttccctgcctgttcccctctgcatagctggattgtctactgagggctgctcccagctcctctcttctagaaagtccttgtttcctgtagggactgccctgctctggtgtaaccgccaagctccccagtgtgttagggaaaggagggaagcagtgcttatggtgactggtgccccacccagctgtgctccagcaccacctgacattctccagctggcacagggctggggctaggggatgatagggaaggcaggccatgctggagccatgctggggagaggaaaggcaggaccaagacgccctaccccaggccctctctgtcggcctcacccattcccacctcctgcccctgaggatttctaggtgtgtgtgaggacaggacactgaggctatgcactgtcttgcccctcttgntgattattcttaaattcggtttcatttctgccattagacctgactccagaggaaccaccccttccagtccttggctcggtcttgtgctcagggccttccttgactacaccacacggttaaggctgctggtatctttcaggcagcagcaatccagacagatggccacatggcagtcctgctcttttgagctggcagcaaacaaaccaacccattatcttatcctcctggtacaggggctagaaggacccttctctctgctaccagagagattggcagaatcagggcctagtaagtgtagctgttacatactgtgatctgacttttcttagatatcatttaagaaaaaaaaaataggactctatcccagcataatcctattaattgagccttgcgagcaatcatatcgattcctattgaattacagagtttctgaattaaatttatgtctcctttagttgagttcttcctgaaaccatagtgtgccaaaatggaaaatggaacatttcatattctaaatcagggcccagaaaaagacctgtgagcccartctgggctgttttttaagtaaagttttattggaacacccccacgctcactcatgtatgtactgtcttcgacggctttagtgctgcaaagacagaggtgagtagttgagactgcatggcscacaaagcctaaaatatttctgtctcaccctttaggaaaagttttgtccacctgttttaaaatatacccaggatcggttttaatcaggtgtcataagacacrcagacacagaaatgactgtcatgaaggtggaagttgttttttttttttaactcacagttccttggaaacaggaggcccagcacagcatgcagggccacacggggaggcgccggtcatctggagataggagtgaggggaagcatgggccaaagcctttgaggtggtttctatgggaaggcagggcagggggagcagccccctaccccagctagtgtgcataacggcagccagctcagaggcaccaggtaccaggtaccagggcctgtctccggctgcctggtccctggcctgaagtgcttagggcaaaggaacgttgcctcctggagagtaagagccagctggagagggtagtcaggagtgtagattctggattggctgctccgcataggagaggtgtgctgcggggcaaggcctttgccatctcttaacattggctcacctgggaggggcagcctctccccagtcagggaggtcccaggtgccagagccacaaaaacaaagaaaataagaaaacgcagggccagatgcagtgactcattcctgtaatcctcgctgagcccaagtgttcaagaccagacagggcaacatggcaagaccccatctctgtaaaaattaaaaataaaaggaaaataaatgaaaaaagaatatatagttaatacatctcccctttgtcagtggcagggaaattctgtacattcttgtactatgttttgttttgttttctaatctttctgtatttttctgagacataactttgatcatggtaattcctgtaaaacattttatttatacatccaaaagtagaatcactgagttcacgtttaaagaatcagtgtgtgaatgtgtgtgtgtgtgtgtgtgtgtgactctgtgtgtgtgtgagagagatgatatgtgtgcattcctggggtgtcacaggaaatgttagaattaggagcatatatttctcattttatatgatcttcaacgcaatctattaatatttttagttcaaaaatacttttttccctcaaactccaaatatttcatgtttagaactgcagaaccacatcatgttgtcctaggaatcaccgtgtttccaaggccatcgaagtgtctcatgtgggtgctgattgatgggcccgggaggagcatgggtgcccctggacaacaggtgcccactgttgagagcagccttgagattgtctgtcccaccgattgcaggtgcacatagcacctcgattctctaatgcctgatgtccctctccatcagattccgaaaaatggggcagttccttctttcccagatacaaaaatggtagtttgtggcaagatgagtggcctcagcatggcttgcacgaggcagaaagacacaagcctccactgctcctgcactcaaggacctgaaccagcgtgggaagcaatgggccgtcccccaccacccaagctgggcccatgtgctccctccctcttctttctaatgtcctgtgtggtttaacttctctttttacctttctgcaaaatacaaagaacttaatcctgttggtctctgaatgaaattgaaggtgaatctaaaccacccattgcgaaatgtagtctgtctctgtgactctgtattcattttaatgggaaaaatacatgaaccttctggaaattagcttcggatttaaaactaacttgccataggatcaaaagcttatgctttttagtctgttgtaacaaaactccatgaatgccatttctgtccagtgctcttgcaagtggggaaggaaaatgctgctgttccgggtgaaagctggggctgggttttccgtgtgaccgtggtgtgctggtcagtgtggacctcagaggggcattgcaggagcacagacctcaccagtgggcaggctgaactggaggacagtgggattccttgggacctcagggaatagcctcaggaatttgccacagggcttagacaatgcttatttatacttaatttaggcaacacaggcagcaggcttttgaataaaacaccagagaccatgctttcctgagaaaaatgaaagatctactgccctgctaaaaagacttctccttactgaaaacactatgagaaaagataacctattcttaacatatatttaagcattcttgttttatgttcaatgttagtcattagaacacagggcttataaaaacaagcgtgcttttgcagcatcaagaagatacatctactttctaggtaatcgacttcctaacatggtaacatattgtaccttagagaaatcctacactgcgtttctcattccctggctgaaaagcccaagaagaataaagccagaggagagcattatttttgagagtgctgtggcaaaagaatatccagacagaagagaaacacatggactgacttaatattgtgtgtcctgggagggccatgtaggaggcatttatcagcgtaactttagtaaaacaacctgtcttaaaacctgagctgctgtggatgcctgaatgattgtttctttgcattaagtgcataaatgcatcgagacaaagagcggtctcccttgtaccatttagtcctgggagaggacaactcagtggaattgaggtagatgtaacttcagacccaagagcaagcctggtgctctttgacagtgctgatgtgcagttgtactgtgggcttgcagctccccacttactaagtggtttcatgactcttgtgaataagtgccacataccaggtggtggtgattaatccagcagcaggaaggcctgcaggatagaaaaggcttgtaggatataagggctgttgcagagagaatatgggtgtgcatgtgtatgtgtgtgcacacatgtatgtgtacgtgtgtatgcatatagtctgtgcatgtatgtacatgtatgygcgctgtgtgtcctgtgtatttgtgtgtgcaaatacatctatatgtgtacacgtatatagtatgtgtatagtctgtagtgtatgtgcrtgggcatgtatgtatgtgtgtagtatatgtgccaactgtttctatgtgtgtgtctgcatgcatgtatgtgtatgctatgtagtgtgtgcacatgtatgtatacaagtggatgtgcagtgtatatgtgtctagtgtgtgcatgcatatgatcctgtgtatgctttcgtattcatgtgtgagcatttatgtgtgtgcatgtgtgtgtatgcgtatgtgtgcagtatgtgtatgcacatgtatatctctgcttataagtgtgtgtgcacatgtatatgtatgtgcgcatgtgccatgtagtatatatgtgtgaacatgtatggtgtgttcatatgtgtgcacatatgtatttttgtgtgttgtgtggtatgtgcatgtgtgtggtctgtgtgcatgaatgtgtacctgtgtgtgtgtattgtgtgtgcatagtatgtgtgtttatgtacatagagccacacctacacccactcagcccttggggctatctttccttctccccctgcagaaaagcggctttcccgggggatttcccacgccagctcagccatcgtctccctggcccggtcccacgtggcaagtgaatgcaacaacgagcagttccccctggagatgccaatctacacattccagttgccagacctgagcgtgtacagcgaggatttcaggagcttcatcgagcgggacttgatcgagcaggcaacaatggtggctttggagcaggcaggtgagttgcccctgccagcaggcccaccctctttaggcttggtgaatggtgagctggcctaacctactctatgagcaagagaagggcacatgttctcagactctgggcagttttcagttaggattctagatgctgcaccgcacctcctgctctacgggccgacagtgttctagccagcatgggctggatggaggggccgataactaggtggtgctgaaatctctcgagttttccccttgctcctaaatcccagtcctcctttaaggagaactctatgcttctttgccttgcttctctctttccccagacaactcctccgtgggtgttgaaygaaagataggaaagaccatgggctttagagaaaacgggagacccgccacttcctgtggacttgggcaagtcaggtgatctctctcagcctcagtttctccatctgcaaagatgaggagactgctgacccggcaacgctttggggtactaagtgacatgtgctttccatagctgtccattccctgcctgcgcagcctcttccagcttccaggttaaggaagcacaaaacctgacctcagtctccttccttctccttagtgtttcctcaccaccctaacatcccaatgaagaaagcgttcaagaagcaagacaaactctcttctttggaatgtttaaggagaaaataatgagtccaaaacaaatgtctaaaacagatttaggttcttcctgagacaaagcaatgccagtttcactcataatcattcacattataaacattgcaaaatcacatatctgggggtttctcaggcacgcatgtggaagatgttatggctgtctcctcaggcccaccacgcccctcccagtgggagccccgcctgcctgcacgggctgacagtgcacatggagcatgtcctcagccagtgggaagccctgctcctgctggggtggggaagcatcgccttccagtgctgacccagccttcagccagctcttcatgtccactgtggagtggagcctccacttccaaggcttggtccgtggagacgtccccagatgtgtcatcccaggagtttagggctgcagccagcaatgcactgttagggagtagagcttttctcggtgctcggcgaagacccaataaaattaccaagcactttctagagttccagaagaagacaggagagaagtacctgtaggttggtatgattctgatattggtggatggaccaatcaggaccctggtaggaaagaaaaggcagcacaaaactgtgagataaaggactccataaagggactgctttccaaggagtgggcaggatttaaggacactagtgaaggatactaccgttcctgggactaccctcaggcctggcaaaaagacaagggatgagagtggctgatggagatagccacgggcagtaggtgtggcatccgggagagagaagatgctggggaaataaatactctgaccacactcttcctccaccatccaggttctgaccagtgcctcttaatggcagaagggcagattgcggggagctcactgatgtggtccacgcaggtcaccctctgcatacagagcagcatggagaaggatagacrgtagatctgtggggccaatgggaaacatccagaaagtcaatgtgccgggaagttttaccagacctggcttctgtgtacacgtgtacacctgctttcatgccattgcttgtcattgtttgcccagggctgtcgtcatccaccactttcaagagggaaggcacaagatgcgtttagacaaaggacgagatgtgcctagtggggcttatttgtgttgggcaggcttgcagtcaggtcgtagccacaggactcatagaagcctcaccaatggcatgcttgacattagaacaggctctacattcccaacagctggatctcatgttgtgactgtggagaaattctcatctcagctgcttcgcagccatcaagagcaatccaatgactggcacccacagccttgctctgtcttacctcagcaagactcaacaaacataaaacaattcagctagattagcaataatctaaaccactcactgtgggggctggctattttaaagacgcttctatatgactaattcagataagatattttcaatagaaaaagctcactattcatagagaagcggaaattagtatttgttaagaaagaaacaagtttcatgggttactctctgttgaatgctacggcggtgtagacctttatacagctcagcactgacgattgctaatagctcgggtgatcatagcagctgcctgagtgctgtgtttcgtgtgaagcacagtctcatgcaaggttgtaggtagrccccaccatgttaccttctccttgagccctaccatgcttagcaaaagccttcacttcttttgaacgtcttttctgttatttttttccatattttgcattttaatttttatcacttatattttaccttccagactagcattttaagatgrgactctggcttcatccagtcttgaaaaataccttttaaaaacccaaacttagtgagttaagatgttaaattatgaatagctcattgtttatgttgggcaccacgaagagaaccaactggaagcagagatcagtgaaggcaggaagctcaggctcccacccagtggtggagaagccatctggtctacactcgcaggaggccttgaggaagtgggtctcactcttcagggagtrgtcaaaggtgcttgtggtgcaattcgcgcctgaagatcagggatctgcctgggacaggagtcctagtagccaacatgtcttcctcgtccctcacgctgaaaaataataaaagtggccaaacgcgatggctcacgcctataatcctagcactttgggaggccaaggcaggagaatcacttgagctcagaagtccgagaccagcttgagcaacatagtaagaccccatctctacaaataataaacaaattagccaagcatggtggtgcacgcctgtggtcccagctactcaggaggctgaggtgggagaattgcttgagtccgggcagtcagggctgcagtgagccatgatcacaccactgcactccagcctgggtaacaaaaccctgtctcaaaaaaaaaaaaaagaaaaagaacagaggtacgcagacaactgtgtgtgtgctccctcagaggagtgaagcagtctctgggctgggtgatagcatgaacctgacccctgcccaccatccatctgactcctccgaactcctttcctctgctctcaagcgaggtcttagactaggtcatttctcagtgccctgctatgctcagactcacgtgaagaccctcagccggccagtgctaaagggtctcccacagcccatctgggtgaggagtttggtcactggaaagcactggcagctcctgtaccttccaccccacagccaggctctgctcccgtggcccccactgtcacagtccacttttccatcatgaagtggccatccaagaaagctgctcagtattgctgggtacaaagggtaaatgcctcttcctaatagcttagtgcttagaatctttatgaataaactatttatatgcaatattattttactgaatacatgagagattgaaatacagatgtyaaaaaattatttagtaaaaaaaaaatccatttgtttaagggacagttctagctgtgcttggcaggaaacattatttctgtcataagactttgggtggaggacttccttttcccttggacagaacatgaacccagggctcaggtggttctgaaaactggcaaacagtggccttcactcagttaacattgcccaccatccagctgtccatcctggggcctgattcyactctcctggggccctgcgtggtatctgcctggcctcccgagccacataggcagccccgtctatttttgaggcctctgtgtcaagtggggtgccagtctgaactcccataaaacccacagatctgggagactggtcttccccaagtcttcaaaccctggaaaacacaacccactcccacctcatgacagtctcagggcaacagaagggccggatcatctgggcctaaaaccagctgacctcctgagaggaagggaaacacctttcgttctttaatgactagcctgccattgagaaggcaagaaaccactccttttgccatcagctgatcctgctgcatttacacaggagatggctcggagaccggggtctctgggttgggaagtatcatctgctgcctgtggcagcagctaaccaccatgtggktgagatggtgtggttcttcagtgtgtctgggggcagagggcagaggcatttttgtgtaatgcaggagtcactgcatacatgggagatggaaacgcatgttgaaaaatctctaggcacacctttgagttgtgctccaggggaggataattggattgaggggaatctgccagagaatggtaagttacagaggaggcttgtgggcttctgagtcagcccgaccctggcttgaggcccggattggcagggggagcttggccacgtcacttggccggctggagcctcacttccttccctctgaaagtcagagatgtgtaacggcggccaaatggagacagattgacccagtgtcagcctgtgttgaatgcccacgaaatgccccatccaggtctggggctacctccacactccaggcagatgaaacccctgccctcagggaggtgaaattccagtggaagaaagccgatgaacaaggggagcatgaaaatgaagtggggcctcagaggctactctggggaggttaggaaggagagggaatcccgggatgccgctggagggcagggagggaggcagcaacagacacctgcgggcctggctttcctggcagagggagtctaacatcaaagtcttggcatatttaaggaagccagtgtcacctgagctggtggagcgagggtgagaggatttggaaaggagggcaggagaatgggagccgggcgctagggagcctcgtcctttaggcttcactgaaggtagataagcagcccctggagggttttgagccgggggctgacgcgtcttgattcacatctgacagattctggctgctggagaatggactatggggtggtaagagaagaagctggaagagcagggagaggcagttgctccagaccagggcagagagagacggctggcagggtcgtgggggtggtagtgcaggtgaggggcagtagagagacacggctatggggtacgttttgaaggcagacctacaggccttgatgatggagggctggggctctggcaggcagggaagagtccagcatggccctaagaatgttaccctgaatatgggggtagataatgttgcctgaggagatgcagacccctggaggaagggcaagaagaagaggccagcactgtcaggcaaagcccgagactgtagtgagacttgtaaagttgctgcccagatgaacatgagggtctggagtcagagagagccctgcgttggggatgcagatgtggagttagtgccctaaagtgaaacccgtgggatcccggagtgagctcctcgtaggaccctcccaccatgcccccaacctggctccatgcagtggtgagcatgagttggacacacttgtctggagcatggacagaaaacaagctttccaaagactcargctggggccctacagtattgagggctgaggaacagaagaaggagccagcagaagagactgggaatgtgcgggcctgggaatcagggcgaaccagcggtggatagtgaccctgacgcccagggtggaaggtgtttcaagaagggagcaatcagtggtgccaaatatgccagtaagtcagtgtgcactagaaactgaccgctgggtttgactgtgagggcaaggttctcgggaagccatgctgcactgtgcttgatacagagaaaggtcaggaagtggcttccattccccttctccttatagctctcaccatcggctgctgtgagtcatctctttcctccagctacttttacactcccttgccttccatctcgtgaggcttccattggcctcctagctacctgggaccattccttgcttccaaaggcagctcctcccatggccagttgccaagtttgccttcccatccttgctgtgctttggagcttcctccacccatcagtcaggcagagtcgcggctgcgactctgggcaagcctggaaataccacgttcctttgtgggccaggtgcagcgttgggcaaccctgggcrtagggcctgggccagagtgtgggagagacagaggccagggttcacatctcctcagcgtagtggtcacagtgtggttcctgtgcagccccctgagggggcgtcaggctctcctctgtgacgtcgtgatgaagcagcccaccttgtggggctgttgtgaagatgaactgaggtcgtgtgtgcacagggctggatgcatactcagcatcaagtaaatggcctcctctactaattttttattttcatagagtggtatttcctatttttctttcttcacactttttgctataaagaatttaaattgtgaccaaatactaagttatcttctccagcattacaattattcattagtaaacattgagcacctgtggtgtctcaaatcctattgtcatagcccatttgcattgctttaaagggatacctgagaccaggtaatttataaagaaaagaggcttatttggctcacagttctgcaggctgtacaagaagcatggggccagcatctgcttctggtgaaggcttcaggaagcttccagtcctggcagaaggggaaggggaagcagatgtatcatatgatgtgaaggggagcaagagaggaggtgccagactctttttaacaatcatctcatgggaaccaatagaacaagaactcactcattactgcgaggatggcaccctgccattcatgacgaatccacccccatgacccaaacacctcccaccaggcccccctcaacattggggatcacatttcaacatagatttggaggggacaaacatctcaaactatatcaactaccaggattattggggacaaccaagatgaggaacacaaggcccctgccccagaggagcaaaggacatgaaggcaataccgcagtcccatggcaggagctctcacagaagcacgtgcaaagcacagtgatgcccagagaggggacatccragggcccaggtggggagggagcactccagtgatattaaaaggagttacagtgtcacatttagggcaagaatcccctcatctttctgatagagaattgtcacgttttgttttctttcatcaaaatgtcgtggggtgatgagcaaaaagacatcttattttaaagtgtgtggtaaccacctgctccaaagctgaagttaattggtcccattatcacggatgaatcagaggactattgctcagaaaagtcagaataagtgactaatagctccccacgtgtgaaaccacctgcctctctcaatggtgttcacctgtgattttcttatttgcagaacctcaagttttcaagctattcacaatgccagtgcccgtgtcttgttcctgttctgtggttatgtcatggggagttgggaatgaccactctgtcaaagccaggaatagaaacatgraaccatgaaactttgcatgttcccaatcgcactccttgtatggagcacacctttatctcgggcaccacattctaggttctgctggatgttagaatagcactgggccatgatggggtctccggaggctggaaagtgctggcatttaccatggctgggccatcttttcagggcggtcacgtctgatgtacagccctaggagtgctctcaactgagtaagagtcttaacttctagaagctggcttacatcaaaccactaagccttgccctccatccacacagctgctctagcaggctgcatcctgcctacctgccctctcccaggtgtgcacagtctcaacagcctgggccacactgttatctgcacaggttacaggagctgtctgcttgcccttgagcattcaggtgtttctctgtgcatagctcccgttagcagcatgcacttcagggacacgagtaaacctcccagacacctgctgaacactcccnggatacgcctcccaggatacacatgtgaaatgaatggacagaattcctatttaaatatccttgggctaaaggacgctgtatgcatttctatttctgcctaacaaattaccacacatttggcagcttaaaacagcacaagtgtatcatcccacagcttccgggggccagccgtctgctgtgctttagctgggtctgagactctgctcatagtctctcaaggctgaaattaaggtgtcccctggctgtgtgctcatctaggggcagatccataagttccctgcggttggcagaatttagttccttgcagctgaatgactgaggttccattttcttgctaactgttggtgcctagagagtacccaagagactcaggagtgatgcaggttcactgtgcgctgcttccttgccaagtctcatgcatgtgtacaggttgcacaaagcaggtgtcttacagacaggcagtgagggacaatagcagcytagggttcagggtaagacagtcacacaagagttaggacagtgcccagggtgcatgctgtcttgtgctgcagctgagggaccccagaaagcagcctgctgtgggtttgatacctgggggatacagtcattattgggctaaaacattgaaatacatcctgttctcggagggaccagaacagagtccagactgktccagctagtttcccgtgatctcaggatactgcattcccagcacattcttttttttttttttttcctggagacagggtctccctctgttgcccaggctggagtgcagtggcacgatctcggctcagtgcaacctccaccttctgggttcaagcgattctcctgcctcagcctcccaagtagccagaactacaggtgcccaccaccaaacccagctaatttttgtattttagtagagtattttgtatgtagtagcatgttgcctacagtaatgcttgagaactacaggaaaggggaaagaacggggtcagtccaaagccatccaggaccccacaccacatccttgccgtctagctctcttcttatggcatggcagtgaagttgtttactgctttgggttgtttactgtttggcatggcagttgtttactgcttcaagaccagccagagaatctctcctctctccccctttccctcttccctcttccgtattccctttatattctaccatctaccctttctctgtaaatctctcygactttccttttctctgaccactaaaccctcttttggtcctcagattaggtcaggccaacccaggataatctcccttttgatcaactcagagtcagtgaatagtaaagtaattacatctgcaaaatcccctcactttaccccatattataacctaatcacaggagtgacatcccgtcggagtcacaggttccacctacacccaagggaaagggatgacacaggagtacaccccaggaggtgggaatctgaggaccactttagaattctgcctgccacagatacagtgtcattacttgcagtatgataattcttctatgctaaaagatccagaatgagagattaaatcatactgaatatgttgtggtcaggggaatttttttgatttcctgatgtgccacttttaaccatttcacttggattggtatgttacagcacactgtgcctagaggcaggcatgcatttggactgaattctacttttttttttttttttttttttgagacaaggcctcgctctgtctcccaggctggagtgcagtggcacgatgtcagctcactccagcctgtgtctcccgggttcaagcgattctcctgccttagcctcccaagtagctggaattataggcatgcaccaccatacctggctaatttttatatttttggtagagatggggttttgccatgttggtcagtctggtcttgaacccctggcctcaagtgatccacccacctcagcctcccaaagtgctgggattataggcatgagccactgtgtccagccagaattctactcttgatggcttcaaatttcaaacagcttgtctctgagccctccaaagatatcataccctttgattgggctcttttgacaatcagaaccatggatgtggtcrtctgggataggatggggtgggcactatggcaactatgcttttgataatagcagccttcacgtattggggatctcctatgtgctaggtgtattatacgccattttaattatgtccagatctcacatcggctgcatgcaattgccaagatgctcttcattttacagaacaggcagaagagacttggggaagccgaagggtttgcccatggctgcctggctgtgaaatgtcctcatcctgcccatgccacgagacctcctcagttcagctcagagcgttgggaactgtcatcctttccctcaggatactttctgccacgtgacccattccaaatatgaattgcatgatttattggattttcttaaaagaataaatcaccaataccagagaaaatctccaaaggaacactctttgagaggccaagtagaaagccagcagccgagttacacaattctagagggacacgttgctgagggcaccgcgcaggaacatctgacagaggcaaagtgaaggggggtggcccagggcgcccacagatgatgggggtggcccgggaggcccacaaatcacggcagtccccaagctttacatttaacactcctcacacagagtgactgatccccaagtcctgtcaggaagaaaatcaaatgaagttatcaaatttttaggagtatatggtacgtacagaagaacagttcacaagcccaggagacttcagaccaagcgtggcaagaagcctaccttgcggcagttccagcacagctgagaaagcgtaaaggaggaagcattttgaccatttttgtgactgactgttacacattaaccttctttttagggcaaacagagttagtttaagctgatttgtctacagctggttcactgaatcatgtggactagccaatgttttgtgttttgtttatgattagagctaatatctcggggaaatcaggatgacttaagttttggctacatggttataggtggttggccttggggtgtgtctgaactggggcctctatttttctttaacagtcctgtaaaatgcagggatacataatgttactgatgagctattacccaccaagactgaagtttggaagcaagtcatgtgatgaatctgctgtaacagagctcgtaagatcaaaaaatattcattaagtcactattgcattgtcattatgttctcacttttatttttgtgaggaagaaatagaaatctgtttgttaatctaggtattggaaatgaaaagcatgtgttcaggtgggagttaaggaagggttagaaaatagaacctttagatgtcttaagaagtggtaaaataaaactggcagtgtatcagatccatgagaagccagcctgttcaacaattctgggtaaaaataagaaacatgtgatgttaaagcatatattaatgacaatatgtagtcacagttttatgttgtagccttgtttatagactcagtcagcatctaaggtaccccttaaatatttcagacatactcttttgcattttatggaaaaaataaaatgaggtgaaaatatttgcaaattggggttttctgaagacattccatccagcagattcaccacctgaatcctttctttgccttcaaaatgtcatctcaggttcaagcagcttccagctgtcttttctcttagagtcatctctggagctagacccattaccctttcattgttttaattccttattgaaatgtacatgtgggaaagtgtgcaaatcataagtgtagaacagatcacatcctataacaaggactcagacaagaaactcacatcaagaaaagtgacttcttatagcataggtttattttgcctctttttgagctttatataaatggaatcatgaatgggttaagttctggattcttctgcttatcattaagcttatgcaattcattcatagagttgtgtaattaccatatagcttatttattctcattggtgtattgcactgcaatgtatatacatgtattacaaataacttctccattatgttattgatggattttttggtgtcttagctcaggctaacataacaaaataccatagaccaagtgatttaaatgacagaaatttattttctcacagttctagaggctagaagtcccagatcaaggtgctggccaattcagttcctggtgaggattctctttctatcttgtaaacggctgccttctcactgtattctcacatggtctttcttcagtgcatgccttggggtgggggacagtttgagagttgaagctctctagagtcttttatacaaacactaattctgggagatcagggccccacccttataacctcatttaatgaatttaaattacttccttgaagtcttcgtcttcatatatagccacactggtgattaagatttcaatatgtgaatttggaggggacacattcagtccataacaagctgttgcaactttgtcattattataataaaagtggggtgctatgaacattcttgtacaggtttctggtaagccatgaacacatttctaaagatatatacagtcatccctcagtatccatagggaatttgttccaggaccctccagatactgaaattctcagatgttcgagttccttgtagaaaatggtgtgctatttgcatataacctactcacattttcccatatattttaaatcatctctagattacctgtaatacctaacacaatgcctacatcatttcatccatgtggatttgacatactatttggcacacagcaaattcaagatttactctttggaactttatggaatttttttttctggattatttctatcagcagttggttgaattcgcagattcagaacccacagataacagagggtcaattgtacttaggagtgatattgctggatcataggatttacatatgttcagcattataacagttgtccaaatagttttccagagtggatgtaccagttgctcttcctctgttgagagttctggttgctccatgttttttgtctttttgttttagttactgtgttggaagtgtaggagtatccacacagtggttttaatttttattttctgatgactagtaaaattaggtacttttcatgttattggccatttgcatatcctcttttgttgggtgccttttcaggttttttacccatttttaagattgcctttttgattgacttgtgggaattatttatacattctagatatgggacctttgtcaggtgtgtattgccaatatcttcacccaccctactggttcccttttcactcactgactgatacactttgatgaacagaagatcatgactaaaatagttcaacttaccttttttttccccttacttgagagcctctatttcagcttaagaaacctttgcctaccccaaggtcctgaaaatattctcctgcctttcatacttaaatctataatccacctaaaagtgattttcataaatgatgtgctatgtaatgaaagtccattttcccatatattcatcaacctgacatggtaccatttattgaaatcatcttttctttattatgctgcagtgtaaccttgagatacagcaggtgactgtgtaggtgtgggtctgattctgggtctgttctgttccatcaacaattttgatgttattcttctttatcattaagtttaaatcattttaaatacttattataatttttcctttgactcataaattacttagaaatatgttgcttaatcactgtggggatatttctaggagtttttttttctagcttaattcttctgtggtcaaagaatgtataatgaatgaattcagacattttaaatttgttgagacttgctttatgacccagcatataattaagcttaataaatattctatgtgcacttgaaaaaaatttgaattctgtccttcttaggtatagtactttttatatatgttaattatatcaagtttgttaattttgtcgctcagatcttttctattcttcactaagtttttgtccacttattctaccagctattgaacagggtgtgttaagatctcctactatgattgtgtttctctgtttcttccttagttatcttttgctttatatattttgaaactgtgttagtggatgcatagacacttagaattattacaccatcctggtgtaataacaaaactaaagttttgttagatgcagccctgatggcagtgaagtctcaggttttcatttgtctgaaaatggcattattttactttcatatttaacagctagttgtaggctttacagaccatgtaagttctctatcacatattcattctctctttctctttcccttccctctatacctcttatagaccaaagtttactgactcctgatctatattattttctccctctactttggatttaatcactgttcctttgtaactttttaacatggatgattaattcattaattcctagcctttctttttaactcttgcaagtatttaaggttattaatttttttctccatactattttagctatatccccaaaattttggaatgtaatatttttgttattacatggtttcaaaatattttctgattttcattttggtttattatttgacccatgaattattgtaagtgcttctttgtttgcaagtatgtaaaaactactaaatatttttagttatttttattatagatttcttacttccattgtggacaaaaagcattgtctgtatgatttgaaatctcttgagaactttgcttcacgattcagaatatgatcagtttttttaaaatcattccatgtgtgcttgaaaataatgtttagtcttctgttttggctgcattgtatttgtccatttggtcatttattatgtttttcacatcttctgtacatttattggtttattttttactttttctctcaattaccgatagagatgtgttaaaatctttcatcatgattgagtacttgtctatatctccttttattcctatggatttttaatcctgcataaatataatgctatgttattgaatacagcaattaaactgatttcttcctcatgaattgagcagttgaacagtgtagagggtgcttattaaattctactaatgctttttgccttttgatttattttatctgctattgattcagctatgttagctttccgtaagttaaaacattcctgatgtaccatttgccacctttcatacctttacctatagcacttttgtattcctctgttttagatttatctcttgcaagctgcatgtagttaatttattcataaaatcagtttcacagcctttgtcttttaacaggtgcatttatttttaatgcaattgccattttcccccattcaatgtggtgtttattctctccttacacatcttcttttaaatcaattaaatattgtttaatcatgtctttttaaaaattctacaagttttgaagttataccctctctttccattattaagagtttacccctaaaatatgcgtatgaatcacatctcaaattaattaacatcttaacctactttacacccaggcaagacagggactttggagtagtttagttttattcatccttattctctcctgttttgtaagttgttgtcatttattttagttgtatacttttaatctcatcagacattagtgttttatatagtcaacattcattttgatttacccatatgcttaccttttttgtttctcctcatttcttcttgcatgtcagatcttccttctgtttgaagttcatcctttacagtttctttaggtgagtgctaattttactctctcagtttttgttagtcttaaaatgtctttgttttgccctcattttttgaaaacacttttcatgggtctagtattatagattgccagttattttcattcagcacattgaagatttttttttttttggcttcttctttccattgttcctttgaagaggtaggctgtcagtctatcactcctttgaagataatctggtttttttctttctctaggtgctttaacatcttttctccctgtcttttatattgtgcagtttcactaggatatgttaaggaagacattaattttattgttcttagaatgtcttagacttttaaaatctgtgagtttatttttacatattttggaaaatcctcagtcagtattcaatattgcctgattcatgcctttctgaattttgattggacaatgttagatcttttcagtctattcttatgtctcataaactctcttgcatcttttctctttccctctttgttgcttcttacttatcttcaaatgtattaactttttccttcaacagtgtccaacctgatattaaactgattcttacttttttactttaatttttatatctttcattttaagttctatatgtgttttccaaatctgcctcttattctttggtcatattttgtttaattcttttgtgtattttaaacatttttaacatgcttgtttacagtctctaatcatttttaacctcaagtttataggtatctataaactgctgattttgtgtgtatgactcttactcacagtggcttgttttctgttgtgtttgtagttttgggttgtgagcaggatgttatatgtgggactcttgtgtggcctgtgttgagagtgtactcctcttagagagattgtttttgtttgtttgtttgtaccagtttcccaagaggaattacctttggtacttagaaccaattttaggttaatttcttggcttactggttccaagccacaaatcaatttaggtcaagtcttcatgacagtcaacatttccggggaagtttttattttcctctgctaagcctaggctaaaagagacaaattttcttcccaactgcctttgccagagcaaaattatttctaatctttgcattcaggatatagtttttgaggatcctaactctatatggaaggaaaaggccatccccagtcccaattccccacatttcagggtctccagccttttttcgagttcttatgaagtgattaaacagttaaatgtcttcactcgttggcagttgctggtttggtgcatactaatttccatcccatatttatttccggttgttggagatttactacactttctttcaagcttggatatacatttgaaaggattattgaaaataagtatttttattttctgacctcttttcctctttaaatctgtgccctcctgctcatcttagggagagggatttctcttttcaaacgaccagagacaaagccttcagcccctactttatctgcagtgctacacgcattcacacaagatcttattttaaattattttttgctaagtattacagagaaatcaggaataaataagcatagagtaactaacaaaagtaaaaatcaatgagggtttgtagggatataagaaatcttttcattggtttttaaaagttgctttctttggttcattaggcttaacacctaaaggccaggtctttccttacattcctcacatggttccttttcccgaagatctactcaacttttttctttaaatcttttttatcctaatactacaatctaaccaatgaatgtaggcaaaaaaaaatttaacatgctgtatttagatgtctacccaattcaagagtgtaatttgcatttctgagaacctctggacagtgcttctcaagcaatctgtgttgaaggacaactcttttctttagatttccaattcactgtctccctatgcttctataaaatttaataaaaatattacagcaaagcgcattgctataaaagctcctaaacacttcctcccattttctgtacttgcctcattgtgcaccagctgacctccctttaagcagcaccaggcactctgtgtgcaaaagcttccctttatttgcagttcatagtctttcttgcatgaatgtcagagcagttgtgcttactctaaaaaggactttggtgtataaaggtaccttttaagccaaagcattttggttcactcattcattcattcattagtatatgcataaatatactcctttatttaactcaggattttggacctgtatatgcataatacatatatggggctttctatatgccacgccctatcttaagtactttcccaatattaaataatataatgttcataaaaactctgttagatcaggactattattatctccatttttaagaattgaacactgaaacagagtggttaagtaagttgcccaacaccacactgctaagaaatagtggaactgagatttgaacccaggaagtctaactccagcttctgtgcctaaccagtctrctggctgcctctctgatgactaccttagacactctagtccagattctgcaagggtaggtgttccaaagcccactatttcatcctcattttcaacttgaatcagttggtctttattgcacagacctctgaattgaaaagggaaatcaggtctttcacctcctttgtgggaagagtgatgattsgttagcgtgtctgccatggaaagtgtggtgatttttcaatgctgcttgctatggtgtagaggggattgacagaagacacttcagagaagtcacctattagcttcagggctctgtgccttcaaaaaaattgaaaattataaccaaactaaaaatttcaactcaatctattgaaacagcggaaaaatttagtcaaactagcattagtttgcattagttagattcgcccaaaatatttttaactgaattcaacccatttttaaaacttaatcgagacaaatgagttaatttacatagaaattgtctttggcaccagaacagaatgtctccattgtaagactatagagtaaacccacatgccatttccttcgtcttgaacatcttcacatctacaggaaaattggaagatgagtatttatatatcttgcaccaaaaatcaccagttttcgggactttgtcacatttgctttatytctctttatgtgtatggaagtacatacactttttctgaatcatttgaatgtgtattgtggatacttcacttcttctgaaaataaagacattctcctatatgacttaacagcattagaaaattagcactaacttagtaatgtcaactagtagagcccatactcagattttcccaattggccccaaagtcatttttgtaatttattttcattccaaaaaacccaactttatgcgttacatttggttgttatggctctttatgcactttttgaaaaacattctctcttcttttgtttttcatgaaaatggatattttaagattcccagccagttcacgtacaatggtcatatctcattgttgaatgctccagtggggttaattcctcacccttctcccaagtgtagacctcggggtcatatgaccctgggttactctccttatatctgtaataaaggctggaacaagcagaggccctgctgatctgcacagtcygtagggataggaaggggaaagtcctgctatgcctagacactggcagtgagccaggttggggagagagaaagctcaagggaaaggaattggggtgtggggaggaaggaatatgggaggaatgggataacatggatttgaggcacttgctcattatatggacccattggatagccactccccacctaggaataacaagtcagaagtcttaaagaagaatcctcagtctctactgcaggggagaggccaagccagcgcctccccagaaccggtggcagaggaataaacattgtgtacagcacayattcgtcagcatttaatagtatcatttatctgaagatttgaatatataatgtatttttaaatactgtcttcatgtgatataatgaaaaaaattgccaaattcatgttggtgttacagcgagggaggaaggaatgagagtgaaatgggggaggcaaatagagggaacttcagcttgatctttactcgtttttcttttcttttatgttgaaaggaacctgctggtgcaaatatggcagaggggtgacattcatttggttttgggtgatgggtgtgtttcttttggcactttacaaaatttgagctccagttttgctcgttactcagtaatacggcttttgaaatcatataggtcagagaagttaaaattggcttgccacaaactcaaccataacaaacaaaattagactggccttttttgtgatctgattttgtcctggatgtgtgagggctcctgttaaggktcagcggatcgtgggcaagtttacttactccctgtgagcstcagtttccttctctgtaaaatgggaataacatcccctgacacagagctggttgatttattgaaggtcctgcagtgtgcaggagaacacactaacccagccagcaggagcttaaactgtgaggtcatcattatcccacacaactcagagtctgaaaacagggatgttcatggcagggctggcagctgcacagtgttatggaggacccaggcacacayagcaccctgctcttctctccccagcgggtcagtgctagctccagctggggatgcagtgtagctgtggccgcatcaggccacacatcctcacactgcatcattcagggcagcaagagagagcccctgattgtggcccttgtgaaggaggagcaagccccagcaggtctcctgttacatcttgtgagccaggcgacagcagtccatggcaaggggagtggaattgcacagatcgtcttggacgtatgaacatttgcacgttgccccatggggcaggsaaggaggcttgcctgaaaagccccagacacaagcagggcgctgtcagcaaggatgggagggaaacgctgtggggcgggcaagacaacgaggtctgccgcagaaatgcagaccacctgcctcattagcatattccctgtccctcctctccctgattgtctactcatgttccctatactccctgatggttgcccagagcactagcagctgagatcaatgcagaggatgaacaaggctgcccactttggtgtcaaatgtgtcggatttccaggtgttacagccattttgttgagttttatgcctttgtaagcaaagatcctgccattttattttactctgtggcaacccagttttactgtatcccagcctggttgttataaacactttttaaaagtcaagtgagacaggttgctatttcacagcctagagacaaagaagtgactaagtaactgcgtgttttttccaatgacgtccacaacggtccatccagtggtagtgtcarttaaagcccttacttgcatttctcatttagctttaataaggtgacttgtaggtggtaagaatataccaatttgttagtgtaagcattaacatcttcatataataaatagatgttcgtctacttaacttygtagtgttaattttaatacatgcttttatttagaattaagggcgcagttattttttatcagtaatgccacttattacaatggaatcactgaatcttaaccaaaaagcgctgaagagtggataaggattcagtttaaacaaagaaccaagaagtttttttatattaaactttgttaatatggcaacacattaggcaataactgtctgactctaaaataaatatactcctgagggccttaattttcaagcttactcgcagtctttatccttcatatttcattatttctattctgatagaaacaacaccttttattaaaattagatwtttttatttgtacaaatttatggggtatatctgaaatttcgttacatgtatataatgtgtagtgattgagtcagagtgttcatcacccgagtacaatacatttttgttaagtagaatcaccctattctgctatccaacattgaatgtattccatcttactgtatgtgtgtaccctttaacccacttctcttcatygtccctcaccactcacccttcccagtctctggtatctgtctttgcactctctacctctatgtgatcacatttctaactcccacatataattcagaacatacaatatttgtgtttttgtgcatgatttatttcacttaggataatgacctccagtttcatccatgttgctgcaaatgaatgacatcattcttgttaatagctgaatagtattctcctgtgtatttacacgttttctttagccattgacagatggaatgtagaaatgtaaaacatgttctgcttcttcagttgttcaaatcctattaatatttctctcttttttaaagaatttttgattaaaatgcttttataatttcttggaaatatctattataaacattctcatttgattgaagttcccaaagtgttgaaggccctagggaggtgcatgttatatttcatcctccaaataaaaacatatatatgtcactagaagtttcacataacattagaagcttgatacaaccactcataagcttgaagcaatttttaaacaattttagtattatccaagaagtgacatgtaagatgacatttgtgtcacctgcctaacatgtaaatgagccaggctatttatcctttccatagacacattcttttgaaaagcagccatgagtgcagatgcacctgtcatcaggtaggatagagtctcctgtagccatcagcctggagattacctttgcctcgcttctgtgctattcacccatttccctcctgtttcctgtatttctctggttttggtttccaccctcattttgtggagtacatcctcctgaagcttcctgagaaagagtgaatgaagatgtcttgacatgagttcactagaaaacagaacccggccaggcgcggtggctcacacctgtaatcccagcactttgggagactgaggtgggcggatcacgaggtcaggagattgagaccatcctggctaacacggtgaaaccccgtctctactaaaaaaaaatacaaaaaattagccaggcgtggtggtgggcacctgtagtcccagctactcgggaggctgaagcaggagaatggcatgaacccaggaggtggaggttgcagtgagccaagatcgcgccactgcactccagcgtgggtgacagagcgagactctgtctcaaaaaaaaaaaaamaaaaaacaaaaacagaacccaaggtaactcccaatggctatttatttcagagacacagtcccagatgtgttagcaactagttttattgagaaataaggctgctctgaatttcttrtatgagtcttatgttttcatttctcttgggtaaataaatatccacgagtggaattgctgggtcatatggtaaaggtaggtaatagtccatttcacactgccataaagatactacctcagactgggtaatttataaacaaaaggggtttaattgactcacagttcagcatgactggggaggcttcaggaaacttacaatcatggcrgaaggggaaggggaagtaggcaccttcttcccaaggtggcaggagagagacagcacagggaaaactgccacttttaaaaccatcagatctcatgagaactcactcactatcatgagaacagcatgggggaaaccgcctccatgatctaatcacctaccaccaggtccttcccttgacacctgggcattacaattcaagatgagatttgggtgaggacacagagccaaaccgatatcagagtatgttgaactgtattagaaattgccaaaagtttttctaaaataattgtgcctttttacaatcccaacagcaaagtatgaaaactccagttgctccatggccccttagacatctgtgctagtatgyaaaatacaattgactcttgaacagcacaggtttgaactgcacaggtccacttccacttatatgtggatttttttcaaccaagtgaggatcaaaattacagtattcacaggatgcaaaatccatgtatatggagggccaacttcttagacatacaggttccacagagccaactatcagacttcagtatacacagatttgggtgtatgtcggcggggtcccagaaccaatcctgtgcagatacttggggatgactgtaccattgatttgtgtatattgatcttgtatcctgtgaccttaaaaaattgcttattagttatggttttttgtagcttccttatgattttctgtgtgaactatcatgttctctgctaagaagaatagtgttatctcttcctttctgatttgcgaatacagattttatttctttctcttgacttatttcactggctaggacttctcatactatgttgaatagcagtggagagagggcgcatctttgtctttttcctagtcttagaggtaaagcattcagtctttcaccattaggtatgatgttagctgtatgtttgtgtagattttttaaatcaagttatggagatccccctattcctagttttatgggaatttttaattatgagtattgaattttgtcaaatgctttttctgtattcatgatatgattatgtgatttttcttctgtagcccattaatatggtgaattatattgattgattttcaaatattgagccatccttgcatcccttggtcatggtatatagttctttgtatatgttactgtgttctacttgtttgtattttcttatgaattttgcatcatattcatgagagatgttactctgcacttttctctctttgtactttttttgattttggtatcagggtaatgttggctattttctggaggagcttgtgtaatattggttgttgttaggtatacctcttggtataacctttttgggaattgttctagttattacattatatacacatactttatcaaagtctattggtgttgacattttactactattggtgaagcatataaaccttacctgcctttttgcttctttattctctaccatttataataaaattgttttaaatatttattcaacatacattgaaacatataaacagataggcaatgtcataatttttgctttaaccatcagacataatttagaaaactcaagagaagaaggaaagtcttattatgtttgcccatatttttgttctttccatgttcttccttctttatatgccaaaatgccttcttttatcgtttcctttctgcctagagaacttcctttagccatttctttaaggtaggcttgctaggaacaaaatctccttgcttattactgaagaatatttttgctagctttaaaattctgggctgacagttattttctttcagcacttaaaaaatattatcttggctgggcgtggtggctcatgcctgtaattccagcactttgagaggccaacgcaggcagatcacttgaggtcaggagttcgagactagcctggccaacatggtaaaacyctatctctactaaaaataccaaaaattagccaagtttggtggtgcatgtctgtgtcccagctacttaggaggctgaggcaggaaaatcacttgaacctaagaggcagaggttgcagtgagctgaaattgcaccactgcactccagcctgggtgacagagcaagactctgtctcaaaaaaaaaaaaaaaaaaaaatttatcctgcttccttctggcctacacggtagccaatgagaaatgcactgtctttagaattgtttttcccatataagtaaggcgttgtttctccttggcagcttttaaggtttctttgtctttagtttttagaagtttgactatgatgtattttggcatgagtttctatgggttttttttctgtttagggtttgctcagcttcttgaatctgtatgtttgtttgttcatttgcaaaaattgggaaccttttagtgatttagtgattatttctttgaacactttttttttttttttttttttgatacggagtctcgctctttcacccaggcctaagtgcagtggcgcgatttcggctccctacaagctccacctcccaggttcacgccattctcctgcctcagccccccgagtagctgggactacaggcgcccgccaccacgcccagctaattttttgtatttttggtagagacggggtttcacctttcaccgtgttagccagaatggtctcaatctcctgacctcgtgatccgcccgcctcagcctcccaaagtgctgggattacaggcgtgagccaccgcgcctggcctcttcgaatacttttttagctctaccttatttcgcctcttctacggactccagacttttgtcgcagtcccacatgttcctgagttgtgttctgtatatgtgtttttttttttaagtttaatttttctctgttgttcaaattgggtgatttctatgttatacctttacattacactgattctttttctcttctctccaatctgcttttcagcacatccattgagtttttaaaatcagagttgtatttttcagtccctattatatctgcccatatttttgttctttatttggctctgttttgtatcttctattgttttggtaagactttctatttctttactacattttctaatttttcatttgtcttaggtatgtttgtaattgcttgttgaagtattcttaggatgactacttttaaatcccagtcagataactctaacatctgtcatctcagttttcatatcttttcttgttctgtttgaaatcttcctggttcttggtataagtgattttttttgtttgtttaaaagggtatatatttggtattaagttataggactctgggtcttacttaaatcttgtgttttagcggacctcctgacaccactctggtaggttcagggggccattgcctgacaactgccagagggtaattgaagtacaggttccccctctgcccctgttgatacctggggaatgggcttggtacttcttggcaggggtacttcctagctgagaggaggcagagattctcattacagccagatgagtgtgaaagttcaggctccctgtgtgtcctctgaagatagagggcaaggtgcttattaccacccagtggggttgaggtcttggctttgtactcagccttctctgacactccccaggtgatggagcaggcagtgatgagcaccttgttacagcctggtgagggtggaagtctaggcttctcactagaactttgctggcaggggtggtggtcgggttataattttttctgtgatgtttggctggaatagaagaggaaatgtctaagcagctactgttttgctaagctacccctttcctggtattctgtctagagagagcatgctttttcttttctatctttttttttttttttttttttgtggcctactctcattggttcgtttttacagtatctaatctgggatatgtgaggcaaaaagaaactccagggaacccaccattatgtcgttcctcaagtctcaagatccctagttagtctgccacttcttctccacttttcagagtcttctaatatgattttatacataatttccagggcttttcgttgtacttagtaagagaaataggaaaaagtacatctgatctatcttccctgaagtggaagtctctaaatgtaaatattcatgaaatttaacataactacacctatgtaactataatggttttgatgaatcaaatgaaatatgaactatactttcaaaggtatgtgtgcctcaaaaaagcaagacggtgaaaggaaaaaatagctttcaggagggaaagctgtgttcaaggaaattacaaagaaatgttttatcttgtgtaaaatacgtttccagattcaaggagagaaggtgctggccttgagtttcttaatgctcatgctaattgatgggaggatttggccacttcttgtcctcaaagggaaaagaaatctatattttatttgaggagagaagtagccataatgttccccctttctattgaaacctgtngaaaatctgtccctgatgtttatgcctccttagcaaacacccccastggccccttccttttctgggatcctgttctaaagtgagcttcttttccaggtcgcctgaactggtggtccactgtgtgcacgagctgtaaacggcttcttcctctggccacaacaggggatgggaactgccttttacatgctgcttcactgggtaagctccacagcacagacagagggtggccaggctccaggcctgcgtaaggaaagacatatgctattgaaggaaacactattgaaggaaaagcatacactaaatagagtcacccatgtcactgtcatgagaaagtccccaggagacagagccaacaatcctggcccttcttgtcaagtagcacttgctggagagacagaacacacataagaaaagacctggcgtgatagaaggaggccttgagcatagctgcagggatgggacttagagaccgtcgcctggtacaaataaaaaggacttcctgggaggaggtgggatctttactgaaacttgaagaacttgagagactagaagagggcattgcaggcagggagacccygcagataaagcataaaggcaggaatggacagggtgtttggaggtaggggtgaacgaggtaaagctggagtaggaagttttgggagcagtgcatgaggttgggtaaatgagggtccactatgttgacagcagtcaacagttggcatggactaatggaaacagacgtaggtactgctcagataaatcacaggggagtcagcatagtcagaatataccacagagagatcagcacacttgtccaatagagacgtgagcttcccgatcacacaaagccacacaacacagaaatatttggataattgaggatcatcatcgactttctggaacctcagttatccctttaggcccagcgttatatgcacaaggctgaatccattttgataggtgagtctgggtttgcaccagggaccatcagggccggttggttcttacccgccctggaggatagcgcctctccaaaacacacaaccctcacacaggaatgcagtccttgtttgtcaaacttgsatccccaacaaacatggctttaactgggtgccatgacctacatcargggccagcccccagacctctctctctttggacctgcggtgaggcctattcagcaagaggtaggtgagataagactgtaaagggcttcaagggaaatacatcagggtcttgaagggttccagaggaggatggagaacaagggaagcattccccaggcttgacctgcagtgaggaaaggcaaggcagccacttacctgcttcatctccatgtcattggagcacattctgcttgttggcattgcaaaagtactccacattcaccatggtgagaaaatgaaaatcagcgacccccacccagcggcggccactcttaacagtttggtattgtcatcatcttccggtcttttgtctgttcttcaggtgaaatgatgatcttgctgtgttcacagtcttgaatccaacattttcccttacaatctgagaattttccctgctgttatccttcaaacacatgattttaagtagttgggtcttattttatcatagtggataacattaactattcccctgttattgagcatattttgccttgttctttctaaaacctggagaaagaatctaaaagaataaatctctcatctgtgtcaaacagcagcctcattgtgaagtctggggcatggaaatgtttttgtccctcagcaactgcagcatgtagagtcattgtccccatcagcacaacagcggggcaaggccacaccccacagcattttccctgtgagcacagtgggcctcccaggcctgcctgggaagagagagcctccctcaggctggtcatttccatctgcaagagagcctgggccatgactgaccagggctgtgagacccccctccaagaatcccctgtacaacaataagcccagagctcatagcaatctgtcctcttatcccagcactttgtttcattttgtgcccatatagctaaactccgcaggactggggctgcccaaagctgccacatgacattcaccagcagtccttgtggaacccctgttggcctggcctgacgttgagctaggattgtggggcacatatagaaatgacagtcatcttggagtcaggcctgtaggcagatatatgcaggacaaggaggccatctctgcaagagagacctgcccaaggagctgtgggagagtcccagnaggcagctgaaagaggtctgaggatgagcgaggagtgacagtggtcattccccctcccctgccatcctatagaaaaaggcgaagccttgctggctagaagcctgtggcaggcctgggctattgcatatccaaagatgcccagccagttgagcctttgaaaacatcagttcacattactctccttctgtagactctccagaggctcacagttccctcgagagcccccttttcactctccctctctcctcgatcccactttagccacctttccctcttgccttttctcaagtactgccccctctgggtctgtccctggcctttccctgtgctgggacagcaacttggctccttcctccacccatttgagcctttgctcctatgtctccattcacgccacagcagatctgcctgcctcacctctcctcgtggggctgccaccctcaacatcgtacactctgtgccagcctcgtggctatcctcacttcccacttccccacaacatgtgctccatgagattttaggaacttcatgtgtcccggccactgccacatatattcccagcacctagaatgagtgagtgggtgcgtgggtgggtggatggctggatggacggatggatggatggattcccctgtgttttcccttgtagccagagctgcccttctcttgagcacttctcccatgagttggrgttcttgatcacatctaagctgcccagagcacattctcagagatggctggtttctctctatatcctctcagcacctggcacagggtgagaccctctcactaggaagcaggcgctctctcctgggccaggtgtgtgcagtggtgtcactgacgctctgcttctcaggaagctgagatgcctcagggctggagaggagggaaatggcagaccctggagaagccaggatgctaatggcctccctcacctggagccctccataaggacactggacagcctgtccctgtcccctagtcagtcccccacccaaatgtaagacttgaataatgaccattaggtcctcaaagcaaaccagcaacattgagaatgggttgccaagggcaccagagaggaaaagcacttgattttcacccactattgttttgctaagaacaggatgtgctgcttcattcacctagttgccttaatgggaagcctcaggaagaaggctggaggggaattaacagaaccgctgagtaaggaggctgttctgcgtgcagacaggaggctctcccagtgggtcgtggtagtttgcatcacctctggcttgtcttttctcatgtcctttctctcctctgttctccctggcctcctggctccaggaatgtgggggtttcacgaccgggacctggtgttacggaaagctctctataccatgatgaggacgggagctgagagggaagccctgaagcggaggtggaggtggcagcagacgcagcagaataaggaggttggtatccactggcatggccagagccygggacccaggccagatgcagcctcgggccgtggtcgagtccacagcatggcctccaggccccagacagtcttatgaggggaaggcagaaacagcccctgggatcaggaaagtctcctgcttttaagcccacagaggaggagcctgtyaaaatagcagagtcccggcagacagcaactatgcgtccacttgtgcttccttaaggcataatcatgaaagctgcctaccttcattcccaaaagcatcctggcttggatgatgaattatatatatgactgcctgctgtcaggtgcagcccatggccccagcccctgtgtgtgagctcagtccaaagggattcccgattgtccccaaccatggtaaacatgaggaccttgctctcctagaagaatctgaayggccagccccagttaggtgcaggcacaggttaatgctcggtcatccccagcccctgagaatgacccttgttggtgggcagattcccagcagctctggaattagagcttggggcttctgaaaatatattgtgcatagcaaaggtggccaagagggtgcagttggtatagttggtagctacctacagatgtgcctggcctgggtcccggtgaggctggtccagattgggagggtgaggagaggagggcagcgcagctgtggcccaccccccttctgagccggctcccctctgccagtcagggctggtgtacacagaggaggagtgggagcgggagtggacggagctgctgaagctggcctccagcgagccgcgcacacacttcagcaagaatggcggcacgggcggggggtaagtgctgcccctgctctccccagaagtcacctccagctccaggccacccagggctacacacagcatggggggatggcacgggggggaatgtgggactcttgtgctgtggaagacagaaagattccagctttccagcattagcttcaagacaaggacgcacgggaggacygtgggtgatggctggccccgccaggtgctagtggaagggtatgcagcccccacatgcactatgcaggcagaggtgagctcacatgagctgcctccaggccactttccttgaactttattgtgcagaacagttggggtgtgcrccttcagggcacagcaggcctctggaggtcacacgtgatggtgagcattcccacacattgccatcgcacgaacctggctctgaagtttgggttttctcccccaactaattaatttgtggcttcaagaagttgccctgaaagcagaagctcattaagctagcctggtgtttcccagatgggttccatggatattatatgtgttcccagcaaaaagacttcacatctgtgcatgtttaggaatagcttgttcctacagaaacaccttggatgttctagtatggaatgaagaccgtggccagaccagtggggcagccatagagccttggccncggcttattcttcagttcatattctctggaacctgaaagcaaaggtgttgctcctagagaaggtctcagccaaacatgagaaagtgtgagcagtaacaccagggagacccatggaaggaggattgcatgcagctccaggctgccctcaggctcatgggccctgcagcgggcaactgggtcctcacccacccaccaaggcagggcctagtgcctcatgggccagctctccctggaggccccggctggaaaagaggctcccacagagctgcagctgcagcagtggcgtccaagaccatgtttgaagatgaaatcattagaaacccacatacgctggcacacccttcctccagggctgtcttgtcactgtgttttaaggctatgttatgtccataccaacagtctatcttggcaggacatttgaggacaagcattctgaagactcagtcgactgtggaaaactgctctcttcctctgcacgcctcccgagtcctgcctgtgatgggtcttaagtgttcctcgacatcgttttcacagttgcctctctccctcctgccacagggaggacgcctgataggtgctggcagactggatccaggccaggtgtctctgccagggacagggaggagtggggaaagacagcagcaatgatgactttgatagtgggtgaaaatcaatcacaggtgaccatcacatacacatctcctgagtacccccatccaggaggagcttcgcccaaggtctcatggctagtcagcccatctgactcctaaggccacagtctggtaccctgctgcctgctccctggggcccgagggattcagatgctaatggggacacaggggccacttggtgtctgtccctatctcccacagagtctgagtgatcaaccttaatctaacaaaaggattaggtccctttaggaatatccaaaatggcccagacattgtcccatttatgtaggatagcctggtcccctgcccctgggagccatagttctggctgccacatcacaaaagagaaggaagaacccggggaatggccagagaggggaaactaaacaaccaagggtggatgggagtgaccccatcaggaaagaatggagagatgaggcaggaaggtatgggtggtgttgggggaacggaaggagggaggcgagcacaggtggggtggggtggggtcggggagaccataagagggccctgtgctaggcactctctcccctcctttcaaactctgcctcacaagcctccagtaccccttccacagattcaaaaactgagcctcaatgggattaggtaactgttccaagaccccacaaaaatgataaatggaaggagccaaaaagtcaaaatttggtctgatcattaagtctcctcttttgaccaggctctacagcctaacaaaatccctcaaatacagcagtctgtagaaaggacacagccacctggtccccacagatgccactgatgctcaggtcagaatcctgtgccagtgatgcaggaggcatttctagggtttcagcaacaggtgtttccagtggagaaagaaaaagggaaaaaaaaaaacaaaaaactcagaagaggacagarcatatgcaataggaatctaccaaacagagttgcttctgtagccagatgcctccttgggttacctggaacctttgcatggccagtcaaggagggaggcctttggaaccaggcataaaacattttcctgggaatggggagttttggctgagtcccatggactggggtaacggacagagagcgcctcagcaaggcacccgtgcagctgtgcaggactcgccaacagggtgctccagagctcacctgctccaagaattcacttggggttcagagtccacaagagaggcctttgtgcacaagcacagttgctctgccttttgcctgtgtcttctctccccatgttgagctgagaggtgtagggcatcatctctggggcttgagggctgcagggttgagtttctgacacctgactgaagsncctgaaggcagaaactggcgagctcagggttcacagggctgtggtgggctgtacaggccaggacatggggccgtaggggatgtaaggccaggatgctgcgagctgcccgaggtccaggcatggattcagggaggaggccccaagcgggctggcttcaggactcatctatggtggggaccacacagaagaccagcccctgaggccagggctgagggtggacacgagtagtcagtgagaggagccaccactgcagcccagggacctaaggacacagcccctcaactggcagagagctctgaagacccaaaaaaagcacttcctcagacagcaggtcagcactgggacctccagcgagcccagcgggccctgaaggaagacagcaagaaakactttgccaccctcctgcccctcctccctgcctgtgccggccccacaggggacacagacagcagccagagaaggggaggaggcaaaaggtgaaacagagaagccagctggaagctaacccagtctttcaggaggctcaagcttggggctgatagccccctgcacaggaaagtaaccagaagaaccacacaaaatttccagggtgccacccgggaataggaaagagcaagtcaagggagagtttgcaggcatgatggcgagaagaactaaggtggctttattcatcccagcctgggtttcccagaacctgttccccacggatgagggtaaagggtgcagtgcgggccctgcatcctgctctgggagcccctggtatggagacagatggggcagcccctgtactattggtccttgacacagatgatggcctggagtcattttaaacttgttactttcccagaaagcaactatgtcacgtatctgaagaggtcagcagggaccagagaccaggtgtgggtgtgagctagacctgcttcctctcactgtgcctcccaggaggactcacagtggccaggccccggccacgtggaagaaccaggccttccctagggcttggggagggattagtgaggtcagatgggaatgtgaacagtgtcatctactgagcccatgttatgtgtcaggcaggcctatgagctgtcattatcatcaccaatcacagagaaggaggctgagattcagagaattagataatgtattagggttctccagagaaacagaaccaataaaagacatacatataaagagatctaatgtaggtattggctcacgtgattatggtgtctgagaattcccacgatctggcatgtgccagctggagacccaggaaagccagtggtgtaacacgaaggcccaagagctggagaactgatggtgtggatccagtctgaatctgaaggcctgagaaccaggagtgctgagggcagaaagtccatgtcccagctcaaacaggtttggttattccgccctccgccactgttttgttcccatsatgaatagatcagatgagccccacccatattggtgaaagccctctgctttctgctctccagcaattsaaatgctaatctcacccaaaatgccctcacagacacatgcagaaataacgtttaaccagctatctaaccatcacaggttagcttccaatgtcccacagcctgaaagacacaaagccagaacctgaacttagaactgaccaaagaaacctaagcccacactcttgacaaatgcagaccaggcatgaggagtaggaatmaacaacttatcttgactrtggtgaaaataatcatttttgttctttaaacttttaaaagaactacttatttgttttctgtttgatgagaagggctaagtggaagctgagaggccagtccgacagacaaagaggagaagagagcagagcaagagggaccgtttgggggaccctctggcagcccccgggggcatcttctgtctaggtccttacttttctcacatgcyaacctctctgctttctctttgtagttgagtttctgaaatttcactgacaatgtgtttgctgcatttctttttattagcttttttcggaagtagctagaatcccaagtgatttcctagcacacagtctgagagttgtcaatttcagtcagtcttttgaggaaaagcaagaggcattttattcctgggagatgcccacaccacagcctggtgctcccgggccatgggctggccttgtgaaggaaaggaggcattcttatgtgtattcctgaaggtgccatgacttccaccagcagaccaagcagaaagagcatctgctaacgtaaggtgtcctcactttgcagatgtgggacccggctcaaatttttaaagacatttctaattgaaaataagaccaaagttgactatctagggatggttctcaagtaggagccttctctgatcttcctgtctaaagaatccaccttttatcactctactgagagttttttattattttattatttatttaaatatgtttaggggatacaagtgcaggtttcttacatgcaaatattgcattgtggtaaagtctgggattttagcgtacccattacccaagtagtgaacattgtaatttttcagtcctcacccccgcgaaccctccggcctgtcatagcttccagtgtctgttattccattctgcctgtccatatgtacgcgttgtttagcccccagctataagtgagaacatgcagtatttgactttctgtttctgagttatatcactgaggataatcgcttccatatccatccatgttgctgcaaaagacaggattccattcttttttatggctgagtcatattccatggtatatatatacattttctttatctaatcctacgttgatggacacttaggtggtttctatctttttgccattgtgaatagtgttagagtaaacatgcaggtatctttttgatagaatgattcatttccctttgggtatatacctagtagtgggattgctggattgagtggtagttctatttttagttctttgagaaatctccacactgttttccataaaggttgtatgaatttacattcctaccaacagcatgtgttcccttttcattatatcctcaccaacatctatttttgtttttgttacatttgcttttgaagacttggtcataaattatttgcataggccaatgtccaaaagagttttacataggtttccttgtagaatgtttatagtttcaggtcttacatttaggtctttaatccattttgagttaatttttatatatggtgagaagtgtgggtccaatctcattcttctgcatatcgctatgcaattttcccaacactaaatagtgaatgacgcaaaatgaatagtgtcatttccccagtgtatatttttgttggtgttgttgaagatcagttggttataagtatgtggcttcatttataggttatgtattctgttccattgatctatgtgtctgtttttgtaccaataccatactgttttgtttactataaccttgtagtacaatttgaaattagatgatgttatccttcagctttgttctttttgcttaggattccgttggctagacaggctcctttttagttccatatgaaatttattgttttttataatcctgtgaaaaatgacattggtaacttgatagggattgtattgaatctgtagattactgtagcaatatagtcattttaatgatgttgattcttggaatccatgagcatgggatgtttttccattcatttgtgtcattgacaatttttttcttcagcattttgtagtcctccttatagagatctttcacatccctggttaaatatattcctcgatatttttgtagctaatttaaatgggattgccttcttgatttagtcctcagctagattgttactggtatatagaaatgctactgctttcattatgttaatgttgtatcctgaaactttactaaatttgtgtatcaaatataacaggtttttggtagagtctttatggttttctaattataaaatcatatcactagcaaacagggatgatctgactccttcttttccaatttggatgccttttgtttttttctcttgcctgactgcgctgtgggtacttccagtactatgttgaataacagtggtaaaagtgggcatcctcatcttgttccagtccttagaggaaaagctttcaacttttccccattaagtatgctgttagctgtgggtttgtcatagaagacctttattatgttgaggtatgttctttctatgcctagtttgttgaggattttcatcatgaagtgatgctgaattgtattgaatgcagaaatccttgacaaaatactagcaaatcaaatctaacaggacatcgaaaagataatacaccataatcaggtgggatttatcccaggaatgcaaggatgattcaacatacacaaatcaatgaatgtgatatatcacgtaaacagaattaagaacaaaaaccatatgatcatcttgatagatgcagaaaaataactgataatttcttatttgatcatgtgttagtatctctccctacctaaacctgcattcatgggcacacatgggcaagtgtgagtgcrcgtgcgtgcacacacacacacacacacacacmgcacagtgctagacctgtagtggataatcagtaactatttgtcacatgactgacctcagcttattgatcctaagcaataagtcttgttcctcaagccacactggccactgctagaaggtctttcagagcctaagatccattcagtcccttcgaagcactgggaggcccccgtccttccatctcagcttcccaggccatagctcttagcagagtccctgctagcctgtactgtgcctttggagagtcttttgtaaaaggtgcctgtctgggcaggcacagtccttgaccaggggcaaaggcccacagcaggacataggctgggttcagccccttgagcctcctcagactggctctgctgtgcagggccctacctgagagaggggttgaggcacacctctcagaaatgctgcccatgagatctgtgcatgaggagaaccttgcacctgtgaaaaggagtaaggaccatccccacctactgtgctgtgggtgtctcaggatgcatcaggaggaggaaaaggcagtggttggactagtgagtataaacatgctacctagaggtgggaggatgtgtgcatacagtttatgcgcatttactcacattcatacgtgtgtgcacacagatgtgcacttactttttttttttaatcagatggagtctcgctctgtcacccaggctagaatgcagtggtgcgatctcggctcactgcaacctccacctcctgggttcaagcgatgatcctgcctcagcctcccgagtagctgggactacaggcacaagccaccaatgcctggctaatttttgtatttttagtagagacagggtttcaccatgttggccaggatggtctckatctcctgacctcatgatccacccgcctcggcctcccaaagtgctgggattacaggtgtgaaccaccacacctggccttgcacttactttttttatggaagggtacaccaaaaaccaacacctatgtccccataggtgaggtgactacaatttatcatccaaactggttcatttgggggaaggaaagtgggcactaaccacttgggatgtgtgaacaggactttcccaagcaaaacaggaggtgtggacaccccatctggaggaggggatatggggagggacctgggaggcttcatccaggctctccgtctgggtggctgggtgactgccctttaacaagacctgccggccccagactggcttccttatctatgacacgcgctcttgccgaggatggtctccaaggatggtggctacagcttaagccagggtgcccccaaactgttccctggggcctgagataccatctggaccttgctccatgacctttgcttcttggtcctgccaggagggactcctcagcctctgcccacccccatctttctcagggtgttttcattgggtagacggtatatccctaaccctggaaattctccctcctcaagtacccactggagaagcagatgtaggtgccctggagaactcagtgtgtggggcccaaagcatgttaggaagttctcaggacatgcacatcttggaggatgaagtcattatattgcatgtcagtcttctttgcagtaagcactgatttttaagcattttaggaattgttatgtctttgcccagtggccagattctccccacaatcccagatctcgcatttgctcagcaaactcacaagaagaagacatgaagtctcagggctaaaagtgggagtgaattttcagaattggtttttctgaaactgatttctaccaatgggctctggtcacagagtgcaggtcacagttccaaactctcgtcccagataagatcttgtttgcccttcattttagagcccccagctaaattggagttccagtaccagagcagctagaaaacctgcaataaggagaaatgaaaagggacctggacataggcgtttacagtgtgcrtttcatgggatacttctcttacctggcaggtgtcctaatgcctggttgcctaacccatgacccatgtccctcacatgggaagcttgtttgtactggcagatggctttgtggctcctgtctggcctgtgtctagttttttcttacctgaccatcgctctgtggctgggaccagccttgtgttctccttggcgtctggtgaaaacatggcctggggtagcctctgcttcttccaaaggaaggtgcaaattcaatccaccgccacaatgggaagcaagttcaaaggtttttacttatagatcctgggcatggaggccatcatgagttgggagggcagtgctccatcccagggtcacattgaggcagggattaagattcaggcagagagatccaactagaaatatatataggggaataggatgtgggtcactttaagttcatgggcaaatgtctgaatggtccatttaaaggaagtggtgggaaagtggaaagcccagtctgctaggcagagagtcgcctctaagttcttatctctggccaccagcttgggtctttgggtgtggtgttctacttctaatgcccaggcagcaacctctgctgttttgtttctgttacaccctctacaccctcaggtgctctctggctgccttcaacactgaggctcctggtatagaaccaggaccctccctaagtcttggacaaggagccagaagcaagtagggaacatcattatgattttyaggctgccccccgctggagctgggatcctctccgccaccccctgggtcactgagcaggtttcagttgctcacatggctcccatgctcaacaccaaaactggaatggagaaaggctgctctgctccagctgtcctccatcacctctcaactgggcccgccatcctatcattgctgctgaaataaaatggccctgccttaagttagccatgaaaagaatgccatgccagtacaatggtgcctaatacttaacctttgcaccgttgttaccttggaggccctcttgcatagctactcaaataccagagtgttctgccaggaggctccatgctgggcatggtccaactccatgcctttgccctagcacagaacttgaaggacgggtagatgaatggacagacaagtaggtgcttgggcagatagatggttgaatggaagaattgaaggatgagtacatggatggatgcgtgcgtaggtgggtgggtggatggatggatggatggatggatagaggtacatgtgggtggatggacaggtggatgggtgggtgggtggacaggtgtatgggtgggtggatggcatggatggatgaatggatggacagatggatggatggatggatagatggacatgtgggtggatggacaggtggatgggtggttgggtggacagttgtgtgggtgggtgggtggatggcatgaatggatggacagatggatgcacagacagcagatggatggatggatggatggacaagtggatgggtggatcaatagatggatggatgaagagagagagggagggaaggaagagagatgggtgggtgggtgggtagatggatagatggatgaatggatggatagatagataggaagaaggatggataggttggtagatgttacatgaaggcagagttctctgagggcctctgcagtgcctttcacagcaccagtgtatagtaagtgctcaatgaatatttattggttttttggttggaaatatgatggccctgctttaagttttgcatgagragaatgctgtgccagtacaaaggtgccyaatactgagccttcacgctgttgttaccatgggggtcctcctgtgtagctgctcagatcccagagtgttctgccaggaagtgaagatgggactcagaacccaggcctgagagggctaccattcaccttgctctgcccgcttctcagtattagtacctgactcaagagcagctcctctctttccagcactgccccctccattccttgaattagggaaggaacagtgctccacatttctagctggggtatttctctctccaagtatgcaggttttaactccatattctctccccctgtgctgttcattatgttgttcaaccattcactcgccggcactcaacgcatactaggtgacagggacaaacaagcaacttccaaaagcacttgaccccccaggcactgcagcttggctttcaggtgtggctgggcaggctaatcacctgcagtgtttcaaaatgcacacccaggagcactgcatttagacctggcataaaatatatgtgtgtgtatgtgtgaatatgtattcatgtcaatacatatttaaaacattcctcttctacttccctttccttccttgctgaaaaagtaagttctaaagccattaggtggggcaaagcaaggtggcatctggagtgggtgggggatgggaggacaccaggggccagagccagatgtcagccacacaggtgaagagggccacctcacggatggggagcagaggtgggagatggctgacatatgggaagactgatcaaataaggaaatgctttagaatgaatacgaacaagttttctgaaagtaagtgaagaaagttgcaaatagaattaactttgtggggttggattggaattggaggtatcagtgaactcaaggttttctataaatattgagagggagagaaagatgaaaataaacatggagagggagagaaagatgaaaataaacatgcaaaaatatgtatccatgtgtgagtgtgaacttgaaccatctttttgcaccaggaagcaagaaagtgctctaagaaatgatgggagctgggcacggtggctcacacctgtaatcccagcactttgggaggctgagacagaaggatgacttgtgcccagaagttcgagaccagccttggcaacatagcgagaccccgtctctacaaaaatgaaaaaagttttctgggcataatggtggcctgtggtcccagctacttgggaggtcagaatgggaggctcacttgaccccaggagttygaggctgcrgtgagctatgatctcaccactgcactccrgcctgggcaacacagtaagaccctgtctcaaaaaaaaaaaaaraagaaagaaagaaagaaaagaaaaaaagaaatgatgaggatgtcaaaaggacacagatccagctttagagaagccacactgaccacatcaaggagtatctgagcatccacataatcacactaatggattataacccactgaataaaatggaaaaccagaaatccatagtgataccaataaacctataaagatttggtgaggaatggagtatttgcataggttcaagttcctctccacaaaatgcttgttaatttcaaaygaaaaattagtagtctgcaggggcaaggcctggaagatgaccttaaggagtggtccaggtcaacctcaccagtgatgggacaacctcaccagtgatgggacaatctgcagttcacacaacctgataagatgtcacaagaaggactcagcttgacccaatccaatctaactgtgaggaaayagagaaacccttatgaaggacattctacaaaatacccaacctgtaatcttcaaaaatgtcaaggtcatggaagtcaaggatatcctgagaaatgttccaggtgaaggagactaaggagacgccaccgctgaatgcagcacctgatcctgagcaggaacctttgttctaaaaggcattattgggacagctggcacacacacgtggggtctggtgattgcatgtaactgtgtgaattcctgatgtcggtagccgtgtggtggttgtgtmggaggatgttctgttcatagaaaatgagcaagaactttccagggtgatggggtgccaggttggctgtttattttcaaatggttcagggaaacaaaagctctttttactgtatgtgcgcaactattttgtgaggtttcgattgctgccaattttttgaactgttaaaataaggttaattgggttggatgtggtggctcatgcctgtaatcccagcactttgggaggccaaggctggtggatcacttgaggccaggagttcgagaccagcctggccaacatggtgaaaacccgtctccactaaaaatacaaaaaaattagctgggcatggtggcaaatgcctgtaatcccagctacttgggaggctgaggcttgtaaaaagtaaaatagaggttcttctttaaagactttcctccccatctagttaaaaataaatagtaacttcttttagaagcaaaatttattcaaagacctgtgctaacattcttaaatatctgctagccataataaaaaaatcaacatactttatattcttagctcccacaatttaacctaaatatttgccttgcatacttatactagtccaagcaagcactaagtcatagtctggtcctcttccttctttaaaagcatttttacctttctcaacattccacaagttacttcctccttcctttattctcctctgcatttgcctcttttaaaaaattctaagttactaaccaatcaaaacaaatacaaaatgtaaaatcccgttccagccaataaaaaccagacacatcagtaaggtggacacgtcaggttataaatgaccctgtctcctttattcaatatactctcataacaaaactgctggcaagtacaccctttctacagaaaataaaaaatggcctcgctaaaaaaaattaaatttatattcaagtaatattgctttacgacaccaggaaacaaacatttcaaacaattttggtgacccgtatggggatacattctctgccgggggtggtctccagtccctcctcataagggagcgtgctcctctgccacattgcagtggcctcaaggataagagctcaaaacccacccggtatgtggaataaactcagagtctcagcaatgcaaaaaaaaaacaattcctcacatatcacgtgaaccagaaaactgtgcacagattgaggaaaaaacaccaggaaaaaacaccggtaaagtatttccttagtaatcaagactgaggaaaaagctgcggggcagtaaagcattccttagttaaaacataccaaggagagagaaactgcaggggcagtaaaacattccttaggactagacacaaaaagccatgggaggtggtaaaatatttcttagccaggatgtcttaaaggttaaaaaaaggtaaaaaaaatccccactgagtgggggttaaacctcaaaaagaggtgagaaatccccatgggcgggggggttaagcctcaaggtaaaaaatccccattgtcgggggttaaacctcaaaaagaggtgagaaatccccatgggggaggagttgaacctcacacaaacctccgatagtaaaatatatatacatatatatgtatgttacatatagatatacatatatatgtrtgttacatatagatatacatatatatgtgtgttacatatagatatacatatatatgtgtgttacatatagatatacatatatatkttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatgtatgttacatatagatatacatatatatgtatgttacatatagatatacatacatatatatattcaaaactcccctttcccctcttcttgggggaaaaaaaaaagactaagctccactcctgccagtcgctcctctaggggaaggggaaaaaaaaaagcaaaaacaccaagcatgacgccagacagccaggcacaccaaaaattaagtccctctccccacccgagctctgtgtgaaaaagagagcggggactgtcgcagaaagaaaagccaacaagatgaaaggacctaactcttacgactaacgacaggtgtctgccaagcctgtgggccagtgatggccctgggccaggactgcagccggccgggggccaagactayagccatgcaaatcccacccagcccagaaaactaagtgtagaaaaaataaataaatcagggaaaaaaaaaaaaaacaggggaaacagacggcagcgcatacatgcaggcggggcccgtcccttgcccagcctgcgccgcaagaccgggaaaaaaaaaggaaacaaaaaatgacagagagggagagaaaaataaatgcaaattaaaaaaaaaggaaaataaagtgcaaataagaaaaaaaaatagaaaaaagtaaaaaaataactagaaaagacaaaaatcaaagaaagacayggtaaaattaggaaaagaaataatgtaaaaggcagaacgttaaaacatgttaaaaattgtctataaaagtcataaraagttataaaaaaatttatgcaaaaaatattacgtaatttaaaagtaattaggcctcctaaatgtaaaactatttaaaaaacagtttatacagtttatatacaaaatatgtaaaaatatatacttttaataaaattacaaaaagacataaaaatatgaatttttacctacattaaaaggttaaaaaaattttgttttaaaactttaaacaaggctgggcgtggtggctcatgcctataatttcagcactttgggaggccaaggcaggcggtcacgaggtcaggagatcaagaccatcctggctaacatggtgaaaccccatctctactaaaaatacaaaaaaaatagccgggcatggaggcaggcacctgtagtcccagctactcgggaggctgaggcaaaagaatggcgtgaacccaggaggyggaatttgcggtgagctgagatcgcaccactgcactccagcctgggcaacagagcaagactccgtctcmaaaaaaaaaagtttaaacaaatttaaaaatattaattataaagaaaattctgtatgtaaacatattagctaaagaggtatccaatttttctgtaaactaaacattaaaataaaagcacaataaatttttcttaaagcactaacctgctctttaagaaaaattataaaaagttttaaaaagtctataaaaaccttaccttatagtcagacattaaaagtaaataatgtcttcaaaattttattaaaataaagtttaacattaatagcacattaatgttaaaaaacataaaatcatacaaaaagcattatcaaatataaaatagtgcttaactttctcaaagcccgagggcggccgaataagtcacaaggcccctcatccccaaggccacaacgcgcaggggcggtgaaggccacaaaaaagccaagaccttaagagggggcagggccacaatgtcccctaggcaacgctaagcagaaatggagcagaagacgtcaccatggggcctcaagccccagaatacgcaacaaaaattatatacgtaatttatcttccactttccctttcctcaaaactaaaaatcttttaacacaggtaccaaccctaaaatttctagtacatcagcaccagcctacaaaccacattcttgcctggcgcagtgcctcacgcctgtaatcccagcactttgagaggctgaggcaggcggatcatgaggtcaggagatcaagaccatcctggctaacacagtgaaaccccgtctctactaaaaatacaaaaagaaattagccgagcgtggtggygggcgcctgtagtcccagctactggggaggctgaggcgggagaatggtgtgaacccaggaggcggagcttgcagtgagcggagatcgcgccactgcactccagcctgggtgacagagcaagactccgtctcaaaacaaaacaaaaacacatccttatcaaaaaataaaaaactcaagccagcctgggaaggaccctattttatgctgttaaccactaagacccctgtccacacagccaagaaaaaaaggacccactatactcaaatcaagaaaacatcttaggttactatactaaaatcaagccctactaagttaaaattttaaaaagcttaattttcatatactttctctattacttcctttcctttccttattctgttactagctcccttgttattaatgtaactaaatctaactcacctcaaaccattgcctttaatgcttgctctatcataccttgtaaaaatattaaaaaatcaatgacagctagccttttcacacaaatatttatgtcctggccctctaattaacacaattacccctaacacttatcgttataatcacctgcagccaaaacgccaattttctgctcctactgagaggtgaagccagctggacttcctgggttgagtggggacttggagaacttttctgtcttacaagaggattgtaaaatgcaccaatcagcactctgtagctaggactgtaaaacacaccaatcagtgctctgtaaaacgcaccaatcagcagaatcctaaaagtagccagtgacagggaagattgaaaaaaggacattctgataggacagaaatggaacatgggaggggccaataagggaataaaagcttgccacccccgccccccagccagcagcggcagcaacctgctcgggtcctgttccatggtttagaacctttgttctttctctctccacaataaatcttgctgctgctcactctttgggtccgtgccacacttaagaggtgtaacacgcgacttcattcttgaagtcagtgagaccacaaagccactggaaggaaccaactccggatacactacagcctaacaaccttataataaatggaacgacgtcctttaaattactcaagagcaaagttaaacttccacacacacacaaaaaaaacatacagatctaaaacccttcatctatttcattaaaaaacctacccaaccttctcaatataaccctgtccttctgtcaccacctccaccttaactaactctaaacctacccttaatcacttctataatatagaaatttgacataaatttttaaaaaccctaaatatttttaaaatacacattattcccccatcttccccttcttcagtagcctaagttctaaatccgacaccagttactcctgcatctaataaaagtagaatgcctattataaaaataaaaaattaaagacagaccttagccatcaaaacaatacatcaaaatacaaatgcctagctaaaatattccattcacactttaaaaacaattattayactattacatttgtacacatggtactccagaggcccaaattatcccctttccacttaaatggtcacctcatcaaccaaatataaactatatagtagctctttttcaaaatcccactgcttaaaataatccatcatgccaagctctctctgctatttcctaaaatttaacactgtgcgggtcagcccctgaggacaatccagcttgcaccttttctaaatgccaaacttacactgtgcctctcatggcaagaaaaaaatttaatattccttaaaagcatttaaaaaatgctttttccaaaagctcgcccatcaatccatgcttagccatccccaagcaaatatatggtagtactgtaaaggacctttactaaacgctgtgccaaatatttgaaacagtactaatccagttagctgtccttcactctagcatttcatcaatctaaaaaaataaaaacaaaacaccgcaggccaaaaaaaattccttgtaagtcctttaatcctcaagtttatataaatgctattaaaatsctgtaaaaaaaatttcaaataaatttaaaatacaaaatcaaatagctgcaaaatttaagtccacgttattctggtaagtatgaatttaaaaaatgtaaactaaactgtatctgttacaatcagcaacaattcataaattacactgaaaacgccatcaaaaaaatagctaagcaattaggacctaccagacaaattgccttaaaaaaagctttaaatataatatcagcaaaaaaaaaaagtcataattaaaactcaatattgtacctttattcctaatactgcccctaacaaaactataacaaaagcactacaaaaattaacagcactatccaataaacttgccaaaaattctaaaataaataaccctttttctaaaataataaaacattaattcgataagtaaaaaaaaaaattgtggccaggcatggtggctcacgtctgtaatcccagcactttgggaggccgaggcaggtggatcacgaggtcaggagatcaagaccatcctggctaacacgtctctactaaaaatacaaaaaattagccgggcgtggtggcgggcgcctgtagtcccagctaccagggaggctgaggcaggagaatggcgtgaacccgggaggtggagcttgcagtgagccgagatcatgccactgcactccagcctgggcgacagagtgagactccacctcaaaaaaaaaaaaaaaaaaattaacttcaattctcaccttgttcgctcttattaatatacttataagctattatgttattccctgccttcaaaattttatacaaaaacttatctctaccactcttacaaagttaactcctaactctcctccaccctattcgaaaaattacttctcttaaagctattaaaacagacaaattaaaaaaaaattataagagggagaattgtaaaaagtaaaatagagttttctcttcaaagcctttcctccccatctaattaaaaataaatagtaacttctcttagaagcaaaatttattcaaagacctgtgctaagattcttaaatatctgctagccataataaaaaaatcagtatactttatattcttagctcccacaatttagcctaaatatttgccctagcatacttatactagtccaagaaagcagtaagtcacatcctgttcctcttccttatttaaaagtatttttacctttctcaacattccttcctttattctcctctgcgtttgcctcttttaaaaaattcaaagttactaaccaatcaaaacaaatacaaaatgtaaaatcccattccacccaataaaaactggacacagcaataaggtggacatgtcaggttataaataaccttatctcctttattcaatatactctcataacaaaactgcgagcaagtataccctttctacaaaaaatataaaaatagccttactaaaaaaatttatattcaagtgctatttctttacaccaccagaaaacaaacatttcaagcaggttgcattgagctgagataacgccactgcactccaggctgggtaacaaagcaagactctgtctcaaaaaaaaaaaggtaaattgagtcataagaaaaagaaaaaacatgggtagtatgtaaccaaaattccacaggtgatggtaatgcattccctaggattcacaccctgcattctggaagtcccaggtggctgggaactgtgcccatgaacccatgaagctctttccccaggccatgccaggggccacatttgccagccctggccccacctgctgccgtcgtcacagactccctcagctaattctgagcattcctcaracactcaggaacaagtctgagagccacctctggggagtcttggctggtgctgtcatctcagctggcaggcactgcaggtgcagccgaggctccataacgctgtgagctctggctgtcctctcaacgtgcacctcccttttgggtggccttgctatggggggacatcgaggctgccaccttctgcccgaacgtcttagggtttgagtggaagcattcttgagcctgcggtttccctgatcctcagacgtgagcctgggcatggtcagggagggtctgggccacctgggctgcacattcacatcgcatcccctccagctctggattgaaatccagacagccttctcactgttctcctccattggggtgagtgtcttctagaaggctcctcagatcttggtggtaatgaccccaccagcccatcagatgtgcccagggaacccctgggtccctgagagaaataaacaggagaggaaccsctccatccctctggcccccactgcttccttgtgaaacacccccagaaagccaatagccctgctaccacaggctctggtgggctgcctccgcctrcagagagactcgccttcacagcggccggcacccttcacctgcgggctctttccaactcatcttctgagaccgctcccacggtggggtaggggagstgggacctgtgcatttgccatcggcggatggcatgagaagtggcccaggatggcgcagctgccggggtccatgaagataatatccagagtggggagggctcagcccctgcatgaagcagtccccactttctccatcctccaccctgttttagtcagtgaccagctggctctgttttgtttcacagtgtggacaactctgaggaccccgtgtacgagagcctggaagagttccacgtttttgtcctagcccatatattaagaaggcccatcgttgttgtggcagatacaatgttaagagactcaggtggagaaggtaagttcctcaaagagatgtgttgtattcatgacacagaaagcatagcatcccagctagaaagcagatagcacagcacaaggtcgagctcccagaggccacaaagcatcactctgtgcaaagatctcctcgacgtgtttctttctcctccctgatggcagcagagattgttcttgactagctgccctgcctatcaacggcaggtggccaggagaaatctggtcrtgtgaggaccaggaccaagcccagaggggctcctgtctcctgtcgtgtgcctagggcatagcagacagcccacacccctccancagccctgggccatgtcctggaggcactcagtcactcaggtgtgttcccacccctccgcagaccacatgtgtgttaaagactaaaaagaaaggaagacagaatgcatagagtcatttggcaaaagctatggtagaatcagaactggcagagaaagaggcaagggcagtttatggcctgcccaccaaaagccacactctgtgcacagccccttctagaatgttcctccattcagcccttgctacaacctcccagggtggacaccaccctccccactttacagagatgaaactgaagcccagagaggctaggcaatgtccccagcggggatcagccaagggcagggagtgatccaaagcctgtcctccctccagcgtgcagctgcccantttgaatttacacctgcaccttaacaaaagtcataggtcttccagggagctctacgaatcaggatgtggctcttcacgctaaatcacagctgccataaaaaatctgatgtggccacgatggttatgtagccagggaactggtaggacacaggtcctgcctggcccacccccttccctgtgtggctcagggacgcgggcctgctgaggtctgcaggtctccgtgcaacaccagggcttgcatcagggcactgctgcgtaagcccaggactgagctcccagcaccatcagatctctgagttgcggggcagaggaaggtccacgcttcctaccattctactcacagccctcttgcaggtacccccaccctgtcgcctctcagtctgactctcctgtgagcacagtgatcaatttagacaaagtgaggatggcggaggaactcataagagttcatcaaagacatccctgaaattaccgtccctgaattctgctcaaggagtgcagcaatacactsactctagggccaaaagtaaagacgtttcatgacctcaaagcagatgctgctttaggacagatatttccagaagttattctattttgctgagggtgttaggcttttctgccctctttttttacaagtaagaaaatgagtgaaattgtgtccctgtcactgaaggacttgatccctctgattctcagttcccatctgacttacatcttggtcctggagctctctgactggttccttcaaattcaatagaagaggttctcaaaacatagagcaaatatacacccttgagaagcgcacatactctgttgtatacaaatgctttaccaaacactaggaaaggaagaagtacatccagaaaaaggtgggcttccaggctgcaactgctctgaccaatctcgggtgactgtcatcccagccctggggctcctgtacacctgtgcaggtctcagggcagcaggagtcctggggcagacagatgactctggaaaccctcagccccatccctcagcaccgcctccatccacccctcctgtccctccgcttctccacggagtccccccggggtagtgagggacagggatgcaggggcctcccctcccagctcgagctggctgctcctcacaccctcaccctggtttgtgtccacagcgttcgcacccatcccattcggagggatctacctgcccttggaggtccctcccaacagatgccactgctcgcctctggttctggcctatgatcaagcccatttctctgccctngtgtccatggaacagagagaccagcaaagagaacaaggtatgcctgtctcccaagagagtgcacgcaggagcctagggtgggggcagagccatcagaagggaccccattgcacggggaggtggattgtggagacccccccttagaagcacacctgtgcacactcagcagtgacagtttttgcataaagctaccttatgcatgtgtgaacgttttcattgaaaatarcaatgttaaagacaacattctctttaaaatactaaacaaaggcaacctacccttaaatagcttttactgttttccctttcacatgtatacatattttataggaatgcaattagtcttagatataaattaaagggraaaaaacttmaaaagcaagtattaatgaactrtggcccaccacccattttataaataaagttttattggaacagagccacattcattcacagatgcatcatctgtggccgtttttgcactacagtggtagagagaggagcagccacagacaccaaggcctgcagcgcctaaaatatttacttactaattagctatttatgggaagagtttgctcacccctgctccagggtaagcttttaactcaaaaggtcaacatttcctttcaaagcattgcagctgagtttcctctaagcagccatttcagtgctgctgatgttgggccagcccacaggctgtgcactgcacaattccagggcaccagtcaatgtctttactggggaaatagggggattttgtttggaacaattgctgttttctcatgttagctactgatggatgtgtgaccagctgagtggagaggaaaccccttcctgttgtcattcttgtttgtagtataggcagagactcactcccccaggggacagacggacaggcaagaccaactatttcagagtccctgccattaggtatggtcccagagaatgggaagtgccctgtccagggccaacagggggaaggaagctcaggggtgtctgcttctgaccttttccactgagtgtgcagctcaggaagtaaatatagcaacaagattgcacccctaggactcccaaatgctactccttcctgtagacagctgggaaggaaaggacacagacaaatgaacagaacccagcctcccccagccctccgccagaggcggcaccagcgtgtcacttcctggcctggcagttgagtcgggaatgaggctggggctgtggagcagaagctgaaggtgagaaatgcacagggcatttgagaccccttcccaagagcagatgcagagctcccaggagctgacatgcgtggtgcagccgcagaacccaagtcacaggaagagagacgactggaggctacagccggccgtgacaagaatgtcacatcatggttctttattatttgcagatgtggcactggccacagaaggaaagatttaatcagtaaggcctcggaggtgctccggtctttccattgtctccccactttcaatccggaatgcggaatgcctgcacctccttcccggggatttagctcttcgtagggctgaccccgcctcttgggagaccagaagggccttttcaggacctgggatcggccaggggcggggccctctgtccagtccccagggagattctgtggtcagaaggtgatggtcccaaggccagcgtctcccagttccgagcatggggttcagatacccgaccccctcctcgcaaaaggcaccgagtactcttccaggccttccagatactgctgcttggtgttttcaaggcacatatgaaagcatcctcccttcaaaggatgcccatggagggcgctgtggcttgggacctttcaggagggccttgcagagttgtgggtggtttcacttctgatgacctggtttctaaaaactgggatctggtcccagtgcacctctcagagccactgtggtgtgggtctttggctccctcacagtcaaagcagcccactgggatcctcctggggcgatgcaggtccctgcctctaagaccatcctgtggccaggctgcacattcacccataaggtccccacgacccactgcagggcaggtgccatggccacgctctttgtcacntgcacccttgtgcccccttagaccttcacctctgcagccttccctctgtgcctcaaaggacactgtggggacgggacagagtcccagctgtgctctcaagtcacacgacatctcagcagagagggacgtggaaatcacagtgaggctgcagcttccaggatgagctgcagactcaggcctgctggagtgagctggccagaccgcaaagtcgcaggacctggtgggaggcaggagatgggagactccagaatatcgagccccaggatgccaccggcccccactgtgaagcacaggtgtcaccctctgccatggtaccctgtccgtcctataaacagcaccctgtgacagaggctaatagatacaataatcacangccccaggaagagcagacaccgcatccttgtgcctgcggaacgatgctttgagagcctggaaatgagataaaaaatgtatttcaggctgagacaaggctcccttcttcccaccacccacttcctcctcctctgtttacatgccccatcatgtctcatccacatgtgtccagctcctggaggcttaaaaatccatgaagcattctttaaacttctcatcgagtgcctctccctctaagggaagccccctcttataggtgctactgccgtggcccggctactgctgatgccgccactgaccatcttcaagttcaggaatcctcccgtttcccaggctaggcatgcaacatggggagagggaagggcttgaggtggaaggtcaggagctggtgggactggtcagctatgggcaacctcagtggcccaggctttgcaaatttatcttaggactttttagataaaatgtatgcattctttcttggtagcttccacacatgatggtcacctgctttctcctggggaggacattagtcatttgctccctgacaacctgagccttgggccttcagctttttgcaggaagcagcctccttgcagccacatcttaaaatggcctgcaggggagctctgtgaaacccagatcygggcattctctcagcacccagctcaggtcagttcctactggccactgagcaaatgtgtacattatgaaaaatcaaatcaattaacaggagaagcagaggtgccgcatagttcctggaaacatagaacctaggaaagaactttggaatcatccagtgcaacaatcccaactcccctccttttatagcaaacattgtccagtgtactcttcattaccctgaaatgaaattcatggataatgttacctgtgttggaataaagtccatttagtacccccacatcaggagaaatcaaaggaaaccaatgtaataaaataatctgcatttctgtaaatattctcacacagccatactgcaaaactcaatgaagcaatcagatcctggcacccatatgtggggtgcccagttacacagagaggggacacaggtgtgctgagcataccctcaaataccccaggaggctctacagtccaaaatggcagctaactcttggtaaagtcccaaacaagccaagcacagccttgcccatctccacagctcctcttccctttgggtggatatagagccgtgcagagcatacccatgtgtacatgttagctctcggcctggccagcaggttgcactgggaagggctgggtgcatacaggtgctgcctaggtctgcaccccaccttcatgctcatatatttgcaggtgcttcctgtgctcaagggctgttctaggtcctttccaggaatacctatttaacccttcccatttcctcttccccactttacagagggggaaattgagaaaggaggaaccatccccagggaatagttgcagccagtgaagggttgggagggtggatggcgaggcttccacaaagacttggcccaagagagtggcatctccaagagaagaggctcaggaagtggtaccccaagtcaaagcctgcttgggataagatagcgtctcagacccaggactcaggaaccttcagggtcgaagagggtagggagggggtgctttgtttcatggaaggtgtcaatgccatctgtggctattcttttcttaaaaattaatatttattggccaggcacagtggctcacacctgtaatctcagcactttgggaggccgaggtgggtgggttgcctgagctcaggagttcaagaccagtctgggcaacatggtgaaaccccatctctactaaaatataaaaaattatctgggcatggcagcatgtgcctgtaatcccagctactcaggaggctgtgacaggagaatctcttgaacctgggaggtggaggttgcagtgagccaagcttgcgtcactgcactccaacctggatgacagagtgagacttcatctcaaaaaaaaaaaaattaacatataagtcaattatttaaatagtttttccctcatatatacaaacagcctgtgagcctctgaggcatatccaggggccacacagaggtcagggcaccctcagtgtgtcctcagtgccttcccccaagggtcccacttaaggaacctagagagcagcacacaggagccctgagggagtccactggttacagatggagggggagatgctggtgtgaacagagagctctgaaacggctgcagactgcaaggatcgaggcttacagatgatcacaccaaggttggccatccctttattgggaacagagactcaacacattcaaaatgtgatacttgaaaaaaaaaaagtttttgcaaagagcagcttaccaatttgtctcttgctgcttagaaacaacacagcaagtttataagtgtctgctagggatcttgggagccaaacagagtacttctacccaccgggccatggaagcagccttccatctgtatttgatgtatggctcgtggttaaatcaaatgctcacctatgctctactattccccaagccacacggaatgtaacattccagttttcaatatgtttgacaatgaaccatgctttttcttgcaggattaatttataataaacagatccaatctctttttaaatagaaatgtatctttacatgttacaagtatcattacatattctgctcaacttgattttaaaattgtgttaaagaatcatttatcggcggggcgcggtggctcatgcctgtaatcccagcacattgggaggctgaggcaggcggatcacgaggtcaggagatcaagaccatcctggctaacatggtgaaaccccgtctctactaaaaaatacaaaaaattaactgggcatggtggcaggtgcctgtagtcccagctacgcaggaggctgaggcaggagaatggcatgaaccagggaggcagagcttgcagtgagccaagatcgtgccactgcactccagcctgggcgacagagcgagactccatctcaaaaaaaaaaaaaatcatytatcaaataccaatcaaattggtctatttgtgtacctatctgaataaaataatggaggaagtatgtaatgcctattacaagacattacggtaagaatcagcttagttcatggtggcaagaaagtttttttttttgaaacttttttttttttttttgagatggggtttcattctgtcacccaggctggagtacagtgccatgatcttggctcattgcaacctccacctcccaggctcaacagatcctcccatctcagcctcccgagtaggtgggactacaggcacatgccacaagcccagctaactttctgtacttttggtacagacggtgtttctccatgttgcccaggctggtctcaaactcctgagctcaagtgatctgtccacctcagcctcccaaagtactgggattacaggtgtgagccactacgcccggccagcaagaaggttttggaaaccagaagtgcccccaaactgaattacgtttgtaattagtctcccttctcttggctactttctaagtttgtcagttgccactgaaagatagggtcagagtgggagtaaaaagcacagctacgcctacccttgtggtgtgtggccagtctcactgggccatatttctttgccactcctctcaggagccccagagcacagaaccctgaagaacctttgtctgcaaaggcccctggctaaggggtgagaggccgaggagctggggttgggggcatccagacttttagctgagacctttgtttctcaagtctgtcatctttgacactgttgacctacagatcacaaagcaccatgaggtggccaggagctatggaagggacttcatggctatggagctctgtcttcagcttatagagtgggcaggtgcccagagagctgagtaacgctgattaaaagcacgaggtgtgtttatccacaatacatctgctgattggttcatgccctaccccaatgaccatcaactcagggacccaaagcactgttccaaagggatgccagccacagttaactccacggaaagaactggctgagggtttttcagtcatgcctgaaggcctggagagaagagaaagcaagagtgcacccagatgccagcctcccctcaggagccctgcctgtcccctcctgagctacaaattaggcacagacacctggatcccccaccagacctccccaagacgtccatgcccacaggaagcgcataccagccaccatcgcccctgattcccaaatgagggccccagccatctctgtgtgatgtgcagtttcctccatctggccactccaggctcctgaggactccangctcccatgcatggtactggagtgagaacatgtgctccaacaaaaccgcttctgagaggggctgggaggcagcagcaccagccacctgtcctacctgcaggacaggagcagccagcactcactgccctggatgtggggagtgagtttttggtgggccagggtgacatcctggttctgctctctgaggagaccccagttgtcattgtcccacagggccacatctgatgtgtgcacagagtgcaccctctggggctgagagcttcaccayccacttttggcatgagttcaggagcccagaaattgtgttagatgctgaacgctctctcagcctgagagttttttcagcagtacagtttccttaattctggtcagcactttttccagttttgtcttagtcaattcaggctgctgccacagaataccatagactgggtggcttataaacaatagaaatttatttctgatagttctggaagctgggaatacaagatccaggagccagcagatttggagtctggtaagggtgtcctcctcctggtctacacacagccactttttactgtgtcctcacgtggccaagagagagaaagaagagcgctctcgtgcctgttgttataaaggcactaatcccattctcaaggactccatcctcatgccttaatcacctcccaaagaccacacttctaatactcttacatggagactaagctttaacagtgaatgttggaggaacacaaatattcagtcaatagcaagcttagtctatagaccaatgaccaatccaaatatcttatctacatataaactttaggccagagaatgtatgtctgccaccattggccctgatgccccagcctaggggcccgatcctcaggggctggccttggcctcacgtacaggctatcattacttccctcctccctctctgctttgagtttaatttgctaccccttttctagtttcttaaggcagraattttgattactaatttgagactgttttctcatctaatatgagcattttaatgctataacttttcccctaagtactgctgtaamtacaccatacaaattttgatgtgctatatttgcattttcattccgttcaaactattcgttaatttcccatgagacttcctctgacttatggattatttagaaacaggctgtttgagtttcaagttttgggggattgttcaaatattcgttactggtttatagtttcagttatgacatgagcacaaacatcatgatttctgttctttttaatgcactcagactggctaagaatatgttctgtgttggtgaatattccatatgtatttgaaaataatatatactctgctcttgttaggttctagaaatgtcaattacctcaaattctctgagagtgcagctcagttcttctatatccttactggtttctgcctacttgctctgtcagttactgagcaayaagtagcaaagtctgcagctgtaatacatttgtttatttctctcatttttgttagtatttgcttcatgtactttgaagctatgttgttagcatgcatacacataggatgattatggcttcttggaaaattgacccctttagcattatgtaatgttcctctttttctttggtaacagtccatgttgtggagcctactttgacataaatatggctactctagctctctttccattagtgaatatcttttaacctccatatgtctttatatttaaaatgggattctttttcttttttttttttcctacaacctcaacctctcaggttcaagcaattctcctgcctcagcctcccgagtagctaggattacaggcacacactatcatgcccagctaatttttgtatttttagtagagacagggtttcatcatgttggccaggctggtctcgaacccctgacctcaagtgatccacccatctcagcctcccaaagtgctgggcatgagccacagtgcctggcccttacaatgagattcttgtagacagcatatatgtgggttttgctttttcatccagtctgacaattttatcttttaaaagatacgttttgaccattttcatttaatagtattaatgatatgtttggattaaaatccaccatcttgctacctgttttctatgtactgtatgagttcttttttccttttgtttctcttttgctatcttatcttgggtaaattgagctttttaatggttccgttttatttccactatggacctgttatacccctatttttaattgttagtggtttccctagggtttgcaataaacatctttaattaatgagatttgtttttttttttttttttgagacagagtctcactctgtcactcaggctggagtgcagtggcatgatcttgcagsctctcactgcagcctccgcctcctgggttcaagcgattctcctgcctctgcctccagagtagctggattacaggcacacagcaccatgcccagctaatttttgtatttttagtagagatggggtttcaccatgttggccaggctgatcttgaactcctgacctcaagtgatccaaccaccttggcctcccaaagtgttggaattacaggtgtgagccaccacacctggtctaattaatgagattctattttaagtaatattacttgacttcacatgttgtataaggatattacaacagtgtattaccaatccctccctcccattctttgctattatcagacattttatttttacatctgttataaattcataatgcactgctgccctttgctttagacagttatctgttagagcaattaaaaagaagaaaaaaatgaattttcacatccatttattccatttccatcactcttaattgtgtaaatacaagtttctactggtaccatatttcttgcactttaacatctcctgtagttcaggtctgctggcaatgatttgctcacttttatttgaaaaactctttatgtcttcttcatgtttcagagatattttggctgggtatagaattctagattaacagtttttttttttctttcagcactttaaaaatgtcactccattatcttctggcttacctgttttaccatgaaaagtctgttgtaatttgtacctttgtttttctctgtataatgtatcctcttttttctctggctgccttcaagactttctttttgtctttgggtttcagaagtgttaagaggctattataggaatatttgtggtggtgttactttttcttcttgatgttctcttagtttcttagatctgtgttgatggttgtcattaattttgaaaaattcttagccattatttctttaaaattttattttgcattgttctttccctcttctgggatttcatttacacagaacttaaggtgctgatattgtcacacagctcttagatgctgtgttcagtttcccacctcctttttttctgtttcagtttgtgtcatttctagtaacctatcttgaggtttacagatcagattctttgctcagctatatcaagtcaactgaccagcccctcaaaatcattcttcacctctattatggtgtttttcatttctagcattttcatttctttctcatagatttgttctgtatgctgaaattaaccatcaaatcttgcatggtatctggcttttctattagtccttaacttattaatcagttatttttaattccttgtctgatagtttcaacacctgtgtcatatctgagtcttgttctataaactgctttgtcttttatcaatgtgttgggtttttttttttatctttcctttcgcctcataggttttttgttgtcgttgctgaaagccaggcatcttgagtaggacagtaaagactgcagtaaawcacttttattcctggaaagaagcatgcctttccttttgctaggttttcagagtctaggtttggaccagtctagttatgatagcccaggaaggtcacccccatccccagatccagggatacagtgcctgcctaagacagatgcttaatcagagtaacagaagatgacccttagtgcacccagtgtttgttgccctacactctgcagtttaagcttttattccttggtagaggtaggatggaaatatctatggagacactctcttagaactcctgccagtcttttttgggagaaccaggtaggtcctgtggagaggagcctgcaggtgcatgtgaatttcctttatatcttcagcccccagggttccatattatttcactagctgatactgttcctttaccaatttaaccattttagctgaatgattcttactggggtccagctgaattggcccttcttaagctcatgtctgtctctccttggaggcacctgtctttccttagatattggataagtcggtttccctgtgacttcagctgtctggtgggttaaagataagttgtgaatttgcagtttgactggaatgttttcatggtggaacaatgctcttccagcttttcacatcggagacaaaaaccagaaatcttgatttttttttagaaaataagtactcagaatatattcaggctagcatgagatgatgcctatatgtttccaggctaaaagacatacaagaggcctttcaaaaacaaaaacaaaacacctttccggcctttttaggctcattttgaaaagcagttgctgttctagacatttaccaccagagggcaagccgctgcatggctgctcctcactggtaaagccaggtttccaatagggaaatgtcagggtgtacagttgagaagcagaggcatcctgagcagccgctgctcacgaggaggacctgttttcatggcctcctggccggaactgtccctgggctctgcagccccagccctcaccacaggccgcagttgaccctctgcagaaaagccttcctttgagcccctcggtgtcttcagttgtgagcaggcatgtccgtagagcctctcagtacctggcccttcaccccagccagatctaggccgcaaggctgctggacccttctaggtggacaggcactagccccttcaggggtattcccaccgtgcactggagccctgggcagcccaaggagtccattccagccctgctgttgaggggaggagtccccaggaaccccatgatagggaagtgagggtgactgtctggggtgccgtcttagcttaggtggtttatctgaaacaaacaaaccaaaatcacagtgacttaacacagtggaaatctaaaaggagtgttctcaattgtcaggcagctcttcagtggagatctgctgtcttctgcaggcaccatggaaggggagtggggagagacacccccatgcctgagcacatcacccagcacttcccacattgcttctgcccacagaccatggatgccactaggtgcctgttccccctaaatcctggggccngggtggctaagacatggagtggtggctgggctgatgttctccaacagcaattctaccctgggaagcgggtggacagccagacccaaaatgtccaagttgcacccacaggaactgcttctaacagattattcttgttctagaacaatatttcctgaatttgcttgattttaaaagccacaggagatgcttatttaaaatgttgctttttgagtccctttcctggacactttggtttggcccatccattcatgggggcttggaactcccaggagctgcactgctctattctgggaaacattgtggatggggagagcctgtgccaccccctgccccatgagtaagaagcgaggctaaccccttctctgtttgtgtagtgactcatagaactatgggacaggctgctgggcaccacccaagggagacctgtccctgagccagccctgcagccctccctgggtgtgtctgccctgcagctcagatctggaaagggtggccacgtcaaggcagaacccagcaggctgcagcaaagccaggccaagccacccctgacctctcaaatcagagcactgcactttccaatcccaagccagattaatgaaaagcccggagctggtcattggtcagcaaagctgcatttcccttattggcagcttggggaagctggagaagaagaggtgcgggggtggagaggggaattatttgcacccacttttcctcttaagcaacactggagggcagcattgagtcagtttttccaatttcttaccaaatcaactattggtgttcagtcttcgatttgatctatttccttgcctttttgttcttgccatggcacccttgccatgaaccatgggcaccagcaaagaggcaaagcagctggtccaaggtggctgtgcttctctgctgtgtgtgactcccaggtgtggggcctgcaggggagctaagtggagcccatggaggaggctgctgcttgttgcgaggaaagacttggggagaccatctccnagttcctcctgcccttgtccctgacaatgcccttgggaggagtcaaccgtgtcactaggcactcctctcatcaggtcccccagcagctcagaagctcctagaagatcccaaacctgtagataccccctccaccctagcccttctggagtgagccaggatttcccacgggtggtgagtttcaccacagaagttttgtgatgagtcaatccctctgagaaatgaccagccagtggctcatcactgcaatctccacctacatgtgacctcctcaaaaggaccccctgaccccatccgaaaaaggcttcaccatcactgccttctgcctggtgtttacccttccagggctcatcaccacctgacattatgagatgtttgttaacctgcttatctgtccccagcacaggtgagcttcccacgggcaggggcgggtgggtccatgggtcccaggcactgatacagacttgtggcacaaaattacaaaccagtagaggtcagcaacacccttgctcacctgacttgcacattcggcccttctctgggacgagacaggagagctgagccncaggcccacctgcaaggtggcctcccaaagtgtgcctaacctgcctagatccttcctagaaatagcagangcagcaatagcttttttcccattctgctgcccaatggagtatctgccattggacagacccaaagagagccagggtccaggtgacgcttccaactgctctccactgtccgcaataaatacgaaattttaaaaactagcaatagtggttttggtcttcatgctcctgctggcacagatctgtgtagatgtccactcggtgcatttgtcacccagatacctggcttgsgaatttccttgccatcctgcctggggactgccggggctccaagcacggctctgtctcttctgttccagccgtgatccccctgacggattctgagcacaagctgctgcctctgcactttgcagtggaccctggcaaggactgggagtgggggaaagacgacaacgataacgcccggctggcccagtaagatcctactctgtccctttccccagygcccacagggagggctatggctggggcatyctggggagggaatgtaccacccctgctcctcctgggacagctggcatgcaagtggactgggtgctataagggccagctcagaccatttcaataggatattcttctcttgccagccttatcctgtcgctagaagccaagctgaaccttctgcacagctacatgaacgtgacgtggatccggatcccctccgagacacgggtgagcctggctgtgctgggaccagacctggcagcagggtccaggctgctcagctccagtctgaccagggtgcatcctcccaaatgctcccacactcttgcctgcccctgcccggccgcccaccccagccatacccacagcccagtagctcctccacctcctttgacctagccatcccagctgcatgcagctggggccaccctggctatggcttgaagtggctctggctggacctagtggctgtgtacacacatgtaggcatgtgtgcatgcaagcatgcgctcttgtaaagggattttttgtccccctattttctgcagaaggaatcaacacgcccactcagaaaacaagccacaggcaagtcacaacacaaaactatctgctaagatcagaacacaatgtgctgccgcagagcggaattaattacaaaccgtgtgggtcctcaaaaaaagccagggaactgacagcgcgattcctcggcgcccccttcctcccctcccagaggcagcacactggtgggtggagctggcaggaaggtgaggagaggggcctacgccccatgaggctgcctgcctccagagggtccggggctgcccctgcttgcaaacgctgagggattcattttaagcatctgactgattgatgttttttgaaatctcagtagtgaactgccagggaaaaggatttgtaaaanacagcctgcaagtaattggtcctctccagacatttacttaaagtggggytcacaaagaattagtaaaggagtggcatgagtcaaggagtcgggcggtggccagcactgctcagtgctctcagactccagcctctgcctgtacgtcatctcccagggctccatgaggcagggactgataccccattttactgatggcataagtgacagccagtcggtggcagtttgagtcctgcgtctcaaaggcctggagcactcccgtagtgctgtggctgttcttcttcagcacccacatggggagtgatggcagtggctcgagatgtagaatcaggaggctctcgggctgagaatagctctgcctgcaattgccaggcctcggtgccttcatgttagatgcagggctctcagcagacaactgtgggaagggtccttccagccagggactcctgagcccgctctcagtgcgctcctgctagcaccaggcgcacctcccttcctggcccagcccgagtgtccaccctttagtgtctcacgcaccagtctgagacacttcacaccttcctatcccaggtgggaaggggaaaggaatgtcagagtgggaggtggtgagggtcagttctgcccacctttgctttggggtgacctggtcacaggagagtcaccgactcttgaacttgcttgaagggtttgagggggggacaaaaattaagtgggagagcaatgggccttctcccaggctcatcccctggaagccagggacgcctgttcaggtatgagcaccagttcctgcagcacccagcggccagcatgatgggccctgcctctcgtccaatgacactcggtcagaattctctcctcacccagggaggtccctacagagtagtagtaggtgctgcctgcctctctgctctcccacctcttttctcagggtccccccaccccagatatggtcgtgcccccctcagactggttgacctcatcagtgggtctcatccaagaagtgctccccagcgtcaccccaccccacccagggggacttttctgggaatgggaacatcttttttgctgagcgcaggcctatttcagaatcctcctcaatttagcattccaccttgccaaactgagtgagaaaggaactcctgaagcgatttggcatccctgaatcaagggggtgtttgatccaagatccgatgaatgaggttgagtgcaaggtttctgtcccatgcctggcgtgaggtgagacatcttttcagaggaggcacttttgtgcaggcccagtgtcctccccacctgaaggcctccatccttacagaggccagcctgggacctgtgtctggtcaagcaggcggccttgccagtgggggaaggccagagtctgaacctgaccgttctaaattgtgacaaggctctggggaccaagaccaagtagggtatctgcaccctgctgcaataccctactcagggttccagggtaccaagtacctgaggtcccccagagagaaagaatgagtacaccccagcttccctggccagaagacacacgcagttaagaggtccctacatccttttactaccgcagcagatcagagcccactcctatccgctccttcagcaccgcccatccggatgtcacagtcaccagagcgacagtggggactgggacagtgaaggtccagggccctagcctcggcaacacaggggcaaggtgtgtcttcctcgctggcgcgtggacagctcttctctaaccaccttcgatccggccctccctctccacacaggcgcccctggcacagccggagtctcccacggcctcggcaggggaggacgtgcagtccctggccgactcgctggactcggaccgcgattcggtgtgcagcaattctaacagcaataacggcaagaacggcaaggacaaggagaaggagaagcagcgcaaggagaaggacaagacgcgcgccgactccgtggccaacaagctgggcagcttcagcaagacgctgggcatcaagctgaagaaaaacatgggcggcctcggcggcctggtgcacggcaagatgggccgcgccaactccgccaatggcaagaacggggactcggccgagcggggcaaggagaagaaggccaagtcgcgcaagggcagcaaggaggagtctggtgcgtcggccagcacgtcgccgtcggaaaagaccacgccgtcgcccacagacaaggcagcgggcgcgtcgccggcggagaagggcggtgggccgcggggcgacgcctggaagtacagcacggatgtgaagctgagcctcaacatcctgcgcgccgccatgcagggggagcgcaagttcatcttcgccggcctgctgctcaccagccaccggcaccagttccacgaggagatgatcggctactacctgacgagcgcgcaggagcgcttcagcgccgagcaggagcagcggcgccgcgacgccgctactgcggccgccgctgccgccgccgccgccgccgccacggccaagcggccgccgcgcagaccggagacggagggcgtgccggtcccggagcgcgcctctccgggcccacccacgcagctggtgctcaagctcaaggagcggccgagccccgggcccgcggcagggcgtgcggcgcgggcggcggcgggcggcacggcctccccggggggaggcgcgcggcgtgcgagcgccagcggaccagtgcctggccgcagccccccggcgccagcgcgccagagcgtcatccacgtgcaggcgtcgggcgcgcgggacgaggcgtgcgcgccggccgtgggggcgctgcggccgtgcgccacgtacccgcagcagaaccgctcgctgtcgtcgcagagctacagcccggcgcgcgccgccgccctgcgcaccgtcaacacggtcgagtcgctggcgcgcgcggtgcccggggccctaccgggcgcggcggggacggcgggggcggccgagcacaagtcgcagacctacaccaacggcttcggcgccctgcgcgacggcctggagttcgccgacgccgacgcgccgaccgcgcgctcgaacggtgagtgcggccgtggcggcccggggccggtgcagcggcgctgccagcgcgagaactgtgcgttctacgggcgcgccgagaccgagcactactgctcctactgctaccgcgaggagctgcggcggcggcgcgaggcgcgcggggcccggccctgagcggcgcggcgcggcgcgggcggcgaggttctaccttcgaggatttcttttccattgtgtcggtgtcttttttacatgccctggtccaccggaaggccggcgcctcctctgtcagtgccgtgtacgtgtttggtcaaacgttcctaatggtgcctgaacctacactgacgccactcaggtagtagacggataggaaacaagtcatactgttggaagtgggtgtgctagcctagcatctgcctcgtacctgtggaaactcaatagccattgcaagagtatttttgttcctcagtaagagaaataaagaaattcgcagccctttgttttaagaagggagtgttttacatgctttttttgcttttttttttttctcctaccctagcgatgacctcttccaggtagcggtcccttgtgcgcggttggtagtacccagggcttagagcgagcgcgcacccggggctgcggtggaggctcctctgtgagctctacctgcctcccatcccgaggcctaggagaaggcgggtacctggccgccagctgacgccctggtggtcactgtggccctttagaaacacacagctccatttcataagcaaaacctcctcccccagccccggctcaagcaccattcacactgccatccaagccgcgggcggccgtggaaagggcactggaccacccgtctcgcgggcgccgtgaggtacagcgatggctcccagtgccgggcagttcaggtgacaggagctttccaaagacacctagggtccaaaaagcagggttcccatctcacaatttggatttgctcatagaggagcagataggacaggctgctcacatttctcctttgaaggcacttccacagtggactgtcgctgncgggcccctgggcggtgaccatcggtgccccgggagacagcgaggaattgaccctttggtcactgtgtaagcccccactaggctgctgctctttccaaagggaaggggctgggggaaccaggaaggaagcccacccccacacctgcatctgtctgggttcagccaggtaaagggactcactgtgatcgtggcccctccacggggcaggacgaccctgcctccgtctcgtgacacaatgagggagcagcccgatccctgagcggtctcttttttggtgcctcctacatttcttgaggaaaaaaaaaatgtgtccttagctaccctgttttgagcagcaatatgcagcctcttccttccaagattacctccggagaacaccgttcttggccaaggacactgaggagctaaatctgcctcactaaggaacgagcttgtttccaagaaatgaggataagatgggtaaaatcctcactaacaaagaatactataaaacctgtgagagccttagaatagcttctaataatcctaggacaggagaaagcgcctggctttgctgtgagtgtatcctcagaaaaagcaggaggtcgaccatctcttcactggagccagcttctcctctagaaacgatgcttttttccctaactaaagagcagcaaaaacaaaaaaaaarggggggcgaggggattttttttacttgtttgagaaattataataaaataattgagtatctcctgtgagtaatgcctttttgttttyaattattccacagcaggtggagttttcagtaatttgttcaagttttgcataagtggttccttaaatcaaaaattatttattaaataggatctttaagaaattttttgaaagttttacttttcctgctgaacaatattttcaatgtgtggtaattactgtactawcatccatgtccctaatattactggggtttcttttattactcagaaaacaaaagtggttttttaaaaatctcatggagagggtctgtggcagctttctggactgattcttcgtgtcacgctgagcagctgctttggcatccaaagctgtgggatcacagaaagtgttgcttcaggtgtggatgccagccactcctcatgctcgtcactcttaaaagattgagacacccaaccttaaaaatgctccaataatccattcagaaaccaaactcatatgcacaagatgtcaaggaggcataaagtcaattcttgcttgtttttttcatttcttaatgtaaaaacagccaaccagaaatttctaaaactggctatgctaattcagatattttctttctcacgctatctgccaggtttgtctaatttaaaaaataaaaaaataaaacagaataaaaaccgtccattgtaatagaggaaaaccttccaaaccaggcagagtacgtaattatcaaaacaccaggacctattctacccttgcatttccaagttacctccacccatcaccatctgatgacagatgtgccctaaataagagcctgagataaagccactggctgcatcctgcaccccagcttctcaatgtggtaacgaggcgccagacgcctgtagacacctgctccaggctgatacattaccactcagtccacatgacttaggaatagccatttccttttgtgagagagctggatccatccttcctctaaacagtattaaaaatgcaaaagggagagagcsgatggtcatattaaatgtgctagtcccgtgcaccganagcatgctccttgagaagaggcgtgtagacctcgtccctggccagagaccaacttcagcaggctggccagaaactattaaaaactgtgttgactgcatgtgggccaagggcttccctcgtgttccatggcgtgagggccctttgtggagcagggagaaagggaagaaggtgagtcctaccggggtgcatggccctgctgccctagctgaccctgcctgagagcagccttccccacctgatctggccacacttccctttctaggaaggacaggtgtctccaagggactgcaggtttccagaggatcccagatacttctaaacccctgcgaaggttatttcagaaatttactttacatttcctgcacatttgttatctgggtaaatgatttttttaawatattgttaagggaaggtgtttttcagtgtattctgttggtagantttatgctgtgttacgttgaaattttacaagccaagtttaaactgtactataaaaattatttttgtattattttcagaacatgccacagagcaatattttgcaccygttattgccacagggttgtcccttggaagggtaactggaggtgggaaggagctccactgtgggctccggggggttaaacgctttttgctgcttgttcaaataccttctgaaagtgggaatgtatcagtgtctttttttattgaaagcttgatttcctwttttctgttcatggattttggtactgcacctttcctcttaaatgaatactttgtattcactaaattactgtggaccttttcatacctattaccacccagtggcatttgaatctatttacaaatcgaatgttttcccaaatgatttaatttactacttctcgtagcttactgtcaagaattgggggtgctgaagataaaaggactctccatgccccccaggtgcacacctcagggtgtggacatcctccatgcagagcccgccctgtctctggggaggggtcatgggcccatcaccccccccccccacttagtgtccacaaacttattttgcgaactattctactttgcaaaaataaacttaaaatatacttcccattggttaagataaaagggctgtacttatcagtggtgggaaatttgtacaagaaaaaacagacttttccaaatccatgtgtgtaagttccattccatgtgagtcttttatttacgaagagacctggagtraaagctgaaggcatctactgtatgtttggggctcctttctttatggccatgattttttttctyctcatcttggtgtggactttaaaattaagtacccccagtgttctgtcctttttctttcctcagtgcttctaatagrtaagaagaaatgtgtttctgtggctgagcaagccctgctgggccagacagaccttaccagccctggcttcatcctcgctgggctgcagaggcggcccctgctctagttgagtccggttctgctgccagctgaggacagacacaccgtatgaagggcctagaggtggctggcatgccagggagcaggtggccccttccaaaacgccttaaagtggtggctctctagagatctgaggcaccaccttcccatttactcctgactctaaactctagctggcctgttttagtgtggctggccggggcagtgaccagcgctcagctttgttcttgtttaattcaagtccaccctgttgcccgtgtcctctccacagctctgggtctgttggcccggagtgtatttctgccagtgctgcctcactgactcgggagtgggtcctgggtagttcacgatagagaggccagcacacgccatggggagagccccccacgctcaccccaggaggccctgcggcacatccaggctggaccactctgcaagcttctgtcacaaaagacagctccgggcactgtgcaaattggcctgttagcagttatgcaggtcccttctttgccaaaagatctattattcctccccactgcacccccagcagaaaagagcgagggagatgccctgcagggaccccttgggaacaacagttatgtgcagtctgtgcagtatgaagaacttggccccaccaggctgagccgaagacacacgtagttgcagagtagcactgaagccatcatctccaaccatgctagtaatgttactgtttctatttattttgccaaatgatttgttgaaaattgcatttttgctattttaatcttgccaaaaaagggggcctcactaatcctaattatgtacatacagaatgatgcacattgcttgcatctttttattcctcccaaagagcatatcaaggatatatatatacataatttgttagtttaacataaggcgaagagtaccatttggttttaagagtaaatataggctgaatttattcaagaccaaagcaacctatttaatgaggacaaatgagtgaaaccagctgttttagaatttatctgcagacactggagtgctcctttaaacgaagaaacagcctcccatggcagaggaaaagccaggtccttacaaaggcctctcccatcccagtacttcttctgcctgctgctctgccctgggacgtaggccttcctgccgtttctagtcacaggcaccctcctgcctcagggcctttgcacatgccattccttctacctgaacattcttccccagagagccacatggttcacccctcactacctgccagtctttgctccaatgtcacctttcaacgaggccttccctgacttatttaaaaggacaacacaccccaccctccctccctacccacctctctgcatcttcttcttgtgcacctatcaccatctgagtgctgcagatgttaatcattcatccatttatttgattctcgcctccccatctcccatagactgtaagctccatgtgggcaggaacttttatatgtcttgctcattgctgtatcctggtgcctacaacagtgcctgacacatattaggcactggataagtatttattgaaaaaaggaaattaaatcagtaaattgaaaactattaagaggccagaaaatgtcaatttcagctttcatcaaatctaggttctattattgtgagaactttagctgacccagtgacctggctcctatgggtacaagatggttagatacaccgggcagcagcggtggcttctgttcacagacaagtgaatgcctgccctgccgctagccccacctcacaaatatgaggctcactgttcgcaggggagcattttggaaccagctgggatgaagacagttttctgcaggtagcttttgtagccagatgcacagtagtgggttcccatcactccatgaggtcactgtagacctggaccattccagagaatcctttgtaatcagtctttaggtgtctcccagtccttcccagttcaacacgggtggcagcagatggcccagcccagggaaagtccacctgaccattagaaggactcatcctccagccaccaaagcaaggctgcagaggaagaggagcttgtcacaaacattaaccggctcagggctgggtaactgcattgacaaatttggaagcagcagggccagagagccaaggcccccgggtatccccattggccactggtggaggtgcactggaaggtcagggccttgacaccacagagccaagcaacacacacctccttgggcccaggccccagcacggtggccctccagtgctggcaggtggcctcacccacagcaggggaggcgtgggtcctccaatgaccttcctgcccctgccagatgattttcacaactacctaactttggtgtttacttctaggtcctttggccaaatgcgttttcttctaagagttgttggcaaaatactgttacaagcttcttatgggacttttgtcctactgtggcctggttaaaggctttgtcctcctgtttaatccacttccgtggttttgctgtcatttctcttgatgccatattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaagcctgctcctgccagcactcagggagggagtgtgtgcttcccaagagcctgcccccttggcccatgcaaactttctccatggcaggtgtccgtgaaggtctcccaggccctatgggctgtccagctctttgcacacattcttcccgcttgcaggaatggaatccaaacacctgatacggaatgatgacttggcagtggggagtggggcagcttgtctccgctaacttaggaccaaaactaggaaactcaccatgagcatgtgttggagatcagctgtggcctccagcccctgtacacacagaggcaagccccacctctgacagagccagtcaccgttcagtaggagcttgtcttccctgggcccccaggtgggaaaggctgggctcttagtcctacaagtaaaggcgctgttaggagcaaggagcaggcttagctgggtccacagagggactaagctccttagtgacctgttactgcctcatctacggagtttgaactccattcaccatcacctttgagaatttggccttgttttaactaaggattgttgaagttaattataacaagggaccatcctcaccctgtgtttgctttgttccattaaacgtgcgtttggcctaatgaagtcagtgaatgttcctcttttttcttttttggtttctttgactgatttttggatgatatatgttgctttatttctcccattttctttgattactgtggacaaaggaaaacactgaggcaaaagtaggtcgtcaatcacattactttgacccagttgtgcagaacccctttctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcactttttatagaagaattgtatttaatttctttcttttatgaaagattatttcaagtaaaaatagctctgtaatctgtgtgacatggcttctccattacctgacacagagagaagctttgatgcctactcaataaaattaacatgtttgtaaagtattggttggtccaattatttgcccactgactcctgtgttcttggtaaaatgccatctaagaaaagctttattgccaagaggaagaggactatatcagacatccatccataccagttttgttttgtttaagtgttttcccagccagatgagatgtaaacccagttgtcaccatttcattctcttttttttttttttttttttttttttgtttgagacggagtctagctctctgtcacccaggcagtggcgtgatcttggctcagtgcaacctctgcctcccaggttcaagtgatattctcctgcctcagcctcctgagtagctgggattacaagtgcgcaccatcatgcccagctaatcttttttttttttttttgtatttttagtagagacaggttttcactactctgttgttggccaggctggtctcaaactcctgacctcaagtgatccacctgcctcagcctcccaaaatgctgggattacaggcgcgagccagcacgcctggccaagtttcattcatataagaggaaaatagtttctctcctttctaaaatgaccatgacacattctatctggatgaaagctgtatttagtctgttttcacactccggataaggacatacctgagactgggtaatttctaaaaaaaaaagaggtttaatggactcacagttccacgtgtttggggaggcctcccaatcatggcagaatgcaaaaggcaagtcttacgtggcaacaagcaagagagaatgacagccaagtgaaaggggaaaccccttataaaaccatcagatctcatgagacttactaccacgagaacagtatgggggaaaccgcctccatgattcaattatctcccaccaggtccctcccacaacacatgggaattatgggagctacaattcaagatgagatttgggtgggggcgcagccaaaccatatcaaaagctgaatagggttgtccttaacatgtcttcaccagaggttgcaaccataagcaagagaatggcagctgggagcatagaggaggaggaggaggattttgccgtgaatttttatctgtgagtgctcttctatggaggagaggcgctgcctctgtaaaagaaagaagccccctcaggaagctgtgggtggggtccaggccacaggcctatctaaagaaggtgtgatgcacccaggactcagtcccaacccactgtgtgccatgcactgggacagtgatggaggaggtaatgacagggtctcacgcactgaataggcatcattggggggtggcacattctgtgcctagtggaattcaatccatgcagcaaccgtgtgagatagcaaaatctctgtgttgtagagaagaaaagtaaggtttggcgaggtaagtcgtaaagccaggattccagctcaggtgtgtctgacatgagggtctgtgctcccagcatcagagtacattgtcatcctgaggaatgggcaaggcccctgcccaggaggagctcagagtctgggggatggtgacacccaagtccatctggctccaggtggggggtgagttagcacagatgggagaaggacaggaaagatacctggcagggctgtgggatttgctggagccatggccactacatacccatggaatcctgttaaggccaatgggaccatccgtttctggctctaatgtttttctacacgaggaaacaggaaactgttcttagtttgttcaggacaagcagagaatcccgtatgaaagacaaaatactgcatttgaagctttgaaatgtgcttagaagactatataggatggtggtaggaaccctggattgggctggccccagaattgaccttgaggaaggcatctcacccctccagccccaggtttctgttctgtaaaaagcgactcaaggctcttgaagtttccccaccaaatcaaaaaatctgtgtattatttagaaaaacagaagtcacctcagttattttgacagagaatttagtataggaaactagtcaagcaggtattggaagcctaaaaaacacaaaaaggagacatacacgtcccacggagagaacatacaggaagcagcttcctcacagggtcaggggcaaagcaaagagagcatgttgttaaaatccacaggcagatagggcagggctccaccgcgttgaggtcagacctttgaaaagggagctcttr

SEQ ID NO: 10824 - DNA, 90853 bp, Homo sapiens
tgtgcggcaagggctgtagccggagctagcggacttgtggccactgaggagcttctgcctgaacgtgccctccaggcgacagccgcttggtgcgcagcgcctgctcgctaagcgtcaggcccttgctgcgccctacgccgcaggctgggaagtagcgcaggcagtagtagtacaggcagcggtaaagctcctccttgtagcttattggtgtcggcggcctggtctgggcctgcggaccctaacccaccgcctgctgacactgaccggcagtctgtggccatgcgtctgcgcatgcgctctcctggaatacccagccgctgcgcctcgagttccgattggttctacagaaggggcgggcctgtgagatatcacaggggcgcgcctcagctgacgtcacaggcgcgggccttccggcgtcgtaatagcgccggccttcggcgacgtcacagtggcgctacagtgcctggagctgcgctggtttttcctcggagtggagcctggtaaccgcgacttccccgccatgttctgtgtgttgctggctggagaagggtggttgacaaactccgacccagcacagtgtttctgtgggtcaaaactagaaaactatgtccaggctcggccgaggcggaaggatccgttcaggccaggagttaaagagctgcctgggcaacatggcgcgaccccatctctgtagtcccacctcagcttcccagatacttgaaccccaaggttcaaggctgcaatgagctatgatcccatcacagcactccatcctgcgagacggaggtaaaccttgtctaaaaaaataaactatccaagtgtacaacagggagggactgcttaaagaaaacatgataattgtatgttcaaatacttttaacaagtgcaaaatgtataggctgaaataaatagggctggccgggcacgttggctcacgcctgtaaattccaacattttgtgtgctcgaggcattccgatcagtagacatgggtgaaaccccatgtctactaaaaatataaaaattaggccaggaactttgcatcgttttagggggctcgcatctccctaagggcccggtaattgaaccccttggacctgagggtgagaaaccttggctcagttcttcccagggtgatcagcccaggggtaagcgaggagagaccagaaaacaggacccatgagaaggtccccctcctggagtttgaggcccattccttcttgtccctgcgtctcctctttccaggactcctccctgctctgccccactcctgggagtggggtcatggccatggggggctgcttttgggtacaggccccagcggcaaccctgggcccaaagtgggcaggctcacctggaggggatcagagtcacatggcaagacgcaaggggaaaagccgcgctggaaccgcacctctctgccccctgatgtcagtgggtgcactcttccctcacctcactcaggcagcggcttgagttccatgggagcactgtcctgctccctctgctgcctctttttagtcttggggctactataacactttcccttccccagccctgccaacctggtgggacattgggcttccctcttcctggggacaggcgggtcctggggacaagcctgtcctgtatcatacctgcagcgagactctttttttctccaggacctgcggagcagccaggcttcatgagttaaatgcagatctgaaccatacccagttgggattggggtacacactctactcctctgaaaactagctaggggttcgaacttggtgagagggagagtgggacagagccagaccagacaaggactgatcacctggaaaaacctgccatcaaagaccttgacgagtgctgggggcggtggctcatgcctgtaatcccaacactttgggaggctgagacaggtggatcacttgaggccaggagttcgagtcccgcctgggcaacatggcaaaaccctgtctctactaaaaatacaaaaattagctaggtatgctatgctcctgtaatcccagctactcgggaggttgaggcaggagaatcgtttgaactggggaggtagaggttgcagtgagctgagattgtgtcactgccctccagcctgggtgacagagtgagactccgtctcaaaaaaaaaaaaaaaacccacctgaagaaggtttccagttctgccagcagtcccccatccaacccccagaagcagacattcctttgctgtgggccatggacaggcagaaggaagcgcctcctcatggcagaggcctacccaggagaaacccaagggaaggcactgcctggccagcccctctgccaaagccattttcttttttccttttttttttttttttttttttgagacacagtttcactctgtctcccagactggagtgcagtggcatgatcttggctcacttcaaccttcaccccctcccccgccccctgccgggttcaagtgattcccatgtttcagcttcctgagtagctgagattgcaggcatgcgccaccacacctgtctaatttttgtagagacggggtttcaccatgttggccaggctggtctggaactcctgacttgaagtaatctgcccacctcggcttcccaaagtgctgggattacaggcgtgagccactgcgcctggccccttcaggtgggtattgaggcttcactacaatactagttccccgttgctgccgcaataaattaccacacacttagtggcttaaaacagcatagaggtattcctttacatttctgaaggccagaattctaaagtcagtcccactgagtcaaggtgggagcagggtcagtgcctttccaggctctgcgggagaatccgtttcctggccctggaggcggcctgtactcctcagcttgtgctgcccttctcgaatgactcgcgtttcctgctttcatcactacacctcccaccgctctccatcacctgctctgctcttataaggatccaggtgagtacataaaccctgtggggacaagctggccaaagactcttaacttcattatacttgcaaagccccttttgccatataaggtcatgttcactggttccagggattatgatgtgggcatcttgggggcatcagcctactacagctaggctgcaaaactattacaccctcctggtgtttcaatgattgggagaaaaagggttgggattttttgctttggggtccctgttaaacttgtatctgtaaggtctggggtctctcttaacctggtgtttttgtttttgttttttgagacggagtattgctctgtcatccaggctggcagtggcaccgtctcggcccactgtaacatctgcctcctgggttcaagcaattctgcctcagcctcccaagtagctgggactgcagctgtctgccaccacacctggctaacttttgtatttttggtggagacggggatgggactggggggtcggggaggggagggggggtttctgctgtgttgaccttagctcaaaggatctgccctgcctctgcttccaaagggctaggattacaggcctgcaccaccaccactgtaaaatcttatttccacacagctgagacatgttttaggaagtttgctaaaagacccctggagacctcattgtggcctccctgctgttgtgtttaatttgattgatcttctctgcccttctgcttttcagaattaaaagactaaaaagaggtactaaactttaaaacttctcttatagtctccctttaaagtaattctaagaaccaccaaaaaggggaaaaattttttcaaaagcagtaaaatgatatgatctgttaggatgtaaaatatagaaaataagtcattatatgttattgctgctttgacatagggatgtattgagaatcaacttttggtcaattttcagagaaatggaataatcttattgctgatctatgtaaacaagttgaagaattgtctgaaagaaaatacagtgtgtctaaactggaaaagtcctgtaatagtttgttcatgagcatttacacagtggagttactgttcatcatgggggtactgtggacaagcccagggctgctggtgagtcacgccatccttacacgtctctccttgtaaggtactttgtagtgtctgtctaaatattagaaacattctttgtttctagattactagaaagctaaggaaaagttgtatttctctaattatcaattagcatttcttttaaactttcagcataatatttgggatttatttacatgcttattgcaaatccctggatcttagggatttaattgaacatatatatatatatatatatatatatatatatattttttttttttttttttttttttttttttgagatggagtctcactctgtcgccgaggctggagtgcagtggtgtgatctcagctcaccgcaacctccgtctgccaggttcaagcaattctctgcctcagcctactgagcaggtgggattacaggtgcccaccaccacgccccactaattttgtatttttaggtgagatggggtttcacgatcttggccaggctggtcttgaactctggaccttgtgatccacccaccttggcctcccaaagtgctgggattataggcgtgagccaactcaccaggccattttttatttttttaaactaattgtttctctcaatctgctttgttaaatttgttatttggccaggcatggtggctcatgcctgtgatcccagcactgtgggaggccgaggcaggcggatcacctgagatgggagttcgagaccaaactaaccaacatggagaaactctttctctactaaaaacacaaaattatccgggtgtggtggcgcatgcctgtagtcccagctacgcaggaggccaaggcaggagaattgcttgaacctgggaggtggcggttgtggtgagccaagatcacaccattgcactcttagtctgggcaacaagagcaaaattctgtctaaaaaaaaaaaattcgatattcatcaagatgcccctattgtctctactttttatcttgatgcattgccgagttgacgttagatttcaaattcttctttgcccttatactgttctatcctaaagccacctttatataatgatgaaagaaattagcaatttgttgttatctctttgatggtatatagcaaatgcttacctaaaaatagcaacaacctgcgaaaaacatcatgtgttttgccgtttttatttgaatgactatttactttgcagtctactagcaagctatagaattgtgtgatacgcagaattttaactgaagtgctttaagtgaacatttaaacatgataaaccatattaatggtgtttatgttaatatacttgaagtgaacattttctcttcatcatgagtaatataacgtacccctcaatgaaagtctagaattagagtaaatttgctaattaattaataacttttccataatatttttagttatgtgcttaaggctcttttagtgtttctcctactttttaatagcttatgccttttttgcctttgttttttattggttcattttaaagcaaaaacctcataacgtgttatttggaagcactgtaacctagtggtgagatcataggctctggggacacagcctggccacatctcttctccttctgagccttagtatcctcttttgtgttcatgagaactgaagatttatcccaaagatttgataagatagtaaagtgcttcacataataccaggcatataaatacatagtaaatgcttccttcttatgtttttattggttgattgattgattgattgagacagaatcttgctctgtcacccaggctggagtgcagtggcactatctcagctcactacaacctctgcctccctggttcgagaaattctgctgcctcagcctcccaggtagctgtgattacaggcgtacatcactatgcccagctaataccagctaatttttgtatttttagtagagacaagagtttttccatgtaggcccggctggcctcgaactcctgacctcaagtgatccacctgcctcccaaagtgggattacagatgtgagccaccaytatgtttttattatattgttaatttagtactattctgagtaaaaataatttgctattacagtcttataaattgactatgacaattttataaatgtcaatgctttttgtaaggtgaaacattaatgttgtggggcttttgttgtgatggtgatttattagattattttgtttaaagacaataatgttcagctgttgtgaaattacaaaaacaatcttcacatttcataattttaaagcaatattaatggtaattaccttagagaaagatagttttgttgtgatatataagtatgatactgaagtttagtgtacagcaaaggatattaaacctaagtcagcactaatgtgttatatagtacacttgaaactttagtatagatatcgatgtttagcaaatagacattgacacataatgatagcaaaaaatggagctgttctgatggaagaccgttgattatgtttgattttaatacttcccatgctcttgacctttttttttttttctttgagagagagtcttgctctgtcacccaggctggagtgcagtggcaccatctcagctcactgcaacctccacctctcaggttcaagcgatcctttcacctcagcctccccagtagctggaactacaggcgagtgccaccttgcctggctaatttttgtatttttagtacatatggggtttcaccatgttggccaggctggtctcaaactgctgacctcaggtgatcaacctgccttggyctcgcaaagtgctggggttacaggcatgagccaccacacctggtcagctcttgactctttatagctgttgtattattttaatcttgagtaaataaatgctcgctgaaatgttgcagttcatgagaatcttcttctgttatttaaaaaattatttgtaaaagtccaataaggttacactaatgtttmtgttttgaaaatattacctcttccatttagtactatatgtrttaaataaaagtagacagtttttttttttttkgctttataatgtggttcagatttttttaraaagtctggctgtgtctacattgccttaaagcaataggatatttctctttatttatttatttgtttgttttttttgagctagagtttcgctcctgttacccatggtggagtgcggtggtgtgatctcggctcactgcaacatctgcctcccagattcaagcaattctcctagctcagcctcctgagtagctgtgattacaggcacccaccaccayaccctcctaatttttgtatttttagtagagttggggtttcaccatgttggccaggtgggtcttgaactcctgacctcaggtgatcctcccgcttcagcctcccaaaatgctgggattacaggcatgaaccaccttgtcccgccaggaatgttttttaagaaggctatctacttacagaattcctggccttgagaggatattacttggaaaggaaaggatttgttttgtgattaaaaagtaagactcttggattcttgttggactcttatctctgttctgagtaatatatctttgttattgttgacaaataatcattccccattagggttatatttaattaagtttgagttattttatgttttttgttgttgttgttgttgttttgagatggagtgttgctctgtcgcccaggctggagggcagtggcatgatctcggctcattgcaacctccacctcccagctttaagcaattctcctgcctcagcctcccgagtagctgggagtacaggtgtccaycaacatgccccgctgatttttgcatttttagtagagacggggatttaccattattggccaggctggtcttgaactcctgagcttgtgatctgcccgccttggactcccaaagtgctgggattacagacttgagccaccacgtccgtcctattatatgtatttttatgtatcactttttaatttatttgggtccaacattgagtcagtcatgccagtgttagcttttgaaacatgaacactgcccgcacctgactggcatgcaactgacattttctttcacaattttctgctacttttgctaaaaataataatatccatgtcttgcttttaggcctaagatttttatagcatatgtgggaatatatgattgtttttctagatgtgtagaggaagatagtcttgaatgcagtgtgatattaaaggatcccatttaagatttttgtaatatgcttcaaagacctgtgggttgcaaagttaccacttttgagggcacatgctccatgaagcaccttatgtgacaatttacaattattgttttgttttgtyactctgtagaaacctcaaatgaaggtgtagttgggctcaagcatccagattatcttttctcttcttattttttcttcttttcccaagatggagtcttgctctgtcacccaggttggagtgcagtggcatgaccttggctcactgcaacctccgcctcctgggttcaagcaattctcttgtttcagcctcccgagtagttgggattacaggcacctgccaccacacacggctaatttttgtatttttagtagagagagtgtttcatcatgtcggccaggctggtctagaactcctgattttgtgatctgccagtctcggcctcccaaagtgctgggattacaggtgtgagcgatcgtgcccagcctgtcttgtcttttcaaaaccatccttggtgattcaatgttaaatatgtactagtggatgttactttgctgaatattgcctagtgaatattaagtattctcacctttcagacatgaagttatgaatttaagatgtgaagatttacagcttgataaaccagcttcaggaggtaggtcttcagtcttaagtcagattggaagattatatgcaggccggccacagtgactcacgtctgtaatcccagcactctgggaggccgaggcgggtggatcacgaagtcaggagatggagaccatcctgactgacaggatgaaaccccatctctactaaaaatacaaaaaattagacgggtgtggtggcgggcacctgtagtcccatctacttgggaggctgaggcaggagaatggcatgaacccaggaggcggagcttgcagtgagccgagatcccgccactgcactccagcctgggcgacagagcaagactctgtctcaaaaaaaaaaaaaaaaaaaaaagattatgtgcaataattatttaatgcttaacattgtttttttttaaaatggtaccttccacatgaaataatatgcctgtaactattaattatgttccaggataggagaattcatgttgtcaaaattctttttttttttttgagatggagttttgctcttgttgcccaggctagagtgcaatggcacaatcttggttcactgcaacctctgcctcctgggttcaagcaattctcctgcctcagcttcccgagtggctgagattacaggcatgcactaccacacccggataattttgtatttttaatagagacggggtttctccgtgtttatcaggctagtctcgaactcccaacctcaggtgatccatctcggccttccaaagtgctgggattacaggcgagagctactccgcctggcctcacgttgtcaaaattcgaatactctctaaaacagtgaactcattttctttttttcatctcttaattgttagatgtgttttgaaagaaacagaagtagaattggttttcatacttgttttgcttctggagtgaaatggggacaaaacaatggaatcacactgttaagatttactaaaatggaaggattgcagcaagatcatatccctagtctccccatagcaaatggcacctgctagctgttcttttttttttgaaatggagtcttcctctgtcacccaggctggagtgcagtgctgctatcttggctcattgcaacctctgcctcccaggatcaagcaattctcttgcctcagtctcctgagtagctgggattacaggtgcacgccaccatgcttggctaatttttgtaatttttttttttttttttttgagatggagtcttgccgtgttgcccaggctggaatgcagtggtgcgatctcggctcactacaagctccgcctcccgggttcataccattctcctgcctcagcctcccaagtagctgggactacaggcacctgcgaccacacccggcgaattttttgtatttttagtagagatggggtttcaccatgttagcgagaatggtcttgatctcctgacttcatgatccacctgccttggccttccaaagtgctggaattacaggcatgagccactgcgcccggccctaatttttgtaattttttagtagagatggggtttcaccatgttggccaggctggtctgaaactcctgatattatgatccgtctgcctcgtcctcccaaagagttgggattacaggtttgagccactgcgcctggtcataatgttttctataatgttgttttattttaggaaagtaaatacaatgagtaggacacagctccacgattctcttaactgttttkttgttgttgttgttgttgttgttttttgaggtggagtttcactgttgttgcctaggctggagtgcagtgctgtgatctcagctcactgcagcctgtgcctcctgggttcaagcaattctcctgcctcagcttcccgtgtagctggggttacaggtgcctgccaccttgcctgactaaattttgtatttttagtagagatggggattcaccatgtttgccaggctggtctcgaactcccgatctcagttgattcacccgtcttggcctcctaaagtgccgggattacaggtgtgagtcactgcactcatctgtaatgggatatttcactgcagactttgataaacagaatattagcatttttggtggtgtttttattttactcataatatttttcttttgactcaattacaaaaacaagtgaagttcagattataaaaattaaagagcaatacagattcaatatttttttctacatattgtgtttaaatgatatccttttttccttttgtccttatagctcaagctgtaaaagccaaaggtccaccccttttttccagtctcatgttgaagatctttatgtagaaggccttcccacaggaatttttttttttttttttttttttttgtgtgacggagtttttactcttgttgcccaggctggagtgccatggcgccatcttggctcactgcaacctctgcctcccgggttcaagagattctcctgcctcagcctcctgagtacctgggattacaggtgtgcgcctccaagcctggctaattttgtatttttattaggaacagagtttctctatgttggtcaggttggtctctaacttgcgatctcaggtgatccgcctgcctcggcctcccaaagtcctgggattacaggtgagagccactgcgcccagcctgttttatgtatttttatgtaccactttttaatttacctgggtccaacattgagtcagtcatgccagtgttacctttcgaaacatgaacactgcccrcacctgactggcgtgcaactgacattttctttcacaattttctgttacttttgctaaaaatagaatagtatccatgtcttgtttttaggcctgagatttttaaagcatatgtgggaatatatgattgtttttctagatgtgtagaggaagatagtcttgaatgcaatgtgatattaaaggatcccatttaagatttttgtaatgtgcttcaaatacctgtgggttgcaaagttaccactttacttttgaggacacatgctctgtgaagcacgttatgagacaatttgcaattattactttgttttgttactttgtagaaacctcaaatgaagatttagtggtgctcaagcatccagattgtcttttcttttcttaatttttttttttcccygatttggagtcttgctctgtcacccaggatgtagtgcagtggcatggtcttgacacactgcaacctctgtctcctgggttcaggcgattctcctgtctcagcctcccaagtagctgggattacaggcacctgccaccatggctggctaagttttgtatttttagtagagatgaggtttcaccatgttggccaggctggtcttgaactcctgaccttgtgatctgccagcctctaccttccaaagtgctgggattacaggcgtgagccaccatgcccagcctgtcttttcttttcaaaaccacccttggtgatgaaatgttaaatgtgattaaatgttaaataaatactagcggatatttgctgaatattgcctagtgaatattatttattctcacctttcagacatgatcttatgaattcaacacatgaagatttacaacttgataaaccagcttcaggaggtaggtggcacaccccaatcagtcacttgtgcatccagaagggagggaacgtgtttcaaatatgagtaaaggcagggaggtgtcaggtatgctcacatgttcacatacctcacctattctgtgtggagtgaggagtgccatgtgggcattgtaggattgcatagatagacttgggtggccaagtggaggaaggccttagatcctacaaaagcagtggtagtcattaaatggtctcatagcacttctctcttaaaataatgtggatctgtcctttagaaagattattctgggttgattttgaaggataacacagtgggtagtttgagtgtggggggtaggaacagaaggcctctctctactcatggaaggaatgttgaagtgggcagagtcttgtttactgattggggttgtgtatctgtgtatatttgttgggactgagttataagggagaggaaaggtttaagatgatgcaagctgcttctggctgtgttgtgggacagttcatccaagattcagaaacagaattgagctggtttgggggaaaagtgacttttgcatatttatcttataaaaaagatgactttggagacatctagatggtctcacctgagtgtctgaaaattgctattttcaaaattcaagtcaccagaatgagttttttcactgtaaaatgaaggcagagtggaccatgtttaaaaattggctgggcacagtgactcatgcttgtaatcccagcactttgggaggctgaggcaggtagatcacctgaggtcaggagttcgagaccagcctggccaacatggcaaaaccctgtgtctactaaaaatacaaaaattagctgggtgtggtggggcacacttgtggtcccagctactcgggagtctgaggcaggagaattgcttgaacctgggagacagaggttgcagggagtcgagattgtgccattgcactccagcctgggtgacaraatgagactcagtctcaataataataataattattattattagcagtgcacagctgtgtgagaaaggcctatagatttcttctaaatgctttattataatactaatatcaactatgtttttacagatcagaacttcttataatacaactgacgttactcagcctagaacaaatacaacaggtaacatagttgtgaaatcctttttaaaagcacagattaatctttaagcttttaaaaattaatcttttaatttgatggaactgctccttccttcacctccccaaaaaatcttttgctgaagctcgatacaggcactccttgatttatcaatatgaacatgtgcagtgtagggatcactcaagctttttttttctttcttcctttttttgatacagagtctcactctgtcatccaggctggagtgcagtggtacaatcttggctaactgccaccaggcttaagcaattctccttcctcagcctcagcctcctgagtagctgggattacaggcgcgcaccaccatgcctggccaaattttgtattttgtgttttggccaggctggtctcaaactccttcgctcaggtgatccttctgcctgagcctcccaaagtgctggattacaggtgtgagtcaccgcacccggcattaatgtactctgaggatgctgacttccagatagccatttttgggtcaaggaaagttcaagtctcctgagtatagtagccatacctcctagagagcttccttttggtttggttacaaaatgtattttagcttagttttcttacattaggtgggcgaaataagaatgagcagaaggctggggacggaggctcacgcctgtaatcccagcactttgggcagctgaggcaggcagatcacctgaggtcagaagttcaagagcagcctggccaatatggtgaaaccccatttctactaaaaatacaaaaatcagctgggtgtgatggtgtgtacctgtaatcccaactacttgggaggctgaggcatgagaatcgcttgaacccaggaggcggaggttgcagtgagccgagattgcaccattacactctagcctgggggatagagcaagactgtctccaaaaaaaaaaaaaaacaaaaaggcagaaaagtttagggacacccaacaaaactagaattggaaacagggaattacgctgtttgtagatgatttcttttcaagatgggctagtggagtttctgagcagcagctacgttctcctttcacatcttcakgtttcataaggttacctttagccctctgagtgatcagatttccctcacagtcactcacgggagcccttgatcttgacaaaatagaacttgagtagctgagttcaaataactgaggtggcaagaggggatctccttcttggttcttatattttttttaaatgaaagagctagagaagcaatctcaaggtcaggataactcaccctggtgttctcacttttcagggattgtgctgcattctgacttggattctgccatcgaacacagaatgccctgatccttagatgcagaggcagctcttcagcctatggggtaagtaaccagggaatggaattctcaccaattcttattttctatgctaaaagttttactttacgatttgggcctgcttcttttttttttgaaatggggtttcattcttggtgcccaggctggagtgcagtggcactgtctcggctcactgcaacctccgcctaccgggttcaaatgattctcctgcctcagcttcccaaatagctgagattataggcatgcaccaccacgtctggctagtttttttaaatttttagtagagatggggtttcactgtgttggacaagctggtctttaactcctgaccttgggtgatccacctgccttggcctcccaaagtgctgagattacaggtgtgagccactgggcctgggcttgggcctgggcctgggcctgcttctttctctctctctctctcttttttttttttttcagtagcagtttaaaattggtacctcatttagacacaagcaaaaggatattagcccactttggaaataggtgtgagtccacatatgattttcctagtttttcctcttccttcactttttgctctcttggtagtatgttaattctattctctctctgaatcttttttcttcatttctttggcagatatttttacttgtcttggaagagtagtttttaggactctttaaaaggttacaatatggatgacaatcttggctaatggtaaccagatccagggagctggggtagygttagctggaatcagttcaaattagcaaagcagtggtgttcagtggcaggaatacaagtgtccacatcttgtttaacacaagatatgttaaacacatcttgaaagggatagtgacatcattctcagaatctgttgggaatacacatagcctgtagacccatttgtctttgaccctgtaaagatattttaaagagtaataccctgagtggttttctgtccagtttgcctgctcatttatctttgaggacagcatgccttgtggagctccgcaggccccaggggtgtgtggattctacatttgaaagtgctgatgctgagagactgtgtcttggcggaccccaaggagtctgcttttcctctacttattgtccctgcttttcctggcagctggcrttgctgtttaaatgggttgttctttgctgtttaagttgtttggtagtggtgtgtcaggatgcgggttttctgaatacttttccagctggttacttgagtggtggttagggaggagctgtcttggggctgttctggagctgttgaggtcgggtgtctgtctggatactcacagcctatctgttgaggagaacgctgttctcattgtgctgcctttggtgatgctgtgtgtggctctttagatgtgggtggaggtgagttcggggagttaatgagatcttttttaggtgcttttgataaagtagtctgcactagaggattcattgtgactttctcccttaacctgcacatacttctctgctcacccttgctgtctttctcatgcctttgattttcccatctcctgttggttgaatttacataaaagctctgctgtagtttaaatgtgtcccctaaagtttatgtgctggaaactcaatcctcaatgcaacagttggaatgtggggcctaataagagagccctcattaatgaattaatgttgttattttggtaatagattagtaatcacaagagtgggcttattgtaaaagagagttcagcccctgttgccctcttgctttctcgcactctcttgtccttctgccttctgccatgggatgatctttttctgtcatgggatgatattccctcatattcagaaaagggagtctcccattaggaataaagtcatgagaagaaatgggcattttcataattatggtgttttctttatagcagtggttctcaaaggtagttcctagcagtatcacctggaaacttgttaaatttgaattctcaggccctatcccaggccagctgaatcagaaactctggggtgggacccagtactctgtgttttaactagtcttccaagtgatattgatgtgcattcaagtctgagaactactgcttgtcaagttagttgttcgctaattttttactcccaccttcactgggccctggagagtgtggaagggacaaaagtgagagaacactgtctctgcaggtactttgtcagtcttctgattaatcgtttgagaaacctagaaaacatctgttgagtacctgctcagttcctggcactgtgctaagtggctaagagcatggggtggacatgtaagcaagtaattgtaataggacatgagtattataatggctgtatttataaaaagctacaggaactggagagaaaattatcctgtgagtggggaagatggagtcagatgtcacttgatccttgaacagggtaggatttgaaggtgaacagacagaaaggtattctaaatgggttcatacataggatgaccatgcaacttattatccaaaggaggtcacttttgagaatcaaggggggtgcttttataggccaggactgttgcttgctaactgggatgtacgattgccctatttgtaaagaaggaatgatgctgtgaacccagagttcgatgtaaatttgtggaaaactcatttcttctaattatttgtagagtttacaacaattcttattggatggtatgtttttttccctagggctgctgtaaaatattacaggcatactttggagatgttacgggtttggttccacatcactgcaataaagtgagtcacacaaatttttgtgttacccagtggatataaaagttgtattttgggccaggctccctctgcatctctgtgtttcagttggggtagggtaattttccgttcagtttgaagagctccccctggtatttcttccagtggatgtcttcccataacaattttttttttctcatctgaaaatgtctattttgccatctttttttttttttttttttttgagacggagtctctcgctgtcacctgggctggtatgccgtggcgcagtcttggctcgctgcaacctccacctcctgggttcaagtgatgctcctgccttagcctcccgagtagctgggactacaagcgtgcgccaccaagcccatctaatttttgtctttttagtggagttggggtttcactatgttggccaggttggtcgaactcctgacctcatttccaccctcttctgcctcccaaagtgctgggattgcaggcgtgagccactgcgctgggctatgtttttctttttttcttttcttttctttgagatggagtctaactctgtttcccaggctggagtgcagtggcacgagctcagctcactgcaacctccgcctcctggtttcaagtggttctcctgcctcagcctccgtgtagctaggattacatgcgcgtgccaccatgcccggctaattttttgtatttttagtagacacagggtttcaccatgttaaccagtttggtctcaatctcctgacctcgtgatctgttcacctggggctcccaaagtgatgggattacagatgtgagccactgcgccagacctttgccatcagtttttaaaggaaacagctactgagcactggatgctaggtgggcaggtttcttctttcagcttttttttttttttttttaagccatcatactttagaacctttcagcgctgtcaaattatcttctggcttttattatttatgttgagaatttagaccgggcgtggtggctaacacctgtaatcccagcaatttggaaggccatggtgggtggatcacatgagctcaggagttggagaccagcctggccaacaggtgaggccctgtagcaacatatggtagccctttttcagtacattggcctgatccagcttagttggatgtcatttacatatgtgtcttatatcttagatacaagagatttcttaaaagcttaaagcataacacaaatatttacttgactgcaccatctaacaaatctaaataaatacatttcaggtctaggcattgcgttttgtatttctctaaaccagtgtgcgcatgtatttctctaaaccagtatgtgtgtatcactttacccagccacagcaaatgattatggatgaaatggctgcagcaaagctaaaactatgatatgcctttgagaaaaaaatattgagctgaggccaccgctgtcgcggccgccacagccgccgccatcttcttcctgcccttgccttggtgggtggcggtttcctgcgccgtgtctggcttggccagccggagcaccgcgctgggctccatgcagccgggctgcgcggccgctcagagcgggtgcctccggggctccggtygggggcctggcaggagtgggccggggatggccgcggcaggcggcaggtcggccgtggagccccggggaggcggccgccacgatcgctgcccgaagtctgcgagatgtccggcrgtccgctcagggccccttttgcagactcggtgcccggtgtgcatcggtgccgcctgtcggtcttggcaccgctggcgcagccgccgcgtaggaggcctggctccagatccccgacccctacgagcgccggccctgcgtgcctgctatgttggtgccatctcttctgcatatttatgcttgcctgtcacattccctggcctctgagtgtcctttggcagtttccaaagcatttgggcaagaaggagcttggggagcttcacagcaggtgggggtgcacaggggagggaccgcagccagaccagcagagcgcttcaagggctgccacgctgacggacttccacactgtctttcggaactggggttaggggacagcccttggccaccaccgtgtccttactctgtcactttacttgggcctggacctcccctttccagctctggcgtgtgacactgcactgagcatggtgtcgagaccaccactggctggggccgtggcatgaagggtgccccaggctcggggaaggtggggaccttttccccgctccccaaatgattkttgcatgctctggtgaggggacagttgtactccatttcccgtgtgccagcttcgggactcagctgtgcttttgtgtctctttgattagcaaaagcaaaacgaattcctccctgaacactaagcttcctggaaacttccctagacctaaacctgagaaccgcatataaacaggccttgagggttctgttgtcagtagcgggttacctgattgcaaactgagcaagtttaaaacggagtgggctgctttgggctgcacagccacctggcattctgacagctaagcaggaggcagaggtgagagaccaagatggactaaaaatgccctagccgctgggagcccaactcggcccagcctcgttgaaaggaggaacattcggtgcagccatccgaaccttatcctttataaaacgggacagctcacaggattacatttctaagccaatcctgtgaccatcctccatgaaattctctattttggttacatgtggtcaaactgagcctcactgaaacaattgaaaaatactctggacaaatcttaagatatcgttttgaaaatcaaaaggtatggaaaatgttgtggcttctttctaagctttcttcagcccaaattctgttattctctgatcttttatggtgtgaaatcatacccattccattatgtattgattgtcaagaaggaagtaggcttttattgctatgtttatgtcagtttccgtttattgtctcaccacatttattgggttattgcctttgcctttgactcaacaggagctggaagggaaagaatcccaaattctgtttcttaaggcagccagttgtcasaatgaactttcctcattttctattgtgaggcctgaggaaagacattcagttccaaaggctgtgcctatccttttaaatagaagagagagggcctggcacggtggctcatgcctgtaatctcagcactttgggaggcggaagaaggcgaatcrtgaggtcaggagttcgagaccagcctggccaacatagtgaaaccccgtctctactaaaaatacaaagaattagccaggcgtaatggcgggcgcctgtattcccagctgctcgggaggctgaggcaggagaatcgcttgaacccgggaggtggaggttgcagtgaaccgagatcatgtcactggactccagcctgggcgacagagtgagactccgtctcaaaaaaaaaaaaaaaaatagagaagaggaagcagccgtgccaaggctaggtactgactgaagcaggaggaacaaattggaaatgtgggaatgtgaatgtgggcaagttgagggacttgtagcttctctttggttgaatctttttgctgaagctgctttattgtatctgacatgtgaaactgcacaatttcaaacaaacccctattgaagtcaacatacaaaaaagcatttaaagaacagccattagtggccaggcacggtggctcacgcctgtaatcccagcactttggaaggccgaggcgggcagatcacgaggtcaagagatcgagaccatcctggctaacatggtgaaacctcgtctctactaaaaatacaaaaaattagccaggcgtggtggcaggcgcctgtagtcccagctactaggaaggctgaggcaggagaatggtgtgaacctgggaggcggaggttgtagtgagccgagaccgcgccactgcactccagcctgggaaacagagtgagaccccatctcaaaaaaaaaaaaaaaaaaaaaccattagtaaaaataattttttcagttaacgctatttttcccttgtataggtgttggtaatcagataaatagcttattgcatatggaaagttgttttctttaagttaattcaacctattgcaacttagaatccaggaaaatagtattttcaaatatgtatttggaatcttcaaaatattagattacaaattaccttaaaataataaatatttatgcagcatagaagaatcagcagttctctgaggaaggtaaatagcagttaaaatatcataatgcactttttatcagttgtaaaaagaaagatccaggcttagatttatggtattaccattagaaaaacaatgtgagtatttaagaaacatagcaacactagccattaagtaggcatcaaataacattctgaattaagttacaagataaaaccaagatttggatgacaatgacaatattgtccatcattgttatccaattcctggttttatcttataactggttttaggggcaattctagtgaattgtccctaaaagatgtttgaaattagttccatacacttttcctgaatcaacttaaatattgatttcacaaacaataagatggtgtgctgtagcatgtcattgcactagaaagaaaagaaatactccactagtggggaataatttcaayagaggaaagtgatgaatgttggatgtgagttcggaaaccagaggttgataaagtcttacgattgctatatgcactgtgaggctactgtatttggaaaattgcaaaacaaaatattttttaaagaacaaaaatctggtgagtagcatacacagatttcaaaaataaattgcataacttcatatttcagtaattaaagatttaacaattgtgattttgtggctaaacaaaatatactgaacaattatgtataaaccatggattcaaagctccagaaaattgtcttaatgaggcgtataaactctttttgtttaatgtccacaccaaatcattatggtctgccatttcatgaaataacaagagttttaaaataagtgatgttttttagtttgtgtatctatattctttcctaccaggtatagcacagtgtagtacaagggcctacagttgtaagccttgggaaagatactgttttggccacatatttcagctatgtgaccctggaaagtgggtctcagagggacactgtggccctcagtgtcttttcattggtaaatgggggcaacatctcttgtataatgacagctgaaaaaaaatacgattttccttttattctcccttcctttcatttaggctgtagttttcactttttaactacaaagcgatttatctcttgataacacttctagtgtattgtccctaaaatatttttgaaagtagttctatacactttccctgagtaatgaaaacatcatgtatttgctaacttggaagaatcccgagtcaggagatggcctggattctctctgacccttcaactgaagtctttgaccaaaggagcacaggtgacccctctctccttcattttctgacctgtagagttttggactcaatgactgattctctcttctagctccaaaatactgggctaaactccatggaactcccttctgagttaaaaatagtagacatgcctgcactatcaacatttttagaaaattatgaaatgcttagagtcactttgtaattgagtctaaggtttgaatgcatagagttcaaatgcaataactgtgttgataacacaacaaagacatgtacatttttatgtacctttatgttctatgcattagtccttcattccttggcatgaggagaagtgatggtttttcagtgaccttccagaactctaaggctgtgtttcaccaggcctcagggtttctacagtttgaacaaatttctgatattgtacccatgcacacctgagtctaagaactctgctgtaaggtgacattaaacagcacccgaagttatatttgagatgattattcagtaatcattgtacagttgattttcgtagtagggattcaaacactgaatagagtgcagttttaattaaatctgcatttctcagttgaaactttattttagcagtacatgatttctatttcatgaatcataaatgtcatgtgtcttcacaaactgtagttctgaatttaatttattcaccattttgtcgtcaaaaagaagagttgatgtttttgaaagatctaaacagctttgcaaccgatgttctaaagaaataaaatataccgctggaaccccccccccaaaaaaaaaaaaaaactgagctgagtgcattggctcctgcctgtaatcccagtactttgggtggccaaggtgggaggattgcttaaggccaggagctcgagatcagcctgggcaatatagcgagatcctgtctctacaaaaaacaacaacaaaaaatttagccagggattctggtgcacacctgtagtcccagctacttgggaagctgaagtggggaggatcacttgagcctgggcagtcatggctacagtgagctgtgatcatgccactgcactctagcctgggttaatagagcaagaccctgtgccaaaaaaaaaaaggaaagaaaaaataaagaaatgcctttaacacagagaccacctcrtgtattgcaggttgctgttactttagtggagttaagagaaataatttttggtcagtgacttattgaataaattgaccatttgtgctgcttccctgggcgagggcatagagaatggtacaaagtaggctacagtagccagataatcttgtatgtaattttgagctattagtccggagaatggcatgctcagattagagttataattttgcttaatcaaggagggcgtgatctagtacaatagaagaccattgtctagaactcattccttaagaatgctcccctgcttgctctgctcattccagcagcaatcaactctacattttattccagggagttgattatcatttggaattatttgtctagactaatgtttggatactttgttttgttatatttaacattaaaactctgacattgattctgtgtgacattcacattcattttggaagcattgtatttaatcatatgaaagttggtgaaacttggattacagattgcaaatgctaataagtcttttattagaattacggtgtcttcataccatcaagttgaggactgaaaaatatttaagaagagtacctataaatcgaaagaaaacagtaatgacatagaaaactgagcaaagacagttaatttattcaaagaaattatactagtgccaataaatatctgtaaaggtggctaaccttagggaaaagcacgttaaatgaattttttttgtttgcctgtcagactgacaaaaattaaagttcgataatgctatgcttatgaggttatgggagaccagattccctcatacactgtaggtgggaatgtaaatggtatagcctttttgtcagaccagtttggtatatgtcagaattttaaatgcacataccctttggcattccgtttctgtttctagcaaactgctcacattttgcggtctgctcaaggtcatgatctgctcataaccttgtcctgcttggctatcaaaggtttataaattttgttagtactatttctgaatttaataaaatacttcattgtcctgtttacttcagattttttttctagtcccttatttgcttttatgttttggctacagatagcctatcaagaaccagctagatgtttcagtttatgtattttaagttttgtttccattttgactttccctgcagtttgtaaacttagataaccctcacctctttagaactttcatgaatacttcattttagttctttctattttctgtttgtttctacaaacttttaactttttaaagatacctgtaattaatgtagggggtatcagattgctgaccagttattrcaacactattgaaaatttccccttcccctccttcttctaacattaaattaccttatattagattagattagattagattcatttttgagtcagtctgtcctgtagtggtttgacaggtctgttcttgagttcacagtcttctaactagtttgcaaataaaaattcagaaaattaatttagaaaatcaaaaaataatttagtgtttatttttgctgacagaatcattttgttgagttccagaaagtcttgtgggatttttattgccatttgtagtaaacttacacattttggaatgtttgacatggttataagattttattttcgcacattgcgttaagtatatctcagtgtttccatgtggattataattttctcattaaaatattttcyataagtctttacatattcatgctattttgactgatatctctttttatactttctaacttgttattgtttgtctgttacaagagttccacagatttcgtgtacctatttagcttatttcacataaatatgaattcttttatgaaagttagccattttaaagttaatttctcagcagtaacagtgttttattttctttaggccttccagatatacagtcatatttcttatattacacggtaagctccacaaggactgaaatgatttatttttacttatatttgtgtcctaagtgcctgtcattcagtaatcaatcagtatataaatatttgttgaatgagtgcaagggaacactataagaatatgtaccatatacagtgactctatgactaaaacttttttttctacttgtctatatatatcaggttttgtaaataatgagtattctttgcttctttaactagaaaaaaaaaacaaatttaagggaaaaaaatcacctgtaagttttatttcttaattgaggtcaatggatagcttatcattttgctggaattgattggatgtttcctgtaagtcccagatgagttgtctggagataggaatgacctctgagggcatgacattgaacccaagaataggaagcagggcccrctcaaggatagagggaaactactcacatctgtaaagtgttttggttttgcttttctgagatgaaactggtttgcatccagagtcttaagaaagaacactaatagttctgtgagctttgtaagtaagctttgtacctctctggtctttgtaggtacctggacctagaataaatcctagccctggggcacaatttatagaatcctaactgtcccagcagcagagatcatttttactctgtcttccctgacataagtgggaccaattgaatcgtgcattctttatgcccaggttgctcaatcaagctcctatttattggagtgcagtgctcaaacaggagyggcatgtggccccttggagctccctcctggaagcagtgctggtggtggttacctgtctagggacaggtctgtctgcccaggaaagagttgagtctcatgcagtcgatcccccatgtttcttcctgtgtttacaggatatgctgtctgtagctctgatgtccaatctgggtgtgccgactctcctgccttctaccataacagctgtcggcaccaccacatagcctttcaaatgatggcactctcttttggtggtacccttgctctctttttatacttagaagcagcagaatgatctgagtgttgtgtttaactgatacacattagtcccatgataggtgtttatttttattaaaaaacattcatgtgtgatttttaacaaaactttagaatttggaataattaataacgtcaaatccataggaagctgtaaggataatacagacaggtcctgtgtactcttctggtttgcttaatggttacatcttacataactataatataatgtcgaaactaggaatttgatatttgtgcaatgtatgtgtatagtgtcatgcacattttatctcatacatagattcctgtagccaccaccatagtcaagatacagaactattccattacccgaaagacctcccttatgcccttttagtcacatcctatgtcagcagtccccagggctgcccccaggtttcgtaattcgctcaaggctctcacaggacattctttgctatggtttgttacagtgaggggatacaaagcaggattaataaagggtagttgtgcattgagaagattctataggacacgagcattgtgaagattcggagtcttctctccgtagagttgcccagtttgtgcttacttccccagccataaactctagcaacacatgtgaagtgttttctattgtgaaagctcacatgagcctcagaatccagggcttttattggagatgggtcacatagtgtattagtttgttcattctcacatagctataaagaaatacctgagactgagtaatttataaagaaaggaggtttaattagctcacagttctacaggctgtacaggaagcattgcagcttctgcttctagggaggcgtcaggaagcttccaatcatagtggaaagcaaagggggagcaaagtgtctcccctggtgggagcaggagcaagagagaaggtgctacacacgtttaaacaaccagatctcacaagcacagaaccacaggggatggtgtgaaaccattcatgagtaactgccccatgatcagatcacctctcacaggccccacttccaacattggggatttcgattcaccatgacatttgggtgggtacacagattcagaccatatcacataggcatgtagttcctttgcgactgatcactattacagcaactccagaaggaaagcaggtgtttaccataaatcatacagttcacataaaatatctagagaagctggtacagtgtggttcagtaccgtaagcatacaaaacacccttatcatttagggcatagggctagtacaagacctcagtttctaggcgctgaccaagggccagtctcagaagcaggctcgtctgagaatgtgcatcatttgagcaactcagcttgctgagttaactgcttatactattttccttcccctcctctcccttgccttcaccactgttaacctggaaaaagcactaatttgtcctccatatctgtagttttgtcatttggaaaggtagtataaatcctagagtatgtgaccttttaagatggactttttaaaaaactcagcatcttgctcttgagcatccaggcttttgcatgtgttaacagtttgttctttttagtgttcggtattctcttgtgtggtcatgccccagtttgtttaaccatcccatagatgtttattttcccttgtaaagttgatgagcatgtataattttttttcttttttgagatggggtcttgctttgttgcacaggctggagtgcagtggcrtgacctcgactcaccacagccttcacctaccgggttcaagtgattctcctgcctcagcctccctagtaactgggactacaggcacgcaccaccatgcccagctaatttttgtatttttagtagagatggggtttcactgtgttggccaggctggtatccaactcttgccctcgtgatctgcccgcctcagccttccaaagtgctgggatcagaggcgtgagccaccgtggccggccagcatgtataattttaacgtaattgctaatcactcatgaggggaagagatttttaaacatttttaaataatagagacagggtcttgctatgttgcccaggctggtcttgaacgcttggctccaagccatcctcccaccttcgcctcccaaagtgctgggattataggcgtgaaccattgcacctgaccctgggggaagggacttttgtatttattaagcatttagtatgtatcattgctctatagccatgttattctatagtctctacagtaaccttattcattcagttattctttcaacaaagatttgagaacgtatgatatgcttggttgtgtagggaaaaacaattctcaaactgtatttttcctctgttcacgccacagtaatcatcaacacagaagacttccgtgaccatatgtgtggggattcttcccctacacaccacaccagctgggtgtcttctagtttacttcctgcaccatctaccaggaggtagtgtcagatcgcacagggtgaggactcagtcctcatgactgcccctcctaacccccatcagttgcaactccgggcctccaggacttctaactgaccagcttcaagttggggttcccatggctccctttttaggttcgatgaatttgctgaggtggtttacagaactcagggagatgcttctgttttccggtttattacaacaaatattgcaaaggatccagaggaaggagatgctgggggcgaagaatgggggaagatgcgagcttccatgctctccctgggtgcacaccctccaggaacctccactgtgttcagctatctgaaagcttcttgggcccagtgctcttgggtttttgtggaggtttcctgacatcagcattcatccctgagagtatagagcgggcccctccctgaggagggtttaagaccagtcatcagaaaggcacggggagtagagtcctgccttggggcaggtgaaaggagggcagaagaaaatcagagaagctgcccacgaggcctaacacacccaaccttgtaacaaaagcctggggctgggactggtggctcacgcctgtaatcccagcactttgggaggcagaggtgggtggatcacttgaggtcaagagttcgagagcagcctggccaacatggtgaaaccccgtctctactaaaaatacaaaaatagctgggcatggtggtaggtacctgtagtaccagttactcgggaggctgaggcaggagaatctcttgaacccgggaggcagaggttgcagagagccgagatcttaccattgcactccagcttgggcaacagagtgagacactgtctcaaaaaaaaaaaaaatgcctaatatgagcgctatggtagttaccagccaggaaccgtggacagaagtcaatatatattataacaccacactggtactatttgagtcactagaaatgtaacagtggagaaggaaaataaggtctctgtcctcattaaattgcattctggcagtgagggagacagaccaacaggtaaataagtaaataaaaaatatttactagaaataagacatggaggctgggtgtagtggctcatgcctgtaattccagcactttgggaggccaaggtgggtggatcacttgaggccaggaattcaagatcagcctggtcaatatggcgaaaccctgtctctacaaaaaaattcaaaacttagccaggtgtggtgccacatgctggtagtcccagcttctcaagaggctgaggtgagaggatcgcttgagcctgggtaggtcgagtgcagtgagcccatgatcgtaccactgctctccagcctaggtgacagagtgagaccctgtctcaaaaaaaaaaaaaaaagggaaaagagaaagaaatagcacatgaagctcaggcatggtggctcacatctgtaagaagttaaataccagcctgggctatgttgtgagaccccgcctctacccctcccaaagaataataagaaataggacatggagaagcggcatttggcccaggacagaggagagggttgggtaggttggggtaggtagtatttcacagaggctagggaaggcctctcacagtttgatgtgaaagcttagatctaaacaatgagaaagaaaccacaacctggacagcaaggagcatagcattcctcacattggaacagcatgtgcaaaggctctcccagcaaagggggaagtggaaaggatagcagtttaaaacaacattcatttattttttatttttattttttttaaaagacaaggtctctgttgcccatgctggagttcagtggtgcagtcatagctcgctgcaacctcaaattcctagtcttaatcagtcgtcctacttcagccttcctaagtaccgggaatacaggcatgagccatcgcccctagtccatagcactcatttattatctctttaagttctgtagattagaggtccaagcaggctccgctgggtattctgctgaggacctcaggaggtcagaattaagcatcggccagcctgggtttttatttggaggtgatagggagagtctccttccagactcactcatgttggcagaattcattttcatgtggtgaaggtctgaggtcctcatttctttgctggctgtcagccagaagtcattctcagcttctagaagccactcaaatttcttggcttttagtctcctccagcttcaaaaccataaatagtgctttgactctaacttcacattgtgtctcttctgttttttaaaaagacagctttattgaggtgtaattcacatactatacaattctccgttttaaaagtgcacaattaagtaacaaccattaccgcagtcaactttagaacattttcatcatctcaaaaaggaacccatgccctttctctatcccctttattcccatcctctccccycttagtgctcagtgaccaccactctattttctgtctctagatttccctggtatggatgttcagatgaatggaatcatataacgggtggtcttttataaccggcatctctcacttagcatgttttcagggttcaccatgttgtagcatatatcagtacttcattccttattatgaccaagtaatattccattttatggatataccacattttgtttattaattcatcatctgatgtacatttgggttgtttctgctcttggactattacggataatgctgatacaaacattgatgtacaagtttctctctggacacgtttttatttctcttagtctaggagtgaaattgctggtttctatggtaatattgtttaatcatttgagaaactgccagacttctccacaatggctgtaccattttacatttctacaagcaatgtatgagggttccagtttccccacatccttgccaacacttgttatttctgactttttggttctagtcaccctactggatgtgaagtggcatctcattgtggtttcgttttgcatttccttgatgactgatgatgtgcaacatcttttcacatactcatgactgtttgcctttctttctggagaaatgtccattcagatcttttacccgctgaaacagttgttacttactttttattattgagttataagaattctttatgtattctggtttacgagttccttattacataaatgacttgcaaatattttctctgattctgtgggttctgttttcacttgataaggtcctctgaagcacaaagattaaaattttgttggagtacaatttatctgtctttttttgctcctgcttttggtgtcatatctaaaaatcctttgtcaaatccagtgtgaaaattttacctgtatattttcttctgagagctttagttttagcttttacatttaggtctttgattgattctgagttaatttttgtacrtggtatgaagtaagcatctaacatctaacatcgttcttttgtacgtggctatccaattttcccagcactatttgttgaaaagactcttttttctccattgaatggtcttggtacttttgtggaaaatcagtggacagaagacgtgtgggtttatttctggaatctcaattctattccattgatttctatgactgtccttgtaccagtaccacactgtagtaattactgtggccttgtagtaacttgaaatcaggaaatgtaagttttcttacattctttttgaagattgttttggccattctgggtccttgttctcttctgcattttagggttcatgtgcttttgttgggcccatctagataatctaggataatctccttatttccattatcagtcaacttaattatatctgccaagtctttttcgcagtgtaaggtgacataatcacagttgtagcaccagagagtgaaggttatgggtgcacaggtcctatgaggcttagtttggtgaaaagatagagaatgataggagcagagaggctggagagggagatagcaaagggagtttcagaaatattacatagtttgcctaaagtcacatttctagtatgtagcagagctggggtttgagtgcagatttgactgatctctgtgatttcatggtccacaccaaataagtcttcttagactcggagctattgttattgtttctgtctaattcatactgagcttttaatgtgtgccaagtaatccacagagcactcctttattttttttykagctcttaaagagcatctgtacaagtcttttggcatagataataggctgtactggaactagcttgataaaaaaagaaaaaagcagttaggggaccagggtgtatgactcagaatctgagggtgggcgtgcacctaaaccttagccagggattggaactgggagattgaagtcactcaggacgtacaggaccttctacctttctctgcttcttggcgtatgtctatttcactctgtggactgtcctgatacttggaccacttgatggaagatggtcatgtcacacagctccatcattcaagagaacagccccgacttagtcccatttgcaaaactccaagcaaaagactctgacacagtttggggcaatcagctgtgaccctgaattgggggaccattcaaattatacaaacatagcttctgccagcttatctttgtggattcggaggacagtttcctgatacacaggagatatttgcacatgtgctaggcagactccccaaattatgttcattttagtaacatctactagtattatcatacttgtagtacaaaattttaaaaacttaattgatctatggaaaaaataggtatttccttttgctcatttctcttggaagggaagaaaagggacatcaggatgataatggcgagaagattagctcagactttcaaaataatttgaaacccaggacttggtatactaagtgtaggcttacttgagcccaggagttcaagaccagcctggataacgtggcaaaacaccgcctctacaaaaaaatacaacaattagccaggcatggtggctgagtggtgggagtattgcttgagctcaggaagtgaaggctgcagtgagctgtgatcacgccactgcactccagcttgaatgacacatcctgtgttccaaaaaaaaaaaaaaaaggaagcttagtgatgtctctgccacttaatatctttttgatggaataagttatgatttcttaatgttaatatcttcatctcttacaataggacgtagtagatggtctttaaagtttctgcaggttaacattttaggactatttttcttttcttttttttttttctacttctcattttctttgtttctacctaagcctcatctactatttataaatggctggtgtcttagatctaaatcctgactttgggaggctttaaccttgtagacgaagtaaacagtgaacttgagagttctttctaattagatttccctctccccgcgaggtctcattaaataactcttacagatctgacctctaaggtagattaccacccgtcatctttcccttcccattgtgttacctcttatttatttatttatttttgagacaggatttcactctgttgcccaggctggagtgcagtggtgtgatctcggcttactgcagcctctgcctctgcctcccaggtccaagcgattctcgtgcctcagcctcttgagtacctgggattacaggcaagcgccaccacgcctggctacccactgtgttacctcaagtcctctaattgtagttgtctcttggtcagtatccgtgtctcctgttctgtacttctccctaatccaacctagaaattgcctctcaagtttcttcttctttttttttttttttttgagatggcgtctccctctgttgcccaggctggagcacaatggcatgatcttggctcactgcaacctccatctcccaggttcatgcgattctcatgtctcagcttcccgagtagctgagattacagatgtctgccaccatgcccagctaatttttgtatgtttaatagactagatggggttttgccatgttggccaggctggtcttgaactcctgccctcatgtgatccacctgcctcggcctcccaaagtgctgggattataggcatgagccaccatgcctggccgaggttkttttttttttttttttttttaatcatagagtaaaattgatttgggaggagtataatgttctgcgaattttttaattttattagatttatgtaaacacctccacaatcagaatacagaacagtttcatcaccccaaaaaactttcttatgctaatcctttatagtcacattctttcctacccctagttcctaaatggaatcatacagtatgtaaacttttaagatgactgctatggtctgaatctttgtgtgtcccccaaattcatatgttgagattctaaaccacaaggtgatgctaccaggaggtggagcctttgggaggtgattagttcatgaaagtggagccctcatgattgggattagtgcacctgtaagagacggcagagagcctagccatgtgaggacacagggagaaggtaccttcagtgaaccaccagacaccaacatctgttgacttcttgatcttgaacttgccagcttcctgaactgtgagaaataaatttctgttttttataacctactcagtttatggtattttgttactgcagccagaaggaactaagattctggcttctatcagcataaagcctctgagattcatcgaagttattgggtgtactaatacctgttgttgttcttgttttcctgagtagcattctgttgtatggaggcaccatagtttgtttattcattcacccattgaaggatattttagttgtcatttttttgtcatcacaaatattgctactataactgtttaagtaccgaattttgagtaaatagcagtttttatttctttagaggaaatacccaggagagggattgcatggttggatggtcattgtatgtatacatttttatgaaaccataaaagtgttttctctagtgtctgtactattttgcattccactaggaaggtatgagggttttagttgctctgcatccctgctaccgcttggtattgtcagtatttattttttttctgaggtggggtctcactctgtctcccaggctggagggcagtggtgtgatcttggcttgctgcaacttccacctcccaggctcaagtgatgctcccacctcagactactgagtagccgcgaccacaaccatgcaccaccattgctccctaattttttttgtattttttttggtagaaacagggttttgccatgttgcccaggctgtgtcagtattttctattttagccattctaatagatttgagtgatatttcatggtggttttaatttgcatttctctaatgactgaacaatgttgaacaagtattcatatgcttatttgccaccatgtcaataactgcaagggacctgaattttgagttctccctacttaaatgtagcaagttagtctccatggtttcatggatattggcccaagacatgaaactcctgggttggaggcaaaagaggaggacacaggtcacaggacatcagcagaaccagcttcatgtccacgtggactacctttgccctgtaarttccctgtgggcaacgacacaagtaggaaatccaagctcagggaactcagatctcataaggggtggcaaacaaatgtctcaaacctttgatatgaagggagacattatatttactgtactggacagttaacaaattgtcttctgctgtggaaggagctatcatctttctcttgtaaggatgttcaatatacaaacatctttgactggacagtatgtagcaaaggcttctcacggaaatgtgggacaccagtatgtatatcttctttagtaaagtgtctgttgagattttttgctcatttttaaattgggtggtttgttttctgacaactgagttttgagagttctttatatattctgggtatgtaagttctttgccaaataggtgatttgcaattattttctcccattctgtagcttgtcttttcattttctaaacagttattcccagagcaaaagtgttttgttgtgttgccaagtttggtatacaggttctgtgggctgtggctttaatgtcagtatattgtttagagttttgtagtgctgtttccatctgtttcatgtatgtgctgatctgagacctgcatagtggtctctccgttagttccaatttggaaacctttggtacggaatagcgtcagatccatgcatatgcagcctargggtaagcctagaaattgctttcttgagttctcctcagcaatttttcccacactttttgttctcaaagggctcatattttctttcttttgtccagaaaactgtggatttagttactccactctgccatgtctttccaccactgcctgcacatttgagaccaaggatagagattgggaaaaattgatagttctcctgcctcagagtttggctcctgcactctcatttcagccatagctgcagacaaagcacacgattgctgggcactgtggctcaagagaaggaggagatggtaagtggggggatccccatattctctctggctgttaggatttccctttcacatgcctgaagccccaactagaagagctttctctgtgctgtggggcccatttccaggttggctggtggtattgaatgggagaaagtggtaatctcttagatggctgggtgatactttcaattctggtcttccccacatctccattttgcttttcagaatcctcaaaagtagtgcacactgtatactgtcaggtttgatagctggtgactctccatccgcacttggtagcttcgagttttaaaaatccatgatgatttgacttcccacctaacttctttagtttaccttctgtctatactacatcattcatattttacatttgccttcctgcttctgagctttttgtgaaaggcattcttcctgtccagaatatccttcctctttctgtcatgtttccaagaccctttcaacacaaggctctttaaggtctatcaccagcatccccaagtggtctctctatactcactaggtcagaatttgtatgtgtgttactccccaacagtttcctaacactttccctttttccgcgtttttcagtctggctgtacttttggttatgagcttcatgagggcaaggacgtgttctatccgttgcatcaccagtgccatctagcttaattctctgcacacagttggcacttagtaaatgtttgagttaaattaatgagacctccaagatatagggcctaattttatctgcacatgtgagtctcttgaatgaatgctgtagagtgctgcttttttactgtgcttctttggcagtttgttattgtggagaagaatgaggaccatgtggtttcagtttgaaaggaaattgttacatagcgatttaccatacagctgtgagactatgaacaaatgagtttaaatattacacagtggaaaagaaaactgactttggaaattatgatgttacttcaatttttttctcttctcttctttctggacaaggccttgctctgtcacccaggctggggtgcagtgatgtgatcatagctcactgcagcctccatctcctggagaggcgatcctcctgtcagcctcccgagtagctgggactacaggcatacaccatcacaccccactagtttttgtatttttttgtaaagatggggtcttgctgtgttgcccaggctggtcctgaactcctagcctcaagtgatcctcccaccttggcctcccaaagtggcatgagccactatgcccatcgtgggtttgttttcttttacagtagccatcctaatgggtatgaagtgatatctcattgtggttttgatttgcatttccgtgatgattagtgatgttgagcattttttcacatgtttgttggctgttggtatatctttggagaattgtctattgaagtccttttcccatttgttaaccagattattattattattttttttgttattggcttgtaggagttcctttatattctggatattaaccccttattatatatgtggtttgcagatatgttctctcattctgtgtgttgttcctttttactctgtcagttggttcctgtgttgtgcagacattttaaattttgatgtaattaatatatttgtctgattttgcttttgttgcctgtgcttttggtgtcatatcctagaagtcattgcaaaatccagtgttgggaagcttttcccctaagttttctagtttccagcctttacatttaggtatttaatccaatgttagccctttcttaatgggttctgtgtattttcggcagggaataagtctttaatatgactgtttcaggaatttaccatagttaacttttcctttttccttcttccttcctcctctctttccctccctcattccctccctccttcattcccttcttccctctcttacagcctgaagataatggaakcactcactttttcttcataattgctaagactttagttagtagaatgataattccttttcaacagcactttgtcatttgttcattggttagcagtaagaagatgagccttaagtctgaacgctgaggaattcatgtgcatcagtcggacctcctgtgcaagaaaggatgtggttactacggcaaccctgactggcagggtttctgctccaagtgctggagggaagagtaccacaaagctaggcagaaggagattcaggaggactgggagctggcggagtggtaaaaggacttaactaggggcggttgaacagtggcgtgactggatacatacttctgtcaccatccaaatacatttttttaaatttctgctttgacctatcagcaagtcagtttaaaattaaggaaaaggatgttttcccctcttcttctcagtcaacctttaatgaacagctttgagtattttcttcattttttgtatgtcttaacttctgattatattctttgggttatgttaatcttggttctcaaatgtagacaataagctccttggaatggaagaatggagataggcatatttcctggtgaagattaaatgagctaataaatatgatgtacccagtgcagggcttgcaaatggcactcatcaagcattatttccctcattcttttaatatattcagcgtggcatctagctcagtgataaaacacagtagtagaaatctgttgacttgtatacatagtccttgcattatagaaatttaacttttccttaaaaattaggttactcaaaggcagtttgtattatctggaaatataatgatgttaaaaattaaataatgggccaggcgcagtggctcatgcctgtaatcctagcactttgggaggctgaggtgggaggatcacctgaggtcaggagtttgagaccagcctgaccaatatggtgaaaccccatctctactaaaaatatttaaaaagttagccaggcgtggtggtgtgcacttgttatctcagctacttgggaggctgaggcaggagaattgcttgcacccaggtatcggaggttgcagtgagctgagactgtgccactgcactccagcctgggcgacagggtgagactctgtctcaaaaaaaaaaaaattaaatgatgggatggctactgagcataggaactaataaaatgccatgaataatgttaattctttgccagagcattttagaaattctaaaactgcttcaacagaagaaaggcaaatggaattctgccaactcttcttgctagtttttttgttttttcatccagtcagccaatatttgttgagtgactactttgctggcacctgtggtgagctcagagaattagaaattacacattgctttcagtgactgtggtcatcaaagagaaaattttagccaagaacatgaatgatctcctcagggtttccactgcatgcctgatgttgtcagtagcagatcctgtttcaaaaacagagtagaggccactaggcacgaactgcctcagcttactcccttcgccacataaaaatgtactaatacctttatattaacttcttgtccgtcccagagaaagaagtgtcccgattccatactcagacttagcacctcccctgtgatttttgtttctatttcttactgcttttaattgtgaccctgctaaatctcttggaaagcttgtgaaagcagtgattgctggaccttacccacagagtctctgattttagtagtttgggagtaagactagagaatttgcatttctaacaagttgcctggtgatggtgctgctgctgtctggggaaccacgcttggagaaccactgtcttatagatagtgcttgagttttttgttttgttttgagacagggtcttgctctgtcaccccggctggagtacagtggtgcaatctcaactcactgcatcctctgcttcctaggctcaagtgatcctcctgcttcagcctcccaagtagctaggactacaggagcatgccaccacgcccagctaatttttgtattttatgaagagacagggtttcaccatgtttcccaggctggtctcaaactcctgagctcaagtgattcggctgccttggcctcccagtgtgctgggattacaggcgtgagccaccgcacccggcctgtttttgggatttattacagatggttcacatgcagctaatccaaacccaaatttattgcttttatttattattctccgcattctgaacattttcctcctaacccttctcctgagtcaattaatggcatcattgtttaccaagttagctaaaaaaccttggtttcattcttgatttctctttaacctcccttggcacctacaatttgaccaagttccatttgttccaacttagaaaagtcttttgcattttatctttgctcctcttcttttccaggtatttattttcttttacttgaacctttataatatacgcttaattcctgtccgtgtctctagtttctctatccttcaagttgttcacatagctacctgcatgatctttctaaagcacagatctgacaacaataactttttggacttgcagtttttcttgcttccccaccacatgatgaaatccagaataggcttagcaatgggcttagcaggcaagattccctaccctctggtgccttcctgtgtatccagcatcacagttcatcacacgcccagtgctctggctacattcagyttrttgtgaagcaaaccacaggcttgcacatttgtagttccttcttcctggaatgtcctttcacttagaatcctaatcatccttatcagtcaggcgtggtggtgtgtgcctgtagtctcaataacttgggaggctgagggatgagaattgcttgaacttgggaggcagaggttgtagtgagctgagatcgtgccattacactccaggctgggtgatggagtgacactctgtctcaaaaaacaaacaaacaaaaaaaaacagaaacaaaaaaggatcctatttgtcctttaagactcaccccaaacatcaccgttgtaaagcctcatcagactcctccagcagattgtgttgttctttcctgtgttctcayagcactcaatttttactctctgatgtagcagctgtcccattatatagcagttgtttacttacctttttgtttgttccaagcttgagcttgttagggaaaaggactagactttatttatttcactgagcttgttggggaaaaggactagacttgatttctttcatgtaaccctagaccagttgctgaatgagcatgagaagatgccatttgaaatctgtagtgcatgaagagccgtccatcctgtagctatgtgagacctcagactgatttggcgtatttagtctctagttctaaaatctttagatcctcctgaattaatggagtaataaccttcagatacagagaaatcttggagaatatctagatcattctaatcctctcttgaattgcagactccagcgggaggaagaagaggcctttgccagcagtcagagcagccaaggggcccaatccctcacattctccaagtttgaaggaaagaaaaccaacgagaagacccgcaagattaccacagtgaagaaatcttcagtacgtcttccagggtcggatcaaagaagggtaatgttgtgatactcttttttttcttctctgcctgagtgagacacagaggagatccccaatgctcataggctcagctttgtaatttctgtcaactttttgagatcatcagctcagatttgacactgaaattgggcttgagggtcagacaatatatgaaaccaatactctctttagttgaaagacattgtgttttagagaaatttgtttactctgtaggaggaataaagagaattgaaatagatagttttgtttatgaaattcatccccatccaaatgactatctctttggatgttttggtttttgtgcctttatttgtggatcctggtttgttctgtggtaataccctcactgttcatagcttgtcagaaatggtgatttctaggcttgaaagtcatctgagagagagattttctgcccgagagcttatttgagagacagcttgtgtcttgagaacatataggaaaaggcccacattgggctcctggagggatgaaagtgagccatagtagctattttccagtgcatggatttgtatgtaggtgatcatattcacctggcttcttaaaatgccatatgaccagcaagaagattgtcacttaagtcacagttgttctataattgagcagacaagccagttgaatggcccaacrtgaagcaagaaagaatctctgtggttaggcctcggtctctgaaaatttatgttggtactcagttatacagttaatgtgaaatgatgagggagactgggaaccaacactgatgctgtcagaagacctgttctctgggagccccatcacttgctccccagttcctaccctggggtaattgtaatgaggtctcccctggaggcaggggaatgaataataagacactgttwcccttaagacccttgccagtcttctaggttttgtgacttttgctgtttccttttgttttattataaggaaataaaaggaaatattgcttaccaaaaacacagttctctttaagacattgataccaggtgcagtggctcatgcctggtaatctcagcactttgggaggacacgatggatggatcacctgagctcgggagtttgagaccagcctgggcaacatggtgaaatcccatgtctacraaaaatacaaaaattcccygggcacagtggcatgattacatgattaatttgaagttgtttcttggttggctgccagttttagctattttgtctctactaaaaaggggaaaaaaattagcacctgccagagattaaataagaatgtattcagcttatgatttatttattaggaggtgaaattttcaggtggttagtaaggtgactttggagtcactcttgatttgagtcctagctttgtcatttaccagctttgtgaccctgggcggactaaccaagtcttgtccacactgagggacagtaatacctatcagagacatttgatgaggattcagttagttgacatatgtaaagagcttagcacagtgcccgacacacacagtagatctccagtaagtgttagcttttttaaaatgcaagttattcttctgatagaataatcttgcagggagctcaaggccatttattattaagttccttcattcctatttagcttaaagtctgtttcttgatgatatgtagtgaaatggtaagtatgataacagatgaaatagtaaaaaaaatcatcgaattatcagctctaatagcctcattttgcagatgacaatatgaaagtccataaaggttaactaatttacccaaggttgaacgatgagtttgtgcatgagaactcaggtttcctaactcctgggtcaatatttttccattatattcctttattcaatgtgtatacttcagaaacccaggttatttaatgtatataataaatagtaaatatatatatataatcaagtttctgttacttaagtacataattgtcatttatattcgctgactctccttggtggttttaaaaacctgtgtcccaaaagcctctgtacrgtgtgcatgatactatggaaagaagatttacaatttagtgcagagtctgtactttaaaaagaaaccattctcgagttgggtgcagtggcttgtacctacctataatcccagctacttggaagactaaggtaggaggattacatgagcccaggagttagtggctgcagtgagctgtgattgtgccactgtattccagcctaggcagcagagtgagacaccatctttgaaaaaattaattagttaaaaaaagaaacaatccaagtgacttttattttaaaaatgtgtatgcagaatggtttttacctttgttcttgtttctccccaccccgcatctttttgaatggtagatttgtactttctattttttgttctttagttgctttttgtcagtagaaagctttggggataaagatcttaaagtatttgaaaatttatgttagaagagaagattccattatgtctttgtttcacagatcacttaatataagttagccaggtaaattttgcatttcacactgattacttgtttggccatcgtgtttggataagrttagcctaagtgcagttttaatgtattgggtctagactagaaacagactttttggattttgtattcttgatcttctttagtccgtgatgcccttgctcttggtattttgcttgtttctgttagtarcataaaggaaagcttttcgccatacacagcagcttggtagcagacaaaatacaaataaccttctaaggaatttgaagaatattttcacatttttttagagttggattcactttcagagaaagtaaatggaatgtcttgactgtaaagactcagttaaagtgttttagtctccacagtcatggtgagtgagctgtatagaggaagtcatagtggttggccaagctgagatcacttgcttatacattccaaagtgcccttttctttcagaactcctataatcttgtcatcccaagtagaatcttgtgtacctctttcacaaacagatctaaagacagtgatcctccaaagcgtatcttttcttttttagagttaaaataccaataccacccagaccttagattctaaatagtattattcattaaagtgagccagggcttcttagagaaatgactgattctggggctggggcagggaaaaaaaggccccttcaatattttggttacatttcagaagatctagaagccagcttggaggggtttccactggccaagtctgggataatttgagtgtcaaaataaacaaggacaataaggccgggcacggtggctcacacctgtcatcccagcactttgggaggccaagttaggcagatcacctaaggtcgggagttcgagaccagcctggccaacatggtgcaaccgcatctctgtctttttttttttttttttggcacaaccccatctctactaaaaataccaaattagtcaggtgtggaggtgtgtgcctgtaatcccagctacttgggaggcagagtcaggagaatggcttgaacccaggaggtggagattgcagtgagctgagatcgtgccactgcactccagcctgggcaacaagcgagactccgtcttaaaaaaaaaataaagtgaagaaatcaataaataaggacaataaatgaagtataactgaacaaaataataatccgtgtgttaatttaactagtaaaatagagaaatacagctggcacgggggctcacgcctgtaatcccagtactttgggaggccgaggtgggtggatcacctttgcttgggagttcgagaccagcctgaccaacgtggagaaacccgtctttactaaaaaaatacaaaattagccaggcgtggtggcagatgcctgcaatcccagctactgggagtctgaggcaggagactcgtttcaatccgggaggcggaggttgtgctgagccgagatcatgccattgcactccagccggggcaacgagcaagactccatctcaaaaataaaaaaaaaataaaaaaaaatagagaaatacacaaatgagaggttatagtcatgttagtagcaaaaattgattcaggtaaagtttatctgggtgctaaatcttggatgaggggagggagtttcccaggaaacaagttacgaacatgatctcaaattcactgccaatgaattatttatgtgtttatttttctttttttcctttttttgtggagacgggaggtgggtctcgctgtgttgcccaggctggtcttgaactcctggcctcaagtgatcccaccactgtagcctcaaagtgctgggattacaggtgtgaaccaccatgcccagccagattatttattaattataaatagagaaatggtaactataaaatggggatgtaggaggcaaggatagatgtcatgtgtgcttccagacatgacactttgagaacacaacatcatttatgaaatatctaagccgaaaatttttaacaacctgaatccagtcatgaggacacccaatctaaatggcattcaacaagatacctggcctgtgttcttcagaagtgtcatgctgagagaaacaaaggttgggaaaattgtgaactgctcattgtgaacaattgagaaacttggaatatggattttcaattgagtaaaagtattttatcaatgtaaattttcctgaatttggtagctatcctgtaaggtacataaaacaatggcttaatccctttgcattgctatagaagaatacctgaggctgggttacttataaaggaaagaggttcatttggctcacagttctgcaggctgtggaagaagcatggagacaggccaggttcagaggctcacgcccgtaatcccaacactttgggaggccgagacaggcagatcacttgagtccaggagttggagaccagcctggccaacatggcaaaaccctgtctctattgaaaatacaaaaattggccaggcatggtggcccatgcctgtaatccctactacttaggaggctgaggcaggagtatcacttgaacctggaaggcagaggttgcagtgagccgagaatgcgccggtgtactcccgcctgggctgcagagtgtgagactcctcaaaaaaaaaaaaaaaaaagagagagattgggcaatggaaggcttgataatcatggtctacttgctattcctgaaatacaagctttgtttctgtattaaaaacataaggtgcagcttggtccagtggctcatgcttgtaattccagcattttggagactgaggcaggaggatcgcttgatcccaagagttcaagaccagcctgggtaacatagtgagattccatctcttaaaaataataataattagccgggctagtgcctgtagccccatctactctggaggctgaggtcggaggatcatttgagcctgggaggttgaggctgcagtgagctgtgatcgtgccactgtattccagcctgggtgacagagcgagaccctgattaaaaaaacaaacaaacaaacaaacaaaaacgcaaggtgactttaagttgaagagcaagcacttgccatttgagccctagccaaaactatgaactgtaatgtgggtgaggttgttcttttccatatttccttcttcttcacttctttcaccttacacactgaatccctattggctgttcaaacataactaacctcctccctgtgtaccaaacacctgaactgtctctcactttcccctctctaatccaaacttgtggcctcttaataggggttgatttttaggaagcttagagaaaaacaacaaagtgttgattttagtaacttgtatggtcataactagctaatagaattaatcttcatttacattttaaaaggagattttttttcttttttaagcaaaagtgtcctttggaaaagtatgtgtgggagggaagcatgttgtaagcaaagcaataaaggaaatgagtagggttttcctgtctttgactggtgtacagacctccaaagtcagagggattggtgttattctaaagagtcttcagtcctctctggcttactgaggtgtagttatagcatagtcarcagctcaggstttggatttaagtgcacagacctgggttcaaattccagtctttataagtgactgcaacattattcaagttacttaacatattcaagcctcagcttcctcatttgtaaatatcataagtgtactacctgatagacttgtgaagattatacaaaatagcattgtaaaagtacctagtgcataatagacattacctatatgtaagtttatactaccattattattttgtcagatggaatatgtattatgtttttattgggttgagtgttctgtcaatgtcaggtaggtcaagttggttaataacatcattcaagttttctgtctttactgactttttaaaaatatctctctgtcaattactaagcgaggattattgaaatctccaaatatcattgtgaatttgtttctcctttcagttctatcaaattttgttttatgtgttttgaaacagtgttattagtatatacaaatttaggattgctgtgttttcttgaagaattaaccccttttttatgatgagatacctctctgtgttcttgataatatggtccatgttcttaagtttactttgtctaacattggtataaccacttaagctctatttcattgtttcagagtatcctcttcctttcattagtttttaacatatttgtatctttatatttaaagtaaatttcttacagacaacatgaagtgaggtcttgttttttaatctaatacgataatctctgacatttaatcagactgtttatagcatttgtaattaatgtgatttttgataagggaagttttacccctgtcatcttgctctttgtgtttatctcatcttgtcttagttccttttctcctcttttcttgccttctttatgaccacacctttacctccactatcagcttgttagctacacctctttgttctgttttgttttgtttggtttttattaccggttgttctgggctttacagaatacatctttaacttacttaccttcaagtaatatttataccactttacagaaaaaaatttttttaataatagtattatacgactttacatataagaatcttaaacaggattcttatatttcttcctcccgtccttcgtgctgtggttctacatgctacttggtggttctttctctcatcttgggtagtttcctcatatgcatgtgtagtactcagccacactcaagggaaccctctgcagatacctggagctttttctgttagccctctcccctccatagcgtttgcatgatattttgccatgcaaattctggtcacattggcctccctgaactccaaatgctatctcctcaattcagcaattcagctaagctgtgtttgagtggcctctccctgtgccaagactttaaaactctcccagcagtgagctgggacactgtaggacagactgtgtttgtttcctgtctttcaggagttaatctgctgtttacctgtcgtccaatgtctgaaaacctttctttcatatatttgacgttgcagttgttaagatagtagggtaaacctgatgccatcagattattccgtcatgactggaagtggaattatctgacagagaaggatttttgataaagatttttttcctaatcatacagatgtcagcacaatctttggttttttatttacataaaaaatattttagaaaagatgttgctctttttgttttgaattagattgtacctgatttatttatgtgcttaaaaaaataggtagtatatccaaatgactcaaacgtaacagatacggttagaagtttcctttctactttgtctctcgcccatctagttcctaagtaccactgctattgttcccctactttctttttttttgagatggagtctgtctctgtcacccaggctggagtgcagtggcgcgatctcggctcactgcaagctccgcctcccgggttcatgccattctcctgcctcagcctcccgagtagctgggaccacaggcgcctgccaccacacccagctaattttttgtatgtttagtagagacggggtttcaccgtgttagccaggatggtcttgatctcctgacctcgtgatccgcccacctcggcctcccagagtgctggaattacaggcgtgcgccaccrcrtcccgcctattgttcccctactttcccagaacttttgttattagtttcttgtgtatcctctttctgtgcttttattctaatttataaaaacgtatattcttaccccactaccccgttttatataaaacatagcacagtgtacataccttacttttttttttttttttttttgagaccaggtctcactctgtcacccaggctggagtgcagtcaaactcctgggctcaagcgatccttctgcctcagcccctccaaatagctggcactataggtacgcactaccatgcctggctaatgtttttactttttgtagagagcgcatctcactatgttgctaatttatgtttttgcttccaatacatttatgagctctttccatatcagtacacaagaagcatactttttaattttaaaaccctatggcattttattttatggattaaaggataatttatttagtccctcagtgatggccagttatttccagtcttttgctattaccagtaatgctaaaatgtacatatttcatttggtacatgtaagattttattagtagaaaattttggagaaatagaaatgttaggccaggcacagtaactcacacctgtaatcccagcactttaggaggccgaggctggtggatcacctgaggtcgggagttcaagaccagcctgaccaacatggagaaaccccttctctattaaatatacacaattagccaggcgtggtggcacatgcctgtagtcccagctactcgggaggctgaggcaggagaatcgcttgatcccaggaggtggaggttgttaactgagatcgcgccattgcactccagtgtaggcaacaagagtgaaattccgtctcaaaaaaaaaaacaaaaaactcctgaagatcaaagattataaggaattactctgagagcgagacgcagtgttttgtacctgtaattccagcactttgggaggctgagataggaggatcatctgaggttaggagtttgagaccagcctggtcaacatggtgaaaccctgtctctactaaaatacaaaattatctgggcgtggtggggcatgcctgtaatcctagctacttgagagactgaggcaggagaatcatttgaacctgggaggcagatgttgcagtgagctgagatccactgcgctccagcgtgggtgacagagtgagaatccgtctcaaaaaaaaaaaaaatttaagaaactgtagaataggtaggttaatatctttaaaacatactttctggccagatgcggtggctcacgcctgtaatcccagcattttgggaggctgaggcgggcggatcacctgaggtcaggtgttcgagactagcctgaccaacatggcgaaaccccatctctactaaaaatacataaaatagctgggcatgatggcacatgcctgtagtcccagctacttgggaggctgaggcaggagaatcgcttgaacccaggaggtggaggttgcagtgagccgacatcacaccactgcactctagcctggcgacagagcgagactccgtctcaaaaacaaaaaaaaaaatacaagaattagctgggtgtggtggcactcgcatgtaattgcagctagttggagactgagccaggagaatcgcttgaacctaggaggcagaggttgcagtgagctraagtcttgccactgcactctggcctgggtgacagagcagtactctgkctcaaaaaaaaaaataaaatcaaataaaacatacctttttaaaaaattatttttaggaaatcattgggatatggggaacttaaattccttataaacattagagagcatagttcaaaatcaggaggcttagaatgtggtcagagaccaagtggtagttcatactttctgaaagcacttactgcctgttacaacatccttatctctcttgtgtaaatgttccattttcctttcagtgtgtttatttgaagaggggaaagaattgtctgcccagccggtgggatagtgtagtgcaygtttcccttgtctcttcattttatgctttgtcgtgttcatcttgctattaatactttggatgcgttctttcactttgatcagtatgactcaccaacgaaatggtgggtaaataattgtgagtctccacataaacacattaacctttgcctttttgttaagtaaaatgggatttggaaaggttgtctgacatttataagtacctaacatttcagtgcttctattgattgttattctatttgttgactagttttataaactccagcagtctttgagaagcctagtggtgccatttcagtgttcatgattgaatagatagatcaaagcatgatagattttggcaaagaaaatactaatagaacaacttttatttcagtaggaatatcttttagataatgtagttttgtctactcatactttctacttgtaaaacagatttagtttaagggaagttgtccaaccactcaaacataaaatgatttaaattcaagtttaactttgatgaaacataatttaaataaccttaggtaagatacttaaagtaattccatgcatggatcttttatgtcttgaaacttactatgtttaattttcccagctgaaattcaggaagcaaaagctcccagtccttccataaaccggcaaaccagcattgaaatggatagagtgtctaaggagttcatagaatttctcaagaccttctgcaagacaggccaagaaatctataaactgaccaagctgtttttggaagggatgcattacaaaagggtaggttgagaataatcacatagaaacatagagttttggtttgaggaaaggtcttagagataatatagtgcaaccttgtcattttatgcctgagaaaatcaagaccaagagatgttaaattacttacctaagaaaagcctctgaatcaagctaaaacccaactcttaggctagtacttttccactgcaactcagtggtgtttgaatcatctttgtgtggaaattctgaccttgaagccacttgaattatgtgctttagtaacaggcctttttgacttgtgaccttgtaaatagtataaactgccatagtagacctttaactctgtgcaaccattgttaggccagtggcagtaattttaagggttgttgttgttgaattctgttttgttttttgtattttgattttgaattttttcattcagttagagaaaggacagatagaatttagacaagaaagggactttagcagctatggagtttcagtccctttattttatagatgaggaagttgagagcccaagaggataagtgacttgtccaggttacacagctagattttgccaatgtcaagtagttgtgacttccacacctgtttcttttatccataatttctgacccataatttcagtggcaataattcatgagactccctgtaaaggaaatcattttgtaaatagggattaattctgttgtaacattctataaccattaaactcagaattagctccaaaagttccttctatgcagtaaggaagtcttagaaagaaaaaggaaattagaaaagcagcagggtgtttaactgtttagctatattctagctggggtcagcaatcactaggctaataagcagtggacttgtgttgaaataatttttagatattgaattcagtttgtaaaggagaaaagcttgctttcttgcccttcagaaatgtaattagactgtgtaagtaagtagctgtctttctctagatattttttctctctagagtaaaatatttggagttaaaacaagtgagctgttattgatttttttttttaagttaggaaccatgatagatatcttaatgtggaaaaattcggagttcatgtgacatacatctttcatttttatcagaactaaaaactgaggttttgtatttattcttgagcccacctgaaatgttgacgggatagctatactaacttagaatatgtatactgtagtacttaagcatatatgctgtataataatatgttttagaaaattgctcaacttggatttgatgtttttcttttgctcagaagtgtgatgtgttcttgttctgtaataatttagtagacttctaaattagtgtactaaagtaaagaggtaattaactggtacaaatatcaccatgtttatttgtaaggcatcactagtttatatcagagacctggatatggcctcagatttctcctgttttaagagccactaagccacctattttccatttctacactacgtgtttcatggttaggtggccaagtcctatgcatgtatctcaggtatctttagtgaccaacatgaagtctgcacatattgtatatgaaagaaatgttttttaaactggatgtccctagagaagcccttttggcctttggctgcaagttaatgtcctttgaaataaataaataaacactctttacacctgaactaacctaactaacttcagatcagtaatcatataaatttcttggggcagttcctctgacgttgtgaagaatgtggtagtataaaatagcctttgtactcagtttatcaaaactgctcaaaaactttaaattcatgttattcccaccaactaaactttctagatggcatcctaagggcctatgcaatatgagaattcattcttacctgtttaaaaactgcccaggcagccttgccataaacggataattgttcctactggatcccacagtattatgctttctaaaatttctgagatccagaagactgatctgctcttgcccacatgttttcccacataatttctgttttcaccaatcccagtatatgccggcggtgagcagccttttcagcatatgggtcaagtctagaaaattaaatcttttccgaactgcattaaaatttttaagccattttatctttatcaagaaacactttatctacacttacatgttttttgtttttagagtttaaatttcagcacctacataattttcatacccactgcaatatttccatgtaatgctttactatgcaacacatctctctttctttctttcctttccttccttcctttctttttttgaagcagggtgttactctgtcttctagactggagcccaatggcatagtcacagctcaccgcaggcttgacctcccagactcaagtgatcctcctgccttagtctcctgagtagctgggactataggcgcacaccaccatgtctgactgagttttttagtttttgtggagacggggtctccctatgttgcccaggctagtcttgaactcctgaattacaagtgatcctcccaacttggcctcccaaagagctgagattacaggtgtgagccaccgcacctagtgctattcagcaaatactgttgtttgctaatacttttctgtagcttattttgctctgttttctttcttgctattcttagtagctatttaatgttaaaacatgcatactcttatagtacctctataggtcctttaaacaagatatttctattgcaaatgagacaggcaactatgtcatttacacaaaatccttttatgttgaacatacggttgtcaccagctacttttctgttcttacaaatcatcatagcaagaatttaaattgatgagccaaattaataaagcttaatttttaaatttttaaattttaaaacctagtatgtacaacataacttgaataataaaaataataattattattaaaatgggctggggtgcccattttttgggtttctcaattcagttatttttatttttttaatttttattaatcccttaatactccattcatggcaatcaattcagtttctacaccaagacttcttaatagtcattctgataagctcttttttctcaggaagcagttaagcacaacataacaccttttgcttgtttcattggtctttttctagccagtccttctgtaaaaatctgatactgagccaggcatggtggctcatgcctgtaatcccagcactttgggaggccaaggcaggtggatcgcctgaggtcaggagttcgagaccagcccttgccagcattgtgaaaccctgtctctactagaaatacaaaaaattagctgggcgtggtggcaagcgcctgtcatcccagctactagggaggctgaggcgggagaatcacttgaacctgggaggcgaaggttgcaggtagccgagattgcaccattgcactccagccttggcaacaggagcaaaaaaactctgtctcaaaaaaaaaaaatgagatactgattatatgttatgtacttaaagccttgtacctgaatgaggacaaaaaatacacagtttaagacatggctatatcttcatttccatgatctttcccagaataagtagaaagataggtgtccttctatattttaaaatcactccattcttctaaactatatatttatgcaaggattaatttgccctgctgtgtaattactataagaagaacagaagtatgtatccaaaacatactttaaccagcaaataggcttattgtgagaacttcagcagggctagcaacccaggacctaagtttaaaactagaagcactgaggatgagaagtgaggcagtggaaatagctctgagctctcagcatctgtaagtcttaaggaagaaaagtagatgaaagatgtatttgataattacgctgaaggaataaaaataattaaaaacgtgtcatagaggcatatagtgataggcgaggggaaacttaaatcatcaacctggagcagccgtggcagctccatgcgtgaggctggtgccacacagtatcccggtgttggcattgtctccaggccttctctgttccgcacgcagttacaaaacaaaagaacagttgccagcagttggaagaggatgtggatccaaaccaaatgggggacagatactccctctatggacaagatactcatggaagaagtcaagttagaagagcaactgaaggaggttgtggaagaagataagcaagcattggcagatactgagggcttgcagcagagcagccaaaaattggtggaggaggcaaatatgtgtagcattcagggcttctgcaaggactcgttagaggttgcagatgttttggagaaggcaacacagtgtgttccagaagaagaaattaaagacaataaccatcacctgaagaacctctgtgaaactctcacaatgagtgaaggtcagattcaggaagtgttcagcaagcaccaccaagctgaaccctgtcagagccaasttccaccgttatgtgcrtgagggtcttttttttgtctttcttcacatccgacaggcaatgtgccagtgctgtaacaaggtttgagcaaggcatatctcacacatgaaaacccagtgtgaaaacctagtcatcacactcccagtgctttgggaggctgaggcaggtggatsacttgaggtcaagagttacagaccagcctggcccacatggcgaaactctgtgtctactaaaaatacaaaaattagccaggcgtggtggcgtacgcctgtagtcccagctactcggagactgaggcaggggaattgctttaacctgggaggcggaggtttcagtgagccaagtttgcaccaccgcactccagcctgggcaacagagtgagactccgtctcaaaaaaaaaaaaatactttgcaggtcagtataaacacttaaaatatcatttgaatcactgtgttacattatttattatagaaaaagagggaaacaaatataccatatgttttttttttgtgtgagggggtaaaaagcaagaatttgtgaagcggggatgtttccaaatccagcagagtttttaatatattctaaaatgaaagtcatcacacctagatgagatttgggtaaaaaatgaaaatacggaacagtgaaatcagccagagatttcagaaatagatttaatttctcaggagcaagttacatgacacctggaggacgagggggaacaaggttgtgctttactaactgctgatggtgatgacagatacacttgtatagagttttagttctgtttcataccatgcaccttacattccagccaaatcaaagagctaaacatgaaaaaattgagaagaaagtagattaggatatgagctgggtatggtggctcatgcctataatcccatcactttgggaggccaaggcagccagatgagtagaggctaggagtttcagaccagcctggtcaacatggggaaactccatcactactaaaaatacaaaaactggagtttgagaccagcctggtcaacatggggaaactccatcactactaaaaatacaaaaattatctgagcgttgtagcaggtgcctgtaatcctagctactcaggaggctgaggcaggagaatcacttgaacccggaggtggaggttgcactgagccaagatcacaccattgcactccagcctgagcaagagagcaagactgtctcaaaaaaataaaaaaataaaatattagcttgggcgtggtggttcatgcttgtaattccagctacttgggaggctgaggcaggagaatcgcttgaaccagggaggcagaggttacaatgagatcacaccactgcagcctgtgtgagagagcgagactccatctcggggaaaaaaaaaaaagaaaaaaatatatgaacggtaccttaggatacgtatttcagctgtagagaggagcaaaaattgaaccatcaaaaaattgttttacctgggcacggtggctcacacctgtaatcctagcacttttagaggtcaaggcaggaggatcacttaagcccaggagtttgagacgagactgggcaacatagtgagaccttgtttctatatattaaaaaaaaaaaaaaagagaaataaaattaaaaacttacaagaaatttgtttgtttttgagacagagtgttgctctgccgcccaggctggagtgcaatggcatgatcttggctgactgcaacctccacctcccgggttcaagcaattctcctgcctcagcctcccaagtatctggattacaggtgtgcagtagcatgcccagctaatttttgtatttttagtagagacgggttttgccatgttggccaggctggtcttgaactcctgacctaaggtgatccgtccgcctcggcctcccaaagtgctgggattacaggcgtgagccactgcacccagccaaaagaattgtttttaatgaccagataaaaggcttaatagtattaactttttaaaaatctgtgcaataaaaaataaaacatgggaagtcatgaatataaataagagcttcatatagtgaaatatctaaactttactaaaggtagcacctaggcttttatagwtgagggatcaattttaattcaaccaaatggcatgtatatgggtaactagttgacagtgattagggctgcagtcaaggtgatcccatgacttgtgatcaccatgatcacatgtgtgcttgagtgcttggccattttcactgagggaatgaggtgactgcccctgacccccagtgtcctgccttccttttagagttaagccagatggtcgactgctgcaggcttccacaggatgtatcggtgcttggcgtgtgaggtcagtggcctgtgtagatgaggtctgtgacagccagtcctgggggtttgttctcagccttattcatgttcttctactgtgacatccttgtgagaaccattgggagaaatttttgattttggtgtcagaatttcacctgaagaatttgtttgctttcatcttttttttttttaagtttttttttcttttattattatactttaagttttagggtacatgtgcacattgtgcaggttagttacatatgtatacatgtgccatgctggtgygctgcacccactaacttgtcatctagcattaggtatatctcccaatgctatccctcccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcaaactgcatcaactaacgagcaaaataaccagctaacatcataatgacaggatcaaattcacacataacaatattaactttaaatgtaaatggactaaatgctccaattaaaaaacaccatgctttcatcttttgaaccctgaattacgtaactgttttcatcttaatgatgattgctaagaagtttagttagagacagatgtatgggctgactcttgactaatttagacatcttccaggaaaacatttctgtcttgtcatttaggtctctctccatgtgtgatttttttttttttttttttttttgagatggagtctctctgtgttgcccaggctggagtgcagtggtgcaatctcggctcactgcaagctccgcctcccaggtttacaccattctcccacctcagccccctgagtagctgggactacaggtgcccgccaccacacccggatacttttgtttttgtatttttcgtatagacwgagtttcaccatgttagccaggatggtctccatctcctgaccttgtgatctgcccaccttggcctcccaaagtgttgggattacagacgtgagccaccaagcccggcctaaaattttaaaaaaatttttaaaattatctttcttttcttttcttttccttttcttttcttttctttcttgagatgggttctcactatgttgcccaggctggtctcaaactcctaggctcaatcgatcctctagctgcagcctcccagagcactgggattacagttatttgttactctttttattttctagtcygttgtgctgaactgcatttatcttttaaatagactttaaatattctttggcagaaagkgaggaataaatgcatatattctatgtataaaatcagtaaaaccaaatacaaattatcaagcccactgttgtaagggccatagggaaataagcgcatacacgtggttaatgacagtgtgcactgagtttccgaggagtgtggctagcaatagatacttagtgctgtaacggtgtttattcttattaagtggttaatgccacttttggaaatgtatcacagagaatttaactcagaagaagatagtccttacaaaattatttattgctacagtgcacaacaatgaaagaggggaagcaacccaaatgcacagcggtagaggagagttgaataagtcagttaatataatgcaatgytataaagccaccaaaaatgtttggtgggttagataaatagaagtgtccataaaatatgtaaattatcaaaacatgcattaaatctatttaagagtatgtagatatagcaaaaagaatgagatggtcatggtgagacaccactaggtaggaaggggtccccagaaaaactccagctggcctgtgcactggggtggaacttgaagtttgcaccgttgatagcggggaggagcctggcacctcttcttactgtgtaaaacccattattctagctgctggcagaaagcactctagcagggactctggccttgtgagagtcccaataaaaccctgccttactcaccattcaaaccgtctgtaagcctaaatttttgtggccttgagacggacaaggaccccgtccttagctgaactaaggaaaaatcctgcaacagtggatactggaaataatgttaatggataggttttactctcctgaaggattaatataatctgtgagtacttttatgcttactgccagtacaaggagtggcttacttactatcagtacaaggagtatatatactctcttgagcttttctgtttggctatttcagtgcctccagaatgagttgagaagataaatggatcagattgaaaagtacatcatgactcatctctataaatatgtgttctgtccagaaactactgatgatgagatgaaagatcttgccattcaaaagaggatcaggtagttgcttattttgttttgctttatgcttactacctactgatggaagaacatattgggggaaaataaggcatctgagtttcaaaccttaagagaaagcaacagctcatgtttctgcttccttagagtggaagctgctctgtggtgtcagaaagacaaggaatgtggtgacctcacctatccatctccctcaaggcagcttttggtaagtcgtgtttggtgtttgagattgttttcaatctctgaactctccaaggaacagggggactgtgttcttggtccattaccatttcctcaagcaggaagctgtgaatatccgtatcaaggcaggggatgtcggctgggcscggtggctcatacctgtaatcccagcactttgggaggctgaggtgggtggatcacttgaggccaggagttcaagagtagcccgggcaacatggtaaaaccccgtctctactaaaaatacaaaaattagccaggcatggtggcacacgcctgtgcttctagctatttgggaggctaaggcacgagaatggcttgaatccagaaggcggaggttgcagtgaagcgagatcgtgccaccacactccagcctgggcaacagagcaagactccttctcaaaaaaataacaagtcagtggatgtcctctttcctcattcctcccagtggtgtgcatttttcaccattccccagtcacatctttcactagcattggattgatgacatttcccacagcacccagtcttccaggctcactggggtgaaccccagcactgtgtactccagttgcggtggacactgaggaagagaccacccaagtgtgggaacagggccaaggctgagctgatgagttgttctaagaggagaggggactcggagtcccaggttccagacaaggggctggtacttgctagatctgtattggaagtttcacagctgaagtgaggagttgatactgggcaggctgaagttgtggagcccaaggtcaggagccagaagtaaccagaggggccctggaccaagatgcagaaggaaagcagtaaccaagcaagaggggaggcctgcagcagggtagttggagtgcagttagggtgggaccaggaaacacacagtgattcaggtatggtgatcctgcctgtggcgtcctacgcgagctccagtgtgccttagaaattgagggctgaggccaggtgtggtggctcacacctgtaatcccagcactttgggaggccaaggcaggtaggtcacctgaggtcaggagttcaagaccagcctggccaacagggtgaaaccccgtctctagtaaaaatacaaaaattagctgagcttgattgtggacgcctgtagtcctggctactcgggaagctcaggcaggagaattgcttcagcctgtgaggcagaggctgcagtgagccaagatcatgccactgcactccatcctgggcaacagagtgagactccatcccccacaaaaaaagtagttgaggactgagtgtaaaaggacattaacacagtagacagtgaggacaggcagcagccaattctcaaatcgtcactttcaaataccgagtgcatttcagtcttggtagcactgtgtaacgtcacttcagtcagcaaatggccttccattcttgtgataagtacagaagagaagtctcattttaggatcctagctgctttgtcatgtcatttgacctagtacttcgaaaggtgatgtgtgtgggcctgggattgtctgagtggtcagtgatgcctcaggctttccctaaactgaaggaggtgacaagacgaatggtcacggtttgtccttggagctcttgtttactgtctctctccctttagagcccttcactgggttacacctcagatgctgtgtgtccctgttaatgaagacatcccagaagtgtctgatacggtgttgaaggcaatcacaggtcagtgaaaccaagagcctttttattgggatgttttccccttaaagttaacattttactgtaatattagtgtataactttgtaaaatgcagattattgaaggtacattggaatgtagtaaaagtgatttgtaagattgttagttttatgaatttgatggcattcagaagagcaggttaactcttttccccctttattttcagggattatggtctcgtttcttgggcattgaactaaactaaggtcaaatacagatagaataattttttttgttctttttttatgtagttttttaaattcagctgactgttcccatgatagaacaaatttcttaagattcagttgcatttatatattcaaaataattttggagagaggaagggaactggtaaggcaaggtaatccycacgctggagtaacgtagtaaaatgatgcctctgactggttgttagagaagcgctgtgagttatttttctggtttaatcaggaaataaatgaagttccccaggttgatgtggtgctgccgttctagacaggtccagcctcctaataaggtttgtttctcattcatgggaatgacccaggaagagtgcagcacaaacgtttcaattaaaaagaaaatcttaacggagagatggtcatctttggccagtgtctcctttattagaaagaggccttggaaaggcttgttcatgtagacattgttaatgaaattctactggaaaggaagtgggttaactgataatagtagtgttggaggctggccatcgagtaggcttcttttgttacaggaaccagagactcacccaagctacagaagaaatggagatttgcttaaggtattatcaggtttataaagaatctggtggagtctttcaggacctcagccccaacggtcctctagggagtgggctatcttactgcctctacgcagaagagggtctgctccaggcattctctgctgatgtgattcttccacttttcgggttctgcttctctttgtgtatcttcccatgtcaactcctgttgttaagtaaattactggtttctgtaatttcctgtgcacgttctgggggtagaatccaagtggcctaggtcaatactatgtgttttttttcttgcaagcttttctgctattctatggcataggtcatgactactctgccccccgcaccttttgctcggggaacctcataagaggttgaaggtgaaaaaaaaaaaaaagaggttgaagctggaggccttctaaaagcctgaatatggacctgggacttttgtttttcctgactcttactagaaagttcaagatcagctgctttacatttagagtgttccatgggagttttgtccaagccaacgtagcctttacgacctattgctaataaggaagtccccggccttcctggcctctttcacccaggtagggcatggttcattggggcgtcagctggtagcgagtgtttctgtgacccatcagtggtgaaagtaggggtgggttgcccaagggatcagggaagtgtagctgtgttccagaaatattgagacttgataggagaggctgcctgtcaagttacgcagtgtgggtcacattcttctagggctgagaactcatgttctgggctgacaagtaatacgaggtctgttgaagagaactgcataaaattttgagagtcatcaagtgctctgccctgaggtcgaacactcttcaggacttctgaaaggaagtgtgtgtcaccccaggaaggggaccagagagtccatcatcagctcctcttagctccaagagtttaggacaaagagagtgtcagggcctgtggctgatggtggaaatttccctttctctctgttttgtttttttaatttttaatttttatgtgtacataataggtgtatatatttatgagttccatgagctattgtgatcaaggcaggtaatgagtcgtaatcaccttaggggaaatggggttcatcctctgaagcatttagcttttatgttacagacaacccagttatattctcttamttactcttaaatgtacaattaaattacttttgactacagttccccttccgtgctagcaatactaggtcttattcattctttctaacttttctggtaccccttggccatccccactatcccccttgccccccactacctttcctatcctctgctaaccatccttctggtaaaacatccttcagttgttttaattttttagctctcacaaatgagtgagaacatgtgatggttgtctttctgtgcctggcttatttcacttaacataatatcctcctgtttcatccatgttgttgcaaatgactggatcccgttctttggtatggctgaatrgtactccactgtgtatgtgtgccacgttttctttatccattcatctgttgacagacaccctttcccatttggctccgcttgcatgacttctgtgtggctatgggggcagtggttctcagccaggcactagtggtcctgggttcatttgacaacatccggagacatttttatttatttatttttgagacaggatctctctgtcacccaggctggagtgcagtggcacaatcatggctcactgcagccttgacctcacaggcttaagcgatctttccgcctcagcctcccaagtagctgggaccacaggccaccacgcccagctaattgttgtttacattctgtagaaacagagtttcatcatgttgccttgactgttctcaacctcctagactcaattggtcttcccacctttaccttccaaagtactaggattacaggtgtgagccacgaagccgggcctggagacattttaaaatgtcacagctgtggggtgctactaacatctagtgggtagaggccaagtatgctactaaacattctacaggcacaagatggttccctacaacaaagaattattcagccccaaatgtcaggagtgtccatgttgagaagccatgacctggaggaggtatagcctttgttttcacaccaccattaaagataagcctggacacctggatccagcagagatggagtgcacactcagctctatacttcctattcatgagaaggcagagccctgggagaagacatagagcaattatgcagggctctgaaaagtaaatcatagcaggcaggctggggagggaaattattagacagcagtgagtttcctgtatgttgctttcttctcacatatctcctagttgagactttgaagcagtgcaaatcatggaatcacacaccaggatgggaatccaaagagttccacgaagaattccttcaggccagaggatgctaggaaggggtctctgcaggatgaagcatgtggaagagatcccttggggtgtttgtcttcctttattctccttttccttcccttctctccctttttccaccccagccatgccttatggcaatagcagccacacatccagataaaacataattcactttttactcgctttcaaaatgtcagcaataaagatgaacaggatgccagatgaaagaacattgaaaaataaagattaacaagaaagtggtttaaactttaaaagaataaaaatcaccaataaaaggcagaagtctaaagataaatgaaggtattaaaaatggctttaaaaatcttacccaatcttgggccaagcgctgtggcttacacctgtaatcccagcactttgggaggccgaggtgtgtggatcacgaggtcagcagtttgagaccagcctgaccaacatggtgaaaccccgtctctactaaaatacaaaaaaattagctgggcatggtggcgggcacctgtaatcccagcgacttgagaagctgaggcaggagaatcgcttcaaactggaaggcagaggttgcagtgagccaagattgcaccactgcactctagcctgggcaataagagcaaaactttgtctcaaaaaaaaaaaaaagaaaaaaaaagtcggtagtggcttcgtcctccacttttctcttcctccgctgatgcctcccagctctcgtcagcctcctgctggccatctccttaacaccaaacactatgccttcaattcagttgcagagttttgatggagagatatttgcagttgatgtggaaattgccaaacaatctgtgactatcaagaccacgttggaagatttgggaatggatgatgaaggagatgacccagttcctctaccaaatgtgaatgcagcagtattaaaaaaggtcattcagtggtgcacccaccacaaggatgaccctcctccccctgaagatgatgagaacaaagaaaagcaaacagacgatatccctgtttgggaccaagaattcctgaaagttgctcaaggaacactttttgaactcattckggctgcaaactacttagacatcaaaggtttgcttgatgttacatgcaagactgttgccartatgatcaaggggaaaactcctgaggagattcgcaagacrttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaaagcagtggcaagtcaattgtattagcagaatattgtcctcattgcatgtgcagtttgagtacagattccaaacctatggctgagtttcttctagtatgatcaaaagtttcttttttttttttttgctctgaataaaactgaactgtgggttctctataagtggcattttgggttttccttcttttttgtaaagtaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagttaactaggatgtcttccagcctcctgcagtcaaggagtaccactgtaatgattagtctgtatgtagcagggctcccttcattgcatttgaggacttgttttctttttctttaattttatttttaatcctcttagttttaaatatattgcctagagactcggttactacccagtttgtggttttttgggagaaatataactggacagtttgttagcttttcaattaaaaagacacttaacccatgtgggatgtcatgtttttataatcattkttcccatgtggagaaaattattcacactacttgcatgtaaaaaataatttaactttttacattaaaatatgtggtaaaacccagaaagcatccatcatgaatgcaagatactttcaataaaaagtaagttataaaaaaaaagtcttacccagtcttacccaattcttatttataagttccatataagtagaaaagaaaaataaatagatcaagacatagtaacagtaattataacctagaattaaaagattaaaggaaccaaacaataaaataagcaaaagttatgtaattcacacagtagcctcataagggaataaaagcactcaaaagttaagataaggcctgtgcactgcccaatgtatctgtcccccacacgttgtctttcatggcagatgggccaaggagggttccccaggaagctgacctcagggatgatctaagagctgaaagaaccctttggtataccccactgcctggccagagtctgaaagttttattcctgctagtggcaagaatttggtgtaaaattaagctgccttggctcttttatgatgttccaagttaccggcagatgtgcacccatagaggcacgctgcctctccagcagtgctgtcaccacgtgcttcagcaccctttgctgtccgccacgcttgttggaaaaggttgggcattcatgagagcccactgcttggacttagtggtagtcgtgggtagtgaaatttttctctgggagaattaaaatgttattttgagattaaatttattaccttacttgatcccctctgccaattagcaggtgtgaatgtcgtgatttctgtagctagtgaaaatccacatgctgtagagttggccactgtaggcctaagtgtgttggattctagtagctgaattttttttttttttttttaacaggattttgctctcttgcccaggctggagtgctgtggtgtgatcatagctcactgcagcctcaatccctcgggcttaagccatccttctgcctcactgttttgagtagttgggactacaggcacatagaagcacgcttggctaatttttgtattctcacatccagtacaaagatgctttgtgtagcatttttgtatagcattttctgagatatttttttaaaaaggtcagttcagaggatgtgaagtgattttcaagcattgttttgttacagtggttattgattctaggcaagacagtatttaattatctgtaagttaataaggctgaatacttcccccccccccctttttttttttctttttttgctacrgggcctcactctgtcacccaggctggagtgcagtggtacaatcgtagctcaccgcagccttgaccacccaggctsaagcaatcctctcacctcagcctgctgtgtagttggtaccacaggcatgcaccatcacactgggctaatttttttttttttttttttgrgatatcgtgtctcactatgttgcccaggctcgtctcatactcctgggctcaagcagtcctccaacctcgacctctctaagagctggaattgcaggcacgagccaccactcctgacctgaattcttcctttttcttcctactaaactctgcttatttgctttcgactaaatgtactgtgaagctaatcaatttggagtggtgcagcttatggacttggttttctgtgctaagaccctgcgaagtaaggggtggggggacgggaagccaggatgtttagggagcatttctgataaattgcctaaaagatctcaaaacaggtacaaaaattagcttagcattgtagcaggtgcctgtaatcctagctcctcaggaggctgaggcaggagaattccttgaaatgggaggttgggttgcagtgagccaagattgcaccatatcaactgcataccaacttcccacaaaaactgactttttggggactctcacatatctttaaagtaggtcattgaattgatttttttggaggtttctcatattggttgaattattctggtacggactcttgccttatgtagaggtttctatttctcttaagtcagtgtcaatacaatggctggagtttctgtttttgcaacaagaaggtgttggtattttatgtagggtaaatgtgattagaataaacctttggaacagaagtctttattaataaagttttgcaatccacccctgttccaaaaattgatttgattctttcttaggaaaatatacattattattaatactctcatgctacaaaggttttctggttaagctgcagccatcatcattcctaaaaatgaaacattggagacatttgtcaagatactcagtcttcaaacagaaataaaagtagataaaaaaggagttaacataatcagtatagagctattattgtctggtggtgaggacatgaactctggagctggaagtcttggatttggttttgaattttattctgctacttattagctcattggccctgaacaaatctcatgtttcagagccctcagttgtgaaatggagttaataatattactgcttcatggggttgttgtctgaacttagaacaaataatagctattatttgtaaatggttattttatgtagataacccaagagaagtctgggtgttgtggctcacacctgtaatcgcttttggaggcaaggcagcaggactgcttgaggccaggagttcgagagcaacatcagaaacatagcgagacccccatctctacaaaaaataaaacactagccgggcatggtagtgtgtacctgtaatttcagctgctggggaggcttgaggggaagaccacctaagcccaggaatttgagcttgcagtgagctgtgatctcaccactgcatgctggcctgagtgagactctttcacagaaaaaaaaaaaaaaaaaaaaggaaaaaagaaaacccaaaagaatttatattgaaactatagaatttcatctccatcttagagatgaaattctaaaataaccataaaaactaactgtacaaaatgactttcctatatattattactaactacttagcaaatattatggagaaacaattaatttacaatagaaacaaatataaatcacctatagagaacaagagctttcaggatcgttatgaaaaacagaaaattgagtgagaagcacaaagatgtgactgcacagtgccctgtgcttggactttagggctctgtagctgccatcgtgaaattcttttttttctttttctttatgagataaggtcttgctctgtcacccaggctggagtgcagtgttgcaaacattactcattgcagcctggaccttctgggctcaagctagcctcccttctcagccacctgagtagctgagactacacatgtgtgccactgcacccagctaattttaaaattttttatagagacagcctctcacttttttttttttttttttttaagttggagtcttgttctgtcgcccaggctggagtgcagtggcacgatctcagttcactgcaacctccacctcttgggttcaagcgattttcctgcatcagcctcccaagtagctgggactacaggtgcgtgccaccatacctggctaagtttttrtatttttagtagagacgggctttcactgtgttagccaggatgatctcgatctcctgacctcatgatccacccgcctcagcctcccaaagtgttgggattacaggtatgagccaccacgcccagctgtcctggcttgttttaaactcttgggctcaagcagtcctcccaccttggcttcctaatgcgctgggattacaggcatgagcctctgtgccccaccccaccgaaaaaagaaatttgtacttagtttttccccccaggatcctctgtgtgttaaaaaaggttgaatggggaacctgaaactcctccccctgctcttggaagtgtagggcacttcyctttctccacagtgtcagtagaggttgggtggagactgaacttccagccctgccaggtgagcatgaattgtttgttcctgtcctctccaccatctctgtggtattggtgggggctgagaggggagcctgratttctgcctccacccatggtaatgaggtcgcaactcccttttcccaccagtgtgatgttggctaaagaatatttaaatcagattgagagcctcctaatataacaccccagactttcaagacacaataaaaaaatcactcaccatctgtgcgcagtggctcctgcctgtaatcccagcaccttgggaggccaaggcaggcagatcacctgagatcaggagtttgagaccagcctggccgacatggcaaaacccggtctctactaaaaatacaaaaattagccgggcgtggtggtgggcacctgtaatcccagctacttgggaggctgaggcaggagaattgcttgaaccccagcggcgaaggttgcagtgagccaagattgcgccctgcactccagactgtgagacagagctagactctgtctcaaaaaaaaaaaaaaaaaagaaaaagaaaaaagaaaaaaaaatggccgggtgcagtggctcaagcctgtaatcctagcatgttcggaggccgatgggggcagatcacctgaggtcgggagtttgagaccagcctggccagcatggcgaaaccctgtctctactaaaagtacaaaagttagctaggcacgatgatgggagcctgtaaaatcccagctactcaggaggctgatgcaggacaataggttgaacccaggaggtggaggttgcagtgagccaagatcgcaccactgcactccagactgcatgacaagagcgagattctgtgtcaagaaaaaaaatcatatctgaaccaaatgacacatatgttggaattacctgacaaagattttaaagaaaacatcataaaaattcaccaatgagtaaagagaaacatgcttcaaacaaatgaaaaarccccagcaaaaccactggagacatgaaccaaatggaaattttagaatcgcaactgataataactggaagttcttaaatttcgtattagagggccgggcatggtggctcacacctgtaatctcagcactttgggaggctgaggcgggtggatcacctgagctcaggagttcgaggccagcctggccaatgtggtgaaaccctgtctctactaaaaatacaaaaattagctgggcacggtggtgcatgcctgtaatcccagctactcgggaggctgaggcacaagaatgactacttgaactgggaagcagaggttgcaatgagccaaaatggtgccactgcactccagcttaggcgacaaagagagactccatctcaaaaaaaaaaaaaaaaaaattcatattagaattgcagtgactgaagaatggatctattaactgggatatagatcaatagaaattcccaatgtgaacaacagagagaaaattgaacctttaaagtgtaggcttagggacaggtgggacggtaaaaaaaaaaaaaaaaaaaaaatctatcattcttgtcactggagtcctagaaggagaggagaaaaatgcatatggctaaaaaattaaatagcagctgaagatctcccccaaattttcaaaggcagaaagctgtagatttaagaaggagaatgaaccacaaacaggataaattaaataaattatgcaaggatatgtcacaaacctctcagaattaaagacaaaaaaaaccttgaaagtagttaaacagcaaatgacagattacctatagtggaacgattgattgatggatggatggattttttgagacaagacctctctgtcacccaggctggagtgcaatggcaaaatcatggctcaaggcagcctcagctcccagactcatgcttcagtgaggtgtgactctgccactgtactccagcctgcatgacagagttagagtttgtctcaaatttatttatttatttatttttggctaggcgcagtggctcatgcttgtaatccagcactttgggaggctgaggcaggcggatcatgaggtcaagagatcgagaccatcctggccaacatagtgaaaccctgtctctactaaaaatgcaaaaattagctgggcttggtggcatgtgcctgtagtcccagctactcaagaggctgaggcaggaggatcgcttgaacctgggaggcagaggttgcagtgagccgagataatgccactgcactgcagttcaaaaaaagaatttttttttttaattaaaaagttctagtatctaaaatgagcaaaatcactgtgtgcagccgaggtgggtggatcatctgaggtcaggagttcaagaccaggctgcagggagccgagattgcaccactgcactccagcctgggagaaagagtgagactccgtctcaaaaaaaagtaaaaatgcatttaaaagaacagcatcaaccaggtacagtggctcatgcctgtaatcccaacactttgggaggctgagggtggaggatagctgagcccaggagtttgagaccagcctgggcaacatggtgaaactctgtctctacaacaaaaattagccaaacgtggtagcatgcacctgtagtctcagctacttgggaagcaggggcaggattgcttgagtctgggaggtcgaggctgccatgattgtactacctactccagcctgggcaacagagcaagaccctgtctcaagaaaaaaaatgcaaaaacaaaacaaaagagaataacatcatttccttatcattagtttgaagtgagtcattggtaaaagtttctattttcaaaaaaagcattaaaatatagtgtgaggccaggcatgatggctcattcctgtaatcccagcactttgggaagctgaaatggattgcctgagccccggaggttgaggctgcagtgagccatgtttgtgtcacttcacactagcagcctggggaacagagcaagaccttgtctcaaaacaacaatacgtggtttaccacaaccaacaggaaaaatctgkataaaactgtatgaaatatttactgctgtgctcaacatggtagtgtagaggtcaagggcaaaagtcctggggtcaggccacctggtctrctgtctaattagctgtgtcatctttggaaaggtacttgaactctctgtgccttagaattcgttttctaaaatgtgggcggggcacggtggctcattcttgtaatcccagccctttggcaggctgaggccggcggatcacgaggtcaggaggtcgagaccatcctggctaacacggtgaaaccctgtctctactaaaaatacaaaaaattagccgggcgtggtggcaggcgcctgtagtcccagctatttcggaggctgaggcaggagaatggcgtgaacccgggaggcggagctagcagtgagccgagatcacgccactgcactccagcctgggcgacagagcgcgactccatctcaaaaaaaaaaaaaaaaaaaaaaaacacacacgcacacacacacacaaaattagccgggcgtggtagtgggcacctgtaattccagctactgcggaggctgaggttggagaattgattgaacccaggaggcagaggtttttatacttgctaggcagaacttaattaacaatcaattaggaaaagatatcgaagcagtaaactgaagtcagggtgaaaagttctgttgaccaaacatggattctctccttctagaaccaagttacagttggagttacagaaaatactttgaacaggtcctttggtatcctgtaggaaatcagacaaaaacatagatcagttactttctttttcttttttgacacagtgtctcactctgtcgcccaggctggagtgcggtggccagatcaccgctcactgcagcctccacctcctgggctcaagcgatcctcctgcctcagccccgcaagtagtgcggactacaagcccgcgccaccatgcccagctaattttttgtatttttgtagagacagggtttcaccatgttgcccaagctagtctggaactcctcagctcaagcgatccgcccacctcagcctcccaaagtgctggaattaagggcccctgagccacggggccggcccaattactttactcagtttgagcattagcactggaagaaaagctgtcacttgcatatatatttttttaaagacatgatctcactctgtcctgtcacccaggctggtgtgcagtggcgtaatgtcggcttactgtaaccttaacctcccgggctcaagcaattcttttttttttctttttgagacggagtctcgctctgtcgcccaggctggagtgcagtggagcgatctcgactcactgcaacctccgtctcccgggttcaagcaattctctgcctcagcctccctagtagctgggattatcggtgcccgccaccacgcccggctaattgttgcatttttagtagagacggggtttcaccatcctggtcaggatgatcttgtactcctgacctcgtgatccacctcccttggcctcccaaagtgctgggattacagacgtgagccaccacgcctggcccgatcgcttttatttttaataagatgttttcttcgtttcctagccccttctaccaccctacaaatttccaaagattttaatgttgctgcaacagccatcagatgtcaagctagggggtgcagctccctaatgcggggcagcctcagagggggccaaccctgcccagtatgagcggcgctgggcggcaggggacgctgctgtggtccccggtacctggctgggttaggtgttgggggccgcacctacacagcctcaggtgaggcgagtgcgtggcaaggactgcagctggctctagcgggcttgtgctgtccattgaggagcttctgcgccaccttgtgcttgtgcccgctgggcgccagcaggttggtgcgcagcgcgtgctccagtagcgtcaagcccttgctgcgcccaacgcgcaggtagtagtaatccaggcagtggtaaagctccccttgtagcttattgttgcctgccgccgggtccgagccygcagaagctgacagctgcctgtggccacccgcctgcgcatgcgcgcttctggaagacccaggccccccycccccgcagccccgcctcgagttccgattgggcgcacctctggtgacgtcacggggacgggcgttcgccgaaggcgcgtgtcttcggcgatgtcacagcaccgggccttccgcgacgtcacagtgacggtacagtgcctggagctaggctgttttctccttagagtggagcttggtaaccgcgacctccctgccaggtcctttgtgttgctgtctggagatgggtagttgacaaactccgacccagcactgtttctgtgggtcaaaactagaaaactatgtctggatgcggccgaggcggaaggatcccttcaggccaggagttaaagagcagcctcagcaacgtggcgcgacccagtctcagtagtttcacctcaacttcccagctccttgaaccccaaggttcaaggctgccatgagctgtgatcccatcacagcactccgtcctgcgagactgaggtaaaccatgtctaaaaaaataaaaaaataaactatccaactgtgcaacagggagggactgcttaaagaaaacatgaggctggctggactctataatcccagcactttgggaggccgagggggaggatggcttggtctaaggagttcgagactgccctgggcaacgtgacgcaaccccgtctgtagaaaagtttcaaaaattagccaggcgtggtgcacgcttggtgtatttttttcccccccgagacggagtctcgctttttcgcctaggctggagtgcagtggcgcgatctcggctcattgcaagctccgcctcccgggttcatgccattctcctgcttcagyctccccagtagctcggactacaggagcccgccaccaagcccagataatttttttgtatttttagtagagtcggggtttcaccgtggtagccaggatggtcttgattttctgacctcatgatctgcccgcctcggcctcccaaagtgctgggattacaggcgtgagccacggcgcccggcctgttgcatctagttttactcaagcaaaggctgtggacttccttagtttacactgatgtattctagtttgcatctgaagtgtactctgaggatgctgacttccagatagccatttttgggtcaagggaagttaaagtctcctgagtatagtagccataccacctagagagcttccttttagtttgcttaaaaaatgtattttaccttagttttcttacattaggtgggcaaaataagaaagagcagaaggccaggcgtggtggctcatgcctgtaatcccagcactttgggtttctgagtcaggcggatcacctgagttcaggagttcgagaccagcctggccaacatggtgaaaccccatctctactaaaaatacaaaaatcagccgggtatggtggcatgtacctgcaatctccactacttgggagtttgaggcatcagaactgcttgacctcagtaggcggaggttgcagtgagccgagattgcaccactgcactccagcctgggggatagagcaagactctgtctccaaaaaaagaaaagaaaagtttagggacactcagcaaaactataaggcctagaattggaaactgggaattactctgttcgtagataatttcttttcaagatgggctagtggagtttctgagcagcagctatgttctcctttcacatcttcaggttttatgaggttacctttccccctctgagtgatcagatctgcctcacagtcactcatgggagcccttgatctcgacaaaatagaccttgagtagctgagttcaaataactgaggtggcaagaggggatcggcttcttggttcgtgtatatatatatattttgttttgttttgttttaatgaaagagagaagcagtctcaaggtcaggataactcaccctgatgttctcacttttcagggattgtgctgcattctgacttagattctgccatcaaaaacagaatgccctgatccttagaggcagaggcagctcttcagcctatggggtaagtaaccagggaatggagttctcaccaattcttattttctatgctaaaagttttactttaagatttgggcctggctgggtgccgtggctcatgcctgtaatcccagcactttgggaggctgaggtgggaggtcaggagatcacgaggtcaggagatcgagaccatcctggctaacatggtgaaaccctgtctctactaaaaatacaaaaaattagccgggcgtggtggcggcagcctgtagtcccagcttctccggaggctgatgcaggaaaatggcgtgaacccaggaggcggagcttgcagtgagccgagatcgcgccactgcactccagcctgggcaacaaagcaagactccgtctcaaaaaaaatatatatttgggcctgcttcttttttgtgtgtgtgtaatggagtttcactcctgttgcccaggctgtagtgcactggtactatctcagctcactgtaacctccaccttctgggttcgagggattcttatacctcatacctcagcctcctgagtagctgggattataggcatccaccaccatgctcagctaatttttgtatttcatagtagagacagggttttaccatgttggccaggctgaaacgccttacctcatgtgatctgcccaccttggcctcccagagtgctgggattacaggcgtgagccaccgtgcccagcctaaactgcccaattttaaggggacaattgggaaaacaattgtttaaaaaggcaatgaaggcgttgccatgactgtggttagcagtgtgaagatcctagaaaacctgcgtgaactcctgggggctcatagtctactgcctggtcaagagctttagaaaacttggatgtacatgttaggacaccaggttctgaaagctctcagggttgtataaacttctatattaagttccatgatgctcgatgggtagtcccacatttagacacgctattgctattgctgcttctttccttatcatgaaaagagaagatgcagataatacctgaagcaggaagacaaaggggagatactgaacttgtcatctaactttgggtgcccctcatgcttcgtgtttcccattgagcctcatttatcagtgacacagggaatggtccctttgctctccactttccctgtggctgcctggaggtaggggaggcagatcatgtcacttgccgacattatgttgctgtggattcgttggagcgacaggaacaggaaattttcctggtggtgtatgtatcactggggctcacaggggtactttttagtcttctcactggcctctgtgattctgtgaccctggttattacatgttcagaaagtgtcagcttatttgaaagtgatactcttcttttctatttaaacattgccaaagaccatcacactatttttttaaattgaaatatttttttattttttattttttggagataagagtcttgccctttcatatgaacatgaagggactcatagtccttcacctgttgttggtctttaatttgataacgtatcagtaaagggttatgtctgaatgaattatagaagtttaggacctaaaaaaggaaggtcccagaaactgggctttggtttatttttactactacacttgctatcgaaaccaagcaggtgacttcatttctcttggattcagctttctcatgtgtcaggatgggagaggaagggaggcgttgggataagtgtcattccactgtctgtacttcaaatctggctaacacgtgtggcaaatacttagatttgttgacagaggtttcctggagtgctgtcttgaacgattctgaacaggctcagcaagaaagtrtgtttcagttttaggtgtatctgtcatggagaaggaagtaaggactggggagcactcacagcattcctggggcattcctgtccattatttcaatacctggtgctgatgtttcctgtctcttgtcaggaatcctgtctactgtgtgtctgatgacatgaacttactgagtgctgcttagttgcatcatagacaccacctgtctttgaacagctaccctgactcttgayggaatgcaaaggctgccgagggccactggtgtgtggaatggccttcggtcatttctgcttagaacacagaggtcattttggctactaacataactcttcttttgagtgaaagggttaaaatgttcctcccaaaagtacttaatttttaggcttgttcttcagatttgcccaatatcctaagcaaaatgccttcaatatgaagtgaatattgcttgattgtagggaacttgtccataatgtacttgagaatgcagatamaaataaaagaatgtctgtgtcaaattttatttttcacaaattatgttctctttcagcttaagctcttggactcactgaggcagtaaaagaaccatatcctgtgtttgaatcaaaccccgagttcctgtatgtttagaaggtttgccagacaggattcccttttgaagccctcctggtttggaattccatgacttaaaaggatcgtccgtgggagtaataacatcaagtctgttggtaaaaagtaagttttaggccaggtgtggtggctcatgtctgtaatcccagaactttgggaggctgaggcgggcagatcacctgaggtccggagttcgagaccagcctggcagacatgggaaaaccctgtatccactaaaaatacaaagaattaggtgagcatgggggcgggcacctgtgatcccagctacttgggaggctgaagcaggagaatcacttgaacctgggaggcagaggctgcagtgagccaagatcacaacactgcactccagcctgagtgacagagcgagactctgcctcaacaacaacaacaacaataaaaagtaagttttatttgccactgtcgtcatttctggaattaaaacaataaaatgacatttctactaaaacgtttttctagctagaggtgacaggtgtggctgtaagtccttgatggaaaagcctggctctgagccacagtcctggcactctccattgcccctgccattccccatcccgtactcagtcatcttcatcagtgcaagaatagtgaccgctgcctccacgatgttcagacacactgtggtggcatgcactatacctaagtacttgaatgaagtttaatctgctgggttttttctgctctgttattcctgggtcaatcttattagcaagtaaatattgatgattgagtttcttctcctttttctgagacagagtttcactcttgttgcccaggctgcagcgcaatggcgcgatctccactcactgcaacctctgcctcccaggttcaagtgattctcctgcctcagcttctgaagtagctgggataacaggcatgcaccaccatgcccgactaatttttgtatttttcgtagagatgatgtttcaccacgttggtcgggccggtctcaaactcctgacctcaggtgacccacccacctcagcctcccaaagtatggggactgcaggtgtgagccaccatgcctggcctgatgattgagtttttcttattatatctgcatttctgcagaactttagtggctgaagaaagtacactagtgttaattttctttttcatgaaagaagtaatttactcttcagacaattacttgccagtcataggaaggaaaagtcagggttttcatccacaatgataggaattattgtgacattacaggatgactctgtgatcagctttaggaaaaaaccctggtcatatcacaaccgttttactagctgtgaggccaccattgttggtaaaaagtaagtttctttctagacctgaactagttatttcctagttacctcctggagtggctaataaaataaacactaaaggtaagagattacctgtatttcgtattatatttcactgcattaagacactctatatcagcattttttaaatcacacagaatcattgtccactatctttgtgggacttgcagttagtttcttgcctttttaaggtattttatttaatggacttctttttctttaaaaaaattttgttggaagtgtcacatttgcaatcccacttcactcatgtttccatggctttgttgagccccctgtggaggattacactacaagtttaattctgcaggtttctttgaaaagagccaaactgaaagaattttaatgctctgctcttataaagcatctccttctgtatttttttctacaatatactaaagtaattctgtgctctattttacagcttcgcagtttctaaaaagaccacgaagccctgagagtaatgaaaaggttcctgaaattgaggtcactgtggaaggtaagggccagtccttgccatgtttctgttaattctccagtttaatagttatgtcaattcactagcttcatgtttatacagatgaaggtaaccaaactagttttacctgtgaacagctgcctgtgataaagctaaatttctgaatgtctttaattgaaattttgaaaattattaacagggagtaaataacatggatcacatcataaactgcactaaagaaaatccctaaaatgcttttcctttattacaacaaataagggtgcagagggtcacatggaatgtttcatcttttgtctgctttttttttttttattcttttaaggaaaggaagttgaggggtggtttaaacagcagtgcctggaatcaaagtatttcctacgacaccctctaatgtacttccttctctccatgcccacggggtctgcagggttctcatcttttcatgttcacagtattaaaatacttcatacaataccaaagacagttcccaaccaaccatcaaatatgggtatttcttccatctcctcataattgcaaaaggaaataactgcgttaggatcattcttttttatttggagatgaaagtctcgctctgtcatccaggctggagtgcagtggcatgatctctgctcactgcagcctcagcctcctgggttcaagcaattctcctgcctcaactttccgagtagctaggactacaggcgcacactgtcacatctggctaattttttttttctttttttttttttttttttgagacggagtctcgctctgtcgcccaggctggagtgcagtggcgcgatctcggctcactgcaagctccgcctcctgggttcacgccattctcctgcctcagcctcccgagtagctgagactacaggcgcccgccaccaagcctggctatttttttttttgtatctttagtagaggcggggtttcactgtgttagccaggatggtctcgatctcctgacctcatgatccacccgcctctgcctcccaaagtgctgggattacaggcgtgagccaccgcgcttggctacatccggctaattttttgtattttagtagagatggggtttcaccatgttgcccaagctggtctcaaactcctgagctcaggcagtctgcctgcttcggcctcccaaagtgctaggattacaggtgtgagccgccgcgcccagcctaggatcatttttttctgtcctaggtgttgattttttaaataagagtttgcagtactggtgtttagtggtgcaataatttccatttaatcatctggcatacgcagagagtataccagatgactgagagtatatctcacagagagtataccagatgactgaatggggattagagcgagtatttaaactcttcattcattgatcctgttaaaggaaagcttacttaataacataaactcttggttatgaattagatgtttctcctatgaaagcttgtgggcatctttgagcaacttaatacctgattatttctgttcaaaaatgccgagaactaaaaatccattcaaacctttacttttctccttttggaaaagtgcatgaggtgttccttttggtaaaaagacacactgtgcgaccacagagacctgagcctgaacccatgaagatgtgaacaaggtgaacaatgagactatgtaaaggggaggttaattccaaggtgacaggaactttatggagaagattatgatttctacactttgtatccccttctaactctagtatgaagttacattgtatacgttggtgctctaatctcagtctgtggatattagatattaagattggggagaaaataaaacagccagttaatgtgcaccatttttataggtactgtcagtagcatataagaaatagcatgtttctcaaaagtaaattagttcatagtagtcagttggcacatttggcaggtacttctgtgaacttttttttgctatctttaaactcttcattcattgatcccgttaatccaaagcttatttaataacataagcttttggttgtcaattagatgtcaggaaaaacagagaaatgaacagctaatataatgagttaaaaggattgaggctgtaggaataatgttaccaagaataacttgaggattgtttgctactatagctagctgtgattatcaaaatagggagatgcctgtttttctcacataaaagtaattgtgcaggtaggctgaggctgacattggttcagttgctcaaacatggtaagactggcttccctgtgcctctcttcactctcctttctggtgcacaatgaccaagagagctcctgtcgtcatgtctccatccatcatgtctccatccaattataagtaaagaaaatgcagcatgagccctgcctgcacccacagtcaggaaaagcaagaggctttttttgaatcctagcagaattttgcataagcctcttggttttaaaaaaggtgaattttaaaataataaaataaaataaagcacaaactctgaggccaaggtaataggatttaaatctgtgctctgccacttagaaaaattacttaaattctctattctttaggttgcacacatataaaatgggaggaagaaaataatatttgactcatggtttttaaaatttgaggtgttatttctttaataaacagctgctatcatttgagaacacttgctatttaggcagttaggaatttttcattagaagggatgtaaagaaagacgatgggcatttgtaatggatttaacattcatcatttggctgcctgactgacccccagagctgtgattttactaatgaatttttcagaagtcccttagctagcaatgagcctaaacagcctcccactctcaccattcagtgctcttgttcttatgtgtttctctacaaacttggttactctcacaaagtgataaaaacttgcatttcttttctttcctttttagagacaggatcttgctctgtcactcaggttgcaatgcagtggtgtgatcatggctcgctgtagattcaaactcctgggctcaagcagtactcccgcctcagcctcccaagtagcttggactacagacgtacaccaccatgcaaagctaaattttttatttttttgttgtagagatgggatcgtgttatgctgcccaggatgatctcaaactcctgtcctcaattgatcctcctgtctcagcctcccaaagtgctgggattataggcagccatgggccatctgggtccagtctgctattttctttttttaaataacaactttattgaaatgtagttcacataccatgcaatttgtttatcaaagtatgcaattcagtggtttttagaatattcatggagctgtgatctatcaccactatccattttagaagctttcattaccctatagagaaatccgctgttctttgccactagctaagaacatggcggggagtaagctagtggcttactcccctcaacgcttctgtgttccccataggcaaccactgatctattttttgtcaccatagatttgcctaatctggaccttctatataaatagggttgtgcaatatgtgattgtttgtggctgtttttttttttccctcttagcacagtgttttcagagttccttcctgtcatagcatgtgtcagtatttcgttccttctatggctgaataatattccatggtacagaaacaccacattttatttattcttcagttgatgaacatttgggttgtttccatgtattggctgttaatgaataatgctcctatgaagattcatgtacaagtttttgtgtggacatacatttttatttttctgggatatatacctaggagagaaattgttgcattctatgatgttgtacatttagccttttgagaaactgttttccaaagtggttacaccagtcaggtgcagtgactgatgtaatcccagctacatgagaggctgaggtgggaggatcacttgagcctatgagtaaagagagaccagcctgggcaagatagcaagaccctgtctcggtttttgaaaaatcaaattaaaatgacaagaagacaggtgcggtggcttatgtctgtaatcccagcactttgaaaggctgaggtgggtggataacttgaggtcaggagttcaaaaccagcctggctgggtatgg

SEQ ID NO: 10825 - DNA, 54016 bp, Homo sapiens
  misc_feature (1)...(54016): n = A,T,C or G, or insertion/deletion polymorphism (see Tables 1-2)
ctcctcccaacacctttcttctcctcctacccctccaggggctggggccgccacctgctggcactcctgggtactgctggaggactcgccgtactgttgccttgtctcagtaatgcccggatgccactgattatcctagggaaacagaggggtagggaagggtggcagtccccaggacacagacacttaggtagtagaggggatgctagaaccagaggcccagggcatagatgtccttatcagagaagcactgtgtctgacccaccgtgctgaggagggtacagaggccagggaaggaaaaaggccatactgtgagtcaagtggccaggcacaggctgggacacagaagcccaaactccctgttgagatgcattcctgcagcctctcaggtggataaagagttgggggcagcacggagtacgggtgtgtgtgtgtgcagtgttcagtccatgatcggccactgcagcctccacactcgtcccatgcctccctcctgccccctttcgtccatcctccacagtgcacttgggtgacctggtctcatcagtcccctgtttaaaatcctgcagtggcccctactgaccctcaggataaaagtcagactccctcgagcccacaaagccctgatgcctggccactgaccacctctccaatcttccatcccactgccggctctctgcctcaaccattcttttctctttgttcgaacccatcaagatctctctggcctccaagcttttgcagatgcttttccccctgcctcgaacactgttcctactcctgaatgtgtgtggcctcacaggcctgcttcctccccacagaagccctattgtacctgaacaagaactcccatccacccagctcattattctctttgtctctttcatcacactcatcacaatttgatattattaatttgtggtttcctcggtgtttgcttgtgaactctgtgaggacaggaggacagggcacatagtaggtcctcaattaacttctatcgcatggatggatggttggaggaacagttatcttagtgataactgggtgttagatggagaggccccaccctaggcctgctgtgtgccctcaaaaaagttctggtgctctccagaccttaggagccagtgtattcagtgagggtgagggccctgctcttctggggatctatgagccatctgcgtgtaccagatggacacactcaagttgcccacggtcctggggctgagagggaggccagcaagggggcaaggagaggctgaatgggcagtgtcttgaagcctttatctcctgggaccctggcagacctcggtggctacagtctggctcagtaagacagtcctaagaatctagggagggaatgtggcccaaggcccctgctggtcttttgcccactcagaaagccactacactgagtgtccaggaggtagggggacagttcccactctgtgcctctctggctccccagccacaggcacaaggatctacgtgctctgctcagggcatgcatgggtggaaggacactgagctggggatcaggagtcctgtattctagcttccctcagccccaccgtgaacctcagacaagtcccctccactctctgggcctcagtgtccatgccagcagaagggacatatcttagggtcctgacgtctaagatgactgtgtgagcgcctggggtatgtgtgctgcttcctcatcaccccccacccccaccccacaactctgcctggggagcctgggagtgggggcagagccaggagcgtgggagagccagatgtggtggccgctgccctgcctgagtgagggctgagcggcctcctgggaattctcccactcaggctccctttccggttccctccccctgccccactgagagcagcaacttccggctctgacaagcgtgggtgggggaggggggtcttagcacgggggtctgttcagcctggttccctcctctggggaagagcatgggcttatgagtctagacagaaagcctcggttccagtcccagtctgtggctgacacatcacaaggccttgcacaagttcctttccatcactggcctcagtcataccggctgtgtaatgagcatgttggtgagcttccctccagccctgatggtggacttctatgacagcagctcttggtaacacctgaggatcagtcacctttttttttttttttgagatggagtttcactcttgttgcccagactggagtgcaatggcgccatctcagctcaccacaacgtctgcctcccgggttcaagcaattctctggcctcagcctcccgagtagctgggattacaggcatgcaccaccacacccagctaattttgtatttttagtggagactgggtttctccatgttggccaggctggtctcaaactcctgacctcaggtgatccacccaccttggcctcccaaagtgctgggattatagacgtgagccaccgcgcccagctggatcagtcaccttttgtggcactttcttgttttgctcgaggcttgacaaaatgcctgtgggcatggcttattcaggtctctccacaaccctgtgaggtaggcacatgtgtccccatttcacagttgaaggtactgaggctcagagagctcaggtcatatcatctcccagcgtcacatggctgggaagtggtggagctgggttggagctgccaacatcagagtccagacatttaactcttgagtgtgccaccgtgctgtgggggaaggcagtgtggaaccctaaggcccagagcccccctctcccactgtaccccatcccagtccacttcaggcagggctccccacattccatgctctgcccacctactctcagcccaggcttccccaagacagcattgtccaaggctggactgggttcccagtatctgtgtaggtgtgaggatgttcatagcttgtcctgtccacagtggggctgggggccatgctgaccaccccagggtgatggtgctgcactgcccatgtgccccgtccattgccgctgaaggcagagtgcacaaggggaatccaagacccagaaaagggaggctccgcccaggaagacacagtgatggaatgctgctcgaatgaggaaactcactatttcagtaatagtgtacacttagtacacttcgaggcaatgtactaagtcctttgtacaaaccgaagagtcttatgaatcagtctttgacttgtctccattttccagaggaggaaaccaaggccaggagtttaagtgacttgcctaagctcatgtagcttgaaactggagcagctgggattcgaacccagctctatctctagctctccaacctcctctgtcaatcatgacaattttgccccttggtgagtgccctgggttgctccctgtagctctgcacctcccacccatatctcagttgagaggaggagtgacagtcctggtgcccaccaagggttaatggcagtaggggctaagtaattccagatgggcctcaggacggctgggctggccggaaactggaggccgccagcttcccaggggagccaccgccaactgcccctcccctttgtgctgcatctctggccccagctgtacccctgccctagggcccaccagcctcctctcccttgctagagtccagctctaagggaaattgcagacggaccatcccaagggccttgtagcacagtgagtccacaactgttatgtacaaatagggaaaccgaggctcaggcagggcaagggacttattcaagttctcctgataagtctgtggctgggtcttctgactcccagactagcttctttggggactagggggttggtgtgtctcgtggcctcccccaggctggcctggctgcagagggtcagccaaggattcagaggtgaatggcccaggcagatgctaggaggggagtcgtaaatttctgacggaatctttgggcacaagaaatccctgtgcaagcctgaccttgtggcctgtgggatcttttcacattcccctatttccctgttgccacaaagacctggccaggccccctctctcggggtactcttatggtccccaacccgtggctgggaaccagtctgagaacacttctccttctatgtggtccagcccagatgctctgctgggcaatcccgattgggactagaccaagaaatgcaagatagttgactgtggtgggcatggaatcccagctcacgcaaatcctctgctctgtgaacaggggtctgggggaagctgaggaggaaagacttagcggcgcagagggaaggagggcagagccagcctctacctgtgtcacctgggacagctttcttcaccctctggaattcagttgccctgtgggtgcagtagtgggagcaggggtggtaagcccactctatatgcccttctaaaataatgccctttgccatctgagggctaggagtctgtaactggagatgtcttctgatctgagaagctgagggtggaagaagagacccagctgggggaactggaggagtcttggcagaccctggtaggaaaggagagccagagaatggaaatggaacaaaacggatacttgaaagtatcttgttgaggctgggtgcggtggctcaagcctgtaatcccagcactttgggaggctgaggtgggtggatcatgaagtcaggggtttgagaccagcctggccaacatagtgaaacccggtctctacaaaaaatacaaaaatagccaggtgtggtggtgtgcgcctgtaatcccagctacttgggagtctgaggcaggagagtcacttgaacctgggaggcggaggttgcagtgagcctagactgcgccattgcactccagcctgggagacagagcaagactccatctcaaaaaaaaaaaaaaaaaaaaaaaagaaagtatcttgttgagtgactgaatgaaagagccacagggggaacctaggaagaaagcagggcagggggttcatctacactggaataggggtctcgggtgggggtcagatgacttgtgtctcttccatcatgtgtctcatgagacctagttctgccccagctctgccattgctgcgtaagcttgggaagcttattttgctcctctgggcctcagtgtccccatctataaaatggggcaaataatcctctccttgcaccccaggggctttgagacgtgaaaaggaatgtatctgtcaatatccagagatatccaatctgtgctggatgaccttgaccaaatcacattccctctctgtgccaattcacccctgggccttggtttgtccttctgaaaaacggctgatcatcttggaggatctttccatctcctccatgtcacctcttctcagcagtgctctctgattctctcaggcttccgttaggggtccttctaaatgcactctcagcctcctgtctgccgaccgggcacctgcttgcccaatgaatatcttgctcactagcctggtgcttctgaggtcaggaccacgtcttgctactgtcccctgcacccagtacagtgttagaatgtagtaaatgctcagtatgcttgttcaatgaatgaaggttgactgaatcaaccacagagatgatcagagtctcctttacagatggggaaactgaggcactgagaaatgatctccctgggtgccatggcaaggggaggccgccacccgacatgggcatcgggaaagtggggccgaggccactctttgacaaaagtgactcagcagctggcggctggcgtgggctgtggaatttctaagcatcccctcacatcctgagcgaacgggcgatgggagggagtaagcagagggaaaagaagaaaaacaagaaacttgggggaaaagaaagagagagggggaaaaaaactgaaattgaaaacagacgcacgcgtccaccctccctgccccgccgcccccccttctcccagctgggccaatcagaagccaccctgcagcctttcccccaaagtggcgggggaagtgggggggcatggaagcccatagtggtgtgagctcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagayagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggtaagtgctggaaaaagtgggaaccccagccccatgccctgtccctttgccctaacctgcatctcttcgagtaggtaaaaaaaaaaaaaaaaaaaaaaagggaagatatttttaacaaaacaagatgagaggaggctgggagactgtgggtgatgtcagggatggaggagccagttttctcctttcccctgctctggggtgagtggcctccacctcatcatccctgctgttcctgccttcatcaaacaatcctcaggggtttctgggtgctgactgggggcctccaaagcacagcacagtcaatggggagtggggagagctgggaagagcgggagaggggaattgggagaaggtaggcagggtacacagaaagcaggggactggggacctcaggaccatagccgctgttccttggcccaagccttgtttctaagaatcagtctggctttaggccagtcagccgccaggcaacctctggggatttaaatggatttgcaaattttctagattcttaagatatccttctaaacccccagcagctagaaaagtttgagggctaggaaagttcgagggtgatgggcggccatggcaaccccctagcggtcatgctgctgggtctgggggctgggacctggctgtcagatctgggggctcctctgtgaagaaggggtcagccactgggccatttcctttggtcccaggcagctgctcaggcctcctcgttgtctccctccttctggactctaccccttctccatgccattctaaagcataaatccaatcacaccacctccctgcccaggatccgcctatggctccccagtgcctggagaaagtcccarctcctaacagaggctgccactgcttgacacttactgcacgccgcaactgtgctgagtgctttatgagactgatctcatgtaatgctcaccagcaaccccagaggcagtgactgtttttacctccgttttatacatgaggaamttgaggctcacgcagccacmtaactgtagccacacagctagtaagtggcacagcctggagaggttggaatctccccgtgccccattactccaaacttgggccttttgttcccgccagtcagatcccanaattcccagaaggaatgcgcaccatcctgcttgtgggcatttgccctccctcttccccctttctggaatgcccttcctcatcacttttctttcagggatattccatacaccacctcttccaggcagccttcctaggttcttcctgtcttccaagtgctagccatgcactttgtgctgaagccatgttacttggccctcccctgttggtgatctgtttatgttctgtttgttcatcagagattgttcaggccccagcagtcagaactgaggccgcactttctgctggggaaaggtttaaggtttccccatcctgtgctcttcccccagtgcccagccctggataggcagtgcggctgaaaaaatgtcctggtgaaagggaggaggagctcactgaagaccttctgctcccaagtgtgagactagaacccaggcctccagccttctcacaggtgcccttccaggacatcgtgtggctactccaggcagcattcctccattgcaagcagggaggagtatctctgcttccctctgtgacctcccaattgcacagaggcctctagtgacaagttctgaagtcatgcagtcctcccctgtctccaagcaggagaccctgaatccacagccttcagggacatacagtccctgaacacctacctcatgcaggcatagagcctggtacttcacacaccttggagtcctcatggcaagtttttgaaatcagtgttattacctactttttgtagatgaggaagctgagatctggagaggctaagtgactttcccagggccatacggtgagttaaggtggtgtttaggctgaagtctgcctgactctaaaggcttacctcgtgctccccgggaagctcccagtcagagggaagaatctccatcctcctgcagagcctgctcctggcttcagcaccttccccagcagaaagtgcagcctcaggtctgactgctccaaggtctgcccgggccctggcttggtcttgagagaggaaagagaccatctggtcagcaccctcctcccagacagcagttatcagcagcccccctcctctgcgggaagaagagctgggacttataattgcccacacatgtggggcaggcagtggaaagcaccgtggatccagagtcaggagacccagtgcttgccctggctngatttaaatccaccgtgtggccaacctcagaccccccacatcccatctctgggctccttccgcagctgggaggcagtgagcgctgtgggtaaccagcaccaggcttgggcatcagatgactatgcattgaccccgagtcagtttctggctgactgtgtgaccccggggcagcaccttgcctctctgggcctcaatctccttctctgtgagcagcaggaccgtgtgtgggctccatgagacaacagcattggcaaggtgcttaccacagttcctgcacttcacagctggacctctggccactggctgagagaaccactgctctcctggcctcctgcattggaacacttggctgtgaaattaatctgcaacctgcaaaaggctctgcccacagaagggacctggacaccatgtatgttccaaagatccgtgtccatcctccaggcacaggccacagtctgactctgagaccagctgccttctaggctaaaggagggtgctctgggcattggctcagaacaggctgctgctgaatgcagtgggaagggagaaagggatgaaaaggtcttctgaaatgcccrcccatttcttgcatttgattcagaacccagtgggcagtgggttcttggaatgggaatctttttggtgccccctgtcttctgacccagagcgttaggagggaagggaaggggtgttgggccccttcccagggtcagggcttgtagcacctcagctgggaagcagtgtgagcatgatgatataacaggaaccaactcgttcttagcactttctgtgtctacttcaattgtgctttacatctgttacctcaaagttgctgctgtattcctcagcactnggaacatgctgggcattcaggacattcttartaaatatttactggattaatttaaccatcgaggctgggcacggtggctcacacatgttatcccagcactttgggaggccgaggcgggtggatcacccgaggtctggagtttgagaccagcctggccaacatggtgaaaccctgtctctactaaaaatacaaaaattagccagacgtggtggtgcgcacctgtatcccagctactcaggaggctgaggcactagaattgcttgaatccaggaggcggagattgcagtgagcctaagcgacagggcaagactgtctcaaaaaaaataaataaataaataaataaaccgtcacagcaacctcaaaattagatatataaactctccccacttttttttttttttttttttgagatggagtctcactctgttgcccaggctggagtgcaatggtatgatcttggctcaccgcaacctccgcttcccaagctcaagtgattctcctgcctcagcctcccaagtagctgggattacaggcgtgtgcgccaccatgcccagctaatttttatatttttagtacagatggggtttcaccgtgttggccaggctggtctcgaactacctgacctcaagtgatccgcctgcctcagactcccaaagtgctgggattacaggcgtgagccaccgcacccagctaaactctccccattttacaggtgagaaantgcgcagagtcagttgcctaaagtcccacagctcggaagtggcggagctgggatttgcacctgggtgtttctgactccagatccccttgatgagaggctggatggggcctgggatgcccctggggatccagtgtaaaccctgagaatgtgcctcagctgtgggggccctcagcattccagaggtagtcatcagaccctagaaccctatgggactgtgcacagatcgttcccttctggggcctcagttttcccatcagtcaaacgaggaggttgacccagatgatggtaaatctttcttccagccctaaaacaatttcaggattccaagccatgccagcccagattggcagctgcacaagccttgctgtgtactcagggatcatgcatatttaatttcacaatgaaagggtttttttcttaccctttttctacacattacagaaagaggtcaggatcgatgaccactaatggaaaactttaacctgcaataacaatgaggaactttctgacaattagtgtggccccttaacgtgctcagtttcttgaggagctcagagggctcctacagttcccacatgcccattttcctgagatactgagcagggagggtcggggaggaaggcccactaggggctgtgtgtggatgctgtaaccctttaggtctcttccagtgctgcgttttcaaacctcatatgctctaatttcaagaggaagcaaggctttggcccagatgagtgatgggatccagaggtgagggggggaatggacacagggacctacctctggtgggagtgggtgtgaaattcccatgcttgttgcttccagtgtggaagcccacttcacatccctcctgagccctcaggcccagatcctcaggataaagtcttcctgaacctccaagccttagccccagagcccaccctgcccccgccccctacatccaccagatgcttcctggggtagcccacccccagcctggtgcaggaggctgaaaatcaaagtgtactgctttaaccgcattaaaatcccctcctctcctcaattcagatcagggctatttgatgtctcaggtgcctgaaaccttttatctgccagaggtaccagcttctccrccctgtgatggagagggctgtcccttgggagggtcagggggtctgaaagttcctgaatgtcagagatgaaaaggacttttgggggtcacctgatccaactgctttattgtatggatgggaactaaggtccagagaggggaagggttgcacctaaggtccgtacagatcattggtgatgacgctgagcctgggacctgggctcgcctttgttccaccacaggtgctgggtctttaccatctctctgaaggcctggagagacccagctccacctctgtggttcagggctcagcctccaggtctgtctgggctatgggctgaaaaggagcaaagccgtcccaacaagaaatgggaatcttcctgggtggtttgctggacccccgagcttttggccataccacttcttcattctaatcatagtttcctcttataataaagtggggagaagccaagggagaagtttagtggcccccagaggtccatccagctctgcccttagcccctgagagttcctaccatgcttcttgtgactgttttgccacatcctcattgctgctgctctgttaccttcccttctgagaagtggaaacccaagggcagtgacaccaccagcttcttcacttctgaggctgagcctcagtggttatagggtggggcagggtttccagttagccttagaggggtagggctcagctttctaaacatgtcacagaagccctggcccctcctggcccagagcattgaaggtaaaggtgcaggtttgacctggtggactgtgggtggctcccatctcacctgtatttgtgtccttatcagtgtccaacccagggcctatctgctgaatggatagtgaaataatcactagataaataaatgcatgtagagatgcataaatggattggtgggtgggtggatggatggatggatggatggataaatcgatggagacagacagatggcctcccctttagtccagggcacagagatggcttcatgagtactcatcctcctgagggccccatgcttagaagggcctatgtttggtttaatgctctgcagtcatcattttgaaattgttaataatttttaacaaagagccctgcatttccattttgtgcttgccccacaaattatgtagcttgtcctgccagggagttcaggctgagtttgggacggcttcatccccaacactggccttgcagcctccactgtccccatcctaatccacagcctcccactaaatgccagcctgctggtgtcatcctcctgcatggaggccccctccccacagtgcctggagttacagcattgccctgccaagccagcagctactacccgccatcactatcaacaccttgaaaagttggtggtccagagaaaatcctcacacagcaccgcagacctttcctgaagtctccctgcctccttccctggcctcctgctgcctccttcccaggccatcacctacctgtttgctgaagagccccagtttctagcccaacagatctctccctgccatttctcccagatgcctttcatctctcacagagccctggccatacctttccctggcatcatctgccaaaaaactcaagaaaccctggaggcctagctcaaggccacctccctcaggaagccatacccgctctccccactggagtaatcatatactgttgttagtyaccatttactgggcacctatgatgtgccaagtgctgtgcgtcatcatctctggccctcccagaaatggaaaaggaggtctcccatgccatttcccaggaaattgggactcagataagttaaactcagagaactggggcttggacccaggaataagtggcttccagctggaaccactgctcccagcctggcggggctcccatccctgccctggatggcatcaggcgcagcctgttggcttcagagtgccatatgtctgttctgccctcaccagctcatctccatcacctccctggaaggaaagagtcaccattgcctatccatgccagttccctagcctagtgaatcctgtgttattaggaggcagccgagggcccaggactgaagagctgaccctacagagccatttaatctctcatatcgtgtaagcgtttactgagcacctactgtaggcctaattccatattaggaagttgragagagtccagatcgttgttaggtaggtatcctgatttgtgggaagtcatattaaaggactaagacaaaagttcaggaaagaagtaattgacagacagtggtgattagatgggtctggccttaggttggccaccgaatcgccgagtgtgctaggatgagacactcctcactgagcctcaggacactgaaaagggctgttgctactgattgtaccaataatcagcagctacctcttcctgaggagcgtcttttgggagaggccttcttgcaccgtctcatttatcacatgcatcactttgctgagaagcctagtcccgtggagtcttggctgtgcgcgcaaggccgagtgagtgagtgacttcttctcccttgagtgaatgaataataataatgtggccaccaactttgcagagggctgtgtgccaggccctattctaagcattttgcttgtgttaactccttcaatagccctgacaacccagtgatgagccccaatctacagatgagaaaactgaggcacagaggggtggttaagtgaatgaccgaagacaggggtgggaggacagatgctgagacagtgagagggtcagtgaaacatgggggttctctgccctcctgctctgccgcccaggagggctctgaggggaatctcaatgtttggtaattggcactgataagtgaagggtttactcattagctagctacccctcccctatttgcaggccctgggcctgtgggggaaggctgtgtgctggtgggtcagtgtgaatggcccaaggcctgcctgtcccctgcccacttggctctgagaacccattctatttgcggcccccaccccagcccatggctgctccgggctggcagcagcccggggaacagaaggtttgcttgtctgcgcctgccgcacccccctcctcagtctcagcctgggacccctctcaggggctcctttggctgccaagggcctggcactccctgttgccatggcaccggccggagatgaggctctggggggtggggatggggagggcagcagcaggatggtggaggcctggaactctgcagctacagaggccctggccctctgcaaacagtggaagggggtgctggggcccccacaggggcaggcctggaccctgtgcacagcaggcctgtggcagagccggccacacacctgggctgattgcctggatgctgtatcccgcaggagcactgcccctgccagaccctggctttcctaagcaaaaactctctcctcagccttgtgtgctcaccctcagcctctgcagcgaaattgtggagttctatccctagtcctgggttctatccctagctcgactttaaaattattggtgacccggggcaggcctcccgcatacactgcccctcagtcagagcagaggcgggacccagatccctgaggatcttctcatccctgagatcctggattccgtatggacgccattagagggagaacgtttctctgtggacagatggacagaactgtttctggtcaggagacagacagtctggcatgacgggcaagaattcaggttttggcagttgtggtgatgcgcacctgtagtcccagctactcaggaggctgaggcgggaggatcacttgagcccaggagtttgaggctatagtgagctgtgagctatgatcatgccaccacaccactgtactccagcgtgggcaacagagcgagaccctgtctctaaaaaaaagaaagaatataggctttggagtcaggccggcctgagtttgcattcccgttcctttgcatcttacttattgtgtgaccttgggaaagttaccaaaagtctctgagactcatcattctcctctgtaaaatgggaataatgagtgtacccccctcacagggtggtcgtgaggatgaaacaaaatctccagatcatctcatttagcagagtgcctggctctaaattagtagggacttttgtttgtttccagattgggggggatcagaacaataactagaaagatgtcctgtatttggggagagggtggttggtggatagaagcaagaccaataagcagagaatacagtgagataaactgtactcagtgtaattaacaattctcaatagtctgccctctgaagattctaagctggctaagaatgaaatgggccacaggtgaggtggtgagagccctgtcatgggaggtgtgcaattgcagagaaggtgggggagatgtgaatagagggaatgtactaagactgtagggctctgtgaaaaatggagtgactgtttcccactcaaactgtcagcttcagctttacccagctcaaaagacagcgtgaaagagtgaaaggagaagttgggacaaagaaggcgaaaagataaggctgacgactttattttttaatttatttttttgagacggagtttcactcttgttgcccaggctggagtgcagtggcgcgatctcgggttcaagcaattctcctgactcagcctcccgagaagctgggattacaggctccctccaccacgcctggctaattaacttttatttttttttatttgagcttgttctgtgccaggtactgggctgtcctttttgcggggctccttatctttgcctcctgccacagaggggctgtctcatgggcattgggctgtgtgctytggagcctgtctgcccagtrttaaacactggagacaccactggcaagcttttgggcaaacaatgtaaacagtctgtgcctcagtttccacatctgtaaaatgaggaagcagtactgatgtcatgggattgttctgaggacttggtgagatcattcatataaggagcttagcatagatagtgggtgataagtacagcagacccttgaacaatgagggggctggggacagccaccaactgcaaagttgaaaattcatgtatagcttttgactccccaaaaacttaactgctaatagccagcctactgtgggccttactgataatgtaaagtcaattaacacatattttgtctgttatgtatattatatactatgttcttacaataaagtaagctagatgaaagaaaatcacaaggaagagaaaatacattcagtttatattaagtggaagtagatcactgaaaaagtcttcacccttgtctgcacgttaagtagactgggaaggaggaggaagaggaagggttggccttgctttcaggggtggcagaggcggaagaggtggaggagtggaagggtgggaaggaggtggatgtttcacatgtgtggaacattcacgtgttagtggacctgcacagttcaaacctgtgtagttcaagggtcaactgtactaaatcagaggtagctattattattattgttatttttaaggctgttggaggcccagatggggccggggtgggtggggggactcagggccaggaatccacagggccctgggggtaaccctcaaggcaccgcaggaggcaggaagtgcttgctctgcagccggtgggcaggggtgtgcagcaggcctccctccctcactgacctccttctcaggctgcttcccagccttcctggggacccaggccccctcccttgggcccccagcagccgtgaggcacacactgagcgctttcccacgcactgttccaagtagccagccgcatcgctgcccccacccccaagcacasgcactctgacgggtgagggggtgtttgctgcaggagagcggggctcgggctggggagatcagcccrttctttatcagcctggccccattccagacagatgtttcatcttattttggacttccagaaaataggtcatttctttccattgtgttccctggggaggcctcatggggagaggagcatgcagtgagtgacgagtgtgagggcctggcttgggccctggggagctggaggggcagccgccttcctccctcagttgtgagggagctgtcagggccgggccggaagattctgaaaggctgggcagagaagccagcctttgcctgagggggatggagagcagaggagggccggagaggtcacataggtatttcagaaaggtccctctggctggggtgtganaacaggtggaggggacagattggaggtgaggagattggcggtgggatagccagaggcagccgagcctgtgctggaggagggggtgcagggggcttagcagccttccagggaaccagcgctattcttccatccagtttggacttccagagcagcgggagcacacgccaggccccatcttagtcgatttctgctgctttgttcaggggactttgtaggtacctggagaaacataaagaggaccccgggcctagaagcagcgtggcacagagaatggctccaacaccgagtgggctgcgccgggctgctctctttctgtagcccttagagtgatcccgaggctggtggggaggttcgtggtgcaggggtggagcactgagccttctccaacaactggaagtggagcgagcataggattgaagggggcgggtgggagcctcggccacttccccagtttctcccctccacctgtaactgtctcctcaccctccgatcctgctctcttctctggctcccaggatggggctccctgatcacatgacccaatcacacccacatctcagcctgcttggggacagccacatggaccagacttgccgccagacccaggctgtgctgctatccctttcctactctttagctgctggcgggaggacttcatccctggctccagatgcctcttgcccccacagactcccaggcctggaactggcagccttctctgagctgagtcatgacatgggtccctccccagcacccccaccccgagcccagcattccagctcagcacagctgccttcccagagtggagccctgagggccacagcatgtcagccctgaaagtgctcccaagacactcttgcccacccttttgcacagataaggaaactgaggctcagagagggtcaggactgtacagtagtcacccttagctgcagtttcactttctgaagtttcagttaccccagatcaactgtggtccaaaaacattaaatggaaaattccagaaataaacaacttacaagctttaaattttgtgctgttctgagtagtgtgatgaaatcttgcactgtcctgtctgtcccgcccaggagtgaatcatccctttgtccatatacgctacccacctgttagtcatcaacaaagtccactactgacatccagccatcaacaccatcatggctcggtggtccaggatcacttggagcagatgacctgatccttctgataatgtctggaggtcagtagtagcctaacgctacttcacaattcttacgccatcacctcacttcctcttatcacgtaggcaccgtgtcattccacgtcttcacaagaagagtgaacgatacagtaagatattttaagagagagaacacagtcacatgacttttattacagtatatttttatcattgttctattttattattattgttgttcatctcttactgtgccttatttataaataaaactttataataggtatgtatttgcagggaaaagaacatagtatgtatggggtttggttttatccaaagtttcaggcatctactggggccttggaatgtattccctgcagataggggggaccactatcctataagtgggtgtcacagccgggactagagccaggtcttcttacttcccaccccaacccccctccaaagtctgtcccaggcctgtaaagtgccccggtacggagaacagaagactggactgggtcaggagactggagtctgtggctcacttctcccaacaacttagcaaattacctcctctgagtctcagtcgccaatccctgcctggctgggctcgtgcagagaatgtgactttgaaacaaaggtcaatgtgtggcaggacagaggtgtgctgtggagagggcaggggcagctatagcctgaagcctggggccttgagccaccagcctcacatcttagcaggggctggaggcggggagctgcgcagccaggtgagcttcagccccaccgatcacccgagcccatcttgtctaggccaaaacaatgggccctcttgctttccttccctaagcctcagtttccccacgagcacaatggagcacaggaaggcagttagatcagatagatgatccctgagggctctggcgtgctgacattccaagactctgaccccataaccccatggccaggcctcctcctccctcaggcatttggtttattcagagcatcccaggcctgagactgcctgcccccagcacccccctctccctgcagcatggccctctctctctcatctcactgctgtttctacccggcctgttcctggcctccagactgaacatcccactgtcccctcagtgcccacagaccctccctatcctaaacctgctcagttgcagctctcactcctgctctttgacctcattctcatctcagaaaatggcatcgtcccctcagcacgtgcgcgtgtacacacacacacacatacacttctgcctcccagtattccaagccagatacagaggtgcatacctccctctccagcccctcaatattaagtcacccagtcctgttgattctcagctaagtaactctcaaatccatctgtttttttcagtccccactgccttctccccagacccaaccaaacatgcacgttggtcagagaagcggtggagctggtggcatagaacacagagtcacaccacttcactttaatctctgctctaccccttctggctctgtgttcctagcccagttattaaatgctctctgcctcagtttccccactgtaaaatggaaatgatcactgtatctacctcatagagttgatggagaatcaagtgagccaatacgtgccaaatgctcagaatggttcctggtgcagtaacacgggctttctggcttgtctgttcatgcatatggctgtgtgttcaggtgaatttggggttctatgtgcacatgttctgtgcatgttgtatgtgctgcatacacatgtgaactgttgcacacgggtgcatctccacgggtgctgggcacagtgggagctgcgcacatgtgttttgtgtgggtgtgtacatgtttagtacctgcatgagggcttggcacccacatggcctcttgcatacgtatgtgtttcagaggagtgtgcgaggaagtgcgtaggcaggcatctgtgcatctgtgctgtgtgtatgtgctgaccatgtgcaggctccccccrtcaacccccgcagcaatgcagggccccctccctggcctgcctgtgtcgtgggagcctcaggaccctgagggagggaagctgttgctggcggatgtggccaagatgggctggatttatttagattaaggcrgtgggaaaggagtgragaattgtacgtgctgggaggagggaagtctggggctctgagaatgactccccaagcatgcttgctctcctggacttggggcacccactcctctcccctggacttggggtccttactctgctcctttgacttggggtccccactctgcttccttttgacttggagttcccagtctgctcccytggacttggggtccttactccgctcccctagacttggggccccccamtcctctcccctgaacttggggttccactctgtgccccggacttggggtcctcactctgctcccctaaggggtccctctgagtcacgtgaggagctgggcatgatctccactttrggcctctgagcctacaacctggccagaataggaggaatcaggaggggttcctggcacatagcactctcttcatgggcaaaagggggacacctaggggtgccctccctctctctgctctagaggcctccctgggcaggagagtacagcagatagggggagtgcctgctctctgactgtgacatccagcttgtcctaggtggcccttccctagagtacagtcctcctaaagaggggaagttgtcacaggcaagcccactaccaccaagtcagctgcctgggcctccctgggattggctggaaccagaacagcctctgggaagcacaaagaggcctaacacatttggtggaaaatgtggggtatcagggagtcatccaggatggcctgggaagtcatgtctgggtgccctaagcccttctctgccctccctggccctccagcctcttgtccctaccactctttccttgccacctcctggggttccacgtcaccagcggaaagtcccctgaaacactgttgaaacactgttgtctaacttttttttttttttttgagacagagtctcactctgtcaccaggctggagtgtagtggcgtgatctcagctcactgcaacctccgcctcctgggttcaagcgattctcctgcctcggcctcctgagtagctgggactrcaggcacttgccaccatgtccagctaatttttgtatttttagtagagacggggtttcaccatgttggctaggttggtctcgatctctcaacctcgtgatccgcctggctcggcctcccaaagtgctgggattacaggcatgagccaccatgcccagccttkgtctaactcttaattgtatagatggggaaactgaggcccagagagggaaacaacttgtcaaagcccgcacagcaagtctgtggctgaatagtcatggaaattcctttcrtggaatgagatggctggtggattcttatgtgactctagcctcaggaatgtagccccctcctgcttactagcccccacctcctcaaaacaccccggtaagattcgtggtgactagaatcttctctttggcctgtcagaaaggcagagcttcaccatagggacagctctttgagatgacacctgccaacctctctatatggatggggacgcagagttcagagaggctggagactcgctcagtctcacagtgggtcccagggtgcttatgaggggagctgattgctctattcatagtaaagccagtccgagatccctggggtgcctacancctccctacggcatccacactgcctgcctgtcctctccccacagcttgaatctgcctttttgctgtgtgactggggcatgcttctgtccttctctgggcctctgctgcccattcaaaaagcatacctcctagctcagagtctctaagccacccccagccccaggcccagcagaagagagcctgaaggggagaggatggagtgccacatgggaggagggtcgggggctgcatgccatgaaggcccagcccacatagccagcccagccttccagagccaggccagccccgctgcagtgacctcccttctcctggccagccrgccaaattcctcctttagaataataaacagtgtggccagccagggagactgggagaggaggggcagggaagctgaagtgaccccctcccccagcctctgctaatgattttctttggctgagatctctagcaggaagggggcagccagaggggcaccgacggaggggcagatgggcctctgtgggggctgctggctccgccttggcgctgctccctcctgaccaaggaggcctggcatccagctggaggggctggggcagaggaatggtggggagcagaggctggagggggcgtcagaagggctgggctttgagtcaggagcagttcagagaggggagaggaagaaacgaggagaccttcaggcaggcagtctgaaagggaggagggaggagaagagctgatttgctcagactgtttcttggggtgttgggaagagctaagattgggggtccataggcgggaggagccttgcctatgtcccacccctgacatgtgaatgcagccctggtaggtgaggtactcaccatcatccacttccagagctggggacttaggccacagggagagcgatggcacaagaggtggcatgctggggcctgaacccggtctgcagacctaaactgaaaactaaaaggggtgagatggggaggtaggggcaagctgggcatggccttcagaggcaggccaggctgggcagccccacagccagaggaggctccttgttgcctcatcatgccgtcacctcccaaagctcatgctctgcgacccctgtcctctggcgtccttcctgccaatgctgcaggcagactcttggcatacttggctcctggtggtctcttgggacctgaggtgtgtcttccaagatagaggagagcaagggccaccccattcagtctgtctctgtctttgtccttgcttctgtctctgtctttgtccttgcttctgtctctgtctttgtccttgcttctgtctctgtctttgtccttgcttctgtctcttagtgcctctggtgctgtctctctgggcacctcctctctgtctctgtgtctttgtctctttctacttctatcattccaggtctctttctctctgtctccctctcagacaggctctgctgtggaatcttgggtaaacttctcaccttctcagagcctcagtttccccatctgcaccctgggggtgggggtggggggagcctggcttcactggtctccaaggacctgtgaggcctggctgctcgatgggacctctcctgggcccagcccctagccgctgtcccctgggcctccctgtatgctctgggctgagtaaaggtgtccaggcccacctcccacattccacagccccggctccccggcttcccttcccacagcccacagcctcctccatttcctgttgtgcttgtggagctgcgggagttctctgggttctggcctcccccctcctcctcccatccctttcatcacactttcccaaatatttgtcctggcagataagagcctggtattggaactgtcacccggaggacaggctgtcagagctggtaggctactggataccatccagcccaacttcccctccctcactgtacagacagggaaactaaggcacagagagagtctggggacgcagccgaggccacgtgagagtcacaagcagagccaaagcaaaggccaggaccccaaggctaagtccgggatggagaggagacagcctgtggtcatgagtgccctttcaggcttgggacgtggtggcttttgacttcagcccctcggacatgaakgctgggtggcccaagctggggctcattctgcaggagccaggtggtgagatagcccctgtcgctgcctccacctgccctgggccctgactccygtttaactctgcaggacaccatgcggcttccgggtgcgatgccagctctggccctcaaaggtgggtagatgggagataaggtaggggacccgggggkctgcggagtggaaccctggagctggcaggggtgatgtgtgctggtggcagggcrtgaagcaccaggcacactgccctgcccttcagctttagttttcaggatttccagtgggctctgtggaggcctccagctgccagccyttcagctcagaaagcgtcagtgggcccctgcttgtccagaaccatcagctcaaatcctttgattggccctccagaccccatcccaccttctggcccacacccctggcctcctatcctcggtctggtggatctgtggcactcggcttggacccctcattggctgggagcttccaggtccctgctgggcttctcagcacaccccacccctcactcctgcccgttaacatgtcttcagctctgcaggggctgagcgactgacccagcaattaatgaccagccagcagcctgcccggcagctggccataagatggactggctgcctgaccgcccacctcccctcctgatctgtatcaccagggggcatggagggcgtggcctgaaaaatccttctccaggggatgtcgtggagggggaccaatcacttgacacacacacacccccaaccccagttccctccagcccaaaagggcctcagcatcttttctggcccccctctgagctacctnagcccctccctcccatctctctcccacccagagccacctctgggccttgggcagaacctgggcagtcgggggagggggcagagagctgtagggaagaggctcagaaagtgacctgggaagcaatgcaggaactggaggccagggaattgcttcccgaggatttcctggccccttctggtgcctactgcctacacatggcactgctgaaggactcagaggctggggtctaacgggactgacagaggcagtccagaggaatccctggggccttggagctgggcgagcggtcctcagagccatggctggagagccccagtctgtcggataaaggagctgtgctcctcaaggacctgagggctgtgcatacgtggcctcctcgcaggctcagccttgggagaggtgctgaagcccctgtttcctgatgtctgatacctcctctcccaaaggcgagctgctgttgctgtctctcctgttacttctggaaccacagatctctcagggcctggtygtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccaggtaagggctcccagcctgtgtgcccactccttacccctcttgtnaactggaggcatcaggggaagtccrgagagtgctttagtttattgtgaaatgcagccatcctagaaaagcagacaatcatggaaccagcctggctcagtcggggagtgtgttcgcncccactccttggtctgggtgatctgcctgctccctgccagtcaccctattcctgcctcccaagaactctatattctcagctgcttccaatctgctccctcttgaccccacatcccttcttccccattctccaagctccagatatcagctgcatttcaacttgtgacttgccttctttcttaccctggcactgtcaatatcaaacattagagctggaagggaccagctctaacatttgatttatgctcttctgggagcatccctattctgtaacggggagacagagggccagagatggcaaatgacttgccacacagcaattcaggggatggccagaaacccagttcccctgatttattcacggctccactcctggcagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccagggtgagccccctttctggcctgatgctcagcagaggcaagtataaccctccacagaggaatagccctttacagtttacaaagtgtgggactccacttcccagtggattctcaccacagccttcgaaggaagatagtgttttccccatgttacagaagagggaaactcaggcgcagagagaggatggagcttgtcccctgtcgcagaattcgatagtggcagagctggcctgtgcaacatggtcggtgagggcacaagcttcagagccagctgggtcgaaatcccagctttgctatttcctgtctgagtgactttacacaaagcacataatctctctgagcctgcttcccctcttgtaacgtggggataacaatggctgcctacctcataggatcaattgtgaagattaaataaaagatggagagtacctggcacatgttatgtgctcaatacatttctcctgtacatagatctccagagggtactttgatttccagactgttatcccttctagaacgtcagctccataagaacagagattttgtccactttgttcactactgttgctccagtgtccagaatagtacttggcatgtagtaggtattcagtaaatatttgttgaatgaatgaatcttctacatcagtcatcctttccctctctagccccctaccctatccccaagctgamgtgctagtggctggtggtgacttccccagacctaagccaatctctctctaccagtgtcatccatcaacgtctctgtgaacgcagtgcagactgtggtccgccagggtgagaacatcaccctcatgtgcattgtgatcgggaatgaggtggtcaacttcgagtggacatacccccgcaaagaagtaatgtggggccaggcaggggtcggaggaggggccaggarcgggtggatatctggcttgcaggctgatttctccccggcccctcctgatttggggggcctgcccaacctgttgctgcagagtgggcggctggtggagccggtgactgacttcctcttggatatgccttaccacatccgctccatcctgcacatccccagtgccgagttagaagactcggggacctacacctgcaatgtgmcggagagtgtgaatgaccatcaggatgaaaaggccatcaacatcaccgtggttggtgtgtgccttgggctcagcccaatccccaattccttcaacgctccccaccctcacccactttgctgggtgcagagygatggtgagagttgcatttttgatacagtgatcagggctgagctggacccagtgcctgtcacagccccggggtatagtcagccacactccagtgcagccctagctagcctctgtgccaaccaaaaccccaattccaggataaaccccaaaccaaaatgtagtgtcagccccaaatccaaccctatctcaacctagactttctgactagccagagccccagccccaacctgacttccaagcccaactgccatcccaggtccgggaagccccatccccaaattcaaccttatcactagtcccagcatcagccacagtactgacccagaacagagaactgttagtacaactctgttcccaacctgggagctggccccagcatccatattagccccarattcggccccttctccaggccctgtccccagcccaatttcaacctcagctccggaaactccatggctggcacggtccccaggcctgaagccccaccccacaggctggcctcctttgggattcagttggtgccctgcccccagggccccgcccctgacggtcaccccttgcagagagcggctaygtgcggctcctgggagaggtgggcacrctacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtgagcagctcgctctcccatcccattcttgaagttatttttctttgcagccgccaggcagccctcggctttcagccacaaacctaggcccagctttctgagagcatattaggtgccaggtgctggggatgctgcagcgaccagagctgacagttcatccctcctagagtttctagtctagtggaggaaacagtcgccggtcagatgatcacccagatgtttagttgtccttgtgatgggtggggccagcagtagcagccaagaagtaaaygggcagatgactggggaagagggtgccaggcaggccactcatggcctgtggtatccctgaggctggagatttgctggctgacagagactgtggtaggttaggatggagcagtgtccacctttctgaaggggagagaaataggactttccttcaatgctccccacccccacccacagttcatctcaaccctccctcttggcctaggggaactgcctgtgggtgaggatttacgagacctggtttgagtccyggctctgctaccaatgccgagatgaccttggcaagcccttcccctccctgggccttgttcctctttataccaggagggtggggagaactgtaagagtccttccgactctgacagctgcctttcctgctccccaggtatgtgtcagagctgacactggttcgcgtgaaggtggcagaggctggccactacaccatgcgggccttccatgaggatgctgaggtccagctctccttccagctacagatcaatggtgatgagcacgcccctcgccatgtccctgctccttcccctccctgcccccgttccctctcccttcctgcactgtccacccacccatgggaggagtgggagagggagcctggaactcaggagatggattctaggccactgacccactgccgtgtgaacctggcctctgggcctcagtttccccagctgtataaggaggccatctggctagattggtgtttccaaaacttcaggcacttaggtaccaaggccatgattttcccttctcacattccacttatactgtactattaactcgataggtatttattgagcaactaccatatgcctgtctcttcaaggttcttgaacttccctccctgcctttgtgcagcttgcatccaagtaggggaagacaaacactaacagtagggaggaaaaccccagcaaattacataggttagaaggtaactaacactgcgggagaggaaaaacaggggccgggtagggaaggttgagagtgctgggcacagagtgatggtgtgagttgcatttttgatacagtgatcagggctgaggaagtgacatttgcatgaagacctgaagaaggtgaggacattagcttagtggatatttggggaaagggtacctcgggcagtgcaaaggccagagcaatcactgaaaggcttgtgtggttggaacagggctgttggggagagtggtgggagatgaagtcagaacggggatagggcagtgggggctgggagaagggcaaatcgcataggtctttgtgggcctggtgcagactttggcttttactatgaccgaaatgaagagccatggcagggttttgagcagagaaatgacatgataatgacttaatgttttgttaattgactttctaaaaacaaatttattttgaaagacaaaatgtaacctctctattgtaggtggaaaatcggcatcacatgtcataaatataaagcaaccactaaaataaactcagagaagaccaaacaatgctattaaatgctggcttcatgagcttggtggcccagggttctgagcttgaggcctagcctccctttgttaaaagggaagattagcaagtctcagagaggtgttaaagacagactagcaccctgctgaggcgttccctttgaagtacccagaagggaacccatcggttttcacactgattcctggtatttaatgttcacctgcagtctacagccctcctcccccaagagagtctctgggccaggtcctcccckgaggacctgtcctgttaactgtcctgaccctccygcctcctaactcagtgctctctccatgcagtccctgtccgagtgctggagctaagtgagagccaccctgacagtggggaacagacagtccgctgtcgtggccggggcatgccccagccgaacatcatctggtctgcctgcagagacctcaaaaggtgagcagacctgggcctcagtctcccagtgtccccagctggctagaaaaagctcgtgaaggttatctagtcccgcccgttcttcttggcatattgttccgggcatagagttgcatcctaggaggccaggtcaccacctccttggtcctactctgtatgacctaaatggtcccttttccttacctttacccctgggcagtttggcctagcaaagtgcagggtctgagccccagagacctcacccgccctgtagatcagttctgcactcctggccaggtcgattctaatgcagtggacagaggcaggattcagtgcaggttctgcctctaccccatacgccgtgtgaccccgtgggtcaaataagaatggattttgcaatccacgttgtcagttctgggatgggagcaccccctgctgaccagtagagggagcacaggaggagcccgctcggaaacaggcagtgggacataggaactggacacgtcctgcctccttccaccagtttctcctcagtttccctgtctgcaaggggaaggggctggcagccaaccctaccggctctcctggcaggtgtccacgtgagctgccgcccacgctgctggggaacagttccgaagaggagagccagctggagactaacgtgacgtactgggaggaggagcaggagtttgaggtggtgagcacactgcgtctgcagcacgkggatcggccactgtcggtgcgctgcacgctgcgcaacgctgtgggccaggacacgcaggaggtcatcgtggtgccacactgtgagtccccagcctcagtggcccctgacgatcccaatccctaccttaancctgcctaattggtaatgtgcccatgtacccacagcaggccaaaggagttagcatgcccaggggcaaacaggagcattgtgaaaccctgttgtgtacatgcataggaacacattctggcaaacacaatatgggtacacacgtgtacaaacacaagtctntaagccatggatatgaatatccttcagtgtggtgtacatatactatatgtatgtcgtaagccatgtacatgagcatgcctgttccttgaacataggtgcaaatcctctgtgtgtagatatgtaaatcgtctactgaagaatgcccaatctccagtcactcctgtaaagctagagtgtatgtgtataagcatacacctgtgcactatgcctgtccatgtatgtaaacccaccacgtgtttgtaagccatgtacatgagcatgcctaattcccagacatctgtttaaaccccacagtgtatgtctgtatgcatgtaccggtgggtacacaattcctgtacatgtgtacaagcaatgcatgtacaattcctttgcatgcatgcaaactggcatagtgcatgtctgtaagcatataattggagcacacctttctagaaaagtgtacaagcataattcccgtacacatgtgcctgctgtacaatgtacatctgttagcaggtacacatacacgtgtaatttctgtgcgtatgaacaatgcctaccagtgtcttgatgcttttgtgtatctasctgcccgtccttatgcatacatgcacctgtatgagtgtgcttcatttattcacctttcttcttcattcrataaatatgaggacccaacttctcattgaagtataaaggtcaaagggctcagccctgcctggacctcctagtacccatagtccagagagagaaggcagacaaggaacttggcaattccctccgggatcaccacattaggggcaaagcctggagggagaaggggtcccatgcccagctatgggattcaggaaagtattctagaaaaggaacctttaggtgaaaacctgaaaaatgactagaagttagcctggtaaggaatggtgtcccactcagagggaatggcctgtgtaaaagcccagaggcaaaatgagttcctagaaatgaaaagagttcaactcaatctggctggaggatcgagtgtgtggatacttaggggctggaagggtggcagataaaggggaaggaagtgctatgggatggagctacaggggtcggcagatctagagcaggcagggctccaaaggccatgtgaggcatcttggtctctgtgtatgcaggtccctgggcatgttcaggcacgtgcctgtctagagctgcctcctgtcccctgccctgtggtggatgggtgggcttctttcatcccctcatttcacccatgctcccacacatgcatacacattctctgagcaagtgggtatctgggcagacagtgtggacagcctgagtggaagaccagctctgagccaaggcagatgtgacacttttgtgtgactaaagcctgagcgggaagctgagcaccagcacacagggcctaggatggctgcaagagggctccttcatgcctccagcgatggctgcctagaagatgcaggcttccttcccaggaccgagatgtgtgatgagcgggaggagggaggagaagagggatgttggtctgggaccctgaggaggaaggcatggcgaggataggtaagggtaagggagaatggataaggggtgagagacgaagttggagagggaagcagaggtagagtcatgaagcctctgccttatgtgccattttaggagtttggcctttttcctttactgataacatggggaagcatccaaagttttttttttttttttttttttttttaagatggagtctggctctgttgcccaggctggagtgcagtggtgtgatctcggctcactgcaagctctgcctcccgggttcaaacaattctcctgcctcagcctcccaaatagctgggatgacagcagtccaccaccacgcccagctattttttgtatttttagtagaaatgggatttcaccatattggccaggccggtcttgaactcctgacctcgtgatccgcccaccttggcctcccaaagtgctgggattacaggcatgagccactgcacccagcctccatccaaagattttaagcataacaatggcattcacttagtaattcaacaaatagtaccagctacctaccatgtgccaggtgtggttttagggactgaggttatagcaatggatggggaggaggaggtgggacaggactccctagggagcaaagaagcatagattggggacagaagaggagggaatgagttccataggacctcatgggtggccagcagggcagggcaggggagaggcaggtctggcggggctggatgaggagagtgggaagctgtacagcgaagaggctgaggccttgagggtggaggagactcgaggcttgtaagggccagtgtgagccccactttgttaactaccgtcaccactccaaccccaactgggccctttgggtgaagtggggagaagtggcctccgtgctgaggtctggattcatcaggctgggggtctcagccattgctccctcagtggccactcactcagtccaccggccactcggtcaggcatggagcttggagtctgaccgagctgtggcagccccagcaagggtgtggactcagaggagaggtaagccacaacccagccctcaggggctccagggctaatgggaggtccaggcaatggacaggaactcagaacaggatttgcaccccgtccagagctctggcagcaaggccagactsactggcagggctgaagggacgtggaggccagcagtgatctgagtgggggtagttactgaggggatggagtatttacaggacagtctgaacgtgtggcctagagcgagatgctgagggtctgacactgcaggctgatggggaggtgggcgcttctattctggacaggatgtgtacggagggatctatgatgccaaagatggggtgaggggagggtagctgcccagtttgctcatggcctgctctcatctctgcctccagccttgccctttaaggtggtggtgatctcagccatcctggccctggtggtgctcaccatcatctcccttatcatcctcatcatgctttggcagaaggtaagcccctccctggcccagtgggtgaagactggcacatcattattttgcataaattccacccctctgccctccttgaatgctgcgtgatctggccacatgcagggctcagcatggaactcaggtggggacttgtgacgctggctgtctcagcttcctccacccccagcagtctgggccaacctgagcctggcccgagctatccaggattcccttcccctactgtgtcattaagtccccgggtcctgctgagacaccattcctctcatcctagccatggagcatgggacctttgaggtggactgcatgggctccaggattcttccaggtctcacccatggagaacctgtgattctactgaaatgcattctgatcctattagtctgtaatttcagtgttctgctttgagattttaccattctgtgattccaacattttaagcttcctgaatcaggattacagcacctcatgatcccatctttctaaaattccagtcctgtggttccaacaccttaagatgtcaacattctaagcttacatctttctgacttgcccagcactggggagggccatccgcatccagccgagtacccnacctggtgtcactttctggggtcacctgctctactacttccatctgaggagcagcgaaggctgggagagaagctagagaggaggttctcatgagccaggccctcagctgccagttgctcctcagtctgccaagtcctgaagcctcctctggggccccttggnccctgttccctccgagcccaygaagaccttggctcagttgagcacttgctgtgtgacttcaaatatgcccctgcccctctctgggcctcagggtctcctgccccatgtgtcctagacggacgaacctaatggggctcagggcctgagactccctctgataactaattcctggggttggtcctccagaagccacgttacgagatccgatggaaggtgattgagtctgtgagctctgacggccatgagtacatctacgtggaccccatgcagctgccctatgactccacgtgggagctgccgcgggaccagcttgtgctgggtcagtcctgagaggcctcatgtggcagtgtggggactcaagttgggtgggaagactctctgaggtctggtcccagccttgccatgactagctatgagacctagggctggtgtcttgccttctctggccctccatctcctactatgtacaatgagagcaagaccatcccccaggaactgcctagcattgaggttctatgatcctgtgaccctgtgagacgggatccctatgtggcaaaagtggaaggattgaggacaggctgagtagcaggcctggtctggctggggaagctgaggaggtacagagaagcgtgctcccttgggagggaagaaactttccagagattaaagatggggcagaaagcaggcaggacttagatgagataccaggaaagacagggaggtattgtggttgcaggagtgtgtttagggaatatcctgagtccaaggtggtttaagtaatgtctaggttgacctaagagagtggctctttcccctcactgggcaggaagggtgatagcggccgggggtaggggagtggggggaggggggcagctgggggagcggtgcagcttcctggtaggccaggagctaatggatcatctctgcaccaggacgcaccctcggctctggggcctttgggcaggtggtggaggccacggctcatggcctgagccattctcaggccacgatgaaagtggccgtcaagatgcttaaatgtgagtagtccttggagccctccacatctgggccttcacctctccctgcccctccccacacacttagcctctcccagggtggccygatgctgatttgcaggcactagaggggccatcacactgcagcaggcnctgctcccgagtctgggtctggtttgggaaagagcgttcctcwccctggcctcctcggcctgcttccccctaccctggcctcttcccctcctcagagtgtgggtgctcacccccgccaggctgcctgggtcttgcagcacagggcggggcagaagagtcagaataggctcctgtggtggggcctccatggagcctccatgactgggcctggcctggggcccccattttcctcagccacagcccgcagcagtgagaagcaagcccttatgtcggagctgaagatcatgagtcaccttgggccccacctgaacgtggtcaacctgttgggggcctgcaccaaaggaggtaccgagcccactgccccagaggcctcagggaaagtgcccaccaccaaggccaggccccgcctacccccccctcaggccttgcacaacagcacactcctgctggagggtccgtgcccacccgctccagcgccctcactgcgcggtcccagagggcggtggggtttagaaactcacaaaatcacaacaccttcaaggctgaaggattagtcaggtcaccagtcccagcagcttccagaccatggtgttggctgacacttttttattttcccaatacattttgaaaaccaataaataacagctcacatgacattaagatgagttatatgcccaccattggagaccaccagcttgctacttgggagctaccttcatttgatcatagaagaaagtctctgtggccaactgggtctatttgaagctctgattgccagttaggctgaaaaaaaatgttatcaccatttgcagctgcttattgtgagatttgggattttcctcagcattatgcaaccaaaataaaatacagaagtatgttgggtacatagacttattcacgtttgcaatgatcgctcatttcaacattttcgtttgtgtagatatcttcaagttctcactgattgactttaagtaaatgcattgtagttgaatttaactactaaagtgatcgttgtaaacagtggcctttatctgctttctatactgggctccaaagtaagctttagtttgaaaacatatcaataagagccaacactgcgagctcgccacgtgcccagccaataaagacatcatctcattaatcctcatgacagtgctttgtggtgggtttaattagccccacttaacagctggggaaggtaaggctcagggagactaagtaccttgctctccaccacagaggcaggaaaagaatccagatttgcaaggcactaaagcctcctagccgtcatgccaaagtgtctctcccacatccagcccctgattagcctcatggccttgaagggacgcctgaggcctccatagggactgtccctgagcctgtccctctgcaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccaggtaccaggagggaggccagggactgaatctttgggatacctgaggagcaccgctccttcccctccttttgtccaggaggggaagctgaggctgtgacagggcaggggacagaatcactcctggagctagggctgttccacaagatggtccaccccagatgagggaataacactaatgccaggccctgtgctgctaagccctctacagatgtgacatgccatccctgtgtcgtgggtgtttgcccttcagtccagggcaggcagtgatggaggaaggggcagaggctgtggtgagatgagagccaagcctcccaatttgcacagtggtgctccaggctgtgttcctctctgcagcctctacacatcagcctccacactgcctctcagggagctcaactccagtctttgtcttttccaaaaagaacacttcttagttctgttgctgattacaaaaacaaagacaagagtagcttcagaaaagcgtaaaagaccttaaaacccactcatgtcctctccaatgttttgacattcagtctcccaggagccaaagggcttctcccatctttttcctgcctatagagacagatgtgtgtagagccccacagctctttggggagctgatgctacaggcataggtagcggggtgaatcctggctgcctatgctgggttgcagtcaggcactcccatggccaggtggcgctggggaggccacaggaaggcgcctctgaacacacccgtcttgtgacctttgccctggggtgctgtaatcgcctctgggtgtgagctctctgggttctaactrtcattttggtagcctcagtgcccagcttggcccagcaggttggttgaaaagncttgatccacaggctttcctactgggatagactgaaggaagatgagtgagtgtgtgagtgagagaagaaattcatgagtggcaaggggcaggaggggaggggaaggcaaagcctgcaggctctcctgtgatgctcctttacccccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctggtgggtggacatagtgacatagtaccccacatccaaacaggctgatgctcttcacatgcccagccttgccaaaaaccctgagaagaagggagcctcgtgcccatttcatagatgtagaaattgaggctagccacctggccaaaactgatctgtagtggacccctaaacggaagccctgtttatggatccggaaacatgcgtagaaccctcagggagggagagagcagggatatgggaggacctggccttttgtcgtggtagggaaagtgatctactcagcttcagccccaggctggtctagtgtccctgagaggcaggcaggcaggccaggctgggcaaaagtggcccaagggctaatgccaaaaggccaatgagggcactgataaagcaggagaactttgagtttgatattaagaaatcattctccttttaggggagacctagacgatcagtagccacctgtcttggacattcagtctcccaggagccaaagggcaggggtcctgtgggccagaaggagatataagatagcaggtgaccctctgcttctcctctagcccctgagaggacctgccgagcaactttgatcaacgagtctccagtgctaagctacatggacctcgtgggcttcagctaccaggtggccaatggcatggagtttctggcctccaagaacgtacgtgtggtgttggtggggcagagtgggggctgtggggaggtgggtcacccagccagccagcatcctccaagagcacaccagggtggcctctcgcacatgggcagtgttgtattttcccaaagcccttgacatgaagggtctttccccacaattgtccccaaggcctcagctcccctctccccaaacccagtgcgtccacagagacctggcggctaggaacgtgctcatctgtgaaggcaagctggtcaagatctgtgactttggcctggctcgagacatcatgcgggactcgaattacatctccaaaggcagcgtgagtaccttccctggcccctgcagggcagtcacagtgcctgtgaccgcaggaacagattccctcctgaccagtgtggctgcagctcataggaaatctgtgtggggctccttgtggcctgccctgacagcagtgatgggctgtgcctgcccagctatgtgtgcagggacaggatggggagccgcccaggagtgcatggagcaagtatagcggcggggagggctggctataatgggtccagggtgggggaagggggaacaggccgaatgtgttgttccagtggtggtgggcagaggaagaagcccaggtgacagggcaagaaagatgagcaggtcacatgcagtagcagggattggtctggttaaaacgtgatcatcctgcctgtctctcatctccccacttttccgcaaaccccagatggagggacgctaggcccagagatcaaaggcagccaggataagagcttggggggtgccttgacaagtccctggctcccacacttcactactcagaccctggggcttttccccagggacaggggctgccttgtccccagctagtgagaaaggaaacagcctctggtcctctgaccagccctgggatggacatgggaactgtgctgcgcagagaccagggccctcacagggaatgggacggagaagtggttgtgggtgggagctgccagataccctcctcccatcccaggtgcagagtggggctgaggtccttccttgcactcagcacctgtcctgacctccctacagacctttttgcctttaaagtggatggctccggagagcatcttcaacagcctctacaccaccctgagcgacgtgtggtccttcgggatcctgctctgggagatcttcaccttgggtatgcttgcttcctcctccagccctcagcatcctggcctggtgtctacctcgaccactcatgcctctggcctggtggggctatgggacgagccctgatacagggatcctggttcaggtcccagctctgctaccttctccctgctgtgtgatgttagcaaattctttgccctctctgggtctctttatctccctgtctgygcattgacaggtttgaacagtgacatcagaaagcctgcttggctctcacattctggctgtctatcctggggagggttgtggtctctgttcagagcccatgaaggagcccacagttccaaatgccaggggcactgcccccttacccataccagggccagcatggctctccttgtcctgtagaagagggtgccctgccacttttccacccctgagcctgtgtatctcttgtctctgctccccaacaggtggcaccccttacccagagctgcccatgaacgagcagttctacaatgccatcaaacggggttaccgcatggcccagcctgcccatgcctccgacgagatgtgagtggagtctcatgcatttgggaggattttgtgctgcaaacaatagatatccaactctactggcttaaaccaaagatgagagatttgttagctcagagatctagaaagccttggtgtaactggatccagccattcaaaggatggcatcaggaacctcttgttctagccctgagctctgctttgctctgtgtggcctcattttcaggccagcattgcccaaatggctaccagcagtgccagtctcatgtcctactgcttgctccatagwgccagcaaaagtcccagagctgaccttcaagggctcaggtggggtcacatgccatcaagaaccaaccgtggaagctgcagggctgaaaactgttggcgaaggttggctcctgtgctcacccaggcgtagtcaacctgtggaaccatgtggaatgggggctctgcgagggcctcccaagggaatatccagagacaggacctctggatacacccagccaccacttccctccagctcctttccatggctcaccttgttctgagaggcagcagcctcctgctcccccagccctgccttgtcccctgaaccctgggccagaggccctgacccttctccctatccccagctatgagatcatgcagaagtgctgggaagagaagtttgagattcggccccccttctcccagctggtgctgcttctcgagagactgttgggcgaaggttacaaaaaggtatgttgaggcagggtaggggtggagcacggagagctctggtgcagaagtcagacaccgagtacaaggctctgygtgatgggctggcatttaggggaccaccctttgtcctctctgggcctcagtttccctgctggttctaggaggggatgggctggcgctgtgagtttattttagcagcagagagctttatgaaatggaatcctacatggaagctgatcgattagatgcagggagggggcctagagcactgtctgtcctgctgcctccctcaggcctttacctccataccgaaccgtggggctccttcagaagtgtgaataaccccaggttacatgaccatgaaccgcctgaccacttggatcctgtcacaggattgtccaaggcccaaagagccagtagggccctgaaaccctgccccgtccaacaacacgggtccaagtgaggaggaaatacacatggcctttgacacagaggcagctccttctttgggtncatttctcacccccactgccccccngggatggtcccagggacctgggagatggagtaaggtcatcaccacttcacagcaaaggaaactgaggccctgaagaaggacgctgaggcagcatgagagcctgtgcctgtctgctctyaagtgggggaagagttagagtcctgggtgctggtctgataactgcccctccctgggtggtcctgagctcaccatgccttgtaagattctatgtgaggtaggagggcagctcaaccatgtggcttgggcaaatccctttcccctctgagcagcgggggtcttatttatacaaagggggatgggctcggttagaagatccctgaaggcatttctggcctgaccatccctgtttctttggttctccctgccccgggagcagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccaggtaaccaccctggcctggggccaaggaaattgtgcacagtgtgtgtgtgtgtgtgtgtgtgtgtgtgtgtgtgtgcgcgcgcgcgcgcgcgctgccaggtttgcctcagaggtaagttacgtagggtaagtacttatccctaccaatgaatagaagacagaatggaactcatttgaactttgatgccctgaggtggaaagggcaggctagtaaaaacaaaagtatgggctgggacttacttgcaaggtagctatttcctttaagggagcccccagaggttatctatactctcttatctctaggtcctgtcctagccccaaaaagaagaagcaaacctacttagcatccccagcaccccagctgttactcatggccagcctgaggcctatgttctgttcttcagcaccacgccctggggccagagggagcctgcttggttgtaggagtcagaggtgcctaaaggaattcaggacagaattcagactgggaaggagattcgtggttttcttttgccttgggaagtggtgaagttacagcccagagggggctttataggaggaccctgctgttgtgtggacttgatgtccacgcaggatctccccttaactggagagaagggctccccatgaggccacgcccacctccaaagcgagatccagcccaaggtgaagtggytggagccccaggctggggtactgtcccaactctgccactagccgctgagacctgggaaggcttctcctctgcgagcctcagtttctccatatgtgccaggagtgcacaccggccttagaaggctccgaaggccctcattgctctaactgttgaagaggccaaccatccaagagtcccagtggatggtgcagaggagtgaagtgcagcgctcacacagcttgaggtgtgaatgctcaccctgttttgtgccctcagacaagctgcttcactgtctaaacattggtgtcctcttctttttttttttattatttttattcatttatttatttatttttgagatggagtttcgctcttgttgcccaggctggagtgcaatggcgcgatctcggctcactgcaacctccacctcccaggttcaagcaattctcctgcctcagcctcccgagtagctggaattacaggcatgcagcaccacgcctggctaattttgtatttttagtagagwtggggtttctccatgttgagactggtctcaacctcctgacctcaggtgatccgcctgcctcggcctcccaaagtgctgggattacagatgtgagccaccacgcccggccagtgtcttcttctgtaaaatacaaacagtaaaagtacttctattaggcggtcattgcaaggattaaatgagatagcatacacctttaggagtgcagaggagggagatgctggtgggtgagaaaygagctttggagccagctgaccctgctccgaagttccagctcctgcacttccctgctgtgtgaagtggggcagtgatataacctctctgagccacactttcctcacggtgcaggccttgcatagttttcacaagagttaaatgagccggagtgtgtgaagcctacggtgcaggggtggacacaccgaaggctcttcatgactgctgctggaatcctcctgggctccttcctagcccctcactcactgcctctttcctctagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaaratgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggcccngcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccakcccagtgggcattggaggtgccaggggagtcagggttgtagccaagacgcccccgcacggggagggttgggaagggggtgcakgaagctcaacccctctgggcaccaaccctgcattgcaggttggcaccttacttccctgggatccccagagttggtccaaggagggagagtgggttctcaatacggtaccaaagatataatcacctaggtttacaratatttttaggactcacgttaactcacatttatacagcagaaatgctattttgtatgctgttnagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcatttcattcatctgtaaagtggggattttcgctctcccacccctcgctggaagctggggggcctagaccttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccagggtaaggacaggggagggaatagggtggcgaccaggctgtggctttgagggcagagaggtgtagacctggcaggacccagacccctcacggctgcagcatctcaggggttgtggggccggcatgagtcataggctctcctgccgagcccaggcctgtgggaccccggcagcaacacagggccaggggcaatagggttgctgggggcaggggacagagtgctagggccctcccacctgggcccagagtcctgtacttggctcacttgaggtggaccaggtgtcagcctcagatccatcactgtgtgtccttagcccctcccttgctctctctgagctggggaaacggcatcttcatttgagtgggtgcgggaaggacctcattttggaaccacaggcctccctggactgcctccaggagtctggggctgtggcttcaagtggggaaaagaatggagccatgggacagctctgactcacaggcccagccgccaactcaggggcagctgagccacaccagggaaaatacccgacggctataaggcctggccatacaaagcccaccatcccagggatcctggcttcagaaaacacccagagcctgtgacttctcttctagctgtggcaggagttgaatgaggtgatacccggatctgccttgtaaagaaaataactagcccacattccagacagggattatctttgctggtgcaaaagcctctgtctggaggtcagaagatctcagctccctgtgtctcaggcctgctccttatgggaacttgagtggattacaccacatcaggcctcagtttccccagggataaatggagctagatgccacactaagacaaaggttgataaaaatctgactaccactatccaacagttactatgccccagggctgtctggttgcttcacacacattagctcattttaccctcccaaaagcccagtgacctgagtcctactattatcccatgttacagatgagacaccagtccaagctgttgttgttttgtttgtttttgtttttctagttaaagaagtttattcaagggcaaagtgtgagggtagtcgtcaggaaacaggaaaaccagagaatggtgatcagtgcttccctgtgtggggcaaggtgaggatggtttatatagccagaaacgggtgggtaacacaattacattttccatacaaaggttaacgtagagctacaagatttgattggctactattgactacactttaagggggctgcttaacactcatttgtaaagaggtaatgatcaccagcgtgtcatttagtccaggtttgaataaagaatggggagcccggttaaagtataacattctcaacacaaaaatcaagaggcaatggtcagagagcagtcctgtgatgtgactcagtttccagggcttaacttttcccattggcataatgaattggggagctcctgaaattttattttattttcacaattttgatttgcattcaaaccaaatcaaatgtgcattcagggaggttttgaagtgacttgcccaagatcatctggtcagtgtggcagggatgggagaggagcccaggtcagactgactcccaagtcagcactcagggaggtaaagcacccacccaaatttgcagagctagggactggggaagcctgcgacaaaactcctatcttctgtctccagaccttctggtactgtgtttccccaagagaaaggataggaaaggactggatgagaaaggaaagctaacatcatctgagagctagagaaaaataataaaaactcatttgtgggagggcttgggcctctcaggcccctgtgcagagggcaggcagggtctggggtaaccacaggtcagcccctgctgggctcctgcctcccagtctctcccctcaggcgggcccagggaagacgggtgagctgggattttcctcccagacagatgagccacttggactgcacaattcttccgccaccccactcacggccggggttcttgttcctggaaaaagagggaaagactgaaaggagctatttctgccggggccctgacctgcagctgatgagggtctcacagctcccattcacgtcccttcttctttgaatcagggcaccgtctctaacaggccccttttattttagttataatgttcggttttgcaattaaaaattatttttaatgggcatcaggatatttccttctgtctttgaatatgccttttgtttctaatttgtgcaactataacttcacgtgaacctcatggattctggcttaggcaagtggcttctatgtaattagcagtgattccatcttaataaggtcctgtgatctgacaaaaaaaaaaaaactacttgatacaagtatttatgtcatatatgcctgtatttaaaaatccattaccaaaatacataatatagaaagagaaggtcttctttgagtatttttatatgttaaatgcagtaacattttaaatctttattctctttattcagcaactctgtggtacaaatttatcttgttgaaattctgcctctcactataaatagtttagttatatttttcaaagttgttttctttatatccatactaatatttgtatctgtacctatctacatagaatatagctataatcttcaacaaaactcccatttgtcattgtgcaactttttgtttttcacttaacaatatatcatgggcatactcataggtccatgggaaatacagatattaatgcattcattttgagagatgcacatagtttaaaagcaagcctgtgccagacattatttaaccaatgtcagaaatgcaaaatgcttgttccccagtgccacaaagaaatagcactcgaacataaatttaatttcctcagcaaggcaatttttactttctgcagagagggtgctcctggcagatggaacaatggcgagagcacaccttgacaggggaggggaagaggttcttattcctgacacaggcagcctctactgctgcattgttcccctattggctagggttggaccgcatagtctaagctaattccaattggctatttgaaaaaaaagagcaggagcatgagctggagtgccggggtgagtagtttggtgggaaaggtggatacgaacaggtggctcaggatgagtcaggatggagcaggtgactcaggtcaaagcaggtgaccaggggaacagatgtgaactgattaggactggtgggaaagttgtttactgaaaccagaagcaagggggcgaagagatccaggaagttaaactttaaaatggagaatcaaagaataagagagctgaacatattgacatactgattctttgaagagaaacttggggttcactatatttaacaccaatctcctactgaggggcatttggactatttcccattttttagagttataagttatgctacaatggccattatttataaaatatgtttgtttttgcatatttaagtatttgtttccatagcataaattcctagacattgagttgttgagtaaagagaataaacatttaaaatgtcactgaagtctaaaaattcccttttaagtacatatagtgccctgggcggctgagaaaatcaaacatacaaacaacagaaacaacgttatttaattctagctaagtactctggactggtggaggaagtatggaccctctttggtttattgagaaaagtcataagtgggtgacagagaagaattgaagacagaaatgcgccaagctgaaacattctccttggcataaccagaaacacccagaggacttggcaaggcaggaagcttcccacagtgccattcagtgctgctgcagctctactaatccatcatcccacatctagacagggcatcccacccgtcgggaaacccagccttccctcaccgccctgctctgccccagtccctcatggtgtagggtgtgctcctaccagtggtcccatcggatcctcacgattagcctgtgagaggagcctccagatgaggaggttgaggctcagagccatcaagtggcttggctacagtcactgcagggaggctcttgccttccagcctccctgctcctaccttccccgggggtgtctaggtccagttccagatctcagagtggccagcaggctgagccctggggtcaggggccagctgcctacacagaatgtggctcctggaatttcttgggtggtggggggggggcgggcttctccttgggatggggttctggggccgctctgggccatgaaagtttcccacagcttggaagaaaatctgccaccactgtgtaggggtctggcgagggaccattggcctggggcagggacctggggacatcacagaagccgaactgtctccctgtaccaccccctcccagctggctcttccctcacccacatgttcttggcatacaggtctgccctctccagcagctcccaccccccacctgctcagggctcctcgccttctcctgcagggcttcacagcaggctgcccttgcccagctcccctttgcagatccacagtctctggttttagattttgtgggtcttcactgcaggaactagaaaagtcacaaacatggggaagtaacacagtttctggaaaatcacagaattctaagtcccttttttcccctctgaagagacaagagggaagcttccacatctgaaaatttttctttttcattcttgatcttcctgaagcatagtgatggtcttggtgttcccttgctcaaacatcttcagtggctccccgtggcccagcaaagtcgagactccttcatggaatctttaaggccctccctgatctgattccaacctctcctactgcctctcccacatctgccctccaaggtccatccaccttgtgtgggccactagcttcctgacctctgcccctttttttggtgctaccgtcaccacctagaatgcccagtcttttatagctgaaggtcaaagtcttgctcaagcttccagcccagcaaaagctactttctccaagaagctttcctcattcttcagctgaaaatgatttctcttcgcattcctttgtctgtgcctcttatgggccctcacatctgttcagcattcttagcctcccataccctgtgcactcttacgcctccaggcctttactgtgctgtttctccttcttggaacattccttcctcctccctgtatctctcccccaactcctcacccttctcacttcctctcaactcagatagggccttccttgactcttctctccggtgatcccaggacatcttgcaactcccccagtggcctggttcctctcctggctctgacaataggctgtgagttgcagaagggagggaccacagctgacctgttcaccaccatgtccccagggccagggacagtgattgagaaatatctgttgcatgcccttcacctgca
